United States Patent 8,067,671 (METHODS FOR GENETIC CONTROL OF PLANT PEST INFESTATION AND COMPOSITIONS THEREOF) - sequence listing, part 55

SEQ ID NO: 162238 - protein, 215 aa, Heterodera glycines
  Coding regions on vcDNA: vcDNA=SeqID_88661; Strand=+; Position=3-647
LRKSNSKTLRQQFEPSACNKMFKSPTIVLVLITFIILHIAVPSAESFINLSAVGDFFANLWDSRADNCFYAARYHGNVSDQFHEKVKYWEIEDVQNVSDRRISKDCSGSFYGCQTHACIDAKGNPVFVFNLCASSAAASGENNTGHCSHPELEELCAMEGGKSKCAICENGMCNEANIELQNVMGLDINGTIGTAVVENGTKSAKTGETGGDTTD

SEQ ID NO: 162239 - protein, 110 aa, Heterodera glycines
  Coding regions on vcDNA: vcDNA=SeqID_88662; Strand=+; Position=42-374
MNPTYPMVFFLLVLVAVVLSSVHLKEDKIDVPQRVKRGEYGGGAYGGDGGGVGAPAPGGGGAANIANVNINQQNGCNGRGPQYQWAYTRKTGWVCINIINVIINQQSGGK

SEQ ID NO: 162240 - protein, 96 aa, Heterodera glycines
  Coding regions on vcDNA: vcDNA=SeqID_88663; Strand=-; Position=18-308
TDNENIPFFLPFNYIFSFFKLQFKLSNFSNRIATDSFHSAFIGTHLASTRQISRWQCQNASSTAFCLSCAVLSSSVSGKYFLSNWPGHSLHSAGWY

SEQ ID NO: 162241 - protein, 197 aa, Heterodera glycines
  Homolog annotation: Hit_ID=AAC97507.1; Match level="QueryCoverage =91%, HitCoverage=61%, E-value=9e-72, Identity=68%"; Hit description =thymidylate synthase; TS [Ascaris suum] sp|O96650|TYSY_ASCSU Thymidylate synthase (TS) (TSase)
  Gene Ontology: Biological process=deoxyribonucleoside monophosphate biosynthesis
  Coding regions on vcDNA: vcDNA=SeqID_88664; Strand=+; Position=23-613
MGSEGKILTGNINGETESKEVNSDEMNYLRQVGEILSRGTVRTDRTGTGTISIFGMQTRYSLRGGTIPLLTTKKVFWKGIVEELLWFIRAETNAKTLSSRGVKIWDANGSRAFLDSAGFTDREEGDLGPVYGFQWRHFGAEYRGTDADYTGKGTDQLAELIQGIRTDPNSRRHILCAWNVTDIPQMALPPCHTLCQF

SEQ ID NO: 162242 - protein, 93 aa, Heterodera glycines
  Coding regions on vcDNA: vcDNA=SeqID_88665; Strand=-; Position=2-280
MNFYKSTTFIGLFFIILANSFFDHADDPKLASSFLCCAIVFHFSGQNFPFRHGSVNGHRTAGSFLCECTWGKEKNNGEKSNGQKKEEAHFYLK

SEQ ID NO: 162243 - protein, 206 aa, Heterodera glycines
  Homolog annotation: Hit_ID=NP_507059.1; Match level="QueryCoverage =85%, HitCoverage=98%, E-value=6e-13, Identity=23%"; Hit description =SKp1 Related, ubiquitin ligase complex component, interacts (in yeast two-hybrid) with cullin proteins CU
  Gene Ontology: Biological process=mitotic spindle orientation
  Coding regions on vcDNA: vcDNA=SeqID_88666; Strand=+; Position=65-685
MAEEAVVVPEMESLALTSSSPCSPVLSLLSEEMLQKEVPCVCCDGEKVVVRLSILSQCGFFAKMLQDLNVEANGLSEDFMFDMTKAEIPAETFKKIVAWMEEHKGQPVPEFEEDPNTFERKWLTQNDFQQNFFKCEFAEAAAFLNAANFLDLQSLFRHATQAVAARIKDRSPEEIREMLHLNDKEDKPLTEEEKKAIREKNVWCHY

SEQ ID NO: 162244 - protein, 353 aa, Heterodera glycines
  Homolog annotation: Hit_ID=CAE58761.1; Match level="QueryCoverage =94%, HitCoverage=96%, E-value=1e-125, Identity=67%"; Hit description= Hypothetical protein CBG01953 [Caenorhabditis briggsae]
  Gene Ontology: Cellular component=mitochondrion
  Coding regions on vcDNA: vcDNA=SeqID_88667; Strand=+; Position=3-1064
YLKLKIIIPKMASRDEIGQTVCDLVGNTPMVYLNKITDGCAAKIAVKVEWMNPAGSVKDRIGIAMIEEAERQGKIKPGITTIIEPTSGNTGIAIAFVAVARGYRFIATMPSTMSGERRTLLRAFNAELVLTDPALGIKGCVERAEQLAAAIPNSFIPMQFANEANPEIHYRTTGPEIWRQTQGKVDACVFGIGTGGTITGSGRFLREKNPAIKFYAVEPVESPVLSGGKPNPHKIQGIGAGIVPPILDTKMYEEVVLVHSDEAIAMAKRLAREEGLLSGISSGANVVAALRVAQKPEMAGKLIVTVLPSSGERYLTSALYSDIRAEMEAMSHGETLEDNLKRLLKVEDANSKQ

SEQ ID NO: 162245 - protein, 112 aa, Heterodera glycines
  Homolog annotation: Hit_ID=NP_498776.1; Match level="QueryCoverage =97%, HitCoverage=99%, E-value=4e-44, Identity=75%"; Hit description =heat shock protein (hsp-12.2) [Caenorhabditis elegans] gb|AAA27953.1| Heat shock protein protein 12.2 [Ca
  Gene Ontology: Mol. function=chaperone activity; Cellular component =cytoplasm; Biological process=muscle contraction
  Coding regions on vcDNA: vcDNA=SeqID_88668; Strand=+; Position=13-351
MAMSAIPIEHDAASQWDWPLQHTDGVVKVHNTKDKFEVGLDVQFFAPQEIEVKVSGQDVIIHCLHEIRKDQHGSVKREIHRQYRLPNDVDAATLKSHLSTRGVLTLTASKKD

SEQ ID NO: 162246 - protein, 141 aa, Heterodera glycines
  Homolog annotation: Hit_ID=NP_491085.1; Match level="QueryCoverage =72%, HitCoverage=81%, E-value=4e-15, Identity=43%"; Hit description =NADH dehydrogenase Fe-S protein 5 like (1D570) [Caenorhabditis elegans] gb|AAF60773.1| Hypothetical prote
  Coding regions on vcDNA: vcDNA=SeqID_88669; Strand=+; Position=37-462
MTLNPPHLTLRGYEGHDYMGDTFKKTNDYAQTWFVPLMRGQSIDNRQIPGDDCGFFEDQSVRCFTAFGAKLGRLYCDLEHRDLQECVSRTKKNKRFWKIRDVRFKKWLRGETPHIFEPLADYLKSVHGAPTSYPTGHRVKK

SEQ ID NO: 162247 - protein, 208 aa, Heterodera glycines
  Homolog annotation: Hit_ID=CAE60439.1; Match level="QueryCoverage =83%, HitCoverage=43%, E-value=6e-45, Identity=53%"; Hit description =Hypothetical protein CBG04047 [Caenorhabditis briggsae]
  Gene Ontology: Mol. function=dihydroorotate dehydrogenase activity; Cellular component=mitochondrion; Biological process=pyrimidine base metabolism
  Coding regions on vcDNA: vcDNA=SeqID_88670; Strand=+; Position=248-871
MFSKTASPSSVPYDKVSGLKLPKPRRLVYTRTSLTISVLLSGGIGYYMYKILRGDERLHREWVVPMVHRWFAPESAHILGVKAVRLGFLDDFVESRKEYPELACQMFGKQLNNPIGLAAGFDKNGEAIDGLRKSGFGFIEIGTVTPKAQIGNDRPRVFRLREDQAVINSYGFNNDGIGTVLGRVKKAFVPDSGVPLGVNLGKNKTAED

SEQ ID NO: 162248 - protein, 199 aa, Heterodera glycines
  Homolog annotation: Hit_ID=NP_497538.1; Match level="QueryCoverage =97%, HitCoverage=88%, E-value=2e-27, Identity=36%"; Hit description =predicted CDS, MAP kinase (3D416) [Caenorhabditis elegans] gb|AAK68892.1| Hypothetical protein Y54F10BM.1
  Gene Ontology: Mol. function=JUN kinase phosphatase activity; Cellular component=cytoplasm; Biological process=JNK cascade
  Coding regions on vcDNA: vcDNA=SeqID_88671; Strand=+; Position=23-619
MTDRLKELSETRLHLKATKTRVTREDGSVIEEEKTENGEFVVIFERANGNGNPSGFKQSKRMQKGRGYVIDLSPDLQVANVSKSIYLSSQDVAQDLSLLQRHGITHIVNAASGVRCFFPKEMLYLKLKLLDMPSENLKKHFCRVHRFMKKSIDKNGKVLVHCNAGISRSTALVLSFLMRFEGQLLTEALALVREQRPVA

SEQ ID NO: 162249 - protein, 383 aa, Heterodera glycines
  Homolog annotation: Hit_ID=NP_503545.1; Match level="QueryCoverage =98%, HitCoverage=87%, E-value=1e-119, Identity=55%"; Hit description= ALDH3C2, ALdehyde deHydrogenase (48.8 kD) (alh-5) [Caenorhabditis elegans] gb|AAB94178.1| Aldehyde dehyd
  Gene Ontology: Mol. function=aldehyde dehydrogenase activity; Cellular component=cytoplasm; Biological process=acetaldehyde metabolism
  Coding regions on vcDNA: vcDNA=SeqID_88672; Strand=+; Position=35-1183
MASEDASKIVTEQRNFFKTGATRAAAFRKEQLKKMREMIVQNKDKICEAIYKDLRRNKETNMKMEVDGPLQAIDYCLSELDEWMKPQKLEDHQLGKPLVIFEPKGVVLVITAWNYPAALAFQPAIEAIAAGNTVVIKPSEVSPNTSKLLKQMFDATFDKKFIAVVEGAAPETQALLDQRFDHIFYTGSSSIAKLIMQAAAKNLTPVTLELGGKCPVVVENDADLEKAALRIAEGKWLNSGQTCLAPDYVMTTAEMKPKLVNALQKSIQTLYGENPKKSEQYSRMVNQRHFDRVKALLDKTNGKVLYKNGEPDRDDVFIPPVLVDTDLKDALMQEEVFGPVLPILTVKGLDEAMDVINDGEKPLGAYLFTNDQQKVDKFLNETS

SEQ ID NO: 162250 - protein, 184 aa, Heterodera glycines
  Coding regions on vcDNA: vcDNA=SeqID_88673; Strand=+; Position=96-650
MASSLTIEKRCKLFNTKQMECQFDGTEAGKCAFCVKLPCKFGAVNCAEEVSISCVNPQELEKCCKARDNECCVCVLCEKNKVMKVLVECCGKRTETSAEAGKALCICVPKIGGGKCGGQVQVKQCDAKLVDECCAANTESGDCCCVCLSCNDQKCVVTVRCPTGEAKSTGPTCTASKCESVKCC

SEQ ID NO: 162251 - protein, 163 aa, Heterodera glycines
  Homolog annotation: Hit_ID=NP_494762.1; Match level="QueryCoverage =98%, HitCoverage=96%, E-value=6e-52, Identity=59%"; Hit description =putative protein of eukaryotic origin (2E613) [Caenorhabditis elegans] gb|AAF39886.1| Hypothetical protei
  Coding regions on vcDNA: vcDNA=SeqID_88674; Strand=+; Position=96-587
MDIRSDQHRYPFCIVWTPIPLISWLFPFIGHIGIATSKGIIRDFAGSNYVSEDNMAFGWPTLYHQLNPEKVNGGSEAWDNSVAEASDEYKRRLHNLFLDNCHSHVSLALNTMRYDGKSNWNNFRVAADINLHGKFVRFCGFLRQFLPFSLILLIIAFALFFLV

SEQ ID NO: 162252 - protein, 200 aa, Heterodera glycines
  Homolog annotation: Hit_ID=AAH75329.1; Match level="QueryCoverage =56%, HitCoverage=49%, E-value=9e-09, Identity=30%"; Hit description =MGC89012 protein [Xenopus tropicalis] ref|NP_001004905.1| MGC89012 protein [Xenopus tropicalis]
  Coding regions on vcDNA: vcDNA=SeqID_88675; Strand=+; Position=21-620
MSSIEFSLPVFCSPTQLNFVIGKRDLCESKPIQIFNPYNHLLRFKFFSNAPERWRVENAQGGIRANNYVTTTVQLREPHTIRQPTSDCLRVEIFRDGESVAVGRKDILLNILTVEPPSSSVDGANFVEFSDGTDAALNSTAQRGEAKLRTNSIHNLTGENSQQRRHQQMRPSPWQLSTFYWLALAGLFACLFCLLLPPTA

SEQ ID NO: 162253 - protein, 141 aa, Heterodera glycines
  Coding regions on vcDNA: vcDNA=SeqID_88676; Strand=+; Position=6-431
KRPFPTKMSNLFVASSAVVFLLLQLHFVVTFASSFEGAPPKANEEAMPTTGEQNGGAEFGGSKQKMARKMMRYNGNNFDKVSVLFIRREMALRKLQLQINVLEQQLANALSSAFAAGCPPSGVSSVSDGISHRRHLPMPRE

SEQ ID NO: 162254 - protein, 192 aa, Heterodera glycines
  Coding regions on vcDNA: vcDNA=SeqID_88677; Strand=+; Position=10-588
MSPVFRCHFPAFANSLTFALALFVAAFSVASAEQTVTPGRHDDSLGHRCNYSGPGHCPSGFACVNTKCVRRCFFSGNCPEGFFCKSNFICVRKECAAGDTECCANCAEICIDHSECPSDGWGCVLLKCRRVECRARPDCPSNWPCLLGRCYASNCKSHEECPEGWKCGKKRRCEKGKAEEKAKGNGEENDGK

SEQ ID NO: 162255 - protein, 183 aa, Heterodera glycines
  Homolog annotation: Hit_ID=CAE73340.1; Match level="QueryCoverage =83%, HitCoverage=86%, E-value=2e-26, Identity=41%"; Hit description =Hypothetical protein CBG20771 [Caenorhabditis briggsae]
  Coding regions on vcDNA: vcDNA=SeqID_88678; Strand=+; Position=49-600
MAAKELFLAQQPDLFKPIQSINAVLILICLGSSTAVPGIGVLWFIGLCSLIVSVTATVIFLLNRENGLSGVTISGAFLPWGVIEFVYSSVLTLLCGVGFWLSFGFASHVPDNGHSAGYIFAGIFLVAQVACYAIPVLIIYDRSRTDGPAAAGHEQIANVHPFGVTTDGCEQHYQSMQHERPIV

SEQ ID NO: 162256 - protein, 215 aa, Heterodera glycines
  misc_feature (88)..(88): Xaa can be any naturally occurring amino acid
  Homolog annotation: Hit_ID=NP_509204.2; Match level="QueryCoverage =99%, HitCoverage=13%, E-value=1e-15, Identity=23%"; Hit description =laminin gamma-1 (XH764) [Caenorhabditis elegans] gb|AAC48152.2| Hypothetical protein C54D1.5 [Caenorhabdi
  Gene Ontology: Cellular component=basal lamina
  Coding regions on vcDNA: vcDNA=SeqID_88679; Strand=+; Position=34-678
MRAQLAEADTLVLGLRDRLQQIDTNAAVIEQQLGQFSTDKETTHKELSVGVNYVQTQGEQHLAKAQEAFDRYGEKSQQLSDIAGESKXLSDRQEQRRREILSLAEQIRKESRQSLSDANEAIFGASSTSLQISALLTEVHELEQRLKAVQQMATEQSLETNQTHDGAAFILSGVDSIRLPNVFSDELMEKVKRAQEEGLEALSKTRSEAENKRNW

SEQ ID NO: 162257 - protein, 209 aa, Heterodera glycines
  Coding regions on vcDNA: vcDNA=SeqID_88680; Strand=+; Position=3-629
TVHMVGIDRHSGHFVPLMQIGHSVLADDQLISGAAQLISARTERCFTAFRQRFLTFLYREFQRKGQIQQFLHHFDLFRHVKMRKLQFVGPELLLIRMEQPKGDDDFDDHQFASSSFCPPSSSSSYSSSFAASNHQHHHHHHYQHMFVLFEWRVGRIVGVFNRSSEALFAAFERHNEQFRNGHIVRTMFPTSMEHCGAERAQHEALKQSS

SEQ ID NO: 162258 - protein, 300 aa, Heterodera glycines
  Homolog annotation: Hit_ID=AAH75435.1; Match level="QueryCoverage =98%, HitCoverage=91%, E-value=1e-117, Identity=66%"; Hit description= MGC89209 protein [Xenopus tropicalis] ref|NP_001004946.1| MGC89209 protein [Xenopus tropicalis]
  Gene Ontology: Cellular component=cytoplasm; Biological process =signal transduction
  Coding regions on vcDNA: vcDNA=SeqID_88681; Strand=+; Position=1-900
ADSKERLSLRHTLESHKNWVTSIATSAEAPDLLLSGSRDKTLLIWQLTRDSQNYAIARRALTGHNHFVQEIAISSDGQFALSASWDKTLRLWDLTTGKATRRFIGHTNDVLSVSFSADNRQIVSGSRDKTIKLWNTLGECKYNIEGAHTEWVSCVRFSPNPENPIIISAGWDKLVKVWDLSKSKLRTNHIGHKGYINSLAVSPDGSLCASGGKDGIPMLWDLNDGKHLYSLDAGEEIHALCFSPNRYWLCATTTSGIRIWHLQTKEHIDTAIVSDEDEFDMGESKKKFVPPTPLSLAWSP

SEQ ID NO: 162259 - protein, 323 aa, Heterodera glycines
  Coding regions on vcDNA: vcDNA=SeqID_88682; Strand=+; Position=15-983
MAGPDSRFILEFFNREAKEIGVTQELLDNSQPSDQLIQAYYFLCDLIFENVGTTKENEYEMATELTRARPQMIIRTQQHWDLENQLEICQGLVNELRAEVDSLRGELSECKLPFRISNSELQNITVRHSRTGDAVERIGPRKANTKSLLKPRARLCSNTPKMAVPSEKRAKRGLTKDSEDDDNFRTAEFVPTTPRPQFLLPPLVLTPLSSRFPPLPRRSFSVEPTPTHIQKNAEQQLTMIRDGNGDMPCPSSQKRLNDNGEIQCPSSSTSSTFAASTSDGSAVSVFSADGGLLGPLTFLRRRNIGDPQTSWLANRIRNQGLPC

SEQ ID NO: 162260 - protein, 125 aa, Heterodera glycines
  Homolog annotation: Hit_ID=CAE75099.1; Match level="QueryCoverage =92%, HitCoverage=93%, E-value=3e-28, Identity=52%"; Hit description =Hypothetical protein CBG23021 [Caenorhabditis briggsae]
  Coding regions on vcDNA: vcDNA=SeqID_88683; Strand=+; Position=26-403
MAEFAHRAGAPLECLCMALKVQKRQEGTDAEGNRRWKIGISIGGGIDQNHRQSVYSDSGIYVTSVEANSPAEEAGLKVHDKILQVNGVDYTMITHERAVKYLKKESVLDLLVTRATPKHSTEMQM

SEQ ID NO: 162261 - protein, 87 aa, Heterodera glycines
  Coding regions on vcDNA: vcDNA=SeqID_88684; Strand=+; Position=10-273
KLNSFFFWHFCHFCWLPICCEQCSWDDVNNICVGDCSSLCVLKDFDNCNCNRLPKNLQFFKNRRNFGNLKALAKKEETNNGKLMYKK

SEQ ID NO: 162262 - protein, 188 aa, Heterodera glycines
  Homolog annotation: Hit_ID=NP_503124.1; Match level="QueryCoverage =70%, HitCoverage=47%, E-value=3e-45, Identity=62%"; Hit description =translation Initiation Factor 4E eIF4E (ife-3) [Caenorhabditis elegans] gb|AAC17807.1| Initiation factor
  Gene Ontology: Mol. function=translation initiation factor activity; Cellular component=ribosome; Biological process=regulation of cell cycle
  Coding regions on vcDNA: vcDNA=SeqID_88685; Strand=+; Position=90-653
MTSETVSSDASAAGGADKENTKTDTTTDPSSSENSASIEADHNNSKLRYADETTIIPHDLVERHFLQNTWALWYLKGDRNKNWTDCLKKVSTFDTVEDFWALYNHIQPASGLSWNSDYYLFKEGIKPMWEDKGNLEGGRWLVQVNTRNTTQSRLSLEVDKQKRQTKLDIYWQEMMMCIIGEQFEKWSD

SEQ ID NO: 162263 - protein, 208 aa, Heterodera glycines
  Homolog annotation: Hit_ID=NP_955843.1; Match level="QueryCoverage =88%, HitCoverage=47%, E-value=2e-20, Identity=30%"; Hit description =macrophage erythroblast attacher [Danio rerio] gb|AAH55388.1| Macrophage erythroblast attacher [Danio rer
  Coding regions on vcDNA: vcDNA=SeqID_88686; Strand=+; Position=3-626
PIQLSEVSEGVQKLNRIVAQFKQDIELRVAEEISACEELAKRVGHLSEANSAEETAQHFFNEQRLNRLIIDHLLRTGHFASAQALADFVGLDISAQYQVYHVARQVEESLALKDLGPCLAWIRDNRSRLHRIGSPLETEVRIQQCVELIKQGHHHGALKYVQAFFGGRCDVNGAHWATNGNLLHLMGLVALGKESTRPEHRPLLSDER

SEQ ID NO: 162264 - protein, 329 aa, Heterodera glycines
  Homolog annotation: Hit_ID=XP_311206.1; Match level="QueryCoverage =82%, HitCoverage=77%, E-value=2e-72, Identity=50%"; Hit description =ENSANGP00000019078 [Anopheles gambiae] gb|EAA06830.2| ENSANGP00000019078 [Anopheles gambiae str. PEST]
  Coding regions on vcDNA: vcDNA=SeqID_88687; Strand=+; Position=54-1040
MNGLPPFQPQLSLFGDPQLFAATVSNPTVGSTNAAAPAAESAAALQMHGRQQQLRMRKEIYRYTCEEPLYAAAWSNKLYPDKRFRLVVGTLLLDEEGISSNKMYIIELDENVGELVKRFGILHGYPCTATQFIPNTDVSQPELFATTSNCLRIFRYHPSSASISQECELSATKSSAYSSPLTNLDWNEVDPSLVATCSIDTTCTVWNIETNQPIGQAPSIKGLQKTQLIAHEKPVHDIAFTRLDNGRDQFATAGADGSIRLFDLRALQHSTILYEDAERRMLNHLSWNKRDPTKLATVAQESKEVVILDVRVPCRPMAKFGNHRAAING

SEQ ID NO: 162265 - protein, 98 aa, Heterodera glycines
  Homolog annotation: Hit_ID=NP_495943.1; Match level="QueryCoverage =91%, HitCoverage=94%, E-value=1e-28, Identity=64%"; Hit description =dynein light (10.7 kD) (2J396) [Caenorhabditis elegans] emb|CAA90946.1| Hypothetical protein T24H10.6 [Ca
  Coding regions on vcDNA: vcDNA=SeqID_88688; Strand=+; Position=23-319
MSTTDVEETIKRIQSQKGVTGVIIMDNIGRAIRSTFDDDTTAHHAALLQQLCERSKNVVREMDTSNDLSFMRLRTKKNEIMIAPDKDYLIAVIYKKSR

SEQ ID NO: 162266 - protein, 212 aa, Heterodera glycines
  Coding regions on vcDNA: vcDNA=SeqID_88689; Strand=+; Position=3-638
HFKWYKMSIIDIDAEQNNHSFAVDSQSNNYFLVGRGGDKSILLNETSGNSYAFSNVPTLPSVHYLFKNNKIHFNGIFSYEIHEFFQCSIDNARTLYSIRDLKEFAKACGGGTELIPFFGYALRIVVEAPIELGTDTKTEEDDGQQQKQWGECATFGSGKTEKEAEIIFEKNSQEAPAETFRDEPFFEFVKAIVSNFLDWGTERFRHGRRFAG

SEQ ID NO: 162267 - protein, 144 aa, Heterodera glycines
  Homolog annotation: Hit_ID=NP_871961.1; Match level="QueryCoverage =93%, HitCoverage=95%, E-value=8e-40, Identity=60%"; Hit description =transthyretin-like precursor family member (15.5 kD) (2F18) [Caenorhabditis elegans] gb|AAO38659.1| Hypot
  Coding regions on vcDNA: vcDNA=SeqID_88690; Strand=+; Position=57-491
MELRLLFASLFALWAVTAAMRKQGVAISGKFVCGHAPAMSNSTKVRIVDIDTGPDPDDTLDEKFVDAAGAFKLNGYTRELTDIDPVLYVWTDCNDGHTPCHRKIKFLIPKTKIIGEDPKANDWLDIGVVNLQSTFEEEKRECIF

SEQ ID NO: 162268 - protein, 108 aa, Heterodera glycines
  Homolog annotation: Hit_ID=AAF08341.1; Match level="QueryCoverage =100%, HitCoverage=100%, E-value=8e-42, Identity=73%"; Hit description=peptidyl-prolyl cis-trans isomerase [Brugia malayi]
  Gene Ontology: Mol. function=FK506 binding; Cellular component =membrane; Biological process=transport
  Coding regions on vcDNA: vcDNA=SeqID_88691; Strand=+; Position=59-385
MPVKIETLKAGDEATYPAVGRKVVCHYVLTLENGQKIDSSRDRGKPFEFTIGKGEVIKGWDEGVAKMSVGQRAKLTISPDMGYGAKGIPGTIPGNSTLIFDVELIAVK

SEQ ID NO: 162269 - protein, 91 aa, Heterodera glycines
  Coding regions on vcDNA: vcDNA=SeqID_88692; Strand=-; Position=1-273
HMDIPIFPVRVPPNGSAMCEQTKRHSTKSTYSQCPAALSSQYFSAHFAFPIRKRVSSAGSIAASSSSTPSAGPCQQLSMSGEVSEQRDGFA

SEQ ID NO: 162270 - protein, 96 aa, Heterodera glycines
  Coding regions on vcDNA: vcDNA=SeqID_88693; Strand=-; Position=2-289
QKKVIACEFHRIHHMLLAICSFHRLFLCFSSRRSFLQNSVFAFLLPHLPLGVLLLLVFRRLRFVRHVQPKQTFTALSPVGHANGFGAFNALPHVAE

SEQ ID NO: 162271 - protein, 202 aa, Heterodera glycines
  Homolog annotation: Hit_ID=NP_501594.1; Match level="QueryCoverage =57%, HitCoverage=52%, E-value=2e-11, Identity=31%"; Hit description =RNA and export factor binding protein, ALY family (aly-2) [Caenorhabditis elegans] emb|CAB05180.1| Hypoth
  Coding regions on vcDNA: vcDNA=SeqID_88694; Strand=+; Position=27-632
MTANLAMALDEIIKTQVKAPRASAAGRSVGSGRRLAGATTNSRFRFLQRGFVSGDVPAGQWKHDKFAELYGGGKKRMGGASLGPLKAVKGGAGSSIGARIARNAIERNSGGMVKLQVSNLPGSVVTLDLEELFQDFNVFGVAVHYDEMGNHLGTADLFTDQQSATNILNEFKNIAIDGQEIKFCLVTEGADSVGGKRGNIRD

SEQ ID NO: 162272 - protein, 210 aa, Heterodera glycines
  Coding regions on vcDNA: vcDNA=SeqID_88695; Strand=+; Position=42-671
MSEANLQQQTHGPIAGTDYDSADEYVVIEQEEETDLEKNSTLPETVATNTNSTPSDVQSVAASVGTLDAVADIGNGLDGAKLSVSSVFPQNAMSGSNYSQNGFNSSIFGSFVMEDQLRDLVRSENEQNRLMLDSIKNAIGELTKQKSNNNELNALISQQKKSLGEALTKLDNSEKLSREKDERIVELEQKIQQLSEALDDSAAKTTQLGE

SEQ ID NO: 162273 - protein, 121 aa, Heterodera glycines
  Coding regions on vcDNA: vcDNA=SeqID_88696; Strand=-; Position=3-365
SYQFITLSEPSFAAAFFSVLISAWGKAQTDAEQVENWHTKLPARTISIACACRTTAAPVFKLSSSTTADRSFSFEFQHISSIGRAEGERSQKQAAEDDWKKLGNHFWKLNFRKRRNKIINK

SEQ ID NO: 162274 - protein, 172 aa, Heterodera glycines
  Homolog annotation: Hit_ID=CAE66106.1; Match level="QueryCoverage =84%, HitCoverage=94%, E-value=1e-10, Identity=29%"; Hit description =Hypothetical protein CBG11326 [Caenorhabditis briggsae]
  Coding regions on vcDNA: vcDNA=SeqID_88697; Strand=+; Position=12-530
MQQIPILSLSNFLPIFSLISVPFLLSFPSTAFGCSCAPTKFNESMCVAKWVSHVKVLQNTTTTNSHRIFTVRHLEVFKSPNGTAHNDQLIGKESAVWTPIFTAACGVRELDTEKEYLLAGTVDNLGTMQINLCLFIPIEDGQPNAENGIVEWAKVPEGTKARMANWDDEQCQ

SEQ ID NO: 162275 - protein, 129 aa, Heterodera glycines
  Coding regions on vcDNA: vcDNA=SeqID_88698; Strand=+; Position=1-390
QFIFFLMTEATKIYNRLSAFQKFRINLNCHLRRVRSNWLYQLSTALVFVTALNHASIYLTYGPDHPRCMQQWKERKQRGLLTDELLWKERLLYARRREFLTAVDGYGTVDNWKHPRATMGASTLSSKLF

SEQ ID NO: 162276 - protein, 195 aa, Heterodera glycines
  Homolog annotation: Hit_ID=CAE75456.1; Match level="QueryCoverage =73%, HitCoverage=77%, E-value=6e-22, Identity=36%"; Hit description =Hypothetical protein CBG23451 [Caenorhabditis briggsae]
  Coding regions on vcDNA: vcDNA=SeqID_88699; Strand=+; Position=47-631
MSSFFMHHQQKRSHQQAAAVTLADIRWMEPMAATESAATSTPAKRLLARLGTTRVGRYVQQLAIDYAASFRDIVVGMRQRPLRAVACGAALASLVFTLKSNPDEIALRARLAQLRQQMVLIPASIHSTRADERLEQYTVLLNGNRLELVDFLLFSVLVERPFDKKNDFYAAHDKTLRGWPWTELWRNAWDIGAFG

SEQ ID NO: 162277 - protein, 79 aa, Heterodera glycines
  Coding regions on vcDNA: vcDNA=SeqID_88700; Strand=+; Position=52-291
QMANEILEFPLKYDNDIHYLKVRRTDTVRELKFVIEAKLKIPPEEQRLMIGNCVQPDTRLLSSMKGLDLVRETGPAAPP

SEQ ID NO: 162278 - protein, 148 aa, Heterodera glycines
  Homolog annotation: Hit_ID=NP_741446.1; Match level="QueryCoverage =93%, HitCoverage=78%, E-value=2e-41, Identity=62%"; Hit description =serine/aRginine rich pre-mRNA SPlicing factor, Serpin (20.5 kD) (rsp- 6) [Caenorhabditis elegans] gb|AAA82
  Gene Ontology: Mol. function=RNA binding; Cellular component=nuclear speck; Biological process=response to cold
  Coding regions on vcDNA: vcDNA=SeqID_88701; Strand=+; Position=35-481
MSSRRGGGNNVEGKVYVGGLPEDATSEELDDVFHKFGRIRKIWVARRPPGFAFVEFEDTRDAEDAVRSLDGTRICGVKARVELSTGRSRRDRDDRGGGGGGYRSGGGGGGGGYRGGGGNRDYSRSRSRSRSPYQRRGGGGGRSRSRSR

SEQ ID NO: 162279 - protein, 266 aa, Heterodera glycines
  misc_feature (198)..(198): Xaa can be any naturally occurring amino acid
  Homolog annotation: Hit_ID=CAE73779.1; Match level="QueryCoverage =97%, HitCoverage=55%, E-value=3e-76, Identity=50%"; Hit description =Hypothetical protein CBG21324 [Caenorhabditis briggsae]
  Gene Ontology: Mol. function=pre-mRNA splicing factor activity; Cellular component=spliceosome complex; Biological process=mRNA splicing
  Coding regions on vcDNA: vcDNA=SeqID_88702; Strand=-; Position=2-797
DLQKNLIATGVMPKTIVLFDSETETIKNTFKGHQKRISAVRLHPNLQTIVSGSFDSQIRIWNADDQSARNVIGIHDRLFFDVSLHPTGDYVLCSSEDSHWSLIDLNAGRPLIKVKSDDDDVPGICCGQFHPDGLIFGTGGKNSVVKIWDIKEQINVAQFPGHQEAVVAISFSENGYYLATGSTDGEVKIWDLRKLKNXFDQSGAYLAVGGSNVQIFQAKSWNNIAQFNAHSQPVTGVCFADDAKSVVSASMDKSVRVHAVPPVANE

SEQ ID NO: 162280 - protein, 88 aa, Heterodera glycines; identical to SEQ ID NO: 157977
  Homolog annotation: Hit_ID=NP_497455.1; Match level="QueryCoverage =54%, HitCoverage=51%, E-value=1e-10, Identity=63%"; Hit description =putative secreted or extracellular protein precursor (3C853) [Caenorhabditis elegans] gb|AAF60614.2| Caen
  Coding regions on vcDNA: vcDNA=SeqID_88703; Strand=+; Position=40-306

SEQ ID NO: 162281 - protein, 133 aa, Heterodera glycines; identical to SEQ ID NO: 152027
  Coding regions on vcDNA: vcDNA=SeqID_88704; Strand=+; Position=39-440

SEQ ID NO: 162282 - protein, 226 aa, Heterodera glycines
  Homolog annotation: Hit_ID=AAS52858.1; Match level="QueryCoverage =99%, HitCoverage=42%, E-value=5e-17, Identity=30%"; Hit description =AER177Wp [Ashbya gossypii ATCC 10895] ref|NP_985034.1| AER177Wp [Eremothecium gossypii]
  Gene Ontology: Biological process=axon guidance
  Coding regions on vcDNA: vcDNA=SeqID_88705; Strand=+; Position=16-693
MMQQQSTQAQHSNPSQHLRNTPQSPAATAPPTSSQSQHFQQRPHVAYHQPPQQHYPLQQETNQSQHIRPQPGVRPAHPQQHPTEQQYPSMAGPLFQSQPSSVQALQEHEIGNVGQPRLAQHGHTHISHQQQVMMGQRHATHHPSQQQTLISQQQSQHPQQQHPTTAIRIEQSGQVVHMHAAPPAPPQHQTQRIFVQQQQQQQMVPTLPPQSAHDPSLHPPPLPHPH

SEQ ID NO: 162283 - protein, 154 aa, Heterodera glycines
  Homolog annotation: Hit_ID=CAE63076.1; Match level="QueryCoverage =79%, HitCoverage=20%, E-value=2e-30, Identity=46%"; Hit description =Hypothetical protein CBG07361 [Caenorhabditis briggsae]
  Coding regions on vcDNA: vcDNA=SeqID_88706; Strand=+; Position=3-467
LFQVDPLMLSNFSLILGGFATAFAPFLSRLWMFALYCFPFAFGAASFAALRSIICVELLGIDRLTSAFGMLMLFMGVAALLGPPFARALKNWSGDYGLAFHIMGSLMALSGFLGIPLRRINEWECAKERNRKMIEDEGETQGTKNGRKSGEEKQ

SEQ ID NO: 162284 - protein, 182 aa, Heterodera glycines
  Coding regions on vcDNA: vcDNA=SeqID_88707; Strand=-; Position=1-546
AIFDHTTSSMNTFHPSAYVCYIRSSLFFCQFLMASAWSAADRSAGAALLLPLLRRAHPSDDGKAVKCPAEEFPAEGRRAEGCHWVAHSPLRRRPLFVQSPCFCPLFWHVKCCLVFFGLCFRHPFLRRRVLFYRPPGAEGTRAEEARTTDRWDMANRRRGRGERRKRRVPTKERAGESFGTEN

SEQ ID NO: 162285 - protein, 106 aa, Heterodera glycines
  Coding regions on vcDNA: vcDNA=SeqID_88708; Strand=-; Position=348-668
NQQKFRHAHYLNFIMLTTRMICFLVVFMPMITHFSNAGQYYYPAYYYNPYYSYYGSSASDNNPYYSYDASSGSWKLRSSSDDSSSATYNPSYYYMYYYPYTYGGKK

SEQ ID NO: 162286 - protein, 239 aa, Heterodera glycines
  Homolog annotation: Hit_ID=NP_506376.1; Match level="QueryCoverage =92%, HitCoverage=92%, E-value=3e-91, Identity=71%"; Hit description =nadh dehydrogenase (26.2 kD) (5O106) [Caenorhabditis elegans] emb|CAB01203.1| Hypothetical protein F53F4.
  Gene Ontology: Mol. function=NADH dehydrogenase activity
  Coding regions on vcDNA: vcDNA=SeqID_88709; Strand=+; Position=15-731
MFAKHLRNFPFGCPFAARPLRRYSAHGLQVHRDNERNNPNTPFQFTEANLAKITVLLNNFPEGHKGAALIPVLDLAQRQHGWLPISAMHEVARVLEMPRMRVYEVATFYTMFNRDPVGKYFLQVCGTTPCMLRGAEAIIEAIEKKLGIKKGGTTADGLFSLQEVECLGACVNAPMVQINDDYYEDLTPRDIEEIIDEFKAGKRPLPGPRSGRLAAEPLAKQTTLTETPPGPGFGLQQGL

SEQ ID NO: 162287 - protein, 239 aa, Heterodera glycines
  Homolog annotation: Hit_ID=NP_506367.1; Match level="QueryCoverage =86%, HitCoverage=90%, E-value=3e-30, Identity=35%"; Hit description =tubulin folding cofactor B (5O73) [Caenorhabditis elegans] emb|CAB01212.1| Hypothetical protein F53F4.3 [
  Gene Ontology: Mol. function=co-chaperone activity; Cellular component=microtubule; Biological process=alpha-tubulin folding
  Coding regions on vcDNA: vcDNA=SeqID_88710; Strand=+; Position=42-761
MINLSISTNKTEFPYLVRYPATMALVEFKVKLELVVGIYSADMKLELRSHEGKFISELIGDDRTLEELGVRDQCIVNVCDTSETRNDNSTNDPNAFYVIPEERYANRKDTARKWKQQLMTTATTTTDVERSEQQVPNKIGPGKRCIVQLRDQPPRKAQIAFVGPTHFGENPGTTQWVGVIYDEATGKNDGSLDGHRYFRSEPSHGGFVQIRAIVNVLDDVEQAANDKEQIQQQMEIEEI

SEQ ID NO: 162288 - protein, 165 aa, Heterodera glycines
  Homolog annotation: Hit_ID=AAA98565.1; Match level="QueryCoverage =92%, HitCoverage=98%, E-value=4e-31, Identity=48%"; Hit description =fatty acid binding protein homolog As-p18 [Ascaris suum] sp|P55776|FABH_ASCSU Fatty acid-binding protein h
  Coding regions on vcDNA: vcDNA=SeqID_88711; Strand=+; Position=54-551
MRFTSIPLIFCLIALVCVIASVPELPQKFLKSWSVDHSENFDEYLEAKGYGWFMRQVVKLAGITKTFSKNENGTYACKIETTKKNVEWPSFKLGEEFQAEYLDDSVPKITFDYNPTTDELIETHKKVDSEEKPDIYKYNIDSDGFLVMQMEYNGVKTKRFYKKNE

SEQ ID NO: 162289 - protein, 73 aa, Heterodera glycines
  Coding regions on vcDNA: vcDNA=SeqID_88712; Strand=-; Position=2-220
PHLLHIRVKDIAKVPVVVLVDQFLRGNELIFVHFELIRFHLHQTVFGIHKFRCSKHFRIKKAFRFILTMGLIG

SEQ ID NO: 162290 - protein, 135 aa, Heterodera glycines
  Homolog annotation: Hit_ID=NP_497111.1; Match level="QueryCoverage =99%, HitCoverage=20%, E-value=5e-37, Identity=51%"; Hit description =dauer aging adult overexpression protein 2 like family member (2P429) [Caenorhabditis elegans] emb|CAB701
  Coding regions on vcDNA: vcDNA=SeqID_88713; Strand=-; Position=2-406
VPHLPLATVSAAVTVSPLMTPNAKLELCCQKQQLPSTCQQFCNFDTFTQEKLLIALLGSHCPSAQLSKAFDCATSKVDHSECCRQEGIDRIHNGQCMVFCRTHIKTPPNVAGYVSCLSVFGTIKNCYRDHQIKHK

SEQ ID NO: 162291 - protein, 160 aa, Heterodera glycines
  Homolog annotation: Hit_ID=NP_491791.1; Match level="QueryCoverage =98%, HitCoverage=98%, E-value=7e-43, Identity=53%"; Hit description =putative mitochondrial protein, with a coiled coil-4 domain, of bilaterial origin (19.1 kD) (1G786) [Caen
  Coding regions on vcDNA: vcDNA=SeqID_88714; Strand=+; Position=39-521
MTSRILRLWQPGAPRPRVFLPDFWIKLVEQPSKGYNRLPKNAAAFEVDLKMSRMDVREYLEKIYKYPVRDVRIRVTMGDITWDHPKDRDKRRALWKEEDRKIAIVFFKKGFIAEVPDLFPGRGTDAEIDQMKKFQEQDANTFNSRFVNRGRAGIGEMLPI

SEQ ID NO: 162292 - protein, 112 aa, Heterodera glycines
  Homolog annotation: Hit_ID=NP_496446.2; Match level="QueryCoverage =97%, HitCoverage=18%, E-value=2e-28, Identity=53%"; Hit description =kinesin-like protein (67.9 kD) (klp-17C) [Caenorhabditis elegans] dbj|BAA92262.1| kinesin like protein [C
  Gene Ontology: Cellular component=extracellular space
  Coding regions on vcDNA: vcDNA=SeqID_88715; Strand=+; Position=24-362
MSSSAMGTQPALFDRSNISFAVSFLAGGLAIGYLLGWRTAASKLARCNTRVQLSKDKVVDTVELEDIGEKKAYCRCWQSKKFPLCDGSHNEHNKKTGDNVGPLIVPKAKSAS

SEQ ID NO: 162293 - protein, 252 aa, Heterodera glycines
  Homolog annotation: Hit_ID=NP_499991.1; Match level="QueryCoverage =64%, HitCoverage=76%, E-value=4e-32, Identity=42%"; Hit description =putative membrane protein of fungal and metazoan origin (4B548) [Caenorhabditis elegans] gb|AAK29831.1| H
  Coding regions on vcDNA: vcDNA=SeqID_88716; Strand=+; Position=9-764
MSVGVLFRLTIRPSPAGLRLTCFLATNYHHNLHQFNNNCLVRRHFSCTSRLLLATTTDNKGDAASAKQQQFAKIELKPKTGSDGAVAEPERTYLEEMLIERDAEPKTAGQKVKRAVETTFYISFGLISCAVLGVMTYLVFKEFFAFNTPQGVYRDAVKRVKADERCREMFGKRIMTFGEESGRGRRRHILHNKYVKDGQERLSVMFHVKGDAGIGKTYAEIYKGEDGKWDYRFVLVKSDGVPKKAIFLIDNR

SEQ ID NO: 162294 - protein, 167 aa, Heterodera glycines
  Homolog annotation: Hit_ID=NP_509363.1; Match level="QueryCoverage =89%, HitCoverage=75%, E-value=1e-33, Identity=47%"; Hit description =mammalian VEntral Midline antigen related (vem-1) [Caenorhabditis elegans] gb|AAD31555.1| Vema (mammalian
  Gene Ontology: Mol. function=steroid binding; Cellular component =integral to plasma membrane; Biological process=signal transduction
  Coding regions on vcDNA: vcDNA=SeqID_88717; Strand=+; Position=52-555
MPTFAELFELSATDVVLVVLFVYVVYKLFFARRHIPPPPDVPQVEPLEKQDMTVEQLRRYDGVQDEHICMAICGKIYDVTKGRDYYGPEGAYGALAGHDATRALGTMDVKQIKDEFDDHAGIDPSDLEEAKEWQQRLSLKYPFVGRLLAPGEQHTEYETVAENREGN

SEQ ID NO: 162295 - protein, 196 aa, Heterodera glycines
  Homolog annotation: Hit_ID=NP_510634.1; Match level="QueryCoverage =96%, HitCoverage=57%, E-value=4e-45, Identity=46%"; Hit description =misexpression suppressor of KSR (35.6 kD) (XQ738) [Caenorhabditis elegans] emb|CAA92227.1| Hypothetical p
  Gene Ontology: Cellular component=cytoplasm; Biological process=cell differentiation
  Coding regions on vcDNA: vcDNA=SeqID_88718; Strand=+; Position=97-684
MMEMANTDEINLVTVDVPPNCHFTVYVQKPRENLEGKTVFLTVHDVGSTSQSFIEFVNSSPMNSVKNHAMFLHVCVPGQEEDAPPLDGDFPSMEQMGEHLVHVLNAMDVQNCVGIGEGAGADILCRFAMAWPNRVLGLVLIHCLATSHGIIESLKQIFLNLRVEDGNMNNAAWDYLFLHKFGLHEKTLKEAFIAEL

SEQ ID NO: 162296 - protein, 42 aa, Heterodera glycines
  Coding regions on vcDNA: vcDNA=SeqID_88719; Strand=-; Position=1-126
FFFFFFFKNFIFYIYSRITAMHIAYQYCIITCHRILINLLKK

SEQ ID NO: 162297 - protein, 182 aa, Heterodera glycines
  Homolog annotation: Hit_ID=NP_036356.1; Match level="QueryCoverage =96%, HitCoverage=14%, E-value=2e-26, Identity=36%"; Hit description =NIMA (never in mitosis gene a)-related kinase 1 [Homo sapiens] sp|Q96PY6|NEK1_HUMAN Serine/threonine-prot
  Gene Ontology: Mol. function=protein serine/threonine kinase activity; Cellular component=nucleus; Biological process=signal transduction
  Coding regions on vcDNA: vcDNA=SeqID_88720; Strand=+; Position=120-665
MSNPSHSQFTMLSQIGSGSFGKCFLCKRVADGAQMVLKKVRISDESKNEARLHSLILHPNVVRTFESYLSQRSIYIVLEHMAGGNLHEHIKRNEAEEFKDEDILSITAQLTAALEHIHQLRIIHRDVKPRNVLLSEDWRTVKLCDFGIAIKLADGQKAKGRFGEVGTINYMAPEILEGREYD

SEQ ID NO: 162298 - protein, 306 aa, Heterodera glycines
  Homolog annotation: Hit_ID=NP_003163.1; Match level="QueryCoverage =84%, HitCoverage=87%, E-value=1e-43, Identity=38%"; Hit description =surfeit 1 [Homo sapiens] emb|CAI12837.1| surfeit 1 [Homo sapiens] gb|AAH71658.1| Surfeit 1 [Homo sapiens]
  Gene Ontology: Mol. function=heme transporter activity; Cellular component=mitochondrial inner membrane; Biological process=electron transport
  Coding regions on vcDNA: vcDNA=SeqID_88721; Strand=+; Position=12-932
MLTHRKYRLLQFASVSGRALTISPEFRQLSSVSSIPSNSHKTSKSDGKAPKSSTLWLNLPSNAEEDVRTRVRSSFFGTYVALLFPAATFALGCWQWKRHKWKTELIEKLKIATKTAPVEFPVDNLSAIDDMEFRKVHVRGYYLFDRQFVIRWRCRLDPANTGTSNSEKYGAYVITPMRLEGTNVTIMVNRGWVPNENIESELKKGKQLRESELKDLNAVVRSAEKGSPFVKNHPEKGIWAFKDLEEMARQSDPVPIIVDADFESTEKDGPIGGQTIVVLRNQHYSYMVQWFGLTVGVLGMWALRFL

SEQ ID NO: 162299 - protein, 327 aa, Heterodera glycines
  Homolog annotation: Hit_ID=CAC33829.1; Match level="QueryCoverage =99%, HitCoverage=100%, E-value=1e-140, Identity=75%"; Hit description=annexin 2 [Globodera pallida]
  Gene Ontology: Mol. function=anticoagulant activity; Cellular component=plasma membrane; Biological process=skeletal development
  Coding regions on vcDNA: vcDNA=SeqID_88722; Strand=+; Position=48-1031
MMSNATKNILGTPTIVDNVSFDPKVSANFLHKAIEEKRKDEIIHLLCTISNQQRQELAREFKQLFGEDLSAKLKKALSGDFEELILALLEPPAVYDAQQMHRAMSGLGTLEGSVLIEILVTHSNRQIDEMKRVYEQLYGHPLEKDIVGDTSGAFQRLLVSLCNDSRDESWSSDPIRANMTARALFKESEVESGVNDVLFNQVLANENFIQLHLIFEEYQKVSGHPIEQAIQQQFSGDTRDGYLAVVECVHNRHAFFAKVLQNSTKSFLGIGRRDSDLIRLIVTRAECDMVEIKEQFMQMFNTPLEKAIESNCSGPYKDGLLTLVKGN

SEQ ID NO: 162300 - protein, 167 aa, Heterodera glycines
  Homolog annotation: Hit_ID=CAE66573.1; Match level="QueryCoverage =100%, HitCoverage=98%, E-value=2e-23, Identity=39%"; Hit description= Hypothetical protein CBG11890 [Caenorhabditis briggsae]
  Coding regions on vcDNA: vcDNA=SeqID_88723; Strand=+; Position=31-534
MNGKGKNKKTSSYKERKAISYQQGSDPPFLAQFKNKLGYKEWTVEDKFAKSDDEEEEEGADNPTDDIRKMREEERPQVVVLDPRTDLSAEELQKEIEKGNEEEDKRKIMEGKIMFRKPEKRKTENGCGKEGSKEEEEKEKRAKREEKPGQQQKEQNRRLLSFGEEDE

SEQ ID NO: 162301 - protein, 71 aa, Heterodera glycines
  Coding regions on vcDNA: vcDNA=SeqID_88724; Strand=-; Position=12-227
VKGRLTTITKKQQQHFVPPFPRSAEFSLRPSAHFFACLRLRFSRRIRFLRHFARIFQCQKELKRKRGSSNL

SEQ ID NO: 162302 - protein, 220 aa, Heterodera glycines
  Homolog annotation: Hit_ID=AAF72105.1; Match level="QueryCoverage =99%, HitCoverage=85%, E-value=2e-33, Identity=40%"; Hit description =33 kDa Vamp-associated protein [Homo sapiens]
  Gene Ontology: Cellular component=integral to membrane; Biological process=nonselective vesicle transport
  Coding regions on vcDNA: vcDNA=SeqID_88725; Strand=+; Position=42-701
MTKPQQVLVLDPNNELSFKGPFTEYVNANLTLSNPSRKDVYFKVKTTAPKFYCVRPNSGVIKANDKTQINVMLQPVESPETLESERSRHKFMIQTAFAPDDEQLPVDQFWKTVDPTLVMDSKLRVVFQRPFGFGDENNRDETNATGPFFNFNKTGEPKNEQPTQTPKSTEANSGDIQLALQREVELRMMYQDEKKNLEKENYALIDKLEKLTHNAAAGGV

SEQ ID NO: 162303 - protein, 91 aa, Heterodera glycines
  Coding regions on vcDNA: vcDNA=SeqID_88726; Strand=+; Position=374-649
IYETVNPICLFCSFFDTFARYFIVSYLFITLQFVFFIFLRYFLIDLHRYRYVINEFIHLSIISAFYVFPTYLSLTTRKRIECTIRAPHYSN

SEQ ID NO: 162304 - protein, 187 aa, Heterodera glycines
  Homolog annotation: Hit_ID=AAP30754.1; Match level="QueryCoverage =98%, HitCoverage=98%, E-value=2e-85, Identity=83%"; Hit description =putative gland protein G11A06 [Heterodera glycines]
  Coding regions on vcDNA: vcDNA=SeqID_88727; Strand=+; Position=34-597
MSSPSSSVSLLAIVTIFCLLCKCCVSAPHPCCPGSQKVVSLMANYVGTFAHSFSKASLCSDAQSVAGALKGQLIGCSKGGDATLLADIEGFLGTHSADECAHSLGFVRAMFVIAASASSHASNNSEWQALSAQFGQQISEIDSKCAEFGIGIAKVPYDGPKGDHSQRNVPGTDSVISMPGLTGSHKQ

SEQ ID NO: 162305 - protein, 206 aa, Heterodera glycines
  Homolog annotation: Hit_ID=CAE62925.1; Match level="QueryCoverage =87%, HitCoverage=44%, E-value=1e-59, Identity=56%"; Hit description =Hypothetical protein CBG07125 [Caenorhabditis briggsae]
  Gene Ontology: Mol. function=acyl-CoA dehydrogenase activity; Cellular component=mitochondrial matrix; Biological process=lipid metabolism
  Coding regions on vcDNA: vcDNA=SeqID_88728; Strand=+; Position=40-657
MICSRLFSSPISSSVCRRSLRRIGYCADPTIGLSSEQIEIQRMAKDFAKKELYPEMDKWDKLGQLPMDALRKAGELGFGAIYCDDAYGGAGLSRSDAALVFEQLAAGCCSTAAYMAVHNMVPWMIDRFANEELKQRYIPELASFTKLASYCLTEPGSGSDSAALRTNARREGDHYIVNGSKAFISGSGVSSVYLVMMRHKDAPPGP

SEQ ID NO: 162306 - protein, 232 aa, Heterodera glycines
  Homolog annotation: Hit_ID=CAE69691.1; Match level="QueryCoverage =95%, HitCoverage=53%, E-value=1e-91, Identity=72%"; Hit description =Hypothetical protein CBG15946 [Caenorhabditis briggsae]
  Gene Ontology: Mol. function=acyl-CoA dehydrogenase activity; Cellular component=mitochondrial matrix; Biological process=energy pathways
  Coding regions on vcDNA: vcDNA=SeqID_88729; Strand=+; Position=7-702
MLSKKLIAFCSDTFSGKGLSSRRLISFDLSDQHKAIQDGALKFAKEVVAPKAAEYDKTMAFPWDIIKQAHQLGLMNPTIPEKYGGPGCSNLETALIVEALSYGCSAIQLAIMGPSLALAPLLLAGNETQKQKYAGMLAAEPLIAAYCVTEPGAGSDVSGVKTTAVLKGDKWVLNGSKAWITGGGYAKWFFVLARSDSDPKTPAGKAFTAFVVDGDTPGITRGKKEINMGQRC

SEQ ID NO: 162307 - protein, 189 aa, Heterodera glycines
  Homolog annotation: Hit_ID=NP_510484.1; Match level="QueryCoverage =86%, HitCoverage=95%, E-value=4e-59, Identity=67%"; Hit description =putative N-myristoylated protein, with a transmembrane domain, of bilaterial origin (17.6 kD) (XP588) [Ca
  Coding regions on vcDNA: vcDNA=SeqID_88730; Strand=+; Position=125-694
MQNLFPGKFGQAAQAANTAQMQMKAEHDPSAGFPWWVRFLAKGLGIVGGFVAIFFGVLALFTIHPMCMVAALLQLAAGFLTIALEAPFCCAFVDFIERIAQFSESRAYWQKAALYGGMGIVPILLCAGTETILGAGMICASGVAYGFMALGKKADRTTMLGGANTAGQDPAWSPQLNQPFPQPAGFNQP

SEQ ID NO: 162308 - protein, 231 aa, Heterodera glycines
  Coding regions on vcDNA: vcDNA=SeqID_88731; Strand=+; Position=1-696
AFANNRLNLRNETEQNFPLNLCRPFASPPPKWTLWRFDCRDFPNHCTVKTCAFCAEVNKLRPTAKNIVNETHARWDSMKREKSFDDAPTLLRMATDTFLPSKLTKSVFFNHKLGVAIFRDEIPPKFESVENLSGGIFQLYFHGTSGRQSAVTVQKLDALFIQTVRSLFGMPSPIACHVHGLFYRCEINPGNRRDPISYGNLLDLPFMAKFEVPLCARNFLIRQNWQKSFKL

SEQ ID NO: 162309 - protein, 194 aa, Heterodera glycines
  Homolog annotation: Hit_ID=NP_492757.1; Match level="QueryCoverage =88%, HitCoverage=31%, E-value=5e-38, Identity=48%"; Hit description =TOLLIP protein (1L112) [Caenorhabditis elegans] emb|CAB02090.1| Hypothetical protein F25H2.1 [Caenorhabdi
  Gene Ontology: Mol. function=protein binding; Cellular component =interleukin-1 receptor complex; Biological process=intracellular signaling cascade
  Coding regions on vcDNA: vcDNA=SeqID_88732; Strand=+; Position=48-629
MATSSNSTTTVAEPLPTKTSMKIAELRSRVLIGDLPADFLRIPPVSSSVNLSSAPDQIVAQQPQQIVVPYGHPYAFVNPAEHFYSFVPPHTRGRIAVKIVEAKLTKSYGLPGVRMDPYVRLRIGNTLFETPTCVNGGKSPHWNRTVNAYLPDGVESIYLQIYDERAFTSDECVAWAHVIMPPAIFNHETIDEWY

SEQ ID NO: 162310 - protein, 215 aa, Heterodera glycines
  Coding regions on vcDNA: vcDNA=SeqID_88733; Strand=+; Position=1-645
VQLRIYAIPFTPMKKIDCHPPMANSGEHSSRRQQQQQRHPNTTAENNSDIEGTAHRVASVTLNTESDSRTSADLPAYPFRSKRRKKLPRRDKQQGADMDVDEHQPPWKKLSVNTVDNLTLPSCKVQMDWEHGHGQALSTANDSTQNQSSSTTRQASDMENSVSDQFSHSQSESEASTSNIDADDEQSDWPGNELARHPQLSSSSSVIVPFQLAPP

SEQ ID NO: 162311 - protein, 147 aa, Heterodera glycines
  Coding regions on vcDNA: vcDNA=SeqID_88734; Strand=-; Position=61-504
IISQLLVDLFCQSIVPVVLTFPSFLLSFSFALKNKKCDENGQKCRCESAAQKAVVCPRSVAQFARAIGACQLAARPAKHRHGPRLARVHSPAAQRVISRPIPVFAVLSVAICHFYRALLLLNFGAYVEQTHRHIGAGPAFESIGRQK

SEQ ID NO: 162312 - protein, 194 aa, Heterodera glycines
  Coding regions on vcDNA: vcDNA=SeqID_88735; Strand=+; Position=54-635
MADCWDDEDYDPSAQMADKIASLGLDDVIRQQQPKGEKVPTQATNNSRKEGTAKEGATELSEREKREAQMRADGTAAMDLFGLAVERKEPTFDDLRTKDDFQAFADKLGEQIGARNDHANYSLFVSALVDHMTKPMSKLQLQIVMAKIQAHLDVHLKREEEEQKLQQEKTSKKETKKAKKKELEEDVIEDEYDD

SEQ ID NO: 162313 - protein, 112 aa, Heterodera glycines; identical to SEQ ID NO: 149250
  Coding regions on vcDNA: vcDNA=SeqID_88736; Strand=+; Position=18-356

SEQ ID NO: 162314 - protein, 148 aa, Heterodera glycines
  Coding regions on vcDNA: vcDNA=SeqID_88737; Strand=+; Position=7-453
VKFLHFFRLYLIMNRGRNNQNYLIHGISKYWQVVGALGLCVVMVCITYQLFLHVDEKHKSFKLMISGHFNDIKQINNDFTAWSKNFTSHLNERFEQQQARSRARFKQQLANFVKIRLDFDKQFQKTMYRFAEVELETVLNKSKASGGG

SEQ ID NO: 162315 - protein, 61 aa, Heterodera glycines
  Homolog annotation: Hit_ID=NP_498706.1; Match level="QueryCoverage =73%, HitCoverage=77%, E-value=6e-10, Identity=60%"; Hit description =putative cytoplasmic protein of bilaterial origin (6.3 kD) (3I951) [Caenorhabditis elegans] gb|AAA28213.1
  Coding regions on vcDNA: vcDNA=SeqID_88738; Strand=+; Position=82-267
MSAVQFKQSFDKVCATTANAFRFSLQWCFVPLVVILGFRRGAEPLPNGEIVPLSIASLFWG

SEQ ID NO: 162316 - protein, 151 aa, Heterodera glycines
  Homolog annotation: Hit_ID=CAE67853.1; Match level="QueryCoverage =51%, HitCoverage=56%, E-value=5e-15, Identity=52%"; Hit description =Hypothetical protein CBG13442 [Caenorhabditis briggsae]
  Coding regions on vcDNA: vcDNA=SeqID_88739; Strand=+; Position=31-486
MIVNPIRNIFVRNFACQFGPSELARSYVTDGPLTVSGRSAPVKKRTNAADEIARTKFELLEPIAVTDLPRAQQRFARQIHRSNRTRVQKIFAKNIKMIKNGLAGIALVVAIYLYTFFVMRKETFLEEIDEEMAIERGEMKLDDQGRLVAVK

SEQ ID NO: 162317 - protein, 248 aa, Heterodera glycines
  Coding regions on vcDNA: vcDNA=SeqID_88740; Strand=+; Position=51-794
QLLLLLLLLTAHRMSNPKRVRLERLHALDFGESDDISETQSLDGSAITFANLNTVNAKNQQRKKMNNRDHFELELSAESDHRSPDKSSKFQRMPSSYFSDAKRIIDYVLVYEEKEMTNSNYNNNCDDNKQRDNSRSSPNGTHKNSCFSAPSECPFLSRSSCIGTALTTFHGCQCHRRRGERQRKGRRDGRRRAASAQCFPRKIGSFIQCLAQSADQIGGPLIAFPQNFEFGGDFNRTDGTEINGQFQR

SEQ ID NO: 162318 - protein, 101 aa, Heterodera glycines
  Homolog annotation: Hit_ID=NP_996018.1; Match level="QueryCoverage =96%, HitCoverage=80%, E-value=1e-17, Identity=47%"; Hit description =CG33276-PA [Drosophila melanogaster] gb|AAS65063.1| CG33276-PA [Drosophila melanogaster]
  Gene Ontology: Mol. function=protein tagging activity; Biological process=protein modification
  Coding regions on vcDNA: vcDNA=SeqID_88741; Strand=+; Position=12-317
LKSFKMAIKLEFAGGPDAIFNGKRETEAENDNISTVRQLLRWLSDGPLRGNDRSEMLIQRDTVRPGVLVLINDTDWEILGGLDAQLNGGDKVTFISTLHGG

SEQ ID NO: 162319 - protein, 180 aa, Heterodera glycines
  Homolog annotation: Hit_ID=AAM20116.1; Match level="QueryCoverage =100%, HitCoverage=100%, E-value=1e-93, Identity=100%"; Hit description=unknown protein [Arabidopsis thaliana] gb|AAL59970.1| unknown protein [Arabidopsis thaliana] gb|AAG5264
  Coding regions on vcDNA: vcDNA=SeqID_88742; Strand=+; Position=32-574
MAETAETINTTISSPPPESESSTTISAMTDPTSQEAASKDTDLTKEAESEKKPGGISLRIWPPTQKTRDAVLNRLIETLSTESILSKRYGTLKSDDATTVAKLIEEEAYGVASNAVSSDDDGIKILELYSKEISKRMLESVKARSNASVGNGSVEDANTDASEVSKDDAGPASEEEKSEA

SEQ ID NO: 162320 - protein, 211 aa, Heterodera glycines
  Homolog annotation: Hit_ID=NP_510298.1; Match level="QueryCoverage =100%, HitCoverage=68%, E-value=2e-52, Identity=53%"; Hit description= 5'-amp-activated protein kinase (30.2 kD) (XO377) [Caenorhabditis elegans] emb|CAB04480.1| Hypothetical
  Gene Ontology: Mol. function=SNF1A/AMP-activated protein kinase activity; Cellular component=nucleus; Biological process=signal transduction
  Coding regions on vcDNA: vcDNA=SeqID_88743; Strand=+; Position=2-634
GNNQGGFHKRERTGDGSQRRATGGGTIQILSSSSSSTGSHQTPLQGQISSSTDDGCPVQMKIAKPDLMAEDSLEFAHNEYPVVFKWHSDAQPAKHVYLTGSWDNWRKKIPLVKSTHDFSTIINLNPGRYEYKFLVDGKWMVDDTIAKTDNQMGSQNNVMSIDEADFAVFDALDKDLASSNAGEAMRSMNSTGAQPSQDTPNDRELERLREF

SEQ ID NO: 162321 - protein, 201 aa, Heterodera glycines
  Homolog annotation: Hit_ID=CAE59460.1; Match level="QueryCoverage =85%, HitCoverage=71%, E-value=5e-52, Identity=54%"; Hit description =Hypothetical protein CBG02840 [Caenorhabditis briggsae]
  Coding regions on vcDNA: vcDNA=SeqID_88744; Strand=+; Position=26-628
MPTFPWSKKRKASDDEVVESGMTVRQILEEREEYVKNIGIEYRFGCYEEKRADSCQYLGEYFEAVQTDFKSAFDTFRQNCEQRKFPRSCFKYGQYLAAGRACEASFKKAIEPLRLSCDAGIAKGCRVLALILWNGESDRPPDSAQAEQFMKRVAELGDYEASWTLSTWYLGDTIKYQREKSAPYGHKMGELSRDMQKALMY

SEQ ID NO: 162322 - protein, 175 aa, Heterodera glycines
  Homolog annotation: Hit_ID=CAG01465.1; Match level="QueryCoverage =98%, HitCoverage=97%, E-value=7e-63, Identity=63%"; Hit description =unnamed protein product [Tetraodon nigroviridis]
  Gene Ontology: Mol. function=N-acetyltransferase activity; Cellular component=nucleus; Biological process=protein modification
  Coding regions on vcDNA: vcDNA=SeqID_88745; Strand=+; Position=3-530
CRPFEPFDLFRFGAVNLDPLTETYGLPFYLHYLVNWPDYFMVAEHLSGDLMGYIMGKSEGRDQNWHGHVTAVSVAPEYRRMGLAARFMQKLELVSEKEDCFFVDLFVRISNETAINMYKRLGYTVYRQIVDYYSGDDTHEDEDAFDMRKALPRDVDKKSVVPLKHPVSCNEIDFD

SEQ ID NO: 162323 - protein, 91 aa, Heterodera glycines
  Coding regions on vcDNA: vcDNA=SeqID_88746; Strand=-; Position=2-274
MHLIIEIWKKGLKWGRKGGIKLKMNVYFFGIHPEFFFFFFFTHSLHSLFTTAQNALIPSAATGTDVERCFGFLPAFVHFLVVPTGHLFIPI

SEQ ID NO: 162324 - protein, 118 aa, Heterodera glycines
  misc_feature (74)..(74): Xaa can be any naturally occurring amino acid
  Homolog annotation: Hit_ID=NP_499054.1; Match level="QueryCoverage =88%, HitCoverage=74%, E-value=4e-20, Identity=49%"; Hit description =esophageal gland cell secretory protein 11 like precursor family member (3K419) [Caenorhabditis elegans]
  Coding regions on vcDNA: vcDNA=SeqID_88747; Strand=+; Position=30-387
MFLKFLILAFCFQLAMANLFGQKQSVAVVGMLKCKGKPSAGTKVKLYDNDHFTTDDLMAQSKTDNYGRFKLSGXHKEITKIDPKLNLYHDCNGDFPFTPCKWKITIKALDGSRAHAFS

SEQ ID NO: 162325 - protein, 80 aa, Heterodera glycines
  Coding regions on vcDNA: vcDNA=SeqID_88748; Strand=+; Position=39-281
MVRMTPDECRSIASEGERSLREGDAVNGIKILEKALQCNTFDLSLQCSLHSQLGNAYYARGDYRKARFPSTVRSFYSPTH

SEQ ID NO: 162326 - protein, 72 aa, Heterodera glycines
  Coding regions on vcDNA: vcDNA=SeqID_88749; Strand=-; Position=1-216
PHLLHIRVKDIAKVPVVVLVDQFLRGNELIFVHFELIRFHLHQTVFGIHKFRCSKHFRIKKAFSLYSNYGLN

SEQ ID NO: 162327 - protein, 232 aa, Heterodera glycines
  Homolog annotation: Hit_ID=CAE72053.1; Match level="QueryCoverage =36%, HitCoverage=13%, E-value=2e-10, Identity=39%"; Hit description =Hypothetical protein CBG19139 [Caenorhabditis briggsae]
  Coding regions on vcDNA: vcDNA=SeqID_88750; Strand=+; Position=1-696
VATIKVSSSSAHQLHNNASIINIDTVRFTSHSKENDTENSNGSDFTVNNGGTFVRRKDPVERKVQPNVNPSSNPSSSFTSHDHYPPVVSDGDETADDGTGTIRIISPSKAVPPIPPHHFHRQQQQQLQHNQVNNVPSTFVADVSVGIAPPPPTIRGVRCSSLENTLLPALDKLTRTRHGAAHLDTIAVALKRAEQASPGLCDHLVTELITTMAHPQCTNAELRKAIDRLTTR

SEQ ID NO: 162328 - protein, 195 aa, Heterodera glycines
  Homolog annotation: Hit_ID=CAE59092.1; Match level="QueryCoverage =93%, HitCoverage=71%, E-value=3e-44, Identity=51%"; Hit description =Hypothetical protein CBG02384 [Caenorhabditis briggsae]
  Gene Ontology: Mol. function=calcium channel activity; Cellular component=integral to plasma membrane; Biological process=cation transport
  Coding regions on vcDNA: vcDNA=SeqID_88751; Strand=+; Position=55-639
MSSGIIEFAVARGLHVKSRETAVPYLRSSIRRFPVDEQRVPWNVPLVDYSPCDYTADSVHGKPWADPSEPSKCKFNSMDDGVNRVSFHGSYNLDTDGRPLNPFGRTGLRGRGLFGRWGPNHAADAIVSRRLANGQLQFVAIERRDTGELALPGGMLNKGEPPTEAAVREFSEEAMGGHRREDKLEHFWKKGKTVY

SEQ ID NO: 162329 - protein, 291 aa, Heterodera glycines
  Homolog annotation: Hit_ID=CAB88204.1; Match level="QueryCoverage =100%, HitCoverage=97%, E-value=1e-157, Identity=86%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_88752; Strand=+; Position=18-890
MQETQIIVGVASLCSILAILATVVVVPSLYSEINEIATKVHDGVQAFRVDTDSAWTDLMDLQITVTPPSKPRQNPFSSIFRQKRQLPGHCQCAGVQQPNCPPGPPGPAGSPGQPGQPGQPGGPGQPGVPGQQGPPCPVYTPPCQHCPAGPPGQPGSQGPQGRPGAPGQPGQPGRNSGQGPPGPPGPQGGAGQPGRPGGPGQPGQPGAPGVITTSVPGPKGPPGAPGQPGQPGAPGQPGKPGNAGQPGAQGPPGHPGQPGSPGQPGSPGPAGPPGGDAAYCACPPRNAVLMK

SEQ ID NO: 162330 - protein, 221 aa, Heterodera glycines
  Homolog annotation: Hit_ID=CAE60076.1; Match level="QueryCoverage =98%, HitCoverage=68%, E-value=9e-58, Identity=50%"; Hit description =Hypothetical protein CBG03596 [Caenorhabditis briggsae]
  Coding regions on vcDNA: vcDNA=SeqID_88753; Strand=+; Position=42-707
MSMRRSRSADLSLISREKYLSRWSRENTPMDCVDRWCSNVRRSFTPVRDISGYENIRNERRSRSVDSYRSPLGIVTVPYHTNVNYYQENQPVRKYDVFQARTWSYPIYKYIYGRDNHYSRPGSYTRVYGQQSLYTPSVMAPEAKLATERRTYSGYNYVAGEHSFNLSTKPWSQSNYRFLRVSHISSVPWYFHGQTSNVRHYNSYRPPSFTPRLSTYWKSYF

SEQ ID NO: 162331 - protein, 206 aa, Heterodera glycines
  Homolog annotation: Hit_ID=EAL47380.1; Match level="QueryCoverage =67%, HitCoverage=30%, E-value=2e-11, Identity=32%"; Hit description =PufA family RNA binding protein [Entamoeba histolytica HM-1:IMSS]
  Gene Ontology: Mol. function=RNA binding
  Coding regions on vcDNA: vcDNA=SeqID_88754; Strand=+; Position=64-681
MHSPLFGSMLDNKEYSRHIENFRSSISPPKGITNGLHCHDFRSPSDFDVLVKLAKDPAGVGNRELQQRMDQDQQFRQQVLCAIVNGGKERFLQLCIDCNGCFVIQKLVENGSKETNQMLLNLVRPLAFKMVLNRFACRIVQKLVVNLSGSQVRQLFCQQFKGHENTLVTDQNGNHFVQCVVDHFAPDVYGPFILALANCPTRLSAV

SEQ ID NO: 162332 - protein, 80 aa, Heterodera glycines
  Coding regions on vcDNA: vcDNA=SeqID_88755; Strand=+; Position=28-270
MMSLLASNNASSNGTNAAAVAPLSPLASYKEQQQKHKFKKPNPLDRFLYKVVPAQTHPFTQLCYTALIFGLWAQLGRYMR

SEQ ID NO: 162333 - protein, 171 aa, Heterodera glycines
  Homolog annotation: Hit_ID=CAD38524.1; Match level="QueryCoverage =98%, HitCoverage=96%, E-value=2e-62, Identity=67%"; Hit description =putative glutathione peroxidase [Globodera rostochiensis]
  Gene Ontology: Mol. function=electron transporter activity; Cellular component=mitochondrion; Biological process=phospholipid metabolism
  Coding regions on vcDNA: vcDNA=SeqID_88756; Strand=+; Position=47-562
MSTATDVQHKSIYDFKANDIDGHEISFDKYRGKVLLVVNVASNCGTTEFNYSQLKQLYDKYKGKGFAVAAFPCNQFGGQEPGNANEIKDFVHKKYNFEPDLFEKIDVNGSNEHPLYGFLKKEQHGTLIDAIKWNFTKFLVDRNGNVVQRYSPNTEPRDIEADIEKLVAAAA

SEQ ID NO: 162334 - protein, 303 aa, Heterodera glycines
  Homolog annotation: Hit_ID=NP_493334.1; Match level="QueryCoverage =84%, HitCoverage=69%, E-value=1e-82, Identity=60%"; Hit description =GTP-binding protein like (39.4 kD) (1N870) [Caenorhabditis elegans] emb|CAB07637.1| Hypothetical protein
  Gene Ontology: Biological process=G-protein coupled receptor protein signaling pathway
  Coding regions on vcDNA: vcDNA=SeqID_88757; Strand=+; Position=42-1008
MVFAIRRFVGKCSPFPNCFLLRPSSSFTPSADGNTDKREDAIRLPILPKKSRSAGQPYSLVDYKNVFCKAGKGGDGRVSFLRLKKVEFAGPNGGNGGNGGHVIFQADSKITDLSQVHSILNAQDGVEGRGDCAHGKCGEHLYVPVPLNTLIKKPSTDELRPSKVTLHELCREGDLFIAARGGAGGHGNAFYVSNLVRKPLKAEEGGQGEEMSYDIEMRIMATAGLVGIPNVGKSTLLRAISRAKPKVAAYPFTTLSPSVGMVQYGDFFQLAVADIPGLVQGAHRNEGLGFSFLRHIVRCECVL

SEQ ID NO: 162335 - protein, 178 aa, Heterodera glycines
  Coding regions on vcDNA: vcDNA=SeqID_88758; Strand=+; Position=112-645
MLNHIYNINTTTAATAQQPRKRGTTGTTKHGTMPAPTTTKASGSSERGGGTQHHQFTNGRQVTTGQRRKGATGNEARDRTLASQPPLLPPLTSVYDFKDVVGIGSGAFANVFRARELITAAPAERYRHVALKRINLSAIEKENQLMYESVLNEVDIFKSLSHTNIVKCFYSFTEISPH

SEQ ID NO: 162336 - protein, 199 aa, Heterodera glycines
  Homolog annotation: Hit_ID=NP_740965.1; Match level="QueryCoverage =95%, HitCoverage=79%, E-value=4e-19, Identity=33%"; Hit description =protein -interacting (2A570) [Caenorhabditis elegans] gb|AAB37893.2| Hypothetical protein B0432.13 [Caeno
  Gene Ontology: Mol. function=receptor signaling protein activity; Biological process=signal transduction
  Coding regions on vcDNA: vcDNA=SeqID_88759; Strand=+; Position=37-633
MNLGRCSICTLSFDLNDVSALKCGHTYHYQCIDKWIANSKTCPNCRTSNLKRDILKLFFDEGEKSFSQLVQEPANAELLAQLKEAQDVKCFLEKTIKEQHERLTLLEFKLKQQKTKGNELNMQIQRKAQHIATLESQLFDQKVLKETNEKYKRRLVVCEFYDLLMRGGGDEGKIDKYINQNGHPDEAKFLDLMRKQRDE

SEQ ID NO: 162337 - protein, 201 aa, Heterodera glycines
  Homolog annotation: Hit_ID=XP_395154.1; Match level="QueryCoverage =73%, HitCoverage=86%, E-value=9e-17, Identity=35%"; Hit description =similar to ENSANGP00000020219 [Apis mellifera]
  Gene Ontology: Mol. function=transcription co-repressor activity
  Coding regions on vcDNA: vcDNA=SeqID_88760; Strand=+; Position=67-669
MSSVGKRGTRKTTRNDSDGSCNSAEMQDSENNAENERRGESGGAGRGEEDGAFEPGSWECTVCTFRNRYEAFKCLMCDTRKGTSTRKPRLNPSVVQQQTLVQKLAVEVEKAHQNPCTSAMANSPKPSRAPSANGGLSNKQQSKLTIRRRPVPFRDALVVRSAAKKMVVNVSGVSFTVTEFKPRTSPRGRKKLPVNQNNGKH

SEQ ID NO: 162338 - protein, 191 aa, Heterodera glycines
  Homolog annotation: Hit_ID=ZP_00284411.1; Match level="QueryCoverage =86%, HitCoverage=94%, E-value=3e-33, Identity=43%"; Hit description =COG3195: Uncharacterized protein conserved in bacteria [Burkholderia fungorum LB400]
  Coding regions on vcDNA: vcDNA=SeqID_88761; Strand=+; Position=6-581
MYNYHLIFLLVALIRGFGLIAPMKIEELNDLDAENFVSKLGKIFENSAWVVQEAYGERPFEGVDQLFNAMERVLMNAGREKQLKLIQAHPDLAGNEMFSGNLTQHSTSEQANAGLNALTAQQLSEFNSLNSAYKSRFNFPFIIALRDQKEGIDGILAAFRRRLNNSEEQEINEALSQIGRIARHRLDTLMI

SEQ ID NO: 162339 - protein, 194 aa, Heterodera glycines
  Homolog annotation: Hit_ID=EAA50962.1; Match level="QueryCoverage =77%, HitCoverage=37%, E-value=3e-35, Identity=50%"; Hit description =hypothetical protein MG04721.4 [Magnaporthe grisea 70-15] ref|XP _362276.1| hypothetical protein MG04721.4
  Coding regions on vcDNA: vcDNA=SeqID_88762; Strand=+; Position=53-716
MAKSRQIRIHFGSNLSSNPKKTMAASTPFATSAAPAPSRSKAPLGQATHSVDKNALGFDFNKLVLYLYQTVPQFIAPLRIEKFALGQSNPTFFLVDGREQKYVLRKKPAGALLSPTAHAVEREYKVLHGLGTCGHVPVPRVYTLCMDSSVIGTPFYVMEFVKGRIFPSPALPEIPATERRAYWEAAIRTLARLH

SEQ ID NO: 162340 - protein, 228 aa, Heterodera glycines
  Coding regions on vcDNA: vcDNA=SeqID_88763; Strand=+; Position=7-690
EECSKMVTRLKCVSRVENDGKAMGRSANGFVAFGCERKRMGEEENGGKVFYLLLTTRLNKGHPRKIKLSHFYRLFDKMKRNGMATFQFADPNLTVYVSQADPKALCQFLLHLNGLLRHAVDANIRCSAPSCSSPANVPSSPPPIATVSTVHRQCTSAIASAKPTKICIQSRQEYQSMIRQASSANLQRLDIVGIGFRAVDIRWFGMRRLQQLSLAANKLGSDEWCTER

SEQ ID NO: 162341 - protein, 210 aa, Heterodera glycines
  Homolog annotation: Hit_ID=CAE74915.1; Match level="QueryCoverage =100%, HitCoverage=32%, E-value=2e-93, Identity=79%"; Hit description= Hypothetical protein CBG22795 [Caenorhabditis briggsae]
  Gene Ontology: Mol. function=succinate dehydrogenase (ubiquinone) activity; Cellular component=mitochondrion; Biological process =tricarboxylic acid cycle
  Coding regions on vcDNA: vcDNA=SeqID_88764; Strand=+; Position=2-631
RGEGGFLINNEGERFMERYAPVAKDLASRDVVSRSMTIEIMEGRGVGPLKDHIFLQLHHLPPEQLAQRLPGISETAKIFSGVDVTKEPIPVLPTVHYNMGGTPTNYKGQVIRFSNDKGDQVVPGLWAAGECAAHSVHGANRLGANSLLDLVIFGRACAINILSANKPGDSLPPLETDAGESSIANLDSLRNANGDVSTADLRLELQRTMQ

SEQ ID NO: 162342 - protein, 64 aa, Heterodera glycines
  Coding regions on vcDNA: vcDNA=SeqID_88765; Strand=-; Position=95-289
FFFFFFFLQSTKNIIIYLYNNDLRYWSSRNVYLSFSLSSVCTVSTMHLRFSRHRHFCSSVAPVG

SEQ ID NO: 162343 - protein, 111 aa, Heterodera glycines
  Homolog annotation: Hit_ID=NP_647792.1; Match level="QueryCoverage =97%, HitCoverage=99%, E-value=6e-31, Identity=58%"; Hit description =CG17737-PA [Drosophila melanogaster] gb|AAR10187.1| similar to Drosophila melanogaster CG17737 [Drosophil
  Gene Ontology: Mol. function=translation initiation factor activity; Cellular component=ribosome; Biological process=translational initiation
  Coding regions on vcDNA: vcDNA=SeqID_88766; Strand=+; Position=22-357
MADSIQNLNKPKDAFEQLEEEEGTRQGFCHIRIQQRTGRKTITTVQGIAPEYDLKKIVRYLKKEYNCNGTIVEHPEYGEVIQLTGDQRQHIKDFLCKVGIVKEDNCKIHGF

SEQ ID NO: 162344 - protein, 220 aa, Heterodera glycines
  Homolog annotation: Hit_ID=T32709; Match level="QueryCoverage=80%, HitCoverage=36%, E-value=1e-53, Identity=57%"; Hit description=IMP dehydrogenase (EC 1.1.1.205) T22D1.3 - Caenorhabditis elegans
  Gene Ontology: Mol. function=IMP dehydrogenase activity; Cellular component=cytoplasm; Biological process=GTP biosynthesis
  Coding regions on vcDNA: vcDNA=SeqID_88767; Strand=+; Position=16-675
MDVTSNPNGSVEFEKVPKSLKKGSADTGLDFDEDGLTIHELFSQGTGLTYNDFNILPGYIDFPVSDVELGTHLTRKIRLSAPLVSSPMDTVTESEMAIAMALNGGIGIIHANFKTTQDQVAEVLKVKRYKQGFISNPQCISETDTVSDLRHIKRIHGFTGTPVTDTGKVGGRLIGLVTSRDIDFIKRENYETTRIADVMVPRERLIVGHKNMTLREAYCI

SEQ ID NO: 162345 - protein, 143 aa, Heterodera glycines
  Homolog annotation: Hit_ID=NP_495544.1; Match level="QueryCoverage =96%, HitCoverage=59%, E-value=3e-51, Identity=69%"; Hit description =RNA polymerase II (2H665) [Caenorhabditis elegans] gb|AAC71124.2| Hypothetical protein F43E2.2 [Caenorhab
  Gene Ontology: Mol. function=DNA-directed RNA polymerase activity; Cellular component=DNA-directed RNA polymerase II, core complex; Biological process=transcription from Pol II promoter
  Coding regions on vcDNA: vcDNA=SeqID_88768; Strand=+; Position=32-463
MPAPQQSTDEQAEEDATELKFPKEFEVSSCDALMISEVFLLLDHRRKQSEEKEEIEDISEVFLKTLNYTRRLSKFKSRETIRSVRGIFAGKHNMHKFEVAQIANLCPETAEEAKALIPSLENKMEDEELDELLKELHAKKTFQ

SEQ ID NO: 162346 - protein, 210 aa, Heterodera glycines
  Homolog annotation: Hit_ID=CAE72569.1; Match level="QueryCoverage =89%, HitCoverage=14%, E-value=6e-17, Identity=29%"; Hit description =Hypothetical protein CBG19756 [Caenorhabditis briggsae]
  Coding regions on vcDNA: vcDNA=SeqID_88769; Strand=+; Position=30-659
MFKFAKPMTTTAARMIARKSRLEVMPMAKKYTESDYQRELTYRRSDYSFPAFCESDVTHFKRGEVHHKLMQGGASEGGFTLTAYVLVALLENHVQNKVTELARSNLVSHLADFKEDPYALTLCTYVLHLANSPEKGDVLKMLEGLQTTGTTDGMVHWTTKVSNGAKDGSGGAAKNIGDVAWDTNQYFSQPQSADVEMSAYALLTYMLLDN

SEQ ID NO: 162347 - protein, 96 aa, Heterodera glycines
  misc_feature (23)..(23): Xaa can be any naturally occurring amino acid
  Homolog annotation: Hit_ID=CAE61561.1; Match level="QueryCoverage =97%, HitCoverage=94%, E-value=7e-27, Identity=58%"; Hit description =Hypothetical protein CBG05470 [Caenorhabditis briggsae]
  Coding regions on vcDNA: vcDNA=SeqID_88770; Strand=+; Position=13-302
MELEPFVNKCVSIITGDGRNIVXDCMKGFDQTVNIVLEDSHERVYSIDSGVAQIPLGLYIVRGDNVAVIGEVDETIDKQLDLEKMKAPPLPAIWIP

SEQ ID NO: 162348 - protein, 143 aa, Heterodera glycines
  Homolog annotation: Hit_ID=AAR01198.1; Match level="QueryCoverage =77%, HitCoverage=82%, E-value=3e-10, Identity=35%"; Hit description =cellulase binding protein [Heterodera glycines] gb|AAN32887.1| cellulose binding protein [Heterodera glyci
  Coding regions on vcDNA: vcDNA=SeqID_88771; Strand=+; Position=14-445
MNKLFGLLMLFAALLAHFIDCRPIRSSKRLVKVGVQLDNSEKTASASGNTYKLEFTNLSYKLVCQVKFRIELPQTATLDEYWNINPIGPADDHLFTLPVEQMYPGRSFTSARVKLNGVGEPKVTIMDTVDVLSTKPCPTVPNF

SEQ ID NO: 162349 - protein, 53 aa, Heterodera glycines
  Coding regions on vcDNA: vcDNA=SeqID_88772; Strand=+; Position=1-162
VRAKFKNDDGEKPIKWRFWRDQKKLKLICLILHLDSVRSIAPRHILPLPSPTK

SEQ ID NO: 162350 - protein, 222 aa, Heterodera glycines
  misc_feature (78)..(78): Xaa can be any naturally occurring amino acid
  Homolog annotation: Hit_ID=NP_490843.1; Match level="QueryCoverage =100%, HitCoverage=43%, E-value=4e-59, Identity=53%"; Hit description= peptidase D, Xaa-Pro dipeptidase (1B816) [Caenorhabditis elegans] gb|AAK18972.1| Hypothetical protein K1
  Gene Ontology: Mol. function=metallocarboxypeptidase D activity; Biological process=amino acid metabolism
  Coding regions on vcDNA: vcDNA=SeqID_88773; Strand=+; Position=30-696
MSFCRAPSTFSVPAQLFVDNRVRLVKALREKLGGAAPGTCVLLQGGKDNPRYNTDTTDSPFRQESYFFWAFGVHEPEXFAAVDVESGKSAIFPPKMSPDSAIWDGKIQPEKWFLDKYKVDHVNFQTNGAEIGQFLHKLFNAKKLLLLKAENTDSGNVLEPAKFPGMDSFSTDLASLYPTMAELRVIKTELELAVLRYASKIANEAHKEVMRHVRPEMYEYQL

SEQ ID NO: 162351 - protein, 132 aa, Heterodera glycines
  Coding regions on vcDNA: vcDNA=SeqID_88774; Strand=+; Position=58-456
NASFEKGIRSKDHHQSHLFLMGVASADDDSVPDPIVIKLGESLSLSQLVQKIEQLQNRTVRELLVTLRRRTYEMPVGPPDPNGDRFFQNGHLLVEDVVYNWVRKTRNSIHGIVQLHVLYEGIAMLDEVNYHF

SEQ ID NO: 162352 - protein, 177 aa, Heterodera glycines
  Coding regions on vcDNA: vcDNA=SeqID_88775; Strand=+; Position=38-571
MDQLEVFLSEHPTVEERELFTTYSLAGRLLRPLLPRDENHRRLVYFTEELNSTDYFFSDGQNGRFCVVSLRLMRADKRQRMREYFNENMAVFSETYDCSFGFHELEAMEWDVAVIKVYREHMARCWNDMMGQLLYVVNMYDRGLDPVDMVRTPSAGESSNNGSDQSDVSHNDPLPSV

SEQ ID NO: 162353 - protein, 139 aa, Heterodera glycines
  Homolog annotation: Hit_ID=NP_501850.1; Match level="QueryCoverage =97%, HitCoverage=57%, E-value=9e-20, Identity=43%"; Hit description =DeHydrogenase, Short chain (26.6 kD) (dhs-12) [Caenorhabditis elegans] emb|CAA93099.1| Hypothetical prote
  Coding regions on vcDNA: vcDNA=SeqID_88776; Strand=+; Position=2-421
DTFLHHFDVNTVGPVMTTAAFLPLLKKAASAGEFARVVNIGSSLGCIGQAAVSPRLSPYQNVAYGMSKAALHHFSKMMALDESDIVTVAIHPGWVKTEMGGANAMMSVSDSVAKIMARICALTKSDSGKLLYREKELLP

SEQ ID NO: 162354 - protein, 189 aa, Heterodera glycines
  misc_feature (122)..(122): Xaa can be any naturally occurring amino acid
  Coding regions on vcDNA: vcDNA=SeqID_88777; Strand=+; Position=3-572
KTKISFAIMANPSKNIAMLREARSSPYIGGGGSVGTLPPDALPASGPMHTRLQRNRRPDSATAPNTARLQNAASAEHFEQLKELIQFSAGSSSSTSLIAAGRHFGTEQSIENYGRLKAESVXQFVGGQRHLSDQQHRSVHFGKSRINHFNDSHRGEHEPNSDGDDQFAFISQAALFRDQFACAGRRCWA

SEQ ID NO: 162355 - protein, 272 aa, Heterodera glycines
  Homolog annotation: Hit_ID=CAE73099.1; Match level="QueryCoverage =94%, HitCoverage=44%, E-value=3e-61, Identity=51%"; Hit description =Hypothetical protein CBG20478 [Caenorhabditis briggsae]
  Gene Ontology: Mol. function=asparagine-tRNA ligase activity; Cellular component=cytoplasm; Biological process=protein biosynthesis
  Coding regions on vcDNA: vcDNA=SeqID_88778; Strand=+; Position=86-901
MAQSAEKIVFVRGADGDDENGDGSEIKPVKTLLQALRLSHGTSEVDFLRVSVSSKEGQKQWEKPSKSAMKKAISRLEEERRKREKATNSAAAKLTEEAKSVAEQQQEMAREKRLEEAKKMQVKLDESLPEAKRTKIRECPALCGQRVKVFAFVHRMRQQRKNLMFLVLRDGSGFLQCVLNGTLCQTFEALTLTTESSVCVFGQINKLPIGKVAPGGIELTADFWELIHGSPPGGVDNVLNVEANVDVKLDNRHLVVRGENCSAILRIRAAVT

SEQ ID NO: 162356 - protein, 171 aa, Heterodera glycines
  Coding regions on vcDNA: vcDNA=SeqID_88779; Strand=+; Position=120-632
MKRTLRKIWICNDVLMDILPFFDHAQLGLKLALISPHFDALVDTHFDGKSDLTIWRRITIWGFGEPKIIVERKSEEFPLPDRPLPSKIHFKDLHIRNICSPVCEFLRSNRHIFDKGINLRLDMDLPASVQRVVSRPDWHFLVQQMLPIFVPNIRHLELIGCGSIDMLFHIS

SEQ ID NO: 162357 - protein, 64 aa, Heterodera glycines
  Coding regions on vcDNA: vcDNA=SeqID_88780; Strand=+; Position=2-196
FAVRPAAAIRPGPKAPSYRPPPGKFAIFMNIYNDPFQWSFVKSALGFCVGICAARILSEELSSV

SEQ ID NO: 162358 - protein, 229 aa, Heterodera glycines
  Homolog annotation: Hit_ID=NP_506318.1; Match level="QueryCoverage =46%, HitCoverage=22%, E-value=4e-37, Identity=64%"; Hit description =cathepsin Z precursor (53.2 kD) (5N863) [Caenorhabditis elegans] emb|CAB03209.1| Hypothetical protein M04
  Gene Ontology: Mol. function=cysteine-type peptidase activity; Cellular component=extracellular space; Biological process =embryogenesis and morphogenesis
  Coding regions on vcDNA: vcDNA=SeqID_88781; Strand=+; Position=28-714
MILQFPFGDFNVLLLLTISTVLLARCLGTIVQFEDELELMENTGTADESADGPLGAFWEWHRMVAGADKFGSISQRMLHLRPSLKVPSVSKRIAFPSTAFPNPNPNNAIPPPNVVRRRAHNIPRDKPPCLRPMDRPFREHRTYPRSWEMPGFEATIPRQWDWRNVSGTNFCSPNRNQHIPVYCGGCWVFGTLGSLQDRFNVARKNRWPMTMLSPQEIIACNGRGSCNGG

SEQ ID NO: 162359 - protein, 142 aa, Heterodera glycines
  Coding regions on vcDNA: vcDNA=SeqID_88782; Strand=-; Position=1-426
NIQKENDFVLISLFLGIERPVFCLDWHGTFTAFHLLPNRLQKLPESPPAPRAADSHCLRCRGAMPTALAEPMPGAASGTTPWALSRGAQEAEGKMIRAMAAATSSRKANIEGNEGRHILLIGRRDILLWIFNDKIRTKIISN

SEQ ID NO: 162360 - protein, 212 aa, Heterodera glycines
  Homolog annotation: Hit_ID=AAG21336.2; Match level="QueryCoverage =100%, HitCoverage=86%, E-value=1e-119, Identity=100%"; Hit description=hypothetical esophageal gland cell secretory protein 6 [Heterodera glycines] sp|Q9BN19|HSP6_HETGL Putat
  Coding regions on vcDNA: vcDNA=SeqID_88783; Strand=+; Position=16-651
MDRRFTVFLVIALVTSIYEVLSNGNLNDGDDSFKQFDELEENPAHKYSKEAQKGFEMEEEEVTIREPSGTKESFKLPINMPPVKFSFCVSCGYRQAYEQFAQILREKYPGIDIHGENYPPGILRTVGAQVIGMVKIALIVCVVSGRSPFPTLGLETPTFFQWMLSNRLSAALMLFLFSNAIEGMLQSTGAFEIYIESERIWSKLESGRVPSP

SEQ ID NO: 162361 - protein, 203 aa, Heterodera glycines
  Coding regions on vcDNA: vcDNA=SeqID_88784; Strand=+; Position=1-609
VQSSFEFKHNFQMTNEITPNTTFGDITSDRVFYRPTFVTGDQMDLSLAALALREGSKSPTESVCSFDLMSAVGEDGEQNIADELASNGTAGEVEEQQQHTKQNNKQNNEKKCFAILKVRPISVNSTAAHCPNLKFEFVSKNTADNGTTQQQQLSTAASSSSSSAAASSADEVPPIAPSVGQMSVDILSRHFGLTWEQLMAQFV

SEQ ID NO: 162362 - protein, 209 aa, Heterodera glycines
  Coding regions on vcDNA: vcDNA=SeqID_88785; Strand=-; Position=9-638
MNSQQLDDLNSCLNQLLRTIKEDTSEFPPSDLLDEIKQCLDFLANSPKILAKQRAEYISLSWPADLRVVLNRLLRTFNIPEEYVKLCFELSYCAAQSLGADWLKSSDKQFLRLLASLSSCRLRILLDKPEEIDMAQLIACLQLQEYFCGCVEDEQIWMSDDDATFVSKCCQEAAALCLFLHSRLCPSIVRHHFANGSFLCPLSFHLCFP

SEQ ID NO: 162363 - protein, 171 aa, Heterodera glycines
  Coding regions on vcDNA: vcDNA=SeqID_88786; Strand=+; Position=40-555
MDYANRHTCCWGPFRTRIETGTTVMALFGFGLGILSAISSYVGFHNIYAGMVYLASSLFYLSVIIAMKKKEPSLFLPYLIFEGIGLLCAAVISLTMFIFGIWSPQQAFSTKEQEMNFRSLMLFFAATVGIDVALNAWFYSIIYRTYNLLKKTTKLVASASAVASARVPPPV

SEQ ID NO: 162364 - protein, 189 aa, Heterodera glycines
  misc_feature (63)..(63): Xaa can be any naturally occurring amino acid
  Homolog annotation: Hit_ID=CAE65012.1; Match level="QueryCoverage =89%, HitCoverage=89%, E-value=2e-40, Identity=49%"; Hit description =Hypothetical protein CBG09850 [Caenorhabditis briggsae]
  Coding regions on vcDNA: vcDNA=SeqID_88787; Strand=+; Position=64-631
MTLRNDTPMPPDEELRVPHEISLSSPWLRAVAVYMGIACEKEAKEFMLLRSERDNDPRKALPXGRAVTACAINFLRKMRRECGDEIRDYANCFHRESGRMHLHQCRRAQFPMDICADEKLGVRRPMVGYFNKLHVHESAVPPPDPLERQKLYRDYKAEAAKLLEELPEDWKTDPKSVQEVPEQLRFRRV

SEQ ID NO: 162365 - protein, 206 aa, Heterodera glycines
  Homolog annotation: Hit_ID=AAM12418.1; Match level="QueryCoverage =85%, HitCoverage=64%, E-value=3e-13, Identity=29%"; Hit description =spliced leader 30 kDa protein [Ascaris suum]
  Coding regions on vcDNA: vcDNA=SeqID_88788; Strand=+; Position=2-619
SDIQKAIQALEREYAEQKELFEKWKEENASEADTEPYNAYVEQFRGWEKDVMDNLKELRASIARQPVAPEPELPMVDLDTQLNNLLDRVDTPQFIMAFMSMSQQDPTFLAKAFEVVMEECRTTGFSNPIMPQSATIPSLRPVHRLPTPLHQQPPGVPSASSSARHQSARSPGSLYLPPPLQPKAYVQGSSLLGPSRPTSTVSYTQI

SEQ ID NO: 162366 - protein, 360 aa, Heterodera glycines
  Homolog annotation: Hit_ID=AAO49799.1; Match level="QueryCoverage =100%, HitCoverage=100%, E-value=0.0, Identity=99%"; Hit description =arginine kinase [Heterodera glycines]
  Gene Ontology: Mol. function=creatine kinase activity; Cellular component=cytoplasm; Biological process=phosphocreatine metabolism
  Coding regions on vcDNA: vcDNA=SeqID_88789; Strand=+; Position=28-1110
MAVPQEVIDKIEAGYKKLQAAADCKSLLKKYLTKDVVDACKDKRTKLGATFLDVIQSGVANLDSGVGVYAPDAEAYTLFKPLFDPIINDYHGGFGPSSKQPATDLGEGKTQLLTDLDPEGKFINSTRVRCGRSLQGYPFNPCLTKENYVEMESKVKAVFEQLKGDAELGGTYYPLQGMTKDVQNQLIADHFLFKEGDRFLQEANACRYWPTGRGIFHNAKKTFLVWVNEEDHLRIISMQNGGNVGQVLERLIKGVKAIESKVPFSRDDRLGWLTFCPTNLGTTVRASVHIRLPKISAKPDFKSICDGLKLQIRGIHGEHSESAGGVYDISNKARLGLTEFEAVKQMYDGVKHLIELEKKA

SEQ ID NO: 162367 - protein, 112 aa, Heterodera glycines
  Homolog annotation: Hit_ID=NP_491624.1; Match level="QueryCoverage =97%, HitCoverage=38%, E-value=5e-26, Identity=48%"; Hit description =ribophorin II (31.1 kD) (1G118) [Caenorhabditis elegans] gb|AAB42275.1| Hypothetical protein M01A10.3 [Ca
  Gene Ontology: Biological process=locomotory behavior
  Coding regions on vcDNA: vcDNA=SeqID_88790; Strand=+; Position=38-376
MSPKSSHVNYDLLPEVSHTFRSPEPRPSVLVSDMFSVLCASPLIILFLLWLRIGINFGKFKFSLSALGFHLGLCAVFGLYVFFWLELNMFQTLKWLAVIGVPTLFLGSRLSF

SEQ ID NO: 162368 - protein, 207 aa, Heterodera glycines
  Homolog annotation: Hit_ID=NP_496985.1; Match level="QueryCoverage =98%, HitCoverage=36%, E-value=4e-99, Identity=56%"; Hit description =trp-asp repeats containing protein (90.1 kD) (2O647) [Caenorhabditis elegans] emb|CAB76722.1| Hypothetica
  Gene Ontology: Mol. function=cleavage/polyadenylation specificity factor activity; Cellular component=nucleoplasm; Biological process =mRNA polyadenylation
  Coding regions on vcDNA: vcDNA=SeqID_88791; Strand=+; Position=1-621
VKLATASDDATARVWDFARCAEERVMRGHGADVRSVDWHPTKGLLATGSRDSQQPVKLWDVKTGQCLATLHDHKNSVMAVQWNRNGNWLLTGSRDHVIKMYDVRMMREIRSFRAHKKEVTSLAWHPVHEGLFVSGGGDGSIGYWLVNSEKELTLLEQAHDMAIWALEWHPLGHILATGSNDNNTKFWARNRPGDTQEDVFGMTSVGG

SEQ ID NO: 162369 - protein, 154 aa, Heterodera glycines
  Homolog annotation: Hit_ID=NP_502555.1; Match level="QueryCoverage =56%, HitCoverage=16%, E-value=5e-12, Identity=35%"; Hit description =calcium binding atopy-related autoantigen 1 like (4O63) [Caenorhabditis elegans] emb|CAC44305.1| Hypothet
  Coding regions on vcDNA: vcDNA=SeqID_88792; Strand=+; Position=111-575
LSDKGTATETEQARIYWPGSGLRTKSEIEEEFKCARDGKYPQENLEDWSITGKRSLTHKALFHYTDRRAGKGYSDFATTLYYGRPYIWPPVREINRWHFFICVTFALVILVDCKWFVSSFELFRPPKSEAATLEGDSVEFEDRKKTSVSTNGQI

SEQ ID NO: 162370 - protein, 215 aa, Heterodera glycines
  Homolog annotation: Hit_ID=EAL49477.1; Match level="QueryCoverage =75%, HitCoverage=9%, E-value=4e-09, Identity=24%"; Hit description =hypothetical protein 42.t00003 [Entamoeba histolytica HM-1:IMSS]
  Coding regions on vcDNA: vcDNA=SeqID_88793; Strand=+; Position=24-668
MEIEENGKATSSEDSNMKWKTEEDNLSGTAEQTNPFDDPVHRTKCLIQYIRLRKQRAEAEQAKRNAIKKQKMTARATLQSAREEKAAAETEERQCAMKIEELNQEKHQVLAALKAIHSRETERKRKREEQERQRRALAEEQRRKEEQRRMAAQQQPQQQQQQQSLAALEYLLQLKNAQLSAIIASATGENTQLGTPAVGGHSLASSLPPSILSLL

SEQ ID NO: 162371 - protein, 239 aa, Heterodera glycines
  misc_feature (100)..(100): Xaa can be any naturally occurring amino acid
  Homolog annotation: Hit_ID=XP_396184.1; Match level="QueryCoverage =96%, HitCoverage=43%, E-value=4e-45, Identity=41%"; Hit description =similar to phosphatidylinositol polyphosphate 5-phosphotase isoform b [Apis mellifera]
  Gene Ontology: Mol. function=inositol-145-trisphosphate 5-phosphatase activity; Cellular component=integral to membrane; Biological process= lipid metabolism
  Coding regions on vcDNA: vcDNA=SeqID_88794; Strand=+; Position=2-720
LKEQQRLRVAFNGFMEQQPSFVPTYKFDPGTHNWDTSEKKRVPAWCDRILYWVKDKNVGIEQVTYESAHQVVLSDHKPVLSTFRVQVKKVDRHEKERNLXSSCCREVDKRQNELLPQITLSNTEFHFSTVLFDQPSLAVLTITNTGQTPTHFSFKPARPEADRLEEWLTITPLSSFIDVGGAVEVTLQILVFDESACKVPKDGAELSSIIIVHLTGGRDYFIVVDAKYQREVKDLISFN

SEQ ID NO: 162372 - protein, 208 aa, Heterodera glycines
  Coding regions on vcDNA: vcDNA=SeqID_88795; Strand=+; Position=1-624
ARQEAHQIRGRIRLLIGDRDLELAANPSPTTNEDVNYGFRFISENNLNADDNQQIPNIIAFGRENGEADDDQNENNSEEGREIEQTQNTTGEEEEEDNATDDNVGMSSTESDGQDKMKANNGKGTCKNEDESKPSPTVETEQNKVHQSASETVISQKANANNSEECKESNGENGTRISMKRQRRSHSVDSSPQQKRVFSRKNFTAEDK

SEQ ID NO: 162373 - protein, 128 aa, Heterodera glycines
  Coding regions on vcDNA: vcDNA=SeqID_88796; Strand=-; Position=2-385
FFFFFFFFFFLMCFFYCAFKKDYICTFFKFIFIKSFKSVVVVVREASLNAVSVRTFKESNKLANSDLSACFHGNSSARVVHILSHHLLRLPSSFVCFNNLNNSHFYNWFAHFGSNLWNSDYERLFFCS

SEQ ID NO: 162374 - protein, 76 aa, Heterodera glycines
  Coding regions on vcDNA: vcDNA=SeqID_88797; Strand=-; Position=145-375
FFFFFFFFLTIQSVYSINKMSTIREGNSVDHSAVSLMANSMRQNVSLRGRVSSKCADFLLSDSTVQQFAFSVFFSL

SEQ ID NO: 162375 - protein, 294 aa, Heterodera glycines
  Coding regions on vcDNA: vcDNA=SeqID_88798; Strand=+; Position=2-883
SKIAGEAVAVGTTVSTGKSLPLPPSTPVSSIQPSGILLNKAGKSADRCSVYPASPAPKVLFHHIAVGPAGAAVSTGNNEFLSELPLVEKKKELLLKEIQNKNEREGVIQKKGPTLPPKPTQSDVTPSKRRTERLLSSTSNSASPISRLSKENADLQAELIKAMYKRRNDSGYDDSEDDSEDDSEDVSLVAMKATESGLDNGNQVKNGVISSKTGAGGASSSQVARVVQGRSSTSNSAPPINAVLNEQINNLLSDIQEGKSLKKTRRWKVKENGEVEFVKETQPSEGDSVKEPQP

SEQ ID NO: 162376 - protein, 72 aa, Heterodera glycines
  Homolog annotation: Hit_ID=CAG85767.1; Match level="QueryCoverage =79%, HitCoverage=100%, E-value=3e-16, Identity=70%"; Hit description= unnamed protein product [Debaryomyces hansenii CBS767] ref|XP _457739.1| unnamed protein product [Debaryom
  Coding regions on vcDNA: vcDNA=SeqID_88799; Strand=+; Position=3-221
SVLPNNHFYPFSHSNMAVTFADFFKVICAIILPPLGVFVETGCSIHLLINIILTILGYIPGIIHALYIIFQY

SEQ ID NO: 162377 - protein, 249 aa, Heterodera glycines
  Homolog annotation: Hit_ID=P27442; Match level="QueryCoverage=100%, HitCoverage=69%, E-value=1e-102, Identity=71%"; Hit description=GMP reductase (Guanosine 5'-monophosphate oxidoreductase) (Guanosine monophosphate reductase) gb|AAA29373.1|
  Gene Ontology: Mol. function=GMP reductase activity
  Coding regions on vcDNA: vcDNA=SeqID_88800; Strand=+; Position=107-853
MPQILDGIKLDFRDVLLMPKRSQLASRSEVDLNREFVFKNSKATYTGIPIIASNMDTVGTFEMAETLSQSNLFTTVHKHYSVEEWKEFANRVRNNSNVLNNIAISSGSRSDDLTKMRDICDAVPEIKFICLDVANGYSETFVDFVRKVREEFRTSTIFAGNVVTKEMVEQLILSGADVVKVGIGPGSVCTTRKQTGVGYPQFSAVLECADAAHGLNGHIISDGGTTCAGDVAKAFGGGADFVMIGGQFA

SEQ ID NO: 162378 - protein, 74 aa, Heterodera glycines
  Coding regions on vcDNA: vcDNA=SeqID_88801; Strand=-; Position=1-222
WNIQYNGIQLRNTYYALYHFIALNVCWHQHHHSSSHSSVLCLSLHDDGTSVLLLLLAMNGDIGTFRGDIVAQFA

SEQ ID NO: 162379 - protein, 203 aa, Heterodera glycines
  Homolog annotation: Hit_ID=CAE64949.1; Match level="QueryCoverage =99%, HitCoverage=99%, E-value=7e-69, Identity=61%"; Hit description =Hypothetical protein CBG09780 [Caenorhabditis briggsae]
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_88802; Strand=+; Position=33-644
MGFSTKPIIIDGKDHLLGRLAAVTSKQLLLGQKIVIVRCESINISGNFHRSKLKFLAFLRKRCNVKPSRGPFHYRAPSRIFWRTVRGMLPHKTARGMEALKKLKCFDGCPQPYDTKKKFVLPNSLRHIALKPRRKYCTVGRLAHEVGWQYQGVVEKLETKRKVRGAAFHEKKKAVLKLKRKAVENAKPKTALFDKILEQYGHA

SEQ ID NO: 162380 - protein, 83 aa, Heterodera glycines
  Coding regions on vcDNA: vcDNA=SeqID_88803; Strand=+; Position=16-267
MKPSFNFKLFASVFLVLCVASLVLCQHKPAAACKPPKNVGRGNLALTRWWWDGRSCKQFTYKGQGGNTNNFPSKKLCDQVCKP

SEQ ID NO: 162381 - protein, 176 aa, Heterodera glycines
  Homolog annotation: Hit_ID=CAE66687.1; Match level="QueryCoverage =93%, HitCoverage=97%, E-value=1e-62, Identity=69%"; Hit description =Hypothetical protein CBG12026 [Caenorhabditis briggsae]
  Gene Ontology: Mol. function=iron ion binding; Cellular component =ferritin complex; Biological process=iron ion homeostasis
  Coding regions on vcDNA: vcDNA=SeqID_88804; Strand=+; Position=54-584
MAQHQESLIRQNFAAETEAGINKQINIELYASYVYLSMSFYFDREDVALHNIAKWFKKQSDEERGHGTTFMKYQNSRGGRIVLQNVQKPEKDEWGSALEAFQAALALEKFNNQSLLELHNLASQQGDSQMCDFLEDKYLREQVESIEEIGKIITNLKRVGKGLGEFLFDKEFAETD

SEQ ID NO: 162382 - protein, 234 aa, Heterodera glycines
  Homolog annotation: Hit_ID=NP_740984.1; Match level="QueryCoverage =80%, HitCoverage=61%, E-value=2e-23, Identity=31%"; Hit description =SH2 motif (2F277) [Caenorhabditis elegans] gb|AAM15611.1| Hypothetical protein T27F7.2c [Caenorhabditis e
  Coding regions on vcDNA: vcDNA=SeqID_88805; Strand=+; Position=92-793
MMTPSTIGFRFRKPRWPLSNLRSSAVSATALTKRSSNQIPQNFRWHLSSPILTLEKSAEDQKKQNECCEISPPNATKNEGEELLYDDRIKEWIYPMDVGPMIEELEKLAYFCRSQEKDSVMNHLREMPVGHFALRLSGTRRRFLALSIRVERDEKNQKGIAHYLVLRNEHGFRIKGSKRYFQSLPMLITHHSVITDQLPCRLLLSDWRWTRGDANQRRRQSSGGSTLAVLRATE

SEQ ID NO: 162383 - protein, 120 aa, Heterodera glycines
  Coding regions on vcDNA: vcDNA=SeqID_88806; Strand=-; Position=2-361
AIRQANRRSLQRGDKSLQTRVTRFENVDTAGVLTLAHDGLVLEVVAQQLDQPAHQCLLTRQVFVQPHVQHLCGLRQHFDDEKRSLRMETDGRRGAKAEQAEPIARRGDGGGTVRQTTLGR

SEQ ID NO: 162384 - protein, 49 aa, Heterodera glycines
  Homolog annotation: Hit_ID=S47538; Match level="QueryCoverage=97%, HitCoverage=13%, E-value=1e-17, Identity=66%"; Hit description =acrosin (EC 3.4.21.10) precursor - rabbit gb|AAA61630.1| preproacrosin prf||2019255A prepro-acrosin sp|P48038|
  Gene Ontology: Mol. function=calcium-dependent phospholipid binding; Cellular component=synaptic junction; Biological process=synaptic vesicle targeting
  Coding regions on vcDNA: vcDNA=SeqID_88807; Strand=+; Position=3-152
PSYGAPEPPSYGAPPPPPPPPPPPPPPPPPPPPPPPPPPPHQPKYPPQQ

SEQ ID NO: 162385 - protein, 219 aa, Heterodera glycines
  Coding regions on vcDNA: vcDNA=SeqID_88808; Strand=+; Position=44-703
EHPLPMDNFKNSANISPVDELSEWKGRALFLEQSVKRLVQENRELRHELGRTKNQVMQCQKDCEEARRQRDREVNKKRTIQQFEEEERRARAIASAAFADPVPLTADERGHAELMKRISPMPMRRIMVSATQNQQKTEAAARVVAAYDRTAMAAPAPQFVQQPRGRTFPTALSVFGECVPNNCRRVGAMPSKNIVGVRLTQQTNSVANASQLKRTFPGK

SEQ ID NO: 162386 - protein, 74 aa, Heterodera glycines
  Homolog annotation: Hit_ID=CAE74333.1; Match level="QueryCoverage =97%, HitCoverage=98%, E-value=9e-17, Identity=60%"; Hit description =Hypothetical protein CBG22046 [Caenorhabditis briggsae]
  Coding regions on vcDNA: vcDNA=SeqID_88809; Strand=+; Position=78-302
MTRGNQRDLARERNLKKQQQQKKQEQGTSTEKRMERDAEAMRLKQQKAAAKKAEEEKANAQAPKVVKVDPLKGL

SEQ ID NO: 162387 - protein, 146 aa, Heterodera glycines
  Coding regions on vcDNA: vcDNA=SeqID_88810; Strand=-; Position=50-490
GRLCIKSTFYKNVGTCLGVFLGTRRSTTTPFHIRAILSCSSASNAPASHTTDICWDWLTTTSSMPADNAVAIVCGVVVPFRIEPVFRNRWCNFFTWSICGGSMPNSARYLRATCAKECVSSNQQTNLTFSSTLSTRAPLLIAARAI

SEQ ID NO: 162388 - protein, 247 aa, Heterodera glycines
  Homolog annotation: Hit_ID=NP_496985.1; Match level="QueryCoverage =64%, HitCoverage=18%, E-value=5e-59, Identity=65%"; Hit description =trp-asp repeats containing protein (90.1 kD) (2O647) [Caenorhabditis elegans] emb|CAB76722.1| Hypothetica
  Gene Ontology: Mol. function=cleavage/polyadenylation specificity factor activity; Cellular component=mRNA cleavage and polyadenylation specificity factor complex; Biological process=mRNA cleavage
  Coding regions on vcDNA: vcDNA=SeqID_88811; Strand=+; Position=89-829
MLVSAPLIQQQQQQQVFQQQRPSTSASSADAVLLPHATEASAPTPYQQQQTEDQLELPTSVPSAADSQRQHRATQQPQRFFKSGSGIRIIDNDLPEGPGRRLRKNVANVRKHIDYIANALNHMEARLWQSPHRRQLRWERPVIQPDILYQSYVLMPKLTPEVPVDCVLSKFVRAAMNKVKCPIYSLCWTPEGKRLITGASSGEFTLWNGTAFNFETILQAHDVAIRAMKWSHNDQWLASADHDGFVK

SEQ ID NO: 162389 - protein, 104 aa, Heterodera glycines
  Homolog annotation: Hit_ID=XP_310658.1; Match level="QueryCoverage =89%, HitCoverage=69%, E-value=6e-30, Identity=67%"; Hit description =ENSANGP00000020734 [Anopheles gambiae]
  Gene Ontology: Biological process=sporulation (sensu Saccharomyces)
  Coding regions on vcDNA: vcDNA=SeqID_88812; Strand=+; Position=16-330
MGSARLGEAQRKQLLEPLLKEGGWQMEQGRDAIKKSFTFRDFNEAFGFMTRVALKADKMDHHPEWFNVYNNVDITLSSHDVQGISERDVALASFVEDVFKAMNL

SEQ ID NO: 162390 - protein, 195 aa, Heterodera glycines
  Coding regions on vcDNA: vcDNA=SeqID_88813; Strand=+; Position=1-588
HKFSRTLLLTKHRIVLAVSDHISIAYIFVSYILYYISLPLIWLFNCMHNWSKPIKTTPYSKRCGLNSSLIGPRDRTPEFNMPSSSDLSRQPISSTPFRFRLNFDDPSAYSDNENRPSPANQTSVSLPDNGCNVSPYARYTGSGDSPTSSRSGNGRKRRPRRGDELFMDRRHLRKSREVEEDELDEVENDYTMGDD

SEQ ID NO: 162391 - protein, 200 aa, Heterodera glycines
  misc_feature (69)..(69): Xaa can be any naturally occurring amino acid
  Homolog annotation: Hit_ID=CAE68081.1; Match level="QueryCoverage =94%, HitCoverage=39%, E-value=6e-73, Identity=66%"; Hit description =Hypothetical protein CBG13714 [Caenorhabditis briggsae]
  Gene Ontology: Mol. function=nicotinic acetylcholine receptor -associated protein activity; Cellular component=membrane; Biological process=synaptic transmission, cholinergic
  Coding regions on vcDNA: vcDNA=SeqID_88814; Strand=+; Position=11-669
IFNPKFDSKFQRYFPYDQQNCTLVISSWTSIDYWPDSETVNLYSFIPNEEWEVMSFKIHRVVEKFVCCXMVNLVLPTSVITLVAVTGFFTPASTSNERREKLSLGIDSLLAMSILMMMVSEQMPTTSEYVPLFGLFYLSIIVIIFSGTLITALVLNVHLQKTYNRPIPPLITFIFFHKIAPWLGIRPSTILLELWQETGV

SEQ ID NO: 162392 - protein, 81 aa, Heterodera glycines
  Coding regions on vcDNA: vcDNA=SeqID_88815; Strand=-; Position=131-376
FIWSRLTTVRSESKSRGEGRGSQVLSDQQLMCGFTVLLLITSDKLQSIPFSNGEHGTTLCQSIRENFKKNRIQRRNGCISL

SEQ ID NO: 162393 - protein, 174 aa, Heterodera glycines
  Coding regions on vcDNA: vcDNA=SeqID_88816; Strand=+; Position=11-535
SDPCQHRDPNCPPCPTKRSPRPTAPSRPRAPRWSASLPLSPAAPPNRCATLPSTCTPGSTRPTRPCKPKLSPTTLTTTRRLPIRSSWLPRPTSSRASLQATCWHSRPSKSACCPSPNPRTCPLPTRTWCASTPMSFTVSAGFPSRSRSVPSAKSRSTRSRATLCISRTFGVSWT

SEQ ID NO: 162394 - protein, 69 aa, Heterodera glycines
  Coding regions on vcDNA: vcDNA=SeqID_88817; Strand=+; Position=46-255
KCLCLWTTTFNNRSRPPLLGRPVTTFSRSSLVASSWRSALAHFVMLDSILFSSNFAGIVFQFSQELFFN

SEQ ID NO: 162395 - protein, 176 aa, Heterodera glycines
  Coding regions on vcDNA: vcDNA=SeqID_88818; Strand=-; Position=95-625
TFPVFGSDQKSNVTLAKRSDWWCCTGSSSKSSSGDCPDKLRSLKHSSAAVADLFGNPLRQFFDGSQPLFQRIEQIGQIRAFRIDFRHFLTKVNRILVTLQRSVRRTERIFNSFFGLADHFLQFTAFALPVFRLLDIVLFQIFSSLFPRIIVRRFLPTFLYLLVLFSVFWSVRVASD

SEQ ID NO: 162396 - protein, 127 aa, Heterodera glycines
  Homolog annotation: Hit_ID=CAE67247.1; Match level="QueryCoverage =71%, HitCoverage=21%, E-value=1e-14, Identity=43%"; Hit description =Hypothetical protein CBG12687 [Caenorhabditis briggsae]
  Gene Ontology: Cellular component=centrosome; Biological process =protein modification
  Coding regions on vcDNA: vcDNA=SeqID_88819; Strand=+; Position=322-702
MDAVHVKEAEAQRDDLAKEALINDAEIKDTKAFIMEKARSFDGIPFTIQRLCELLTSPGKHYHGTGTYLRALEKNINVVTTVTENGMRITGADEEEEAEKDAPIRVESNFIVSVDEMDEPLALKLER

SEQ ID NO: 162397 - protein, 94 aa, Heterodera glycines
  Coding regions on vcDNA: vcDNA=SeqID_88820; Strand=+; Position=24-308
LLALFLIAQKMSLLRFFTASNLMTLILLLLVVLMVQLNESAPADGQGGHLAMVNEAENEADHSLTVLRFKRSCPPPCQEKDCPSPMCALCSFCG

SEQ ID NO: 162398 - protein, 90 aa, Heterodera glycines
  Homolog annotation: Hit_ID=XP_325844.1; Match level="QueryCoverage =84%, HitCoverage=56%, E-value=4e-10, Identity=48%"; Hit description =predicted protein [Neurospora crassa] gb|EAA28659.1| predicted protein [Neurospora crassa]
  Coding regions on vcDNA: vcDNA=SeqID_88821; Strand=+; Position=104-376
MSAIAEKAVKIVHCEEAEVEEVEEVEISDPKEQIAEECRELPSNAPLREALEACTARVEAGAEETCVEEFFKLQKAVDQCTSATLFTKLK

SEQ ID NO: 162399 - protein, 201 aa, Heterodera glycines
  Homolog annotation: Hit_ID=AAP68935.1; Match level="QueryCoverage =98%, HitCoverage=69%, E-value=9e-41, Identity=44%"; Hit description =Aquaporin or aquaglyceroporin related protein 8, isoform b [Caenorhabditis elegans]
  Gene Ontology: Mol. function=transporter activity; Cellular component= integral to plasma membrane; Biological process=transport
  Coding regions on vcDNA: vcDNA=SeqID_88822; Strand=+; Position=2-604
ERLREKLASLIMTENHLLRETLAEFVGTFFLLLNGISANIQSFQAASVHFGPQFTWGLDLAFGVYISAQISGGHLNPAISLVQMANGSISLVRFALYISAQLCAAFLGSAVAFPGHFENCMQIQTRNGNQEFSQLFATFPSTNLSIWGSVADQMISTAILAICISLIMDKRNRVPIGLAPLLAGLSLTMIAMTFDTNGGFA

SEQ ID NO: 162400 - protein, 264 aa, Heterodera glycines
  Homolog annotation: Hit_ID=NP_499013.1; Match level="QueryCoverage =78%, HitCoverage=33%, E-value=2e-63, Identity=56%"; Hit description =acyl-CoA carboxyltransferase (66.5 kD) (3K174) [Caenorhabditis elegans] emb|CAA79618.1| Hypothetical prot
  Gene Ontology: Mol. function=propionyl-CoA carboxylase activity; Cellular component=mitochondrion; Biological process=isoleucine catabolism
  Coding regions on vcDNA: vcDNA=SeqID_88823; Strand=+; Position=9-800
MLIGSLINNKNRQTWQFSSFSSILFNKSRKKQLNFLHLNFLRSTSASSSCVESFPEWRHQNMSNEFSPSNWPILPTTVQPDSEQFKQNEAEMAESISEFKNVVDAVIDGQMVEKTVIERHKNKGKLLARERIEQLIDQGGSFLELSQLTAYKVYGQEKVPAGGVVAGIGPICGRLCVIVANDATVKGGTYYPITVKKHLRAQEIALENCLPCVYLVDSGGANLSRQAEIFADKDNFGRIFFNQAQMSAKGIPQIAVVMGSCTAG

SEQ ID NO: 162401 - protein, 247 aa, Heterodera glycines
  Coding regions on vcDNA: vcDNA=SeqID_88824; Strand=+; Position=16-756
IEMPIFFARPLPAEKKLPILNKTPEPTESQKDTLSDDGQDNQDSGASTSSQTNLIKNVRILRKEAAETSLEPYIQFQCFAHFAISRKCVNELCADVSSDGVDVHIFFEDDFPRLPRIGFSCLSLQELYEDRALLSEKNATPDQLSFIQLVRFVDNGLNEIPNWLLVAPKRGQIFTISLDLADGNGVRVRFSFGSVSPTPWYSVRYPPYKSDFSLVIEVDKKAVLRRSYEESSTLSILSSFGLLERKL

SEQ ID NO: 162402 - protein, 148 aa, Heterodera glycines
  Homolog annotation: Hit_ID=NP_783594.1; Match level="QueryCoverage =71%, HitCoverage=83%, E-value=7e-22, Identity=47%"; Hit description =histone 1, H2ba [Mus musculus] emb|CAI35973.1| OTTMUSP00000000673 [Mus musculus] gb|AAO06249.1| histone p
  Gene Ontology: Mol. function=DNA binding; Cellular component =nucleosome; Biological process=nucleosome assembly
  Coding regions on vcDNA: vcDNA=SeqID_88825; Strand=+; Position=118-564
FLRNRQFAHVQQQRHSQQHRTKMARRRRKKEPRKQSYKLYVRRVLKEVHPGKEISMRALNIMNSFVIDALDRIATEATRMAHNDRRKTITLRDMEFSVRLCLPDVMAKDANQKAQKTVTKFYAAKVRDRMRRTEMRRGEFAMMQMAAL

SEQ ID NO: 162403 - protein, 253 aa, Heterodera glycines
  Coding regions on vcDNA: vcDNA=SeqID_88826; Strand=+; Position=68-826
MSSFGPVLSSFVNSMLSESSSIVDIPSPSPSNGTQTLGTAVNGIGTSHSSTRHDTSSPLVASETFVDDAPDDSDSSSAVFYVRNNGTDGGKQKANKKQKDTFKCANCNINFKSDEMLELHQNNCRRSVLSAPANFCSSLSFCDICNRKFISPRGVALHKGKAHKGESSSKLVKPKNMAKCPIATRAVKRGRPRKVGVVPPTFVDTAKKGRAHSIAAVPPIGHQNLLSGRHRTKPTNAATAQQQPNGNVQIPKL

SEQ ID NO: 162404 - protein, 71 aa, Heterodera glycines
  Coding regions on vcDNA: vcDNA=SeqID_88827; Strand=+; Position=47-262
MKFAPLALLVILLVSLVAAVSANSNNPFDADAADNGGMKRVKRQQQQWRWSPQQQRWVPINIANVNIAQNG

SEQ ID NO: 162405 - protein, 212 aa, Heterodera glycines
  Homolog annotation: Hit_ID=CAE65162.1; Match level="QueryCoverage =56%, HitCoverage=60%, E-value=2e-16, Identity=38%"; Hit description =Hypothetical protein CBG10031 [Caenorhabditis briggsae]
  Coding regions on vcDNA: vcDNA=SeqID_88828; Strand=+; Position=39-677
MSICVDLRLSSADLPVCGRHRRVPSRTLLFFCSIFEALNFWTRLRWVTLLRRRLAIVDGSASFVRLSLRRRRPTSKKATDFHIDKRWDSRLSALVQKVLHVETELWRLSTLGGAVSAMGFFSRKFIRHAFVISIRQLRLAIEIGDPVLISRCFLYISLAFAQKGQFLTALKIVRQEWNRGTELKSAFLLNCTRGVWSTIKWLMMNRKVMMLK

SEQ ID NO: 162406 - protein, 195 aa, Heterodera glycines
  Homolog annotation: Hit_ID=NP_492343.2; Match level="QueryCoverage =100%, HitCoverage=45%, E-value=5e-72, Identity=64%"; Hit description= CYcloPhilin (cyp-14) [Caenorhabditis elegans] emb|CAB10726.2| Hypothetical protein F39H2.2a [Caenorhabdi
  Gene Ontology: Mol. function=neurotransmitter:sodium symporter activity; Cellular component=integral to plasma membrane; Biological process=cell organization and biogenesis
  Coding regions on vcDNA: vcDNA=SeqID_88829; Strand=+; Position=40-624
MAVLIETTLGDLVIDLFVDERPNACKNFLKLCKNKYYNLCQFFTIEPKYIAQTGDPTNSGRRGESIYGTLFGEQARFIEMENVPKLRHSQRGIVSMVNNGDGMVGSQFFVTLGDELDYLDGKHCIFGQVGEGMDTVTKLNEELVDRNNRPYRDIRIAHTIVLEDPFEDPPRLSISRRSPSPTIDLIKLDNQIALD

SEQ ID NO: 162407 - protein, 172 aa, Heterodera glycines
  Homolog annotation: Hit_ID=CAE72446.1; Match level="QueryCoverage =93%, HitCoverage=98%, E-value=6e-51, Identity=60%"; Hit description =Hypothetical protein CBG19616 [Caenorhabditis briggsae]
  Gene Ontology: Mol. function=protein binding; Cellular component =nucleus; Biological process=regulation of mitosis
  Coding regions on vcDNA: vcDNA=SeqID_88830; Strand=+; Position=59-577
MAGEEEEETVVEHPLPKGWEKRMSRSSGREYYFNVFSQKSQWERPTRDAEDTAKKPETVHCYHILVKHERSRNPKSWRSDKVTRSKEDATKTLESYHAELVALDVGERFSRFKKIAQEFSDCSSAKRSGDLGPFGRNKMQKPFEEASFALNVGQMSDIVDTDSGLHLIYRFA

SEQ ID NO: 162408 - protein, 209 aa, Heterodera glycines
  Homolog annotation: Hit_ID=NP_509584.1; Match level="QueryCoverage =91%, HitCoverage=62%, E-value=1e-60, Identity=62%"; Hit description =short dehydrogenase (33.4 kD) (XK51) [Caenorhabditis elegans] emb|CAA86312.1| Hypothetical protein B0272.
  Gene Ontology: Mol. function=enoyl-CoA hydratase activity; Cellular component=mitochondrion; Biological process=growth
  Coding regions on vcDNA: vcDNA=SeqID_88831; Strand=+; Position=18-644
MFSFVKITHRFYSTEPLVKKLTVIGSGLMGAGIAQVSAQANVKVVLVDQSQSIVEKAKSGIENSIKRVAKKQFEDPGKQNELVTRALSNISLSTDISQAVSGADLVIEAISENLDVKRKLFAEVESALPQNGKMATNTSSLTLADIAANLKRKDSFGGLHFFNPVPIMKLLEVVRFDGTSEETFNVLMDFGKTIGKTTVVCKDTPGFIV

SEQ ID NO: 162409 - protein, 303 aa, Heterodera glycines
  misc_feature (213)..(213): Xaa can be any naturally occurring amino acid
  Homolog annotation: Hit_ID=AAH76913.1; Match level="QueryCoverage =87%, HitCoverage=77%, E-value=1e-33, Identity=31%"; Hit description =MGC89088 protein [Xenopus tropicalis] ref|NP_001005045.1| MGC89088 protein [Xenopus tropicalis]
  Gene Ontology: Mol. function=NAD(P)+ transhydrogenase activity; Biological process=carbohydrate metabolism
  Coding regions on vcDNA: vcDNA=SeqID_88832; Strand=+; Position=84-993
MPSSAQRKRAELHWGIIGLGNIANDFVLAMAYCQHPNKVTAVATSNSVERAQQFIQKVGLNSEQVKAYGNYEQLLQDADVDVVYIATINSTHLPLIISALEHHKSVLCEKPMVYSSAELSVVQTVQKTINRREGKKLFVMEGFWSGFFPSWQKIRQTVRDGQMGNPKLVSVDFSQKLPDKRRDLSNGICPLVDIGCYTVDFATFVFEGKKSDXVKVIGDVSAEDGVDNWACIALRFEGGGHSVCHYNGNLSTNSNASVTFENGSVLELPERFWASTDLRSRSELQTHRKGQWHDEHFAFPERK

SEQ ID NO: 162410 - protein, 219 aa, Heterodera glycines
  misc_feature (191)..(191): Xaa can be any naturally occurring amino acid
  Coding regions on vcDNA: vcDNA=SeqID_88833; Strand=+; Position=28-684
MVLASKVQKVINLSSKISSVQNTDHMMQQPTEEQRQRIYQTDKAKSALLHLLLTDCLAKNDETTVFDRFKMLKEENNCKIAPEMFSNLPLARLLVNLEGNDNETRTRVEEVRNLLFRALQVLIDAEITPSDELLYSFEQQKMYEEAKLSGLSTLQWLERQRSLNKRGKKRKQEVDTKASKGRKIRYVEIPXLVNFFPRTPERIAWTHERRDELVQTLFI

SEQ ID NO: 162411 - protein, 189 aa, Heterodera glycines
  Homolog annotation: Hit_ID=XP_422386.1; Match level="QueryCoverage =96%, HitCoverage=54%, E-value=2e-56, Identity=57%"; Hit description =PREDICTED: similar to DnaJ (Hsp40) homolog, subfamily B, member 4; DnaJ-like heat shock protein 40 [Gallu
  Gene Ontology: Mol. function=heat shock protein activity; Cellular component=nucleus; Biological process=response to heat
  Coding regions on vcDNA: vcDNA=SeqID_88834; Strand=+; Position=18-587
MPRQQQRIRQDTAVTHELPISLEDLCKGCTKKMKITKKIVNPDGTSRTEDKVLTINVKPGWKSGTRITFPKEGDVFPNRMPADITFVIKDKPHPKFRRDGSDIRYKQVVPLRDALCGMSIKVPTLEGDIIPLNIKHVTKPGSTQRIHDRGIPNPKTGKRGDLVVEFDVRFPDSIAPAARELIANALPPN

SEQ ID NO: 162412 - protein, 149 aa, Heterodera glycines
  Homolog annotation: Hit_ID=AAS78778.1; Match level="QueryCoverage =99%, HitCoverage=98%, E-value=8e-45, Identity=58%"; Hit description =thioredoxin [Ascaris suum]
  Gene Ontology: Mol. function=thioredoxin reductase (NADPH) activity; Cellular component=nucleus
  Coding regions on vcDNA: vcDNA=SeqID_88835; Strand=+; Position=19-468
MAQLFENIGVRRKVDDKLVNGQEALKGCEVVALYFSAHWCPPCRNFTPVLKKFYDELKKSPETAPFEIVFVSFDRSADDLSNYLRESHGDWLYIPLGSEHIETLSKKFGISGIPALVVLKQDGTLVTKDGRADVQNLSPSNAMAKWRSG

SEQ ID NO: 162413 - protein, 201 aa, Heterodera glycines
  Homolog annotation: Hit_ID=CAE67084.1; Match level="QueryCoverage =77%, HitCoverage=58%, E-value=2e-32, Identity=45%"; Hit description =Hypothetical protein CBG12495 [Caenorhabditis briggsae]
  Coding regions on vcDNA: vcDNA=SeqID_88836; Strand=+; Position=43-645
MFSHSPSSLLPHPSSIHPSGITTAGASNNTLSSENFFEDEERPEENIYERHFAQQQMTKEETRLVELQKRKEKAMEKADATQQIAQDINDLNQIMQDLAQLVHEQHDMVDSIEDHVERSMQEVKSGERNLRRAVASNSAKYPVAAAAVGGAVMGGPVGIAAGSLVAGIAAAVGGAFAGLYGGRVLQRKVKQSTAVDSQQSV

SEQ ID NO: 162414 - protein, 166 aa, Heterodera glycines
  Coding regions on vcDNA: vcDNA=SeqID_88837; Strand=+; Position=28-528
MKKHVTFTPSIGDDVHSTNVSSVAESEFSVKERAEVPEIFKKLADDAFQILPLPDIDPTVTSTPAVVNNLIEAVESLDSRMPLAFQEQQQILKMQGEMLQLGVSCKEHYKKIHEQSVMRYNLEKSVNKNIDDLKEGAVVAQKLVKAKSAYEEMVAKAEALLAKANK

SEQ ID NO: 162415 - protein, 174 aa, Heterodera glycines
  Coding regions on vcDNA: vcDNA=SeqID_88838; Strand=-; Position=190-714
MAMSPSLAKGPTQPTKWHEGAAILSRSAPPMKNAAGFISASPFAASPKTSVAVGRCARCVPTAAAAPLILRAKESVGGKSRPMPCCCCCFCCCPISRHSSSSAFNEMILASAVSFGTTAGGDGFFTRRNPFSTNAFCSEGSKAKGAAPPAASLSFRCASSAAEKASICIMRCCC

SEQ ID NO: 162416 - protein, 78 aa, Heterodera glycines
  Coding regions on vcDNA: vcDNA=SeqID_88839; Strand=+; Position=84-317
KMDRDLVPRFTFSGTPGPGILSKKTVDLNHESRQNPGPYKPNLSAFFGFSPVFIWSIRFVQSLIKRIKQYPKIMGNCN

SEQ ID NO: 162417 - protein, 216 aa, Heterodera glycines
  Homolog annotation: Hit_ID=XP_456171.1; Match level="QueryCoverage =40%, HitCoverage=38%, E-value=4e-14, Identity=47%"; Hit description =unnamed protein product [Kluyveromyces lactis] emb|CAG98879.1| unnamed protein product [Kluyveromyces lac
  Gene Ontology: Mol. function=protein binding; Cellular component=DNA -directed RNA polymerase II, core complex; Biological process =regulation of transcription, DNA-dependent
  Coding regions on vcDNA: vcDNA=SeqID_88840; Strand=+; Position=13-660
MVAANLKLSLIFVAGFCLLFIADSDAGKSCKPGEKGPPGPPGKPGNKGKPGVCKPKYETTSKYGTTTSKYDTTTSKYGTTTPEYDTTTSKYDTTTSKYDTTTSDYGTTTSKYDTTTSKYDTTTSKYDTTTSKYGTTTQKYRGKRFADAVLVRAARAEYDADCPAGPPGDAGIAGPPGPPGEPGKCYGSGSKESKEKEYKPSKRSIDNFEHGLRVAR

SEQ ID NO: 162418 - protein, 92 aa, Heterodera glycines
  Coding regions on vcDNA: vcDNA=SeqID_88841; Strand=-; Position=25-303
MIGRAVRNRPFIFEGIFKFILYPRKMAISFFEKFYTSQKRLRMRRRAVLNRHFISQRIFIFRGYPRKMAISFFDKFYTHTNALEHDREGGAQ

SEQ ID NO: 162419 - protein, 203 aa, Heterodera glycines
  Coding regions on vcDNA: vcDNA=SeqID_88842; Strand=+; Position=1-609
VFMPLHFKRRRNIDDLLKEHLIFKRSINQNTSFRLEAAIGSDSLHDRKIRFEESTNSLEENELVNFDGVVVLEGMDAFTGTTSGVLKGLCFSNSSFLNYRTAQLSSSADFSICSVSDEQNQPTKALPSAVTAMSFSGADQMEVLVGRENGRVDHFNSLTDQFNALFALPQPSELKGIHRIDGDRILTAQECGTLAVWSASGER

SEQ ID NO: 162420 - protein, 202 aa, Heterodera glycines
  misc_feature (195)..(195): Xaa can be any naturally occurring amino acid
  Homolog annotation: Hit_ID=NP_495449.1; Match level="QueryCoverage =67%, HitCoverage=34%, E-value=9e-51, Identity=67%"; Hit description =cystathionine gamma-lyase (43.1 kD) (2H346) [Caenorhabditis elegans] gb|AAB93432.1| Hypothetical protein
  Gene Ontology: Biological process=cysteine metabolism
  Coding regions on vcDNA: vcDNA=SeqID_88843; Strand=+; Position=25-631
MPCSLATQSSVLKRRAPASPQQAKMHDKKRHFDESANNGQEKADKVPSKGDKVSPTNEEKKKNVAFATLAIHAGNEPEKWDMNQVVPPISLATTYKQQFAGMPKGHDYARGGNPTRDVLQQSIAALENARHCRVFSSGLSATAAMANWLHSGDHIIASDDGYGGTQRYFRQISVQHHGMELSFVDLTKLSNLEEXFKPNTKM

SEQ ID NO: 162421 - protein, 217 aa, Heterodera glycines
  Homolog annotation: Hit_ID=NP_497058.1; Match level="QueryCoverage =59%, HitCoverage=33%, E-value=4e-22, Identity=43%"; Hit description =gluconokinase like (43.8 kD) (2P34) [Caenorhabditis elegans] emb|CAA21676.1| Hypothetical protein Y54E2A.
  Coding regions on vcDNA: vcDNA=SeqID_88844; Strand=+; Position=45-695
MYKIVQRKERNADGTAKTDAEPFATPSTSTVVPLVRIAKAPHRKANDTTVANVPAEVPTSNTSADGLSSAALNTVRTEIAKSGGVPSPAAKQSAKDAGATTDQAQMDASIRLIDDEMELIDAVKDFLIESNTKYSVIGAIGAQGTGKSTILSMLAGNNPVDMYRQYIFRPAAREAVEACRYQTTKVSVYVVPKLRTFFLDCQPLNCAPLLEDFLRAR

SEQ ID NO: 162422 - protein, 144 aa, Heterodera glycines
  Coding regions on vcDNA: vcDNA=SeqID_88845; Strand=-; Position=130-564
YKLQTSFSKSYYQVQKNMLIIVRNGTGRLFALGQLYLVVGMMAFSVCWCSTVSPFPLDDRRLNEPRLGGGRLSVVEESPRRGTHTPPMQQQTPNEDDDHQKEYHSNGGNCFAFHSIVHFAESENMRVERMQTAITVKVLWTSTT

SEQ ID NO: 162423 - protein, 292 aa, Heterodera glycines
  Homolog annotation: Hit_ID=NP_495986.2; Match level="QueryCoverage =94%, HitCoverage=29%, E-value=1e-83, Identity=54%"; Hit description =MGM mammalian dynamin-like protein, EATing: abnormal pharyngeal pumping EAT-3 (eat-3) [Caenorhabditis ele
  Gene Ontology: Mol. function=GTP binding; Cellular component =mitochondrion
  Coding regions on vcDNA: vcDNA=SeqID_88846; Strand=+; Position=3-881
QTLKSNRTHGSQKSPDGGNLLKALKAAVVSAVLEQHRWDSKALDYLRVIQLNAVADQVVPDRRAWDQSCAFLANAASDRIRELKKTLEESRGPSGWSRWFGWSSPTPEQLVNQTVQDELRALLVNNPEHKQSLLDDDLTVIRRNLETRNLPGPNELSAEMIRQQWRLIYRKHFLERMLQAGHDCQSFYQNYKLGVRSEDSDLDCQAVVFFYRINRMLDLSCNALRQQIVNTEQRRLEKEVKEVLNDWSADTDKKKQYLTGRQVELAEELAHVRFIQEKLEEFIIQLHQEKPW

SEQ ID NO: 162424 - protein, 264 aa, Heterodera glycines
  misc_feature (257)..(257): Xaa can be any naturally occurring amino acid
  Homolog annotation: Hit_ID=CAE74344.1; Match level="QueryCoverage =98%, HitCoverage=23%, E-value=2e-36, Identity=34%"; Hit description =Hypothetical protein CBG22062 [Caenorhabditis briggsae]
  Gene Ontology: Cellular component=nuclear pore; Biological process =protein-nucleus import
  Coding regions on vcDNA: vcDNA=SeqID_88847; Strand=+; Position=19-810
MVDAQHFTQLLIGMMNSENEIRSEAEKQYEAIALKDKGPLLFKHYLISSADVESRSLALVLLRRLLSNSYEEFFTETQIQKDQFHNEFIVCINGETEPVLRKRLTDLLAELARNSIDDKTGKQTWTGIMQFLDMCATSDNPTFREAGMSLIESVPNVFGSDSFKYIAGIKTMFHSSLLYGADSSVRTAAVRAYVAFVCDNEENDAVIRQLSDLVPAVIKVCQHVVDTEDDDDVPLQCLGDLASTLPKILAPHMSDIXSLCAGTV

SEQ ID NO: 162425 - protein, 32 aa, Heterodera glycines
  Coding regions on vcDNA: vcDNA=SeqID_88848; Strand=-; Position=21-119
FLVKNFPKHFLSKKGIKKFIYIIILFLFLLIF

SEQ ID NO: 162426 - protein, 126 aa, Heterodera glycines
  misc_feature (9)..(10): Xaa can be any naturally occurring amino acid
  Coding regions on vcDNA: vcDNA=SeqID_88849; Strand=-; Position=14-394
FFFFFFFFXXNVLFLLRFQKGWHTFFKFIFIKSFKSVVVVVREASLNVSFVRTIKETNKLANSDLSACFHGNSSARVVHILSHHLLRLPSSFVCFNNLNNTHNFNWVAHFWSNLCASMNVSVFCLY

SEQ ID NO: 162427 - protein, 261 aa, Heterodera glycines
  Homolog annotation: Hit_ID=NP_001002205.1; Match level="QueryCoverage= 96%, HitCoverage=77%, E-value=1e-70, Identity=57%"; Hit description =dehydrogenase/reductase (SDR family) member 1 [Danio rerio] gb|AAH72703.1| Dehydrogenase/reductase (SD
  Gene Ontology: Cellular component=mitochondrion
  Coding regions on vcDNA: vcDNA=SeqID_88850; Strand=+; Position=23-805
MASAVRALEGKIAVVTGASRGIGRGIALQLGQAGATVYVTGRAPAASYSLIEKGLPSLEQTAKEIKSRGGEAHPVYCDHANSDDVRRLFKRVEEEQNGRLHILVNNAYSGVPSLIENAGKKFWECEPEFWDDINEVGLRNVYFCSTLAARLMVPHEDGLIVHISSAGGLQYLFSVPYGVGKAAVDRMASDMGLELKSRGVAVISLWPGFVQTEITTMGEKAEQFASAARMSMDAFNAALKGAETPEFVGKAIVGLATDRQR

SEQ ID NO: 162428 - protein, 111 aa, Heterodera glycines
  Coding regions on vcDNA: vcDNA=SeqID_88851; Strand=-; Position=447-782
LCGTLCSVGPSLHRPSIFRPPLSPLPPPFPPFPPVLPASFPIPSPVEFDRSNQFPTVRAPSVMSFPLPYGDFSLSPILLAVSPISTQIPIYRPPFCPTPCAISSHFLRSFH

SEQ ID NO: 162429 - protein, 93 aa, Heterodera glycines
  Coding regions on vcDNA: vcDNA=SeqID_88852; Strand=-; Position=11-292
FTILYSSWVRVGVQIRRPCPCVHQSPSMPIPPSIRLFCRRSRSHSHSHSHNAFDEVQHFQFDCPLLAWQLLMTSKWKLSAEEQEWWTKKTFSV

SEQ ID NO: 162430 - protein, 164 aa, Heterodera glycines
  Coding regions on vcDNA: vcDNA=SeqID_88853; Strand=+; Position=158-649
MIGTYEKRRHSELPPHLQHKFSLPHNDPSIAAAAAEGARMGVEGAKLGPLSHQMIPPRKESAKQMSSGGAQVFLCILGVVLSVCVSLWTAMFSKDSLPRRISISAVAGVCSLIFALLAYAAFKKRTIKTPLDDVEISQSILREHRKSMTNSLRKSTTNGDDLIG

SEQ ID NO: 162431 - protein, 134 aa, Heterodera glycines
  Homolog annotation: Hit_ID=CAE58515.1; Match level="QueryCoverage =85%, HitCoverage=33%, E-value=5e-10, Identity=33%"; Hit description =Hypothetical protein CBG01666 [Caenorhabditis briggsae]
  Coding regions on vcDNA: vcDNA=SeqID_88854; Strand=+; Position=3-407
EVGYALDCVRKAPGNESVWSYLSGILINEPLGTDRPEIVHCCDELLARQPPCNSSHLFQFLIDKIADKMRENAVANEQQLTEMAQKSGEYLDVLERIDPIRHNFWKYRRAQLQTLADSVKFNSSNSASAAAASA

SEQ ID NO: 162432 - protein, 115 aa, Heterodera glycines; identical to SEQ ID NO: 150586
  Homolog annotation: Hit_ID=AAO24602.1; Match level="QueryCoverage =88%, HitCoverage=72%, E-value=2e-20, Identity=49%"; Hit description =histone H3 variant [Trypanosoma brucei brucei] gb|AAO24601.1| histone H3 variant [Trypanosoma brucei bruce
  Gene Ontology: Mol. function=DNA binding; Cellular component =nucleosome; Biological process=establishment and/or maintenance of chromatin architecture
  Coding regions on vcDNA: vcDNA=SeqID_88855; Strand=+; Position=37-384

SEQ ID NO: 162433 - protein, 237 aa, Heterodera glycines
  Homolog annotation: Hit_ID=NP_506715.1; Match level="QueryCoverage =100%, HitCoverage=68%, E-value=9e-70, Identity=54%"; Hit description= AHA1 activator of heat shock 90kDa protein ATPase homolog 1 (38.6 kD) (5P564) [Caenorhabditis elegans] e
  Gene Ontology: Mol. function=chaperone activator activity; Cellular component=cytoplasm; Biological process=protein folding
  Coding regions on vcDNA: vcDNA=SeqID_88856; Strand=+; Position=95-805
MAKWGEGDPRWIVEERPDATNVNNWHWVEKNATPWSRERLRVLLLGQTLEKGPVRIEFSDFKKLEGEATANNRKAKLIFFFEWSIDVNFIATVSGSETEYKGSVEILNLSDENEAHEIEISVHIETAGPHENEIRHILSTDGLSFVRSKVGTYVRELKEEFSKGIILPVDSKGAIRPQAVATQGKTVVDKRRFQNDKTEEKVTTAETQNALKTGGFELTETFKVPPERLFEILTASE

SEQ ID NO: 162434 - protein, 319 aa, Heterodera glycines
  misc_feature (184)..(184): Xaa can be any naturally occurring amino acid
  Homolog annotation: Hit_ID=CAE61890.1; Match level="QueryCoverage =86%, HitCoverage=93%, E-value=1e-39, Identity=37%"; Hit description =Hypothetical protein CBG05881 [Caenorhabditis briggsae]
  Gene Ontology: Mol. function=pyrroline 5-carboxylate reductase activity; Biological process=proline biosynthesis
  Coding regions on vcDNA: vcDNA=SeqID_88857; Strand=+; Position=56-1016
MLQETEAKSDSSKAPNEVALSSEGRISKLYVECFNEREKCLTVIGGGKMATALVHGLVSAGFIDKSEVNICSRSKETAFRWTTQGYQNAYTNDEFYSKVKKPRGIVIVAVKPQIFPGFLDELRKNGWLNFVGPEVLCVSIMAGIALDTFKQQLKLVGFNGHAARFMPNVNCLVSAGIVLVCADXVFRRRWFSRNCSSYQIHAIFRIDESLFDAASALASCAPAYMFTVIEALADGGVLNGLSREMSVRLAAEMVKGSAQLMLKSPEVTSPAQLKDRVCSPAGTTIAGLRELECSGVRSAFIEALSASTRRATEMAPKTN

SEQ ID NO: 162435 - protein, 237 aa, Heterodera glycines
  Homolog annotation: Hit_ID=NP_509222.2; Match level="QueryCoverage =74%, HitCoverage=41%, E-value=2e-26, Identity=39%"; Hit description =putative protein family member (49.4 kD) (XH885) [Caenorhabditis elegans] gb|AAB37021.2| Hypothetical pro
  Coding regions on vcDNA: vcDNA=SeqID_88858; Strand=+; Position=21-734
MKPQEFSGADNEQPSPSRHSIIGVKRKFSSIDYASSNSPVKVLPSFTSTFLPDLSNAQVLKPKPTNVDRLPLSNEEFITPTQPKKQQSRPNSPANGVSKLILPRSRVASIRRESDCNSEKGFGEAEAAHEKMVKSAQQVAMGFEDFCLDDKAFEERKRAKSLSEPICIFTNAFLPQCSSPSPSRGSMDGQKQCYSPSAQQVVRSNLAYSPSPSPTPSGTQSMHRMRSCESQTHLPDD

SEQ ID NO: 162436 - protein, 397 aa, Heterodera glycines
  Homolog annotation: Hit_ID=NP_496280.1; Match level="QueryCoverage =87%, HitCoverage=91%, E-value=1e-82, Identity=46%"; Hit description =mammalian cell Death Associated Protein related (42.8 kD) (dap-3) [Caenorhabditis elegans] emb|CAB60994.1
  Gene Ontology: Mol. function=apoptosis regulator activity; Cellular component=mitochondrial matrix; Biological process=apoptotic mitochondrial changes
  Coding regions on vcDNA: vcDNA=SeqID_88859; Strand=+; Position=43-1233
MLCLRRVLSNGHSFVFSVSSECRSTYLTTSSNDPSEFTADDVGKLYKVPSNLMNVLNVRRKMPEFFVRQLDTLRECVWLYRQQTQEAFHCLHEVDLAHRPALRLVLWGHFGTGKTITLSQLNHLAINKGYIIFGVKDALRWSRDNYRPVQLSTYKPGRLDSPWWAVRLLTAFKVENGHAWKKLAELKTTKDYEWTKVEKTPKRKPLTDIVEMGLTAPALSTDCVGALCRELRAHASAGSIKLLVTIDKANGLFSEKCAVKWPTDRRKATPDELSLNIFIRKFLMPIWSNGLCAMIADKAVVSDARDHLSVSPLDPRSLFGERGYEQIEPFVSVESQHYSEAEFNVIHDYYLEKNWIRQKKGPEGEEAKRQMMYLSAFNPSHYERLCSFSWNLSCSVP

SEQ ID NO: 162437 - protein, 246 aa, Heterodera glycines
  Homolog annotation: Hit_ID=CAF99886.1; Match level="QueryCoverage =99%, HitCoverage=97%, E-value=2e-49, Identity=44%"; Hit description =unnamed protein product [Tetraodon nigroviridis]
  Gene Ontology: Cellular component=nucleus
  Coding regions on vcDNA: vcDNA=SeqID_88860; Strand=+; Position=60-797
MEERIKTELRGRQPSEVQDLLLDSCKANTISGLTEQFTSLTTLSLINVGLTTLDGLPKLPTLRTIDLSDNKLSGGLDKLVECCPRLYHINLCANKITSMEALAPLSKLEELAALDLFDCAITEGPEYRSKVFAMIPQLKYLDGFDINDVEAEISDEEEEEGAEDALEDEDDSEEEEEGVDTDDEAALAYLNSSKALNDEDESEDYVEQRKKPNDTAKEATNGEQKANANKNSGDNRKRKLSDNGEA

SEQ ID NO: 162438 - protein, 73 aa, Heterodera glycines
  Coding regions on vcDNA: vcDNA=SeqID_88861; Strand=+; Position=16-237
MKLTIFAILFVALFIAIAEADGNVRAKRHEERLKRQDNRADEENRQVDSADREKRQDNRADREKRQDNRAIMY

SEQ ID NO: 162439 - protein, 196 aa, Heterodera glycines
  Coding regions on vcDNA: vcDNA=SeqID_88862; Strand=+; Position=3-590
DTNKSMKFDKNNKMNAPKRHNSVSFTDPSILPTECQNRTKWRSYSTNFQSNCHPHGSLLSFVMRHKVKNGGPSREAAMFAVPSSIPSLPMAILQAMIAPNLKKGHSSGTFSLDGEGPSVFSSVCSSSVSTTGAQSNAFGRTSECQLGTTPNRSSDDFCVCPSPWKYAQSEEKETNGYLFILHSNWALQKERMENRR

SEQ ID NO: 162440 - protein, 150 aa, Heterodera glycines
  Coding regions on vcDNA: vcDNA=SeqID_88863; Strand=+; Position=38-490
MDEDEKDPDTYGNWQYEEKPCACHCSYLRAKKFYRVDCDFMDRTTKIVLDAFLSDTALSGLDITHTALEVHYECILCLEIAYKTYEIVCEDETSDRWGRYMTTYGDEPIVGIRTTDFDGIQRVFDGMWKDYNLIVSNCKHWTDDMIRRLS

SEQ ID NO: 162441 - protein, 188 aa, Heterodera glycines
  Homolog annotation: Hit_ID=NP_498935.1; Match level="QueryCoverage =89%, HitCoverage=90%, E-value=4e-19, Identity=32%"; Hit description =single-strand binding protein like (3J859) [Caenorhabditis elegans] gb|AAA50616.1| Hypothetical protein P
  Coding regions on vcDNA: vcDNA=SeqID_88864; Strand=+; Position=50-616
MLLSSNFVGVGRVASRAVHRFFLSTSAVRLQQQHKEEENMDIENLFSEQQNLPQSQSEDQPQVFDAPKRRFNKGINRVELLGGVGSQPLVKQTAQGSAFASFNLYTNVERRLGDGTTTTNTEVHSVVAFGSMAKYVEKNVERGTRVYLTGRLHYTGGALFPDGTRSPRICSVNLESIYPLSKQGAILR

SEQ ID NO: 162442 - protein, 145 aa, Heterodera glycines
  Homolog annotation: Hit_ID=NP_497826.1; Match level="QueryCoverage =98%, HitCoverage=99%, E-value=2e-34, Identity=53%"; Hit description =ethanol induced 6 like (15.4 kD) (3F241) [Caenorhabditis elegans] emb|CAA86749.1| Hypothetical protein C1
  Coding regions on vcDNA: vcDNA=SeqID_88865; Strand=+; Position=45-482
MVRRGGRSSSPKASAPVRSVKSTSPARSAVPSRPAGTQPTSGATAPQQKGPGLLGQMAATAGGVAIGSAMGHAIGNMFSGGNAQEVAAQQDVPANSDNFETTKQYSQPCEIEWRQFLECSQNQSDVSICQGFNDLFKECKARFGR

SEQ ID NO: 162443 - protein, 200 aa, Heterodera glycines
  misc_feature (179)..(179): Xaa can be any naturally occurring amino acid
  Homolog annotation: Hit_ID=BAB63445.1; Match level="QueryCoverage =99%, HitCoverage=99%, E-value=1e-104, Identity=97%"; Hit description= ubiquitin 4 [Physarum polycephalum] dbj|BAB87826.1| polyubiquitin [Physarum polycephalum]
  Coding regions on vcDNA: vcDNA=SeqID_88866; Strand=+; Position=1-604
KIQDKEGIPPDQQRLIFAGKQLEDGRTLSDYNIQKESTLHLVLRLRGGMQIFVKTLTGKTITLEVESSDTIDSVKTKIQDKEGIPPDQQRLIFAGKQLEDGRTLSDYNIQKESTLHLVLRLRGGMQIFVKTLTGKTITLEVESSDTIDSVKTKIQDKEGIPPDQQRLIFAGKQLEDGRXSDYNIQKESTLHLVLRLRGGQ

SEQ ID NO: 162444 - protein, 104 aa, Heterodera glycines
  Homolog annotation: Hit_ID=NP_038927.1; Match level="QueryCoverage =81%, HitCoverage=94%, E-value=5e-25, Identity=57%"; Hit description =translocase of inner mitochondrial membrane 13 homolog a [Mus musculus] gb|AAD39996.1| small zinc finger-
  Coding regions on vcDNA: vcDNA=SeqID_88867; Strand=+; Position=7-321
MASSSNAQQAAALQMVADLEIEMMTDMYRRMTKSCQEKCVDTHYREADLTKGESVCLDRCVSKYLEVHDRLGKLLTQMTQQDDRAVQQQQQNLAAAAQKMHINK

SEQ ID NO: 162445 - protein, 315 aa, Heterodera glycines
  Homolog annotation: Hit_ID=NP_955005.1; Match level="QueryCoverage =78%, HitCoverage=73%, E-value=1e-51, Identity=42%"; Hit description =shadow of prion protein [Mus musculus] gb|AAH27306.1| Gene model 169 [Mus musculus]
  Gene Ontology: Mol. function=GTPase activity; Cellular component =mitochondrion; Biological process=G-protein coupled receptor protein signaling pathway
  Coding regions on vcDNA: vcDNA=SeqID_88868; Strand=+; Position=18-962
MTFPRNSLLRSPRIRPNLLNFSACFSSPSDGSAPRLEGSSPPPLASSIRFPHFVSRQKFTLSSTYEKQDWFPKHMGVQLKVMEGKLRTVDLVIEVHDARVALTGRNPSFGAKLYSVRPHILVFNKMDLINMKRYKEPIEEYYRNEQNITNICWTNCKNLTNKTQFQNLMDKMLDLLRNEHRFNRTVKTEYQVMVVGIPNTGKSSLINALRNVNLDFGKAVKEGARPGVTIRVQNRVRILDRPPTYLMDTPGVLNPWANNIDAAMKLAICNLVLDTTTRPNFVADYLLYFMNKYRDFSYVDFLRIREPSDDIKQVL

SEQ ID NO: 162446 - protein, 244 aa, Heterodera glycines
  Homolog annotation: Hit_ID=JW0076; Match level="QueryCoverage=78%, HitCoverage=45%, E-value=2e-26, Identity=32%"; Hit description =sorbitol oxidase (EC 1.-.-.-) - Streptomyces sp dbj|BAA19135.1| sorbitol oxidase [Streptomyces sp.]
  Gene Ontology: Biological process=carbohydrate metabolism
  Coding regions on vcDNA: vcDNA=SeqID_88869; Strand=+; Position=56-787
MQFLCHFICVVKMQQLLFFLLLVADISHGKGQKEEKSEAKCDEKNNNEAIRLHNWGGNFKFCTQNVEYPRTTAEVQQIVRRAQKLRVFGSRHSYNKIADSCGTLLSTLGMNSIIAINGSRPTVTVQPGITYTDLAPTLYANNFALPTLAAIAEITVAGATQTCAHGSGLPNSNLATQVRSMRIVLANGTEASFGPESAELHAVACGLGAFGVITEVKLNLVPTFDTISYNFVSSPTESLYSHFD

SEQ ID NO: 162447 - protein, 215 aa, Heterodera glycines
  Coding regions on vcDNA: vcDNA=SeqID_88870; Strand=+; Position=1-645
ILHPRVIEWEKMVRGLINKSREEQVEQQQEVIRSLQEENRSLKTLFRRVCAHSNTISSALLMFAEDHPDTFLQHPILLPQQQNVPTPSQLQLLPTRHDNTSFSDSWPILGGASQSLTMRASETFRKTTHPPPNLGLHLFGIQEEAIIPGGTVAVTKDAEVTPARKGKPSPKKHRPFRNVFKALGDGVSKLKFSTRKRPEKQQHGTTLSGTDQRRP

SEQ ID NO: 162448 - protein, 173 aa, Heterodera glycines
  Homolog annotation: Hit_ID=NP_501223.1; Match level="QueryCoverage =97%, HitCoverage=53%, E-value=1e-68, Identity=73%"; Hit description =mitochondrial carrier protein family, embryonic tissue differentiation factor, DIFferentiation abnormal D
  Gene Ontology: Mol. function=lipid transporter activity; Cellular component=integral to membrane; Biological process=transport
  Coding regions on vcDNA: vcDNA=SeqID_88871; Strand=+; Position=86-604
MSDTNVVTNFIAGGVGGSCAVITGHPFDTVKVRLQTMPKPAPGQPPLFTGALDCVRQTVAREGFFALYKGMAAPLVGVSPLFAVFFGGTALGKWLLQNEPGQQLDFKQNFTAGAIAGVFTTAVMVPGERIKCILQVQSMDGSAGTTPKYTGPVDVVRKLYREGGIRSIYRGTA

SEQ ID NO: 162449 - protein, 343 aa, Heterodera glycines
  Homolog annotation: Hit_ID=NP_499865.1; Match level="QueryCoverage =95%, HitCoverage=79%, E-value=5e-91, Identity=53%"; Hit description =cancer-associated gene protein like (41.3 kD) (4A872) [Caenorhabditis elegans] gb|AAC19193.1| Hypothetica
  Coding regions on vcDNA: vcDNA=SeqID_88872; Strand=+; Position=6-1034
MVECSDCSVGVAKVKTAKDGLPRCSDCFIRWFEKDVHEAIERMAIFTPGDRIGIGVSGGKDSTVLAHVLSRLNKRHSYGLQLVLLCVDEGIKGYRDDSIREVQKNEADLSLPLTITSYRDLYGWTMDEIVAKIGRRNNCTFCGVFRRQALDRAALRAGCNKLATGHNADDAAETVLMNFLRGDIGRLQRMGAAARQPTDKATTKQLGNNSDDSGTTSAVAAAETGDDESLPRVKPMKYAYEKDIVIYAHFGKLNYFSTECIYAPNAYRSNVRSFVKELEKSEASGILDLGLLGESTRLKAHVLQPNWGNGDRWGYHAKPKFCRGGQPLDGLNVKRGPPPKQGQ

SEQ ID NO: 162450 - protein, 259 aa, Heterodera glycines
  Homolog annotation: Hit_ID=NP_503731.1; Match level="QueryCoverage =55%, HitCoverage=46%, E-value=1e-53, Identity=62%"; Hit description =zinc finger like protein 1 (34.8 kD) (5D177) [Caenorhabditis elegans] gb|AAF60574.1| Hypothetical protein
  Gene Ontology: Mol. function=zinc ion binding
  Coding regions on vcDNA: vcDNA=SeqID_88873; Strand=+; Position=7-783
MGLCKCPKRKVTNLFCFEHRVNVCEFCLLSNHESCVVQTYLSWLTDSDYDANCLLCFESLSSKETLRLRCLHLFHWDCFDSRARQLPQTTAPAGYKCPSCLECIFPSENQSSPVVDKLRAKLQTVNWGRFGLGLPSIPENEQKVLAAKVIEIASNSNHRSDENVSNRHIEAHTQSPMIANSITCHEDPFEANTFTARSKFPTNSNGNSSNRIFIGNEDDSKYAKAAAAEKNIRNRFVRLPRPLKRVFFALLVIAFLYFF

SEQ ID NO: 162451 - protein, 90 aa, Heterodera glycines
  Coding regions on vcDNA: vcDNA=SeqID_88874; Strand=+; Position=1-273
HNSNNKMMALPSDIPSHVSRTRRAVHRRRRKGPAALHPAQCRNYKCKPKKTTNDRIRRLLRLTRRRHDFCPAKYITCRTTTLHITTLITH

SEQ ID NO: 162452 - protein, 41 aa, Heterodera glycines
  Coding regions on vcDNA: vcDNA=SeqID_88875; Strand=+; Position=1-123
EDGPRCELNRFVPLPDYPSMCETVALVVLYCRWNKNFIKEK

SEQ ID NO: 162453 - protein, 109 aa, Heterodera glycines
  Coding regions on vcDNA: vcDNA=SeqID_88876; Strand=+; Position=7-336
GKSNKKMLVRQNKIIAAAARGVLLVSNRSTTRTPTMCAPPMRCPSVPKRFGMFFFCCVSILGYPTYVMLNLDNVRPFKQTHFNDELNEKLEERRRLRAEGKLNVLQKKL

SEQ ID NO: 162454 - protein, 108 aa, Heterodera glycines
  Coding regions on vcDNA: vcDNA=SeqID_88877; Strand=-; Position=309-635
HSLSRKPIGSLLCHKRICGPLLHYAELEQSFLQNLGTNRTLVGKFMVLNDGRHQQSQILDNGKGDRIMHKFGMVFENGIEYGIVIVHHICLQLLLKFLAKILVQSSAL

SEQ ID NO: 162455 - protein, 275 aa, Heterodera glycines
  Homolog annotation: Hit_ID=NP_497039.1; Match level="QueryCoverage =97%, HitCoverage=58%, E-value=5e-66, Identity=75%"; Hit description =putative protein (67.0 kD) (2O915) [Caenorhabditis elegans] emb|CAB07587.1| Hypothetical protein C38C6.6
  Coding regions on vcDNA: vcDNA=SeqID_88878; Strand=+; Position=2-826
RKGLSFKVVVDMNGNTVVYNDRDVPIGTGSVRKVGERSYEAVISKNLFITRLKDVRRGPCCRELTGEECTEPIKLANPQFSHPSQRDDNGTTRLTWPDCFDMSIDVTLPPTVHINRLAMNYWQKQGAIDVWMKFFERAPNRAEMEKEFFSQLDNPLLGKAFKLAIIGEWLAANSLDQGSYTPTNSELLEFWVSKRAPDRLLACEHGVVDYEIEGSKVKTNVLFEAATTAGNLPNIFKDKKCATFEKLQEERFKQEVHEFKQRGSGGGIIGSIGNF

SEQ ID NO: 162456 - protein, 190 aa, Heterodera glycines
  Homolog annotation: Hit_ID=AAK39520.1; Match level="QueryCoverage =97%, HitCoverage=37%, E-value=5e-24, Identity=36%"; Hit description =BTB domain protein [Homo sapiens]
  Gene Ontology: Mol. function=protein binding
  Coding regions on vcDNA: vcDNA=SeqID_88879; Strand=+; Position=34-603
MASMSDRMKLMLSSGKGADVHFLVGQSDAKKILAAHKTILISASDVFETMFRFDAKNANVGNVNNPVEVPDVEVGAFNVMLSFIYADDLSQLDGDNAMAVLNTAKKYNITGLVTAIKNMPIAKICGDVFMTLAQSRLFEESDLVERSLAYIDQNADTVLKSEEFLQIDQQTLCEILGRSQLAVEEEITIW

SEQ ID NO: 162457 - protein, 144 aa, Heterodera glycines
  Coding regions on vcDNA: vcDNA=SeqID_88880; Strand=-; Position=175-609
VFAIGITAAANVRSAAGHRRVHTFQLVHFAEQLQPFTATHRTATTTFWICSSSGQCRHTWQCQRHFVGVPFLPHFFFQNFLSLFFVRLSRLSALCPRLLLGYSSSSFNAFRVTTLSNIGKKFCRRRQIGGTVFHTTVMKMKFFS

SEQ ID NO: 162458 - protein, 85 aa, Heterodera glycines
  Homolog annotation: Hit_ID=NP_498705.1; Match level="QueryCoverage =95%, HitCoverage=86%, E-value=4e-31, Identity=82%"; Hit description =protein similar to human bone marrow protein BM-002 (9.8 kD) (3I949) [Caenorhabditis elegans] gb|AAA28214
  Coding regions on vcDNA: vcDNA=SeqID_88881; Strand=+; Position=2-259
GKVTFKITLTSDPKSPFKVLSVPENAPFTAVLKFAAEEFRVDPSTSAIITDEGVGVNPAQKASDIFMKYGSELRLIPRDRVGQGE

SEQ ID NO: 162459 - protein, 142 aa, Heterodera glycines
  Coding regions on vcDNA: vcDNA=SeqID_88882; Strand=+; Position=1-429
ERSAIDRANRAEINKVKMRLCLALFIAASALSLGRWIEAGVVEDVKDYVDAFSEISAPAATIGEQLRKISARVSKLVQLGGPVGSLAALAMQKALEPESEEMVALKLLHSTMVKRFDVLDRRVEHLGNRLVQHMALVEYDHV

SEQ ID NO: 162460 - protein, 173 aa, Heterodera glycines
  Coding regions on vcDNA: vcDNA=SeqID_88883; Strand=+; Position=87-608
ELCKPHAKAPGECRQESKLRASQQEGQGSDCKLHACQQQEEGNRFWALRAGQPEGQDSDCKLRAGQQEVQHRDRKRRAGQPEGQDSDCKLHAKQQRDPPYGMMWLMRMMTMNRCQKKWRSRLRTMSRPNLFKKFTKADGISEMAQQQQQSSDLIDRCRIFPRHTKYLIVFLIK

SEQ ID NO: 162461 - protein, 119 aa, Heterodera glycines
  Homolog annotation: Hit_ID=CAE68944.1; Match level="QueryCoverage =80%, HitCoverage=26%, E-value=3e-14, Identity=47%"; Hit description =Hypothetical protein CBG14924 [Caenorhabditis briggsae]
  Gene Ontology: Mol. function=ATP dependent RNA helicase activity; Biological process=nucleobase, nucleoside, nucleotide and nucleic acid metabolism
  Coding regions on vcDNA: vcDNA=SeqID_88884; Strand=+; Position=2-361
ECCSSVSASDNGTAPSSSSSSWAELGLSDATLNALGTMNFPFPTPIQNAVIPIAVKLKKDIIGAAETGSGKTLAFAIPILEHWLTNAIATNVQHFPVKGSLFALIISTTRELDVQQGCA

SEQ ID NO: 162462 - protein, 151 aa, Heterodera glycines
  Homolog annotation: Hit_ID=AAD20904.2; Match level="QueryCoverage =78%, HitCoverage=82%, E-value=8e-15, Identity=37%"; Hit description =expressed protein [Arabidopsis thaliana] ref|NP_565493.1| expressed protein [Arabidopsis thaliana]
  Coding regions on vcDNA: vcDNA=SeqID_88885; Strand=+; Position=59-514
MPKYPSSIAAVAIVGKLNNPLLVHSFSNDTDLKYQFLSHAACDYADAALNSDTVSGSGYLGLLTTLDDLNVFGHQTNTKVKFFLFVQSGISPSTQAQTKDVEVKAAFELIHQAYLDLLANPFHDPDQVAMVHSPRLLARLQSFVTASPSSQ

SEQ ID NO: 162463 - protein, 197 aa, Heterodera glycines
  misc_feature (143)..(143): Xaa can be any naturally occurring amino acid
  Homolog annotation: Hit_ID=NP_462633.1; Match level="QueryCoverage =98%, HitCoverage=89%, E-value=1e-55, Identity=62%"; Hit description =orotate phosphoribosyltransferase [Salmonella typhimurium LT2] gb|AAL22592.1| orotate phosphoribosyltrans
  Gene Ontology: Mol. function=orotate phosphoribosyltransferase activity; Cellular component=cytoplasm; Biological process =pyrimidine base biosynthesis
  Coding regions on vcDNA: vcDNA=SeqID_88886; Strand=+; Position=23-614
QYKGVLQFGSFKLKSGRTSPYFFNAGLFNTGDLLNQVGRFYASAILDHEATFRPSVLFGPAYKGIPLVATTAVNLAVMGHNMPYVFNRKEAKDHGEGGSLVGMSKLQGERVLIVDDVITAGTAIRESFPLLRDHNGATVAGVXVALDRIERRQGERSAMQEVEQDMGVPVRAIVTMENIIEYLEKKGGQDEALAAMR

SEQ ID NO: 162464 - protein, 229 aa, Heterodera glycines
  Coding regions on vcDNA: vcDNA=SeqID_88887; Strand=+; Position=28-717
SNLKDKIEMFGLKTARNLQKYVQVEWEDGLLAKFNYVWLRDNARRSPSLDHLDLNARPQEIKCSREALEVQWPPFIASRYTSNFLRDIALDSPVERLYGAHRGRQNGQFGRSKPSMAGPLNGHLLAFSDARVPIEDGIELGKCYWGEEAQEPGTIWPHLAKVPSVVAVDSLSGPARLSFVDVEKVLIEMRKRYPKHLVFLGTCVLEYAEGPFFATHPVVRVDDQGHILP

SEQ ID NO: 162465 - protein, 179 aa, Heterodera glycines
  Homolog annotation: Hit_ID=CAE60497.1; Match level="QueryCoverage =93%, HitCoverage=91%, E-value=6e-47, Identity=56%"; Hit description =Hypothetical protein CBG04115 [Caenorhabditis briggsae]
  Gene Ontology: Cellular component=integral to membrane; Biological process=membrane organization and biogenesis
  Coding regions on vcDNA: vcDNA=SeqID_88888; Strand=+; Position=38-577
MTYVSAQAHNVLSDIDKKLHENNAFTNLLGKIETKTGLKRLHVFGALVVLYMLYLLFGRWAQLACNITGFLYPAYISIKAIESHQKEDDTQWLTYWVVFALLNVVEFFSNTILYYFPFYWLMKCALLLWLYLPSTLGAQLLYTRIIRPFHLQQHKNIDSMYNKLAGGAQKAYEEHVKET

SEQ ID NO: 162466 - protein, 207 aa, Heterodera glycines
  misc_feature (73)..(73): Xaa can be any naturally occurring amino acid
  Homolog annotation: Hit_ID=CAE66990.1; Match level="QueryCoverage =93%, HitCoverage=92%, E-value=9e-38, Identity=38%"; Hit description =Hypothetical protein CBG12388 [Caenorhabditis briggsae]
  Coding regions on vcDNA: vcDNA=SeqID_88889; Strand=+; Position=13-634
MLSSSACCTLLAALISAAFFAAANPPTVKQCLCSEIQPCTQKYMNTWKACMEQCKGHLSGVGGNVDKLGHCMXATRHSSNRTIKCTQSHSQTACAKSAASAKQVPKRYPETLEIATISEINRMVNSMGIEGAMKGLMDAGKKMYGCTSKCMNSKAGNCEKSFKCGLDYPPDNVAVQEVKKCALNSGLNTANAQALCKCASAAGVKNL

SEQ ID NO: 162467 - protein, 260 aa, Heterodera glycines
  Homolog annotation: Hit_ID=NP_496100.1; Match level="QueryCoverage =86%, HitCoverage=27%, E-value=1e-37, Identity=40%"; Hit description =transducin -like 3 (2K34) [Caenorhabditis elegans] emb|CAB16490.1| Hypothetical protein Y53C12B.1 [Caenor
  Gene Ontology: Mol. function=receptor signaling protein activity; Cellular component=small nucleolar ribonucleoprotein complex; Biological process=G-protein signaling, coupled to cGMP nucleotide second messenger
  Coding regions on vcDNA: vcDNA=SeqID_88890; Strand=+; Position=24-803
MVIPSSLFSLMEIRKTKTFSVSPSSISDSPPNSSADIASSLPSGDDEVYDTAFISRGSNCVAVATNSAELRIHCLDSGESVGVGHGHSQSILCVDSPSWDDQMVASGSKDNSIFFWRIGGVKTDSASDGHQNLTDAFMADKIAVATGHTHSVASVAFSHSKSLPFLVSVSTDTTLKLWPLSELIVKQEKGEQQQQLGDFKLSASATDVAHSKDINSVDISANDRLCVTASMDKTAKLWHIDRKTGQLSAGGTLGGHQRGV

SEQ ID NO: 162468 - protein, 138 aa, Heterodera glycines
  Homolog annotation: Hit_ID=NP_510159.1; Match level="QueryCoverage =83%, HitCoverage=91%, E-value=1e-31, Identity=54%"; Hit description =putative nuclear protein of bilaterial origin (14.2 kD) (XN606) [Caenorhabditis elegans] emb|CAA91025.1|
  Coding regions on vcDNA: vcDNA=SeqID_88891; Strand=+; Position=38-454
MENARLESFATKKRDKIIQITKEQFLAPIKDEYVRRLSQTPIEQIVDDGYNPGPQKPDGTVNFECHCVAHLVASPCGHDFRKAISCQKAATDAELEKGKCTEEFFSFMKCAMKTQCFRSRDEETLNDPLQPQDAEGDH

SEQ ID NO: 162469 - protein, 172 aa, Heterodera glycines
  Coding regions on vcDNA: vcDNA=SeqID_88892; Strand=+; Position=28-546
MRLNVLLAILAPLLLLIATATLCGATGKEAAANKIGVAAVALSEADNSTTPAPPPPPSPGGSDDKKKDDDDKKPDEDPAKKGQRNGHGRRRQKNGRSGRSIWRGVHFCCHSFRHGFDVRTDQNVCPLGEAARVGPTELSDVLKKHGKHWAKTNKDFLISFVVVFCIIFITSH

SEQ ID NO: 162470 - protein, 125 aa, Heterodera glycines
  Coding regions on vcDNA: vcDNA=SeqID_88893; Strand=+; Position=2-379
FVYTHLTIMSGGRPITTLAEARADFGRAKGQFKRAVMALPNHSLDGTFSSLSAYFGLDSSVGVQIVRDLGLTDPAAIFEKRVDHLCEMVSEHWDVQMFGQATRYLRLRSLNYNDLAGCFRRPSTS

SEQ ID NO: 162471 - protein, 204 aa, Heterodera glycines
  Homolog annotation: Hit_ID=NP_638583.1; Match level="QueryCoverage =37%, HitCoverage=25%, E-value=3e-15, Identity=51%"; Hit description =inosine-uridine preferring nucleoside hydrolase [Xanthomonas campestris pv. campestris str. ATCC 33913] g
  Gene Ontology: Biological process=nucleotide metabolism
  Coding regions on vcDNA: vcDNA=SeqID_88894; Strand=+; Position=2-616
EDEHGAIALVRMCKAHREMTVVAIGPLTNIAMAVRLDPDFLSYIDKLYIMGGSLLAKGNATRTAEFNFACDPEAAHIVFTSSTKHSTRAPKIVLAPLELTFDQAFDWDLIARLSDPSRHAAHPWSKFLYRITAALRRMFRSPAHLDAVAQAKDKHQARRACAAAPCCACGYVRVPLLGHLRFVRHVSAGRARVCGSDRGSACGD

SEQ ID NO: 162472 - protein, 156 aa, Heterodera glycines
  misc_feature (125)..(125): Xaa can be any naturally occurring amino acid
  Coding regions on vcDNA: vcDNA=SeqID_88895; Strand=-; Position=157-626
TPSASASASRTSAESDPSGSTTNLCFFNSVSTILRVSCSSSSSSSVSSSSLPASVRSSYVSPSTLDIVNAVAAFVGAIVCAIVFGFSLLAVNIGTGSMLANRSAIICCNCLASSCSSSSSCCFSXASVCCCTACQCCLLRLLLFCSYGIVVILPLF

SEQ ID NO: 162473 - protein, 218 aa, Heterodera glycines
  Homolog annotation: Hit_ID=CAE67356.1; Match level="QueryCoverage =80%, HitCoverage=62%, E-value=3e-28, Identity=36%"; Hit description =Hypothetical protein CBG12819 [Caenorhabditis briggsae]
  Coding regions on vcDNA: vcDNA=SeqID_88896; Strand=+; Position=9-662
MLPLTPAKRFVSKKHCVDSIRWLSLQRTTFAKTIPPGPLLFSHVYLPERTPDGQPQRKPSEHPDFMKYDFMADPEFEKPPPPVELFLLEDIKDLGEKFDIVKVSAEVARWDLLLKRRAVYASPFNLKYYAEKRKKYLAEMESRVRIPLDLLKMSALLMSQILPVTVSADVEWTLSSEMLINSTQSLGLYITEPGIIHLDNVSTLNGPRPNIEGRLVPF

SEQ ID NO: 162474 - protein, 152 aa, Heterodera glycines
  misc_feature (21)..(21): Xaa can be any naturally occurring amino acid
  Homolog annotation: Hit_ID=AAL78214.1; Match level="QueryCoverage =76%, HitCoverage=66%, E-value=9e-15, Identity=35%"; Hit description =putative esophageal gland cell protein Hgg-20 [Heterodera glycines]
  Coding regions on vcDNA: vcDNA=SeqID_88897; Strand=+; Position=12-471
MANDVWLDTLFWIDRTEAGGXHFKLPKWKLGELGIHRAPSGWDWGGTATVTVMDDHPMMNPLPLAKCPAPNGVIGFRAIYIWCVDLEVITFLQCLQRVLNLGIAVQFTIHSKDVRCWYFEAPSAISVNYVVVCHRVATPRSLSGRMNGRASG

SEQ ID NO: 162475 - protein, 171 aa, Heterodera glycines
  Coding regions on vcDNA: vcDNA=SeqID_88898; Strand=+; Position=2-517
SFVHFAIPMSPPKRAKVSADDDGETISDDGEPSTSAGAKRKQKASKPRQRKAHEAFILLVDVGRSSAENSAGAQSDHGTTTDLDRSVQIVDWVLSRKIFTESSDRFSLMFFGHENTSSDDHPNVYVHNEQFATARVVMAARVAERSADERQMPRRLRRRPLRCVGRTESAL

SEQ ID NO: 162476 - protein, 201 aa, Heterodera glycines
  Homolog annotation: Hit_ID=CAD48141.1; Match level="QueryCoverage =97%, HitCoverage=42%, E-value=1e-22, Identity=36%"; Hit description =hypothetical protein [Brugia malayi]
  Coding regions on vcDNA: vcDNA=SeqID_88899; Strand=+; Position=21-623
MNNDQLHDWLADLHGRFCPGRYRQQLSSDGSDVVAPPANGDASTAPAALCPSPESPSQWRPSLCHLSPPTNILLQYFSCNFEDARLSSPLVAQLLALYYKFGAARCFVLQLVPTFIYLYLKALNKRWLNAAQMLETLFLAIYNEEILAAGPGTPSMVKRSEEVLLPLLRSASVVPSSAADFGTISGGSVPGKVNICPESAS

SEQ ID NO: 162477 - protein, 193 aa, Heterodera glycines
  Homolog annotation: Hit_ID=NP_499743.2; Match level="QueryCoverage =76%, HitCoverage=32%, E-value=3e-62, Identity=73%"; Hit description =amino acid transport protein (51.0 kD) (3O401) [Caenorhabditis elegans] emb|CAA16336.2| Hypothetical prot
  Gene Ontology: Mol. function=glycine transporter activity; Cellular component=plasma membrane; Biological process=alanine transport
  Coding regions on vcDNA: vcDNA=SeqID_88900; Strand=+; Position=34-612
MSSNPVEGTENLGQLRQTAPQQTTAADPSSLNSSNSAAVESMDSEGVYLFADRTQSSNSLTPEQAFVHMVKAMLGTGLLSLPYAFSHSGLYLGLILLVLICLVCMFCMRQIVFAAHYICTKNGREIIDYANIMRGAVEAGPSWISSRGYFFKQLVNVKMFVAQLGFCCVYQVFMSENIADFFNKNTAIRLSTG

SEQ ID NO: 162478 - protein, 119 aa, Heterodera glycines
  Homolog annotation: Hit_ID=CAE62352.1; Match level="QueryCoverage =78%, HitCoverage=38%, E-value=1e-11, Identity=38%"; Hit description =Hypothetical protein CBG06429 [Caenorhabditis briggsae]
  Coding regions on vcDNA: vcDNA=SeqID_88901; Strand=+; Position=38-397
MQHARCPYVKENAPLPTNIKEALPKDVSVKIQQIHDDGSLSAEQKMERIDSIICTLPENDIDQIPDPPEVAQLPADVRQRVKQIERQQGKSFSTKFEEIMKYVDTLPEGTKSAAKNIFH

SEQ ID NO: 162479 - protein, 138 aa, Heterodera glycines
  Homolog annotation: Hit_ID=CAE56905.1; Match level="QueryCoverage =92%, HitCoverage=32%, E-value=3e-47, Identity=67%"; Hit description =Hypothetical protein CBG24746 [Caenorhabditis briggsae]
  Gene Ontology: Biological process=sulfur amino acid metabolism
  Coding regions on vcDNA: vcDNA=SeqID_88902; Strand=+; Position=260-673
MIHWYRRRPIAFATKAIHAGNRPEQWDMNQVVPPISLSTTYKQSRPGEPKGHDYSRAGNPTRDVLQENLASLEGARFARVFSSGLAATAAMANWLRTGDHLILADDGYGGTQRYFRDISVAHHGVQLNFVDLTNLNEL

SEQ ID NO: 162480 - protein, 186 aa, Heterodera glycines
  Homolog annotation: Hit_ID=NP_496060.1; Match level="QueryCoverage =69%, HitCoverage=32%, E-value=3e-19, Identity=36%"; Hit description =E. coli Ras-like protein era-1 (2J878) [Caenorhabditis elegans] emb|CAA87384.1| Hypothetical protein E02H
  Coding regions on vcDNA: vcDNA=SeqID_88903; Strand=+; Position=81-638
MKTKPVKLGKLGAMIARNRCTNNDSDDGGAAAGADGSEVDDDAVVGGIHPAQRQGRDAEWHRQYNQLISIPAHRANWTTTRKLFGDQLGWPQFSALFFASALRGDGIDPLRQHLRSVAKGVDKWRMRAKDISTSDPRMLCAEHTRSALLNRCPAYIAYALRTRITEWEESERGGVLRIAVDVFCDK

SEQ ID NO: 162481 - protein, 188 aa, Heterodera glycines
  Homolog annotation: Hit_ID=NP_651944.1; Match level="QueryCoverage =87%, HitCoverage=94%, E-value=6e-21, Identity=31%"; Hit description =CG11077-PA [Drosophila melanogaster] gb|AAF59393.1| CG11077-PA [Drosophila melanogaster] gb|AAL49104.1| R
  Gene Ontology: Cellular component=integral peroxisomal membrane; Biological process=oxygen and reactive oxygen species metabolism
  Coding regions on vcDNA: vcDNA=SeqID_88904; Strand=+; Position=47-610
MAAATTTMPSFYFHKHFFQRIFPGKPFFVQVFSAGVLAATGDILCQKFIEKRDKWDPFRTSRFALTTAIVIAPIQFHWFRFMDRRIGNPKREGPAGKVTLQTGLKRVLVDQSLIAPALTAAFLFSVNFLDSFSTQNAIQRTKRIYLDVLVNNYKFWPFVQIVNLTVIPLHFRVVFLQFFGIFWNIFLS

SEQ ID NO: 162482 - protein, 206 aa, Heterodera glycines
  Homolog annotation: Hit_ID=NP_504842.1; Match level="QueryCoverage =90%, HitCoverage=92%, E-value=1e-44, Identity=45%"; Hit description =ATP synthase factor B Mitochondrial (22.8 kD) (5H721) [Caenorhabditis elegans] gb|AAK95868.2| Hypothetica
  Gene Ontology: Mol. function=hydrogen ion transporter activity; Biological process=proton transport
  Coding regions on vcDNA: vcDNA=SeqID_88905; Strand=+; Position=6-623
MARPFIGFAFDAFKRRLGAHDFPFLRGFIHGFNYYDAQRVKEIGAERAAAEWVVRCEGKVKFDHSPHIFSDYNALQRFTSELDPKRESDRVHLVAVDATDSCISGWGCRHFDGLSRLQNVQFVRCKSLTDNGLQMLADSSVSDTLLTLHIEKCPKVTNSGIRHLRKLKVLNSLTLQNLKNVWKPEKTLDEIRPNLPSDCHISYKEK

SEQ ID NO: 162483 - protein, 209 aa, Heterodera glycines
  Homolog annotation: Hit_ID=NP_998658.1; Match level="QueryCoverage =99%, HitCoverage=50%, E-value=3e-66, Identity=56%"; Hit description =DnaJ subfamily A member 2 [Danio rerio] gb|AAH68384.1| DnaJ subfamily A member 2 [Danio rerio] gb|AAH4804
  Gene Ontology: Mol. function=Hsp70/Hsc70 protein regulator activity; Cellular component=cytosol; Biological process=G1 phase of mitotic cell cycle
  Coding regions on vcDNA: vcDNA=SeqID_88906; Strand=+; Position=2-628
SRKGETTVQPLQVSLEDLYKGNNTKLQLTKKVLCKTCNGIGGKQGSVRKCDRCQGSGKVFHTRQIGPGMIQQMAARCDQCSGEGEMVDEKDRCKKCVGRKTVQEQKIIEVKITPGMRDNQKIVFYGEGDHEPGIEPGDVVLVIKTKSHEQFKRKGDHLFMKKTVSLADALCGFTTTIKHLDGRQITLTTMPGDIIKPESIRGAIQEGMP

SEQ ID NO: 162484 - protein, 233 aa, Heterodera glycines
  Homolog annotation: Hit_ID=CAE63753.1; Match level="QueryCoverage =90%, HitCoverage=49%, E-value=4e-82, Identity=64%"; Hit description =Hypothetical protein CBG08288 [Caenorhabditis briggsae]
  Gene Ontology: Mol. function=transcription co-repressor activity; Cellular component=cytoplasm; Biological process=small GTPase mediated signal transduction
  Coding regions on vcDNA: vcDNA=SeqID_88907; Strand=+; Position=93-791
MARISASTQAATMMVNSIPAGLAAPQQIPQTSQVIAATVISATGASGVLQLGQQSSNSEFLSAFECPVCLDYMLPPYLQCPSGHLVCGNCRPKVTACPTCRGPIPSIRNLGMEKIAASLQFPCKFAHSGCTQFFYHHEKVEHEEICEFRPYQCPCPGASCKWQGSLADVMSHLMKLHKSITTLQGEDIVFLATDINLPGAVDWVMMQSCYNAFFMLVLEKQDKQEQSGQSYQM

SEQ ID NO: 162485 - protein, 170 aa, Heterodera glycines
  Homolog annotation: Hit_ID=NP_500247.1; Match level="QueryCoverage =87%, HitCoverage=79%, E-value=1e-49, Identity=56%"; Hit description =putative cytoplasmic protein of ancient origin (4D482) [Caenorhabditis elegans] gb|AAF60889.1| Hypothetic
  Coding regions on vcDNA: vcDNA=SeqID_88908; Strand=+; Position=36-548
LFSFPEVSCERTATESIMPPGFKEYFFLDKLAKAFNIVKQTGGIRAAIKQRYLMDTNRAGTLIGEDQFGNRYFEDNTYFVPRNRYVVYAERVWLDYDASQIPPEWHRWLHHICDKPPTVEPPPERKKWMLEHEPNNSIVMSKKYVPYSTTRPKVEGWVPGRKRSEEGTTH

SEQ ID NO: 162486 - protein, 151 aa, Heterodera glycines
  Coding regions on vcDNA: vcDNA=SeqID_88909; Strand=-; Position=2-454
HTTTTTTIDGCSLTGVQLLMGLPPIVRVSEGRVPRVEQFSLALLLLLSNFVHFFDVLQQKLDHQFSVANRFARAGEGEVDKAMFRIFFANLNAYDARFVHNVLNRFALLADHLPNFVMRHFDMLLQKLKHVARLFSNLRIDGIDLNLAKAL

SEQ ID NO: 162487 - protein, 191 aa, Heterodera glycines
  Coding regions on vcDNA: vcDNA=SeqID_88910; Strand=+; Position=19-594
MFHCYSLAMLSLITLLLSVGAGAFWPYSGGQPVDASTAVSAPSGAHSGAVSSSYHDLSLVNNGCVYHNGMITENGGQARKATAEEEAKVKQYFASSQRSQEQFQQAMAENMRRMFAAPFGAWQFPPFPQQFPFSSMPMIETPCFCESCRNGASMNHKVQSSMSSVMGENNGNSYNEYSVVDGQQQTEEHQQ

SEQ ID NO: 162488 - protein, 196 aa, Heterodera glycines
  Homolog annotation: Hit_ID=NP_497750.1; Match level="QueryCoverage =94%, HitCoverage=44%, E-value=5e-59, Identity=58%"; Hit description =tumor suppressor like (3E797) [Caenorhabditis elegans] emb|CAA85493.1| Hypothetical protein C14B1.5 [Caen
  Gene Ontology: Cellular component=cytoplasm
  Coding regions on vcDNA: vcDNA=SeqID_88911; Strand=+; Position=31-618
MRSARVNQRQQIEELAQNSALLQDMTILPHNYNFEIPKTIWKIRTIDAKIVALQFPEGLTMFACVIVDILEKHTGAEFIILGDVTYGACCVDDFTARALGCQLLVHYGHSCLVPIQDTVGIHLLYVFVNIDMGTAHLLDTLRHNFLPTAGDGMEKMPKLALVSTVQFVATLQIVKRELAKDGFDIVIPQCSPLSPG

SEQ ID NO: 162489 - protein, 182 aa, Heterodera glycines
  Homolog annotation: Hit_ID=AAH44038.1; Match level="QueryCoverage =100%, HitCoverage=95%, E-value=7e-75, Identity=71%"; Hit description= Ube2h-prov protein [Xenopus laevis] gb|AAH75340.1| MGC89025 protein [Xenopus tropicalis] ref|NP_001004909
  Gene Ontology: Mol. function=ubiquitin conjugating enzyme activity; Cellular component=cytoplasm; Biological process=protein modification
  Coding regions on vcDNA: vcDNA=SeqID_88912; Strand=+; Position=74-619
MSSPSAGKRRMDTDVLKLIESNHEVVITGGLNEFLVKFYGPKGTAYEGGVWRVRVDLPEKYPFKSPSIGFMNRIYHPNIDEASGTVCLDVINQSWTALYDLSNIFESFLPQLLTYPNPADPLNGEAASLYMHKPDEFKAKCMEYVRKYANKEALEALDKKTMKGTENEGDAGEESDDSTISD

SEQ ID NO: 162490 - protein, 217 aa, Heterodera glycines
  Homolog annotation: Hit_ID=NP_491738.1; Match level="QueryCoverage =32%, HitCoverage=17%, E-value=4e-10, Identity=35%"; Hit description =RiNg Finger protein (rnf-1) [Caenorhabditis elegans] pir||T25524 hypothetical protein C06A5.9 - Caenorhab
  Coding regions on vcDNA: vcDNA=SeqID_88913; Strand=+; Position=23-673
MDLSAGDEQLKRNFSCKICFEPFSKDRRYPISLNCGHTFCARCVRQLSSFGTSIACGLCRRGTYSDFRQLGKNVTLLDLLENANLLAGEDPNETTDDDEDNAPLNQPWRGANHFVSSAALTAFIDRHADLRSSVRQFLSPSQWAEFDGPLDAIRCSLFTIEGQLRDAGDSFVLQEGQLEQLEHLFQRMMSEYYHQQQQMQGPFSGFVPVRWAVSGDS

SEQ ID NO: 162491 - protein, 146 aa, Heterodera glycines
  Homolog annotation: Hit_ID=AAF01687.1; Match level="QueryCoverage =100%, HitCoverage=76%, E-value=1e-55, Identity=69%"; Hit description= CPN-1 [Caenorhabditis briggsae] emb|CAE67087.1| Hypothetical protein CBG12498 [Caenorhabditis briggsae]
  Gene Ontology: Mol. function=actin binding; Cellular component =intercellular junction; Biological process=muscle contraction
  Coding regions on vcDNA: vcDNA=SeqID_88914; Strand=+; Position=1-441
FTVSGEVEEFLSTLKDGTVLCKLANALSPNSIKKINTSNFPFKQMENISFFLGFAEKYVNKSELFQTVDLFEGQDPNSVLICLAALARKSEKSFGKAGLGPKEAEGSKKEWTSEQLRAGDAIIGLQMGSNKGANQSGMIMGNTRHM

SEQ ID NO: 162492 - protein, 284 aa, Heterodera glycines
  Homolog annotation: Hit_ID=CAH73825.1; Match level="QueryCoverage =66%, HitCoverage=74%, E-value=2e-15, Identity=31%"; Hit description =OTTHUMP00000062121 [Homo sapiens]
  Coding regions on vcDNA: vcDNA=SeqID_88915; Strand=+; Position=18-872
MASPPHNIDLNNKTTAKMAVKWQKLLTDLTSSCSRLISSEALGLPPALSGGPNLRNERPSAEGPSKCINEIRTIAAELSPEMLRFGPVNPSLLWASSFCAPVYEQKDLFEMHVFGLRSAGHSIPLHDHPRMYGFIRPLHGRIRICTFSWLEPEEEQKIVTERRKRAGMAKGASGVIRRPAKFTGELILDGACKDPPIAIVEPNTANVHSIEALEDGAAFFDLLVPGYNDSRSCNYYTLSDDKGNGKIGIGDFVWLEGSEEVPREFTMQQLRFDPFLMSNTNRFD

SEQ ID NO: 162493 - protein, 208 aa, Heterodera glycines
  Homolog annotation: Hit_ID=NP_502129.1; Match level="QueryCoverage =98%, HitCoverage=38%, E-value=1e-57, Identity=54%"; Hit description =glucose-6-phosphate dehydrogenase and Glucose-6-phosphate dehydrogenase (60.2 kD) (4M83) [Caenorhabditis
  Gene Ontology: Mol. function=glucose-6-phosphate 1-dehydrogenase activity; Cellular component=cytoplasm; Biological process=pentose -phosphate shunt
  Coding regions on vcDNA: vcDNA=SeqID_88916; Strand=+; Position=87-710
MVLCERTFSLSEPLLPETIKFIKESLEKQGELHFELPHVFVVFGASGDLAKKKIYPTLWWLFRDGLLPRDTHIIGYARSRLTLETLRTAFEKHCNVRDGERPKFEQYIKHCSYISGQYDTDEGLIALDRAIIEMEHTFKKPANRLFYLALPPEVFETVTEHIQRHCMSKCASAWTRVIIEKPFGYNDVSAARLSTHLAKLFAEEQIYR

SEQ ID NO: 162494 - protein, 149 aa, Heterodera glycines
  misc_feature (105)..(105): Xaa can be any naturally occurring amino acid
  Homolog annotation: Hit_ID=NP_523475.3; Match level="QueryCoverage =99%, HitCoverage=72%, E-value=4e-11, Identity=33%"; Hit description =CG3047-PA [Drosophila melanogaster] gb|AAF50957.4| CG3047-PA [Drosophila melanogaster]
  Coding regions on vcDNA: vcDNA=SeqID_88917; Strand=+; Position=179-628
MPRRATTLARRNSPTSTPSSTRSTPTRTWATCKSTLSVPTRPRVTISASRRCRTLVSCRRRVTLGPAITAMATGPPRVTSRPTSPKPTKRPGTTLARRRAPTWTXPPWATRTGATSTAAVPAATCRPTSSRPTKRAATTLANSRTPTWT

SEQ ID NO: 162495 - protein, 317 aa, Heterodera glycines
  Homolog annotation: Hit_ID=BAD13432.1; Match level="QueryCoverage =95%, HitCoverage=86%, E-value=6e-60, Identity=41%"; Hit description =plancitoxin I [Acanthaster planci]
  Gene Ontology: Mol. function=deoxyribonuclease II activity; Cellular component=lysosome; Biological process=DNA metabolism
  Coding regions on vcDNA: vcDNA=SeqID_88918; Strand=+; Position=3-953
LFSVFPQNLFGYSCKSLSGKEVDWFVAYKLPDLGSDGDGTAFLYSDANTAAWRLSDKNVEDKTSAIGLTVSQLFTAKKKKGDFFTLFNDENPNNGKTDSNRAHMKGVLVFDDISGFWLVHSVPKFPASTGADYLYPQSGKRNGQSMLCITLSSTALKEIGQQLFVAQPNVYDFQLPDSFARLFPDLAKAVNRTTFPYKKRVPFSVTDVHSLKGQSFTTFHKHKQFGKDLYSELVAPRLKSSIYVETWLVGRGDLPSDCSSSFKVHNVLSVKASKFAFKNTEDHSKWAVSESGRWTCIGDINRQQSQARRGGGTVCLS

SEQ ID NO: 162496 - protein, 207 aa, Heterodera glycines
  Homolog annotation: Hit_ID=NP_006702.1; Match level="QueryCoverage =93%, HitCoverage=64%, E-value=6e-18, Identity=36%"; Hit description =RNA-binding protein S1, serine-rich domain [Homo sapiens] ref|NP _542161.1| RNA-binding protein S1, serine
  Gene Ontology: Mol. function=RNA binding; Cellular component=nucleus; Biological process=RNA splicing
  Coding regions on vcDNA: vcDNA=SeqID_88919; Strand=+; Position=28-648
MANDSRSSSSASSRSRSRSRSRSPRRREQRRRRSRSTFSRSPSPGQKRLHIGNLDESVRRRDIEDVFGKYGRISDCWMASYPPFYAFVVFENNKDASACMKDLGNTAYIKGCRARVTVALPRKGSSLDANSMNGATYRRGPPPPPRRYYDEEDSHRRRRRSRTRSPRRRRSPSRSRSRTPPRRSRSPRRSARRQRPPSPKREPRNRG

SEQ ID NO: 162497 - protein, 236 aa, Heterodera glycines
  Homolog annotation: Hit_ID=NP_502360.1; Match level="QueryCoverage =88%, HitCoverage=93%, E-value=8e-23, Identity=32%"; Hit description =thaumatin family precursor (4N143) [Caenorhabditis elegans] emb|CAA94598.1| Hypothetical protein F28D1.3
  Coding regions on vcDNA: vcDNA=SeqID_88920; Strand=+; Position=72-782
MASFILFIILIITKANNSMGQDSGTNDVQLTLVNGCPYKIYVAGAVQVNLTVNERQTKNVPSVSTAQRLWANTDCDSENNPLCNLQAAMPPISLFEWTFDADGKQTYDVSYVDGANVPISVRVLNCPGVNFNKKLGNSLDTLVDQLPDAMKMDVFGKKRVKSVCLAYNTDSVCCRSPFGTPETCGPTKGWTDDQKKGYEAMLAAFPNSYNYAYDDHIATEVCINAKQFTIGFCTNV

SEQ ID NO: 162498 - protein, 204 aa, Heterodera glycines
  Coding regions on vcDNA: vcDNA=SeqID_88921; Strand=+; Position=2-613
LINVLSNKSLISFFLLQIFFVSFASRAVKRSLYSAKFPLALNEIRSVVSLNSYFSKIVQFCSGVLLTENIVLTAAHCILSDEFGLADYIHVKGFGWNAHSTEFVIRTDFIFLDLEDSICADIALIFLPPKVTGIFGTAKFTKFTESEWSNKSDSDSKIYALGYGITELHRMSFRARKVPLKKLEQKVPKCSLEFYFADSALSCS

SEQ ID NO: 162499 - protein, 112 aa, Heterodera glycines
  Coding regions on vcDNA: vcDNA=SeqID_88922; Strand=+; Position=13-351
MASKKADENDEPEGSEGSPTNKNRWDADAANLEKVTDFHEEKDEMNEISKESLGNLKAQPGEKRFSVRKEDVQAIVDDLEVSRIIAEKKLIQHEGNLKAALLDLMGFAENNQ

SEQ ID NO: 162500 - protein, 80 aa, Heterodera glycines
  Coding regions on vcDNA: vcDNA=SeqID_88923; Strand=-; Position=170-412
RRRCCFVSVGRWAVEETCFGFPFFVLGSLLSAVISGCCCCFCSGGGGTATAADAAPAAVATTLASVPFFSFFGAVLPVFG

SEQ ID NO: 162501 - protein, 218 aa, Heterodera glycines
  Coding regions on vcDNA: vcDNA=SeqID_88924; Strand=+; Position=49-702
QAINVIKEMRSFNSKSHQYDSSKNFQELLSPRLFQRRQQNGGTIVQRVLQQQQFQQMFQQYQLQQQQQRESPPPSTVFGNSCDGTLCQSDRLTSDSSQTLLHIGPNGDDSNDLVGVGAADHSADVTPLETADNVRNSDSMHSQQHHHHHHHRAHLQPMPPQQNQQHSSAVSRASSVRSAPLRPSRYESSSLPRMGVNGGVGSSTTNINSNGHGTNCSH

SEQ ID NO: 162502 - protein, 205 aa, Heterodera glycines
  Coding regions on vcDNA: vcDNA=SeqID_88925; Strand=+; Position=3-617
SLTINNDILDDVIAFIKRSELAQNFSLVSHHFNSLAQRRMHDANAHWVEGDCVFIANATTTRMIIPRGNNGGFEEVPVPTVAQPSYVLGFRGTIHFNGTLSDNALAFFRHALPPPTTLYRFSVLDEFYRANGLLSPFKTTERINTFLDTCVHLVELGGDEAFVGAFLNLPVMRQRVRKLRATRHSELFLNWLQQSDGEWGQLRIM

SEQ ID NO: 162503 - protein, 167 aa, Heterodera glycines
  Homolog annotation: Hit_ID=CAE73927.1; Match level="QueryCoverage =85%, HitCoverage=76%, E-value=2e-22, Identity=36%"; Hit description =Hypothetical protein CBG21543 [Caenorhabditis briggsae]
  Coding regions on vcDNA: vcDNA=SeqID_88926; Strand=+; Position=22-525
MSLNNSNLLGKRKVALNERRKIYIQRDYSQALVVKFSTDFPEELEHYIDRDIWLNFVTDLNQIYAEAEKLTAIAYLENILGLVTCHLSMLCFKSLWKRKLEEARALLYETNQQNFVRNGVYVCNPLEKGFRVIEVVLLDEPIPLPAVQDENNEKNSVPKPIVLQPRQ

SEQ ID NO: 162504 - protein, 70 aa, Heterodera glycines
  Homolog annotation: Hit_ID=CAE59762.1; Match level="QueryCoverage =98%, HitCoverage=15%, E-value=6e-31, Identity=91%"; Hit description =Hypothetical protein CBG03214 [Caenorhabditis briggsae]
  Gene Ontology: Mol. function=phosphopyruvate hydratase activity; Cellular component=soluble fraction; Biological process =gluconeogenesis
  Coding regions on vcDNA: vcDNA=SeqID_88927; Strand=+; Position=2-214
GWGVMVSHRSGETEDTFIADLVVGLATGQIKTGAPCRSERLAKYNRIMRIEEELGTDAVYAGKSFRNPQN

SEQ ID NO: 162505 - protein, 95 aa, Heterodera glycines
  Homolog annotation: Hit_ID=CAG02850.1; Match level="QueryCoverage =95%, HitCoverage=74%, E-value=8e-27, Identity=65%"; Hit description =unnamed protein product [Tetraodon nigroviridis]
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_88928; Strand=+; Position=22-309
MAPAKKKWSKGKVKDKANNAVTLDKATYDKIYKEVPTWRLITPSELVDRLRLNGSLARVALKELADKGEIKLVSAHGSQLIYTRSTIGAEPVAAA

SEQ ID NO: 162506 - protein, 57 aa, Heterodera glycines
  Coding regions on vcDNA: vcDNA=SeqID_88929; Strand=+; Position=52-225
MQQQQPVPKCGNVKCPCGDACQCGTDCKCGAKEASNCANEKCVCENCKCGADCKCGQ

SEQ ID NO: 162507 - protein, 129 aa, Heterodera glycines
  Homolog annotation: Hit_ID=CAE73476.1; Match level="QueryCoverage =66%, HitCoverage=70%, E-value=5e-23, Identity=56%"; Hit description =Hypothetical protein CBG20928 [Caenorhabditis briggsae]
  Coding regions on vcDNA: vcDNA=SeqID_88930; Strand=+; Position=33-422
MHSLLCPRASSSQLSALFKRFSVGNGTASTDCATKKGPVDVLRARLLYQSRKRGIRENDILIGGFAEEHLVKMEEHELEQYDRIINGRHTEWELFHYFSGVKEAPDDLDKNAVFQRMRQHFGEKTPRQF

SEQ ID NO: 162508 - protein, 215 aa, Heterodera glycines
  Homolog annotation: Hit_ID=CAE68967.1; Match level="QueryCoverage =86%, HitCoverage=23%, E-value=5e-34, Identity=42%"; Hit description =Hypothetical protein CBG14947 [Caenorhabditis briggsae]
  Gene Ontology: Mol. function=metalloendopeptidase activity; Cellular component=mitochondrion; Biological process=embryonic cleavage
  Coding regions on vcDNA: vcDNA=SeqID_88931; Strand=+; Position=24-668
MLLILKNCFGRLHVICHQLTRRNFRLLLHRRKEFSKPIFFSVGQPKSSFTGGNASGGSGGMPPNPFQGMSNWQKMAVAAAVIVGLQYFINRLAYTEISWKQFYTDFLEKNNVERLEVIDNKWVRVITRDPTQTVFYFNIGSVDTFERSLTQAQQHLGMETSQQQVPVLYKSESDIVGMIPHMVNFLITGIFLFYMFRMFRGFGGKKPGQRGGGGG

SEQ ID NO: 162509 - protein, 231 aa, Heterodera glycines
  Homolog annotation: Hit_ID=NP_505750.1; Match level="QueryCoverage =98%, HitCoverage=99%, E-value=8e-79, Identity=63%"; Hit description =proteasome Alpha Subunit (25.3 kD) (pas-2) [Caenorhabditis elegans] emb|CAA98441.1| Hypothetical protein
  Gene Ontology: Mol. function=endopeptidase activity; Cellular component=26S proteasome; Biological process=proteolysis and peptidolysis
  Coding regions on vcDNA: vcDNA=SeqID_88932; Strand=+; Position=51-743
MSTERYSFSLTTFSPSGKLMQIEYALNAVKGSAPSVGTRAKDCVVFATENKHSVLTQPVSKISKLSDHIACVYSGMGPDAQLLVKKARKIAMDYQVLYGYEIPVPQLVSRVAAVMQEYTQSGGVRPFGVSLLIGGWDSEKGALLFQADPAGSYFGWKSTAIGKNDQLAKKLLEKRYNEDIEKVDAIHMALLAMRETYDVAMTEDNVELAVCTKDGFERMNKEALREQIQPL

SEQ ID NO: 162510 - protein, 184 aa, Heterodera glycines
  Coding regions on vcDNA: vcDNA=SeqID_88933; Strand=+; Position=1-555
VLAMAIARQFRYSIYLLLVLVRFSLHQSAELEDLQRLCPDLKGAFCSHCDHKSVEQICPIECNFCSTFRSNETPKFFGNAAENLIELKRQCATIRLAFCNVCKITSINELCVEECLDCEAGLRDEQKEVVPLVQTWQQSAGDGLAIGDDGTNSAGEAAELSESEAEGREVPAEVPIEMDSLALF

SEQ ID NO: 162511 - protein, 96 aa, Heterodera glycines
  Homolog annotation: Hit_ID=NP_055278.1; Match level="QueryCoverage =94%, HitCoverage=89%, E-value=3e-34, Identity=75%"; Hit description =Lsm3 protein [Homo sapiens] ref|XP_216220.1| similar to U6 snRNA -associated Sm-like protein LSm3 (MDS017)
  Coding regions on vcDNA: vcDNA=SeqID_88934; Strand=+; Position=12-302
MATLDAVEEPLDLIRLSLNERVYVKLRQERELRGRLHAFDQHLNMILADVEETVTITETDEETFEEIHKPSKRTIPMLFVRGDGVILVSPPTKYVP

SEQ ID NO: 162512 - protein, 400 aa, Heterodera glycines
  Homolog annotation: Hit_ID=NP_506610.1; Match level="QueryCoverage =98%, HitCoverage=83%, E-value=1e-142, Identity=62%"; Hit description= glutamate carboxypeptidase-like protein 1 (52.6 kD) (5P76) [Caenorhabditis elegans] emb|CAB07646.1| Hypo
  Gene Ontology: Mol. function=dipeptidase activity; Cellular component= mitochondrion; Biological process=proteolysis and peptidolysis
  Coding regions on vcDNA: vcDNA=SeqID_88935; Strand=+; Position=3-1205
TTLPLPPMLCDTLGTDKNKRTLLVYGHLDVQPAAFEDGWNTEPFQLIEKDGKLFGRGSTDDKGPVLGWLNVIETMQGLGIDMPINIKFVFEGMEECGSDGLDECLEQRKDFLSGVDFVCISDNYWLGKQKPCITYGLRGLSPFAIEISGPNQDLHSGVYGGTIHEPMNDLCWLLSQLTDTKANSLIKNIDKMVAKLTEEERNTYTKIDFDLNGFKKDVGVEKLTSEDPKQILMRRWREPALSIHGIEGAFSGKGFKTVIPSKVTGKFSIRIVPDMVPEEVDKIVVDFVSEVWKGRGSPNKMKILPLGGTLAWLGDFKQPHFQAGVKAIKKVYGVEPDFTREGGSIPVTLTFQNLTGKSVMLLPMGASDDMAHSQNEKLNVTNYVNGMKMFAAYIFECAKI

SEQ ID NO: 162513 - protein, 138 aa, Heterodera glycines
  Coding regions on vcDNA: vcDNA=SeqID_88936; Strand=+; Position=1-414
GTDSTNNGHYTDNLNIAAPGVVTQHVCKASNLNQFQLSQINSLHPDTGVVGVYLSTEGTKVLPFVKAAAQGLREMASKPISDELLQACKLLAKGTALTPDEFIALLKTVTADDVKKAASPTLRQSPHLAGEVHQAGPT

SEQ ID NO: 162514 - protein, 416 aa, Heterodera glycines
  Homolog annotation: Hit_ID=CAE63207.1; Match level="QueryCoverage =100%, HitCoverage=13%, E-value=9e-90, Identity=41%"; Hit description= Hypothetical protein CBG07562 [Caenorhabditis briggsae]
  Gene Ontology: Mol. function=protein binding
  Coding regions on vcDNA: vcDNA=SeqID_88937; Strand=+; Position=3-1250
KLNLTMKRFNSWASQLENELEGWKDGCPCDFLPNMSPISDANDSSSLSSSSSWSSPLLHKYRLLIEPGNSPFEYVAPGVRAVRRLWNFLILQENLAPIFVRYSFAKAKDKIASSVTKGADLNSILNVIKLVHREHDPIVAFAANSIRPGVMVVSTGRELQELSIDRVLDEHERVVSRLQHYPSTSSFLLAQNWAELDISMQQIRRDPLRDNDDYQLLIPGSDGQPGKNIPTQTSAHLRKRLFSGVRRLEAHSSLPYYASGSSDGSVFLWEWGVEQPVFVARVAGQFAKVAKLAFAQNGARFAAVDGDGLLSIWQAQPGVPAKKPYFIQKCHTKFASDVKFLGQTSTLLVTAGLGMNDQNITLWDILMPHSKCAVHSFVGHPDGAFCVAYQPNTQSLISGGKHGEICIWDVRQRQLR

SEQ ID NO: 162515 - protein, 146 aa, Heterodera glycines
  Coding regions on vcDNA: vcDNA=SeqID_88938; Strand=+; Position=146-586
LVHCIKNAKPIIVNIIALANLGTGIKLNSLTITECEFKYNPENSMPGYQMCKPHQSHGIIMGIRENDMSGDEKSAIKKFIEIIKGSGCPGASYIGLNFKQGKSMTALIFWTGKVVITGTKNNSEIEEMYHHILPYLKMAQKKLGIR

SEQ ID NO: 162516 - protein, 192 aa, Heterodera glycines
  Homolog annotation: Hit_ID=NP_001002546.1; Match level="QueryCoverage= 61%, HitCoverage=46%, E-value=4e-10, Identity=36%"; Hit description =VAMP (vesicle-associated membrane protein)-associated protein A, like [Danio rerio] gb|AAH76262.1| VAM
  Coding regions on vcDNA: vcDNA=SeqID_88939; Strand=+; Position=211-786
MKRNGNSICSETKPPLLELTPKNALTFRGKLGHVGSVSLDIKNCEICSVYFKVKSNANHFYSVRPNTGVIGAYGRVKVVIQLHDDSLAKLDEIEENKHKFLIMAAIVSDASIGTEKFWKGKKEGMDGIYSSKMKTEVHKVCRWEGGKGVLSQQNSEENVPNGKNSVSVEKVPNQILELCSEKEAPNQFSNLE

SEQ ID NO: 162517 - protein, 204 aa, Heterodera glycines
  misc_feature (156)..(156): Xaa can be any naturally occurring amino acid
  Homolog annotation: Hit_ID=CAE56731.1; Match level="QueryCoverage =100%, HitCoverage=39%, E-value=2e-74, Identity=64%"; Hit description= Hypothetical protein CBG24518 [Caenorhabditis briggsae]
  Gene Ontology: Mol. function=polypeptide N -acetylgalactosaminyltransferase activity; Cellular component =integral to membrane; Biological process=O-linked glycosylation
  Coding regions on vcDNA: vcDNA=SeqID_88940; Strand=+; Position=2-614
SIIITFHNEARSTLLRTIWSIFIRTPSHLLKEIILVDDYSFDATIGRDLFGIDKMRIIRNRKREGLIRSRVHGAIIASAPVLTFLDSHCECNVGWLEPVLQRLVENDKAVVAPVIDVINMDNFNYVSASSDLRGGFGWNLVFRWEALGREEKLFRXKNPKKPIKTPVMAGGLFSINKKWFDALGRYDTKMDVWGGENLEMSFRI

SEQ ID NO: 162518 - protein, 139 aa, Heterodera glycines
  Homolog annotation: Hit_ID=CAF94810.1; Match level="QueryCoverage =72%, HitCoverage=52%, E-value=2e-27, Identity=64%"; Hit description =unnamed protein product [Tetraodon nigroviridis]
  Gene Ontology: Mol. function=ATP-binding cassette (ABC) transporter activity; Cellular component=mitochondrion; Biological process =transport
  Coding regions on vcDNA: vcDNA=SeqID_88941; Strand=-; Position=325-817
NLSKVGSGKSSLLNAILGEMHKVYGYVGIRGTVAYVPQQVQILNRTLRENIIFPVTEEEKPDEQHYAKVVKACALTADFSVLPNGDQTEIGEKGINLSGGKKARVRVMERKEYGRTKKLGIVKKSAKDISTVKDFSPER

SEQ ID NO: 162519 - protein, 159 aa, Heterodera glycines
  Coding regions on vcDNA: vcDNA=SeqID_88942; Strand=+; Position=1-477
NQSSPLLMPRSTRATMSCSSRATRSGSRFCGSGGPAPRLYIWSGGVLPTRLTSRLNSLFSSTSITTFPSSISSAAHPIARPNCFFTSWTSESGSSIGSGSDSEGGCVNTSVGAGPSTSGTKSCSLREEVDGTLRFRGGTTSRTALRSRLRVILSVAPKS

SEQ ID NO: 162520 - protein, 125 aa, Heterodera glycines
  Coding regions on vcDNA: vcDNA=SeqID_88943; Strand=+; Position=8-385
ISSPSSSSDSSFSSPSSFSTFFLAFSSSSFSTSLLSAHFDDHLFVQFCLQNFCELFGLFFAQFVNIKRIYSQVFFAHVREHRGDHTALRLNTIGDFDAQEQAFHGRFHNVIAEVHLISSLNIHLH

SEQ ID NO: 162521 - protein, 122 aa, Heterodera glycines
  Homolog annotation: Hit_ID=NP_496845.1; Match level="QueryCoverage =56%, HitCoverage=7%, E-value=4e-15, Identity=53%"; Hit description =putative protein, with a transmembrane domain, a coiled coil-4 domain, of ancient origin (2N824) [Caenorha
  Gene Ontology: Cellular component=integral to membrane
  Coding regions on vcDNA: vcDNA=SeqID_88944; Strand=+; Position=2-370
PTFLQLRRRSFPTPNSASFSSTVEHHLPSPNSARGIYGFALYLGVWILFVLYLIWALVPDYLLKSLHLTYLPAKYWALAVPSFLVFSIFAYILVNFFFNLVNFHSLYDQETTKFQLVNDFLD

SEQ ID NO: 162522 - protein, 152 aa, Heterodera glycines
  Homolog annotation: Hit_ID=NP_055299.1; Match level="QueryCoverage =100%, HitCoverage=31%, E-value=5e-21, Identity=42%"; Hit description= molybdenum cofactor synthesis 3 [Homo sapiens] emb|CAB53750.1| MOCS3 [Homo sapiens] gb|AAH15939.1| Molyb
  Coding regions on vcDNA: vcDNA=SeqID_88945; Strand=-; Position=164-622
FCRSDPSDKVRSLCLLSAEQRVSPTEYLNLRNKIGGSFILLDVRPPTEFEICHLPEAENFPWEELRRAKMEMIIDKINNSMERKSPTINGAGNNGKTKVLVVCHHGNDSQLAACHLHKQLSEAGIGDRFIVRDIVGGMDGWALEVDADFPRY

SEQ ID NO: 162523 - protein, 143 aa, Heterodera glycines
  Coding regions on vcDNA: vcDNA=SeqID_88946; Strand=+; Position=599 -1027
AAKRERRALSQRPRRRHGAGSRKNSAQITFPLNWSNGRHSVRRAKAWISADLHRDNQKQENILLSVLRNWAFLRRVLYYAVCAVAMGLDMIHTIKIFGRIHITETALNALNSACRVEVGSGPEHSRHLVEKGIKQTSLVVSEE

SEQ ID NO: 162524 - protein, 176 aa, Heterodera glycines
  Homolog annotation: Hit_ID=NP_492811.1; Match level="QueryCoverage =99%, HitCoverage=48%, E-value=2e-84, Identity=83%"; Hit description =casein kinase ii (42.3 kD) (1L311) [Caenorhabditis elegans] gb|AAC16993.1| Protein kinase protein 3 [Caen
  Gene Ontology: Mol. function=protein kinase CK2 intrinsic catalyst activity; Cellular component=protein kinase CK2 complex; Biological process=signal transduction
  Coding regions on vcDNA: vcDNA=SeqID_88947; Strand=+; Position=123-650
MPTPSRARVYADVNVNKPREYWDYECHQIRWGNIDDYQLVRKLGRGKYSEVFEGVMVPSEQKVVIKILKPVKKKKIKREIKILENLRGGTNVIGLLDVVKDPVSRTPALVFEYVNNTDFKQLYQTLSDYEIRYYLYELLKALEYCHSMGIMHRDVKPHNVMIDHEKRQLRLIDWGL

SEQ ID NO: 162525 - protein, 629 aa, Heterodera glycines
  Homolog annotation: Hit_ID=NP_508993.2; Match level="QueryCoverage =85%, HitCoverage=73%, E-value=1e-149, Identity=49%"; Hit description= fatty ligase long (79.9 kD) (XG556) [Caenorhabditis elegans] gb|AAA80409.2| Hypothetical protein C46F4.2
  Gene Ontology: Mol. function=long-chain-fatty-acid-CoA-ligase activity; Cellular component=lipid particle; Biological process =gametogenesis
  Coding regions on vcDNA: vcDNA=SeqID_88948; Strand=+; Position=73-1959
MVNILTIRWTICTTLRNGAWPCARVLMLWQPYRLLLLKRMLVKMEMTTQQHPTTYWRGMAVFYWKQKAVSYRSNFYKKFKMPNQKDGVTGGKRIEQELAVFDLPFYIVALAFFLKAFFRLYDLLVFVPFKLFADPELEKERSRERKAMPIDGKPTSSWRHVDTIGTALYTELFEGCPTLGKIWDKAAQLHRGHNCMGTRDILNVVEEQQPDGKAFQKLALGKCNWMNYEHVDEVIVEVASGLSNLGIVQGQKVVIFSETRKEWMISAIACFKLGLPIVTVYPTLGDEAIAFALAECDAVLAFTSRPLLSKVFSSVKDCPQLKRVVYFSELHALAEVAEKAPDAIKEAFKSIGRELYSFNALKALGHSQAKLERNVQPDDLAMIMYTSGTTGKPKGGLLSHRNIIPTASGQSAVISVSTSDTIIGYLPLAHILEVCAEIICLSKGCRVGYSSPSTLHDRAVKIKRGTTGDCVELKPTLIACVPAVMDKIFKAVLDEVKEKSPIQREIFRICYERKRNRFEGGYKSLVMDSLAFAKISKMLGGNLRFVISGGAPLNPETQRFMNICFCCPVVQGYGLTETCGGATLADEHDLSTGSVGPPLRSCEIRLREWEEAGYLPTNSPPQGEVLIHG

SEQ ID NO: 162526 - protein, 115 aa, Heterodera glycines
  Homolog annotation: Hit_ID=EAA40667.1; Match level="QueryCoverage =68%, HitCoverage=18%, E-value=2e-12, Identity=41%"; Hit description =GLP_456_61251_62507 [Giardia lamblia ATCC 50803]
  Gene Ontology: Mol. function=protein kinase activity; Cellular component=cytosol; Biological process=MAPKKK cascade (cell wall biogenesis)
  Coding regions on vcDNA: vcDNA=SeqID_88949; Strand=+; Position=3-350
SESWAVACTFFSMLFGYPPFHSSNLESTYSRIRRCDYSFPVRYPPLSKSAVDLIKRTLIREPKQRLTIGEMLAHSSLNPPNLNRSFIDGNNLQQFSRSASCQQFTTLAKTVVLSI

SEQ ID NO: 162527 - protein, 257 aa, Heterodera glycines
  Homolog annotation: Hit_ID=NP_509544.1; Match level="QueryCoverage =71%, HitCoverage=69%, E-value=2e-41, Identity=52%"; Hit description =calmodulin (XJ770) [Caenorhabditis elegans] gb|AAA68320.1| Hypothetical protein B0563.7 [Caenorhabditis e
  Gene Ontology: Cellular component=spindle pole body; Biological process=cell organization and biogenesis
  Coding regions on vcDNA: vcDNA=SeqID_88950; Strand=+; Position=100-870
MSSGDEATTPALTSGGGASSTRTAGGGSAFQRWGGNRRGSHLVGWDSARPQSAARQQQQMLERMYSKSELHEYQQLFKMFDTDGSGAIGCEELKGAMLSIGLQADDAEIERLIKEVDDTEMVRLICDHSLPSDCLFLLPPISEIDFPEFCQCMKRSQQSGGIKGRLSNEEVSRQCFEVFDQDSNGLITENEFIYVAKEVGGFSQELAEFVFRELLGDSATGQLDQSLFSAIVDDYLFSDLASGGGNDGTVGNKSPKI

SEQ ID NO: 162528 - protein, 297 aa, Heterodera glycines
  Coding regions on vcDNA: vcDNA=SeqID_88951; Strand=+; Position=1-891
AVEKAAERGGVYPEVLFRVAHHWYDDLYLAHLENTQQQQATTTALPPPAHPQPTQRIAPQQCVVRLMMPSPLHHSHQSQQHFFPVHSAAASTSAAVVFSPSVPPPPTPPQQFVGPNVVIHPQQHNLSTGNNFIQYSHHLQLTPTAVPLFHGQTAAVSMAPIFHNGQAPSVSSCCFLSLPPPQLQAVQPPTVVDHKQTSQPHLQQSVAQFGSTIGYPHHHHVTAHQPPLSTPPPPLMLMALPGANVAASAFPPRHILQPTPAQHQLPNYTQQQQQTANQQWTLQKGIGKQQHRIEWRA

SEQ ID NO: 162529 - protein, 201 aa, Heterodera glycines
  Homolog annotation: Hit_ID=AAV73809.1; Match level="QueryCoverage =78%, HitCoverage=96%, E-value=5e-25, Identity=43%"; Hit description =superoxide dismutase [Gryllotalpa orientalis]
  Gene Ontology: Mol. function=copper, zinc superoxide dismutase activity; Cellular component=cytoplasm; Biological process =neurogenesis
  Coding regions on vcDNA: vcDNA=SeqID_88952; Strand=+; Position=1-603
TARADIACNNVIVALDRLIDVPQAPDKKAICVLANNRADSKEGVGTVMFQQKDGEDVRVTVVIGGLGPDHQHALTIYQFGDLTVSSGNFHSTGKHFSHAGQKHSPPEAVSRHVGDLGNITADSKGVAKRNWSDKVISLFGQNNIIGRSVAVHARKDDFGEGTQDVIRSRESGNAGPILSWGGIGLAFDTNMSTCSEDFQRE

SEQ ID NO: 162530 - protein, 230 aa, Heterodera glycines
  Homolog annotation: Hit_ID=NP_507780.1; Match level="QueryCoverage =98%, HitCoverage=15%, E-value=5e-20, Identity=32%"; Hit description =predicted CDS, DNA polymerase type B, organellar and viral family member (5T899) [Caenorhabditis elegans]
  Coding regions on vcDNA: vcDNA=SeqID_88953; Strand=+; Position=3-739
DARFQLREQLIMYCINDVAILRESVLRFRKLIGEHTQGLDPFLVSSTAAGLALSTLRRCFLPFNRLVHSPEGGYLRGRRASAESRRYIRFFELENPGAQVQCADWSVGEANIEDTGYRVDGLWRREPPLRPLAIEWMGCYYHGCPDCFPNRRQKLAAGRTAEDLYERTMRRLFELEHTHGCELHVVWGCEWKERLRRDLELKQRFEAVFVPCPLDPRNDALRGGRTEPFQ

SEQ ID NO: 162531 - protein, 187 aa, Heterodera glycines
  Coding regions on vcDNA: vcDNA=SeqID_88954; Strand=-; Position=2-562
PEKVGSDQLAIQVFGGKKVKLQSGRYKVKLKRLDGEWESIELSEVPPICTPIRTEFVIPGGTPGQHCSATDTVQPQLLIGIRRFWDFVQGFRKTAEGTYLIDTVFGTVICGEQFQTTTGVTPDSSVFAIPPCGEDERDQMPSVKAIEQFWSVEAIGIRDDPTQDADTEAIIQFERSVRQHDDGRYSI

SEQ ID NO: 162532 - protein, 193 aa, Heterodera glycines
  Homolog annotation: Hit_ID=NP_502554.2; Match level="QueryCoverage =52%, HitCoverage=18%, E-value=2e-11, Identity=37%"; Hit description =kelch repeat containing protein (4O56) [Caenorhabditis elegans] emb|CAC44304.2| Hypothetical protein Y67H
  Coding regions on vcDNA: vcDNA=SeqID_88955; Strand=+; Position=14-592
MSQKCSQSRTLSAFEIVPVRGCKLSKSSSRRPEFCECCPIPRSGHRVFADSDFIYVFGGYNPFHSPDSTYTDFWRFNRLTHLWQKCGLSSSDPTTQLPNSLASFALASSSRPSECFIFGGTGIPFGLAASNELHRIRIDLLGNVNVRTEPKQSYEQRQNTANIRQRGRSGGEAADDAAEQRLMPPRIYGHAMC

SEQ ID NO: 162533 - protein, 211 aa, Heterodera glycines
  Homolog annotation: Hit_ID=CAE74515.1; Match level="QueryCoverage =91%, HitCoverage=78%, E-value=6e-21, Identity=31%"; Hit description =Hypothetical protein CBG22269 [Caenorhabditis briggsae]
  Coding regions on vcDNA: vcDNA=SeqID_88956; Strand=+; Position=16-648
MCSGIPEGTYELKIGASFLCSNKSRPPEFNTLRFDFKPASISSEASEAYVVQSQNQNENNFQVVVFGEAQKKTIFKGAKKEIKGDKECLLVYNRKSKELCLERVSANINVKTTRDTDLDQKAISEIERLQKRRRPKQYPPSPKAPVENATAVEPPAEQRKERTFSTSSAGDEIDEDDEENVSALEQLMAPTKVERSEAEEDIFHPAQQRPK

SEQ ID NO: 162534 - protein, 212 aa, Heterodera glycines
  Homolog annotation: Hit_ID=NP_501284.1; Match level="QueryCoverage =66%, HitCoverage=61%, E-value=1e-28, Identity=51%"; Hit description =GAF domain protein like (24.2 kD) (4I546) [Caenorhabditis elegans] gb|AAK84503.1| Hypothetical protein C3
  Coding regions on vcDNA: vcDNA=SeqID_88957; Strand=+; Position=69-704
MSSVRRMLFLLGRKCCCSTVPCSATANGFGSIQRRRLWTSMARLSSSGPFICMMPLKKRQMFISDVYKHDHFLHFDHLHIDNIHCARKLVVHLRPSERTLLLQALTELNAEAKTDGNGHSDHPPSPAQMKQLFFVNTIPFVGFGVLDNMIMILAGEYIDLYLGTLLCISTMAAAALGNIISDVAGGGVAHYVEQFPRHLGYKHPVLPPKQLE

SEQ ID NO: 162535 - protein, 201 aa, Heterodera glycines
  misc_feature (50)..(50): Xaa can be any naturally occurring amino acid
  Homolog annotation: Hit_ID=CAF92976.1; Match level="QueryCoverage =93%, HitCoverage=36%, E-value=1e-25, Identity=38%"; Hit description =unnamed protein product [Tetraodon nigroviridis]
  Gene Ontology: Mol. function=protein binding
  Coding regions on vcDNA: vcDNA=SeqID_88958; Strand=+; Position=34-637
MLARMKKLLSSGDHADVNFLIGNEDSKEILLAHKAILSVASDVFAAMFRXDATNATRATVGKPFLRPVEITDVEPSAFKVLLNFIYWDDLSERNGDNAIALLYAAKKYKIPELVKACVEFPVSELRDIFSALVRTRILEEEEFAARCLNYIDQNADFLFRSNAFLQIDNKLLCELLGRDQLLIRREISVWIAALRWADEHC

SEQ ID NO: 162536 - protein, 125 aa, Heterodera glycines
  misc_feature (71)..(71): Xaa can be any naturally occurring amino acid
  Homolog annotation: Hit_ID=AAP30767.1; Match level="QueryCoverage =100%, HitCoverage=100%, E-value=1e-31, Identity=59%"; Hit description=putative gland protein G21E12 [Heterodera glycines]
  Coding regions on vcDNA: vcDNA=SeqID_88959; Strand=+; Position=40-417
MTSHFLVGVAAFGAGMCFAKTYMEKPKSEDDKEAPKKEEATTGGEAEEKAKKKDKKGDGAAAADKKEEKRXDKHKSKEGKSDDSNRRSKKDKHGKKDKKDKKKDAAEPAANAGEQSTAETTQADE

SEQ ID NO: 162537 - protein, 202 aa, Heterodera glycines
  Homolog annotation: Hit_ID=NP_001002481.1; Match level="QueryCoverage= 97%, HitCoverage=88%, E-value=1e-47, Identity=49%"; Hit description =zgc:92869 [Danio rerio] gb|AAH76329.1| Zgc:92869 [Danio rerio]
  Gene Ontology: Mol. function=maleylacetoacetate isomerase activity; Biological process=tyrosine catabolism
  Coding regions on vcDNA: vcDNA=SeqID_88960; Strand=+; Position=36-641
MATKPLLYCYWRSSCSWRVRIALHLKGIEFDQRIVNLLNGDQNKDEFLSKLPFAKVPVFVHDNLVLSESMAIIEYLDEKFPEPNPLFPKSAEDRAHVRALALQIVANTQPLQNLGVLKHLSEEPAKRNAWARHWIEQSFNVFEKALAKNASKYAYGDQIRLADICIPPQVYNAKRFGVDMAQFPIIARLDETLAEVPAFKVP

SEQ ID NO: 162538 - protein, 161 aa, Heterodera glycines
  Homolog annotation: Hit_ID=XP_216480.1; Match level="QueryCoverage =99%, HitCoverage=99%, E-value=3e-35, Identity=44%"; Hit description =similar to RIKEN cDNA 0610037L13 [Rattus norvegicus]
  Coding regions on vcDNA: vcDNA=SeqID_88961; Strand=+; Position=44-529
MPVFALQMSANLVGVTDLRPSDYDDHRWYLKLKCSACGESYPSEQYANTRETHTLTKGKGICHISAKCSFCGRINSLEILIDSYASYSADKNRLFQTLVKFECRGIEPTSFDPRIGWICVGTESGSIFDEIDLNELEWADYDEKNSSAVEINDISFRFVRV

SEQ ID NO: 162539 - protein, 174 aa, Heterodera glycines
  Homolog annotation: Hit_ID=CAE60078.1; Match level="QueryCoverage =85%, HitCoverage=54%, E-value=3e-29, Identity=44%"; Hit description =Hypothetical protein CBG03598 [Caenorhabditis briggsae]
  Gene Ontology: Mol. function=actin cross-linking activity; Cellular component=actin filament; Biological process=cell organization and biogenesis
  Coding regions on vcDNA: vcDNA=SeqID_88962; Strand=+; Position=53-890
MANAEEVCPTYSEAFSHGNDDGSFCTITEFKRNKLETEARKNWDRFYKRNSDNFFKDRNWTKREIEQMCAKDMELSAPLTLLDAGCGCGNTLFPLAKFFPNWTFCGVDFSSNALSLLQQRAVQIGTNIHTELVDLSGDTLVNFSSLPKADLITLIFVLSSISLEHHSKVVQNLR

SEQ ID NO: 162540 - protein, 262 aa, Heterodera glycines
  Homolog annotation: Hit_ID=CAF93222.1; Match level="QueryCoverage =97%, HitCoverage=91%, E-value=1e-25, Identity=35%"; Hit description =unnamed protein product [Tetraodon nigroviridis]
  Gene Ontology: Mol. function=lectin; Cellular component=extracellular space; Biological process=cell adhesion
  Coding regions on vcDNA: vcDNA=SeqID_88963; Strand=+; Position=65-850
MLSEIPLPHQKGIVDPRLPCKIQIVGRANDVAKRFEVNLLSQTGEHLLHFNPRFDEHCVVRSSTKDGQWQAEERGGTNPFVAGQPFSLDLLVEQGLIECSVNGFQFCEFAARDDFSQLGAVSVGGDIQLNSLEVSTAEGPAIAHEGGDKGPREADEENAQEQPPIVMPAHPEPQPVPAEPTPQQPQPPPAQGPLSVPYQAPLHALLQTNRMRVVGVPRPGAQRFTVNFKTHDGETLFHFNARFDQNCVVRNASVNRQYAPEG

SEQ ID NO: 162541 - protein, 211 aa, Heterodera glycines
  Coding regions on vcDNA: vcDNA=SeqID_88964; Strand=+; Position=7-639
LLMYIRELESPGELPLVLLNAPRSCCRPTKHEQFRAVLNLRRTAQRLTVENSRLNRMNAMLVVLFQRLTGGVLPHQAVPVAGAFGQKQNQQPANAFAVPPVVPVVPVNANNNNRHSYNELQRELDTLTGTVDVLTEQNSRLAHTNGVLFGHVFRSVPPNVPPPFVPVAQAVPQHQPHNAAVALPHNVNPNPPGVFQPGQQLFDDNFVDAYL

SEQ ID NO: 162542 - protein, 144 aa, Heterodera glycines
  Homolog annotation: Hit_ID=NP_509294.1; Match level="QueryCoverage =79%, HitCoverage=26%, E-value=4e-22, Identity=40%"; Hit description =DeHydrogenase, Short chain (48.0 kD) (dhs-29) [Caenorhabditis elegans] gb|AAK68350.1| Dehydrogenases, sho
  Coding regions on vcDNA: vcDNA=SeqID_88965; Strand=+; Position=483-914
FCVSPTKFAVRGAMECLRVELKERGLEDILCTTIYPFYVRTPMVTSKGLRPVARWLPFLTVEECAKSVVDAILKEKVNACIPWWLNSFVALNGIFGINMNNVSRDFLDIHFEPSNYEDGQKSFGRIRNSGEIGRKRRQKRGQYK

SEQ ID NO: 162543 - protein, 183 aa, Heterodera glycines
  Coding regions on vcDNA: vcDNA=SeqID_88966; Strand=+; Position=104-652
MDRRINKTARNRTCSMVTVTTNGRQQPRKIDYLIKKFDALGSGRPPMPTSESPSTSVDSQFLPVTKSASTTIASALGSGRSPMPTSESPSTSVDSQFLPVTKSASTTIASALGSGRSPMPTSESPSTSVESQFLPVTKSASTTIASNPSDCALTPQQKYCRKRALMEPSQHELAIIRNVLSFD

SEQ ID NO: 162544 - protein, 208 aa, Heterodera glycines
  Homolog annotation: Hit_ID=CAE63782.1; Match level="QueryCoverage =89%, HitCoverage=49%, E-value=5e-70, Identity=64%"; Hit description =Hypothetical protein CBG08323 [Caenorhabditis briggsae]
  Gene Ontology: Mol. function=methionyl aminopeptidase activity; Cellular component=cytosolic ribosome (sensu Eukarya); Biological process=proteolysis and peptidolysis
  Coding regions on vcDNA: vcDNA=SeqID_88967; Strand=+; Position=3-626
MVTVAANDKNVDEPNRYCQSKGCKKPVEGNLRCPTCVKMGRPDAFFCSQTCFKASWLEHKLCHKDDSSNINEYNPWPLYQFSGTLRPAPQSARRAVPEHIPWPDYALHPEGVSLEERNARNSGQIRVLNEEEQLGMRLAAKLGREVLDEAARAIEPGVTTDEIDRVVHQACIERECYPNPLGYYKFPKNCCTSVNQGICHGIPDKQAL

SEQ ID NO: 162545 - protein, 203 aa, Heterodera glycines
  Homolog annotation: Hit_ID=CAE61563.1; Match level="QueryCoverage =89%, HitCoverage=54%, E-value=1e-19, Identity=34%"; Hit description =Hypothetical protein CBG05472 [Caenorhabditis briggsae]
  Coding regions on vcDNA: vcDNA=SeqID_88968; Strand=+; Position=42-650
MTSKIESTIASSFRKFLFWFRYDGSKFPAMAKGSDSRNGPSVMQVVESCLQKLFATENSDQIKTFAISRTDAKVHAIRSPILIGLPVACDWFSQSELARTEFLLCFNDQIRNNGFTNAIELLHVDPVAMGFHPCFHVSYRRYIYRLRVISTEQSLNYPNRFFAHLSHVIPSDPSLASLSEFNYSWTIPPTFNIERAQFVCDLL

SEQ ID NO: 162546 - protein, 118 aa, Heterodera glycines
  Coding regions on vcDNA: vcDNA=SeqID_88969; Strand=+; Position=291-644
PCKVWHVHCRIELHHSLGFPHDLSQIWLYFSVHDSELIEERHINGWRSKNHRKTILKNMYTLPFFAQVSDRKRDDTLPLPYEYPYELPVGRKLPYELSKILLILEQRTNTRTTDIPTP

SEQ ID NO: 162547 - protein, 235 aa, Heterodera glycines
  misc_feature (62)..(62): Xaa can be any naturally occurring amino acid
  Homolog annotation: Hit_ID=NP_741119.1; Match level="QueryCoverage =91%, HitCoverage=97%, E-value=4e-54, Identity=46%"; Hit description =putative membrane protein of eukaryotic origin (25.0 kD) (3F971) [Caenorhabditis elegans] gb|AAK93840.2|
  Gene Ontology: Mol. function=purine nucleotide binding; Cellular component=cytoplasm
  Coding regions on vcDNA: vcDNA=SeqID_88970; Strand=+; Position=1-709
HHFSVLFVLSFFSFPLFFAVFVSSAAEQNANLQKQQQLFTIEGKTVVNAELQRIKPNWKAGXRIFLDYGKFVGFIRQDGSFIVPDVPSGSYILEVASGDFQFESVRVDITNSGKIRARRLNLVQPNVVSTLPYPVKLTARHPMRYFRVREEWRVTDVLMNPMMLMMGAAFILVVLMPKLAAQDPNVQKEMQNMQLPKVDMPDMADMLANIWSSGSNKKGSRKQISSGQSTKRVTR

SEQ ID NO: 162548 - protein, 117 aa, Heterodera glycines
  Coding regions on vcDNA: vcDNA=SeqID_88971; Strand=+; Position=91-444
AANCGRTAAKTDGDGTHQKRWCPSFFCLSPPFAPKGQHLRVGWCGCRRFAQRSNCPLLDLLILGRWRLNNIQNNTCTHTFHTEYITHHIYINTYLFLIFSIGMIYVKLTTPFNVICE

SEQ ID NO: 162549 - protein, 209 aa, Heterodera glycines
  Homolog annotation: Hit_ID=CAE75294.1; Match level="QueryCoverage =100%, HitCoverage=17%, E-value=5e-97, Identity=83%"; Hit description= Hypothetical protein CBG23262 [Caenorhabditis briggsae]
  Gene Ontology: Mol. function=pyruvate carboxylase activity; Cellular component=cytosol; Biological process=TCA intermediate metabolism
  Coding regions on vcDNA: vcDNA=SeqID_88972; Strand=+; Position=3-629
EYYLNLAKQLVNANAHILSIKDMAGVLKPEAAKLLITALRDQHPDVPIHVHTHDTSGAGVASMIECARAGADAIDAAIDSMSGMTSQPSMGAIVASLQRTPHSTGLEMDSISRYNAYWETARQFYQPFECTVTMKSGNSDVYNHAIPGGQYTNLQFQAFSLGLGEKFDEVKKMYAEANLALGDIIKVTPSSKIVGDLAQFMVQNKLTKE

SEQ ID NO: 162550 - protein, 200 aa, Heterodera glycines
  Homolog annotation: Hit_ID=NP_502202.1; Match level="QueryCoverage =75%, HitCoverage=61%, E-value=2e-36, Identity=50%"; Hit description =tafazzin (4M416) [Caenorhabditis elegans] emb|CAA92638.1| Hypothetical protein ZK809.2 [Caenorhabditis el
  Gene Ontology: Mol. function=acyltransferase activity; Cellular component=integral to membrane; Biological process=phospholipid biosynthesis
  Coding regions on vcDNA: vcDNA=SeqID_88973; Strand=+; Position=56-655
MDSPPTSTSKLMQIPLLSAKRRKEVLNFQWPFPKHPGLLYRLGSNAVILAVFSLAKLVFCFNKILVQPEQKKLVLDLLNDRNRPLVTISNHRCVVDDPLIWSMFTFREFLSNISRFRYILTAHDICFTKKSHIFFFSLGRCVPVVRGAGVFQEGVDHCVDMLNSNGWVHLFPEGRVTTESGPIKGGIGPINFRNRTNPPI

SEQ ID NO: 162551 - protein, 217 aa, Heterodera glycines
  Coding regions on vcDNA: vcDNA=SeqID_88974; Strand=+; Position=3-653
QRLLPSPAAAFVPSPNGTVSVPSLPSSPTTRTTTTAMISVPAIATVTATSLASSRVPSSSSPSPVAIHPTISTKAATSSAPIILLPNKRSKEGHQSQKQTMAKEMATDFAAESKGGRESEIRRAPARQNAEDEWTKANELDEKGIPPTQRTAPKLSTTTPATTTAHFWVIKDPREARRERLLQLRRKLDPNPEPPTTTTTSAPLLPLSPQFELHRIR

SEQ ID NO: 162552 - protein, 297 aa, Heterodera glycines
  Homolog annotation: Hit_ID=AAM18623.1; Match level="QueryCoverage =100%, HitCoverage=95%, E-value=1e-177, Identity=79%"; Hit description=C-type lectin domain protein [Heterodera glycines]
  Coding regions on vcDNA: vcDNA=SeqID_88975; Strand=+; Position=3-896
FSGYCYKAFTNADKEVKYSEAQKICKSDGAELVSMHSELEREFVNVVALTAAKKYEYNAKVPGLAFYWTSMQLEWDEKKLKNASWADMTPMDYLSPMEWGTKKRPVYVDNSNGGEYNKENENCVFIGQWPREGKQYLKLDSAVDKYGLDVLWRDEVCEKPGEDCPRGAVCKKRATVGECYGTGAYLLDAAEEEEMKKLLKFITVGSGTFVYAEKNTYMVLLLKDLYGKQMKEEDRKKVCAYYKAEYVTVKAEPNKVQEYVDKVLSKQKQMYADASDHMLCKFSGTLGGCGDYCKTGY

SEQ ID NO: 162553 - protein, 203 aa, Heterodera glycines
  Coding regions on vcDNA: vcDNA=SeqID_88976; Strand=+; Position=3-614
TKANRRCCRGRICCVSPAKSRNGTSDASPDGSIGACPPVSRRTSTGAASAVWTYGKHRGTLRSTILNIPLHQCPLCEYGAAEARLVQRHMRNNHTLKECEASERTDERVKKTKGQTKFKGMEPIANVEKHRAEFSELHNQCFPGRPKRLSNITIADESRRAKCRGCAQVRDSEGGGDKLPFDGEKLGRFQGMRKWHFRFHPFF

SEQ ID NO: 162554 - protein, 80 aa, Heterodera glycines
  Coding regions on vcDNA: vcDNA=SeqID_88977; Strand=+; Position=45-287
MHSFKLFASLFLVLCVVSLVICQDKPAAACKPPKSVGRGNLALTRWWWDGRSCKQFIYKGQGGNTNNFPSKKLCEDVCKP

SEQ ID NO: 162555 - protein, 208 aa, Heterodera glycines
  Coding regions on vcDNA: vcDNA=SeqID_88978; Strand=+; Position=363-989
MEQLSAVQPENKIEIEQPNEGDADGEQQPAEPIQLIDKEREYLAVKAASRAVISHLSEWSTPIEMRFAMDGTVETKRKMRRRFCIDRQQMLHDIECMYAPKIGIKQILNVDIVGCQDEISQATENVYQMVYDGGFFRKQTGLCNFKVLKPTPTTKNVLDNVINGILHGCLIHVQETILKNKEMVKKLAKCLAEKENNRMGEAEISDFF

SEQ ID NO: 162556 - protein, 211 aa, Heterodera glycines
  Homolog annotation: Hit_ID=AAC47437.1; Match level="QueryCoverage =100%, HitCoverage=80%, E-value=4e-88, Identity=60%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_88979; Strand=+; Position=1-636
IWSEVSQLKGMPLLVAGNRTARSAYGSCQECCSGGAQGQPGQTPQTPCEQVHPPPCTPCPGGQPGNNGPPGPPGAPGAPGQPGTGGGQPQPGEPGPPGPNGQPGQPGQPGAPGQPGQPASPPPTEPAPAGPPGEAGAPGQPGQPGAPGQPGAAGQPGPKGPPGGPGQPGNGGAPGQPGQPGQPGNPGERGICPKYCAVDGGVFFEDGTRRR

SEQ ID NO: 162557 - protein, 173 aa, Heterodera glycines
  Coding regions on vcDNA: vcDNA=SeqID_88980; Strand=+; Position=16-537
MIKAYQRFILRFFFVSLFLLSINAQRYGSHSYGSGTYGTNYWSSSYGNSRTQPSYGYGGQQSRYGTHEQNGGENGQFERQNAWRGGGGQWGQNQQNWGQPQQQQGATAAVEGGWGRRQQQQFPSPAPPKTQNNWDNSDNFAPSTAQNRGKLRVDLPPGAPGTMEAADADQSSK

SEQ ID NO: 162558 - protein, 119 aa, Heterodera glycines
  Homolog annotation: Hit_ID=CAE73799.1; Match level="QueryCoverage =74%, HitCoverage=15%, E-value=6e-10, Identity=32%"; Hit description =Hypothetical protein CBG21349 [Caenorhabditis briggsae]
  Coding regions on vcDNA: vcDNA=SeqID_88981; Strand=+; Position=211-570
MNRRVDSSTDNDGQSASTLRQANKGGTRRGGTKRQDKANRALHMRLARLRQSQLAAKREFERNMQMKANNAAQSPASNCFDRAPWCSGWIQSSPLICRTSSIYMRQDCAKSCGFCSSSS

SEQ ID NO: 162559 - protein, 209 aa, Heterodera glycines
  Coding regions on vcDNA: vcDNA=SeqID_88982; Strand=+; Position=1-627
VSLDKQTPKLTEQMIRKCQVLPIDLPRGIETQRDKGMIQNNNPFFRAHGVRVETNMMQAEAQHLYPPALGFSAQNEQIEPNNRGVLDFRLADRGQPLPRRYLLPCEFPEVWTVVIVQNSIRMDQCRYFCENLMRCAQARGVQMGKPRIDPMEDTSLNYVRERFDFYSKHRCQFGLFIATGKESTRVGDVHHVFKLQEVEHGVLTQHVSP

SEQ ID NO: 162560 - protein, 116 aa, Heterodera glycines
  Coding regions on vcDNA: vcDNA=SeqID_88983; Strand=+; Position=32-382
ISKNNIIVYILHHFFRIIVKLSSHQNIACLPFFQTYDRENCILTPAPCTICAYAATHGQLPAKLFDFTKEAVAVLESIRFINNSGVAYLAELFRGQLGKKAVKRKVRKRKQSTDNK

SEQ ID NO: 162561 - protein, 171 aa, Heterodera glycines
  Homolog annotation: Hit_ID=AAQ64867.1; Match level="QueryCoverage =81%, HitCoverage=37%, E-value=4e-17, Identity=35%"; Hit description =Tak1 [Drosophila simulans] gb|AAQ64865.1| Tak1 [Drosophila simulans] gb|AAQ64864.1| Tak1 [Drosophila simul
  Gene Ontology: Mol. function=protein tyrosine kinase activity; Cellular component=cytoplasm; Biological process=JNK cascade
  Coding regions on vcDNA: vcDNA=SeqID_88984; Strand=+; Position=24-628
MKPLKIDVDFPSNSHPTSQELNQDCIPLYEMLEFEELQFPNYYLSEQLGRGAHATVMPCHFHGKPAAAKLFNANVDFKTIQKEAKLLHEFRHENIIELYALFHGTMSGLVLELMEGGSLSELIHQRKSIVYQNCHVINWTFQVAKALEYLHKLSFIHRDVKPSNMLLSLDY

SEQ ID NO: 162562 - protein, 293 aa, Heterodera glycines
  Homolog annotation: Hit_ID=CAA65506.1; Match level="QueryCoverage =100%, HitCoverage=93%, E-value=9e-82, Identity=52%"; Hit description= cuticular collagen [Teladorsagia circumcincta]
  Gene Ontology: Mol. function=structural constituent of cuticle; Cellular component=extracellular; Biological process=cuticle biosynthesis (sensu Nematoda)
  Coding regions on vcDNA: vcDNA=SeqID_88985; Strand=+; Position=1-882
AFFGVVMSTVATVICILSVPLAYQNFQQIGTKMQNELEFCKQRSGNILRELTRTQTLAQVVGIIGNARGNGAAKARTARHLVYGEAGVSGSAAQAGLCCGCGVSPPGLPGPPGPVGQPGFDGVPGAPGQTGPNGQAGASGGGSFGAGCGECQPAQPGLPGPPGLPGPSGNPGLPGPNGGQGPLGPPGPPGPDGQPGESGQSGQPGAPGRITGYGPTVVGPPGPPGPNGYPGAPGQPGLPGSFGQPGGPGQPGDAGKPGTPGNPGGNGGPGVAGEIGNMGTCDHCPTPRTAPGY

SEQ ID NO: 162563 - protein, 199 aa, Heterodera glycines
  Homolog annotation: Hit_ID=CAE69933.1; Match level="QueryCoverage =94%, HitCoverage=50%, E-value=4e-77, Identity=75%"; Hit description =Hypothetical protein CBG16309 [Caenorhabditis briggsae]
  Gene Ontology: Mol. function=isocitrate dehydrogenase (NAD+) activity; Cellular component=mitochondrial matrix; Biological process=isocitrate metabolism
  Coding regions on vcDNA: vcDNA=SeqID_88986; Strand=+; Position=138-734
MFSLQAIAVPEIAKKLKCTLIPGDGVGPEQAYAVQDIVKATGIPIEFEEVFLSEVYYSRSASIEDVVDSIARNNCVALKGAIQSSLDDKTDGLNTQLRKRLDLFANVVHIKALEGIRTRHNKMLDFVIIREQTEGEYSRMEHELVPGVIECLKIMTRVKCERVAKFAFDYATKHGRKKVTAVHKANIMKLGDGLFLNVC

SEQ ID NO: 162564 - protein, 203 aa, Heterodera glycines
  Homolog annotation: Hit_ID=NP_493617.2; Match level="QueryCoverage =70%, HitCoverage=48%, E-value=9e-14, Identity=35%"; Hit description =i-90 protein (34.4 kD) (1P608) [Caenorhabditis elegans] emb|CAB04261.2| Hypothetical protein F33H2.6 [Cae
  Coding regions on vcDNA: vcDNA=SeqID_88987; Strand=+; Position=30-638
MFRRFISSAPNVAKVFGGVGLSTVVAAAIPDVELKKKPDWYQETVHRLEKTLKKLSTYAYIENSDILEDAKDILMRCENVNNCDISWRLGRALSEKGDLFSVVDSENRIEFFAKAIPHFQKAFTLEPKNGSAGAHKWYAITLKRLRLITSQHPYVKNANKEVIEHLEKAHQIDPKDAITCHLLGVECFENGRYDEAMKLFQAA

SEQ ID NO: 162565 - protein, 179 aa, Heterodera glycines
  Coding regions on vcDNA: vcDNA=SeqID_88988; Strand=+; Position=3-539
TMAVSHPQQKQNGRHSGGGTVPKHIGIGRLPTEDNGTTSGGNPPHQLDDADDNHYQFQLPLAFRSSLVHPTTTTAQNVQHHQLLQQPQLNATIPSMECVSVIHPKREQQFSASVDQFVDGDDDQFKTEPLDLSLSSARTKANENGTMGGNGATVAGGIQRRKRTTNKRQMAEEMCETTG

SEQ ID NO: 162566 - protein, 196 aa, Heterodera glycines
  Homolog annotation: Hit_ID=NP_492823.1; Match level="QueryCoverage =100%, HitCoverage=18%, E-value=3e-39, Identity=44%"; Hit description= RING zinc finger containing protein (1L381) [Caenorhabditis elegans]
  Coding regions on vcDNA: vcDNA=SeqID_88989; Strand=+; Position=1-1038
IEQPISRHLRRLVTSITLFFTIILLVVYVPVRVIKWLCPSTLPYVFSGSADTPLVEYSFELVLLQVIMPSILEYSKAFSLLKRTVRIWCRVVGGWLSLDSYLLPADKEKRNGGQQHREQQRQRARERAQLHREQRNLGAQHQALLRFRDSSVPEEYVQPNLFPLRISLLLFFVALPTIAISLLFFLLPGTIGRFLL

SEQ ID NO: 162567 - protein, 143 aa, Heterodera glycines
  misc_feature (135)..(135): Xaa can be any naturally occurring amino acid
  Homolog annotation: Hit_ID=NP_502390.2; Match level="QueryCoverage =67%, HitCoverage=9%, E-value=5e-25, Identity=54%"; Hit description =high Incidence of Males due to increased X chromosome loss HIM-6, human BLooM syndrome related, RecQ helic
  Gene Ontology: Mol. function=ATP dependent DNA helicase activity; Cellular component=nucleolus; Biological process=DNA replication
  Coding regions on vcDNA: vcDNA=SeqID_88990; Strand=+; Position=213-641
SCSDVGGQSHQGPFHEFIDDDFLFEKAEQHPPIVVANPSAPNGPFKIRDSSAEFHNDVNLLGVGGQKDVFRKLKDVFGFSYFRFKQKPAVVAALLGHDCFIVMPTGSGKSLCYQLPAVLHPGVTIVVSPLLSLMXDQIIKLQN

SEQ ID NO: 162568 - protein, 146 aa, Heterodera glycines
  Coding regions on vcDNA: vcDNA=SeqID_88991; Strand=+; Position=2-442
RSKSFTFTFVQQSPSNLSTRNPVAICVQMSTDVNLAPCELSFAVDQFDDPLTRQAISGAVDQARTLFAQRHTAIPNIVDTHHILVSRSPHGFTEGSSVSAGSFAAFFSLMINRCFRMDDVAFSGQIGLERQVQYVQQNCGESCRHE

SEQ ID NO: 162569 - protein, 181 aa, Heterodera glycines
  Coding regions on vcDNA: vcDNA=SeqID_88992; Strand=+; Position=32-577
KKIMEQLDSTLNAAKNETERLAEQLKKSAEQAQKEVRERTLHQDPYLRLVYQLQTAHLIALGIEVLTLYLGWRDVNFVWLLLPLLFCAGAIWIVSQRWYHQMDGRSDFNKVLSADKMPVRAKAASCLVGGFVLSLLAQWTAPTMGSTSIGLLFSLSSHAAVLVGAVCSAIELYEGVKLKNR

SEQ ID NO: 162570 - protein, 213 aa, Heterodera glycines
  Homolog annotation: Hit_ID=NP_505498.1; Match level="QueryCoverage =92%, HitCoverage=50%, E-value=6e-24, Identity=33%"; Hit description =putative mitochondrial protein (42.9 kD) (5K173) [Caenorhabditis elegans] emb|CAA94803.2| Hypothetical pr
  Coding regions on vcDNA: vcDNA=SeqID_88993; Strand=+; Position=24-662
MECIGCLAFRTSFSVLLRPFSSANFGQGARDIGSRHNVSSRHSALLEKALAPFVPRTAKELAEYLAKNVLYHSVGDVLVVHKPYGVGSLGYVQKEFGIFPTTQYKFKDRMDLFNGVKKDDSVTLEDAIPHLKEIFHEPKLHFCTGLKRWVSGPVVLPCSEKAFKNIGHSLFQGESISHSNEHWTAQHMHRALAICISRPPRDEGAVHGYATFQ

SEQ ID NO: 162571 - protein, 93 aa, Heterodera glycines
  Coding regions on vcDNA: vcDNA=SeqID_88994; Strand=+; Position=341-622
LPNDEEQQKASFSNFMHIKRCDSGQVIDFIHSHFVGMTSVYSRVCLSVNCMCDGWVKKLINEDKINIRVQWESEREEERTIMMIKHFFLNFII

SEQ ID NO: 162572 - protein, 204 aa, Heterodera glycines
  Homolog annotation: Hit_ID=CAE67763.1; Match level="QueryCoverage =85%, HitCoverage=18%, E-value=2e-15, Identity=30%"; Hit description =Hypothetical protein CBG13338 [Caenorhabditis briggsae]
  Coding regions on vcDNA: vcDNA=SeqID_88995; Strand=+; Position=25-636
MFICGGSRLLGNWRPEKALEMARETEDGEENQSQQKTNSGRNQSSSSVWRASIELGPEDSQRLLRFRFFLGFPLQIDPSNCQSSLSLLVVRWEAKMSPRCILPSIESNSMGECNKGVTSEFGSYGGRDRLIMDGWLHGREQRQIFLRMFGTALRFFDPKLSERRFLIRVTPCDVRMDKEFDFANSNGPVGWRTPSLYVHSLDSL

SEQ ID NO: 162573 - protein, 151 aa, Heterodera glycines
  Coding regions on vcDNA: vcDNA=SeqID_88996; Strand=+; Position=192-644
KRVMANTFPSFAFTYFFVELPTTSSIVWLIHCLFNRGLRLLLLLLFCQCSSSSCSSPVAAPNRRMPTAVFHCAALPVRRKMPQCTAARSLLLERSGCESLITNITLISTNFEPRTRIRTKVENSNFLFHLCFLAFFSRVDPSQLTTNEGNA

SEQ ID NO: 162574 - protein, 236 aa, Heterodera glycines
  Coding regions on vcDNA: vcDNA=SeqID_88997; Strand=+; Position=46-753
TMDHRYKAIIIGKSDQHLSDMFLKLWLIGEWKCVDIKFGRYGGYNLLDPVDVGDFVELYDGGGPIRRLPPGPALPKTRILDGSNGTRSCLKVKVNFMPLDFLLFPASAKEKNLRMAMSAELGPIPIANENSFKLHCFYRGVATLFFAKDSKEEMIAEVYNTPWLIKSDGASLAESDFSTIVHTFAFCQSQDVHRQGLVVDASLKDVFFVHCAELPEMVSLRKDITGGRIAVGDWIE

SEQ ID NO: 162575 - protein, 209 aa, Heterodera glycines
  misc_feature (127)..(127): Xaa can be any naturally occurring amino acid
  Homolog annotation: Hit_ID=NP_741192.1; Match level="QueryCoverage =96%, HitCoverage=28%, E-value=6e-51, Identity=52%"; Hit description =HepA-related protein HARP (3H483) [Caenorhabditis elegans] gb|AAM22029.1| Hypothetical protein C16A3.1c [
  Gene Ontology: Mol. function=DNA dependent ATPase activity
  Coding regions on vcDNA: vcDNA=SeqID_88998; Strand=+; Position=1-626
VIEKKSDPLPISRNTSVTIVLSYDLMVSKAKQLKSNSIYVVVFDECHLLKEQTTQRTKVAFELSKIANRVILLSGTPALSRPSELFTQVRMIDPKIFPSWVKYAVRYCGGKKGRFGFEAKGRCALCXNPDELKTVMDKIMIRRLKKDVLDDLPEKRREVVYLSGDAIDAKIRELKKARDACEQANRYSDAKTKKETFAEYYVQVAPFFP

SEQ ID NO: 162576 - protein, 238 aa, Heterodera glycines
  misc_feature (5)..(6): Xaa can be any naturally occurring amino acid
  misc_feature (8)..(8): Xaa can be any naturally occurring amino acid
  misc_feature (11)..(11): Xaa can be any naturally occurring amino acid
  misc_feature (13)..(13): Xaa can be any naturally occurring amino acid
  misc_feature (19)..(23): Xaa can be any naturally occurring amino acid
  misc_feature (28)..(29): Xaa can be any naturally occurring amino acid
  Homolog annotation: Hit_ID=CAE63551.1; Match level="QueryCoverage =99%, HitCoverage=42%, E-value=5e-89, Identity=66%"; Hit description =Hypothetical protein CBG08037 [Caenorhabditis briggsae]
  Gene Ontology: Mol. function=glucose-6-phosphate isomerase activity; Cellular component=cytosol; Biological process=neurogenesis
  Coding regions on vcDNA: vcDNA=SeqID_88999; Strand=+; Position=5-718
QRDKXXTXERXNXTEDRPXXXXXARNTXXTPFFFNNNDVMPSVMAVLTQMKMFCDDLISGRWTGWTGERIKDVVNIGIGGSDLGPLMVTEALKPYQQGPNLHFVSNIDGTHLAQVLKKVEPKTVLFIIASKTFTTQETITNAESAREWFLREAVDTAHVAKHFVALSTNGQKVEDFGIDKKNMFEFWDWIGGRYSLWSAIGLSIAVHIGFDNFESLLGGAHLMDQHFKEEPLEKNIPV

SEQ ID NO: 162577 - protein, 214 aa, Heterodera glycines
  Coding regions on vcDNA: vcDNA=SeqID_89000; Strand=+; Position=2-643
KSGMDVWADIAKADFMDERFSRVITANKAYNLFQNSIAELDERSFRAQAAILNGLLTHHLDFIHGKCVDLRKIGLLLDHFDRLVLRSECLLAQNANISLLRCLVKCSFYCRFADFLLCSSIYQQSFNEFRLLAMAMFCYGLALKWACHKSVKGSDGADSALLSLCAAELTTLLRTNLHADSQLEAEMHECDRNMLLSFLRCYSSSVPYKDCAQF

SEQ ID NO: 162578 - protein, 92 aa, Heterodera glycines
  Homolog annotation: Hit_ID=CAE59600.1; Match level="QueryCoverage =85%, HitCoverage=42%, E-value=8e-13, Identity=48%"; Hit description =Hypothetical protein CBG03007 [Caenorhabditis briggsae]
  Coding regions on vcDNA: vcDNA=SeqID_89001; Strand=+; Position=473-748
MNMGMPAGATEVPEGVVQLNVGGTCFLTTIDTLKRDSGALLSQLLTLEGLEKNSKVAKRMSNGTIFIDRDGELFAYVLDYLRTGKLLLPENF

SEQ ID NO: 162579 - protein, 148 aa, Heterodera glycines
  Coding regions on vcDNA: vcDNA=SeqID_89002; Strand=+; Position=191-634
IIHLCSRHYLIFNCDRIQTYNKNRRAKNPKLNTIVISVARINKNGSSKIIRISIIMDGKTIKFIADSGSDINIIDEIAYKCIGSPTLGKSDEEGIFFDGRRCQFIGKGFATFKFKGIEVKQPFYVAKAGALNLLGSATMDKFGFLEGI

SEQ ID NO: 162580 - protein, 77 aa, Heterodera glycines
  Coding regions on vcDNA: vcDNA=SeqID_89003; Strand=+; Position=423-653
LICIFPLFVKMLRLIIIKIKFYFYFLIYRQIVKRTKQYKTDLDSQSCTAAGAGIGCCCLLTQIRAELANRWAGIATG

SEQ ID NO: 162581 - protein, 196 aa, Heterodera glycines
  misc_feature (97)..(97): Xaa can be any naturally occurring amino acid
  misc_feature (115)..(115): Xaa can be any naturally occurring amino acid
  misc_feature (129)..(129): Xaa can be any naturally occurring amino acid
  misc_feature (147)..(147): Xaa can be any naturally occurring amino acid
  Homolog annotation: Hit_ID=AAL31950.1; Match level="QueryCoverage =76%, HitCoverage=33%, E-value=5e-32, Identity=56%"; Hit description =CDH1-D [Gallus gallus]
  Coding regions on vcDNA: vcDNA=SeqID_89004; Strand=-; Position=567 -1155
IGSSLHTDRSRNTNRPRISRNGSVPGSDGRCVQRAGTYSERVDDSPLQGIPRSRTIIAMSDPNHGKFSPVYQPLSGKDKHADFASVARVQPRTSKGXHRPVIAQFRAAEHRKSLXEVVPTEAMSQLFSXARVSLVIGINQTNRSTNXERPCTTIHRIMRKLSICQSLRCPGRVSFPVLSQIKPQAPLLVVPFRQFL

SEQ ID NO: 162582 - protein, 297 aa, Heterodera glycines
  Homolog annotation: Hit_ID=AAO51804.1; Match level="QueryCoverage =97%, HitCoverage=74%, E-value=1e-14, Identity=24%"; Hit description =similar to Arabidopsis thaliana (Mouse-ear cress). Hypothetical 44.4 kDa protein [Dictyostelium discoideum
  Coding regions on vcDNA: vcDNA=SeqID_89005; Strand=+; Position=114 -1004
MKHGAKLDAIVTDLVLQPMEEKMETAEAEVRHQTEDIAVASSTCEPELSVHAQFLLTDTLNGLKRTLDDMAQEHKHPIHHLISRCGKAIDTRFFSDLSRLLKNEKEIETDSDNLRHANRLILEHLMGLGRTEVADVFLQESAMSSLEVPDIDNFETLRNIMDSFKRQDYLPTIQWMKANRGEDNDRHDLLFRLQCQHVIRLLETNGKRQALGYVKEMQDEEKEKYKEELKHLMFVVMTHPQKGPHDYLFNEGRRFELEWKLANAITDYRSSLSTMLNAGAKTVPSLMTMRAFLNTSR

SEQ ID NO: 162583 - protein, 227 aa, Heterodera glycines
  Coding regions on vcDNA: vcDNA=SeqID_89006; Strand=+; Position=4-687
NCKRMTENRRAAREIQRQQQKQQSLLKKIDFCSSNVFDLLDRPTVGTSLAPISAVFDAIVDAHLFGKNRYIDHTVVAFLHRILRLFRHSAIALKMVIWPQSVRAWHVMAQQIWPLAASNVCQLSVDSYVFSRLREFVSPSVLRDCANLRQIESDGLFPEGPPDDHPHASDGQALAKWLHTPRADGRPKLLNVEAMTGQFHEQIERLKENKQEDGRNKSKTPKNNFYW

SEQ ID NO: 162584 - protein, 242 aa, Heterodera glycines
  Coding regions on vcDNA: vcDNA=SeqID_89007; Strand=-; Position=1-726
VVRRQIRAQIGIIKIPEKYFCVRSVELFDECLFGFVPMAAVDNVQKGPIQHTLELKGGVKLFVGNWQQNRRRNRQMVKSRKGMLKETRLNTVVERIRHTTSKRLPPTAMEQSRTAKAKAGGWTTIGNFDVGTLQLAGGKRVVQHLLNRCALPAVHAQLKLQQPMVEAEHRRRTVIVGALSRFICAIARLLLVFFPVKPKEQFHRKQNQRGGVHFAWHWKPFAVGPSKFQCFPRWCRVRVAFD

SEQ ID NO: 162585 - protein, 207 aa, Heterodera glycines
  Coding regions on vcDNA: vcDNA=SeqID_89008; Strand=+; Position=3-623
DLLHVKLLSVIAIQFFPYLQINTNITTSGTLNEGSGGGTGTAAPGQNNTNGDITGGSSAAAAVAGNVHRCQSPIMEAEVAEDTSNKMFPSHEQSQQLQQQPQGVKKESVGSSNSTTSSTRVASVVHPIETTKDSKPKPSVKDNTTISPQALNSMLSGSPLITTPSIAPQQRHAPGDYTDAAVTGGKTRGGVPHHLHQYQQQQVVPHQ

SEQ ID NO: 162586 - protein, 83 aa, Heterodera glycines
  Coding regions on vcDNA: vcDNA=SeqID_89009; Strand=+; Position=325-573
PYPLCCGLGFIPTCGLALSRPPPLWLTISCILPAPSHSSPCLMSIKRSPHPRPPLGCGLGSAFPIQYLPTTWGFFVASGEGWG

SEQ ID NO: 162587 - protein, 261 aa, Heterodera glycines
  Homolog annotation: Hit_ID=CAE73507.1; Match level="QueryCoverage =97%, HitCoverage=61%, E-value=1e-108, Identity=74%"; Hit description= Hypothetical protein CBG20965 [Caenorhabditis briggsae]
  Gene Ontology: Mol. function=sterol carrier activity; Cellular component=peroxisome; Biological process=steroid biosynthesis
  Coding regions on vcDNA: vcDNA=SeqID_89010; Strand=+; Position=44-826
MVTNAQNRPKVFIVGVGMTKFYKPKSSGKDYPELVREAATEALEDAGLKYDQIEQATASYMYGGSCCGQRALYEMGLTGIPIFNLNNACASGSSGIFLCKQIIESGNVDLMLAVGFEKMNPGSLEATQGMEGDRALPVDKHIQLMADTYGLQAAPITSQMFGNAGREHMEKYGTRREHFAKIAYKNHLHSVHNPKSQFQKNFSLDEVINARKIYDYMGLLECSPTSDGAAAVVICSERFLEKNPRLKGQAVEIVGIELGTD

SEQ ID NO: 162588 - protein, 89 aa, Heterodera glycines
  Homolog annotation: Hit_ID=NP_492715.1; Match level="QueryCoverage =52%, HitCoverage=8%, E-value=2e-09, Identity=63%"; Hit description =carboxypeptidase a2 precursor family member (1K935) [Caenorhabditis elegans] emb|CAB00065.2| Hypothetical
  Coding regions on vcDNA: vcDNA=SeqID_89011; Strand=+; Position=536-802
WPYSDINFPHLDVSFQNWYDDRLVRRAQKKRLRIVVADQKAKGDYHSYIKMLTWMDDIERFYPQLAKTFTIGTTYEGRSIRGIKIESPV

SEQ ID NO: 162589 - protein, 89 aa, Heterodera glycines
  Coding regions on vcDNA: vcDNA=SeqID_89012; Strand=+; Position=3-272
IPALFMRRSPNRTDFVAKCLSLRPKASDYCFSKRLNTLKFHKSNKKPLNSLFKKFLLTNTLLKDITSWSSVKIALLLMIRGGFSFYLNS

SEQ ID NO: 162590 - protein, 166 aa, Heterodera glycines
  Homolog annotation: Hit_ID=NP_500728.1; Match level="QueryCoverage =91%, HitCoverage=90%, E-value=2e-13, Identity=28%"; Hit description =putative nuclear protein of bilaterial origin (4F924) [Caenorhabditis elegans] gb|AAB88317.1| Hypothetica
  Coding regions on vcDNA: vcDNA=SeqID_89013; Strand=+; Position=2-502
ENQNASDPKIAKIAKPLQPRKYPFVELVPLMGKNHLDTVSERVRGIHPCVEERHNLFACLKKWDYDDMKCTKFSDSLFSCMESNKKIVAAHNEQRIKGEQPLHIVDEGSSVKAEASNILQADIDRLFRKWKQPELGTIQTKVMKRRGHMPYYVDYFHRKNMKGWRA

SEQ ID NO: 162591 - protein, 176 aa, Heterodera glycines
  Homolog annotation: Hit_ID=NP_510179.2; Match level="QueryCoverage =97%, HitCoverage=32%, E-value=2e-32, Identity=39%"; Hit description =sorting nexin 17 (XN732) [Caenorhabditis elegans] emb|CAA93650.2| Hypothetical protein F17H10.3 [Caenorha
  Gene Ontology: Mol. function=protein C-terminus binding; Cellular component=membrane; Biological process=endosome transport
  Coding regions on vcDNA: vcDNA=SeqID_89014; Strand=+; Position=65-612
MIHIAIPSHRTLADHEDPYNKFTVYDIHVNGAFHASVRYNLLYSLHEKLIDLFGFRLNAPDFPPKKLWKLDAKALNERREGLAKYLQGVVANPDVSRHPVMERVFLDFQVKSFSAAVSRMTKLEIFLPDGRPVYVECGTDEATNVIMERFCHAIGLSEKNAKFFGIFLCRPRRGRG

SEQ ID NO: 162592 - protein, 196 aa, Heterodera glycines
  Homolog annotation: Hit_ID=NP_740904.1; Match level="QueryCoverage =96%, HitCoverage=40%, E-value=7e-64, Identity=61%"; Hit description =EATing: abnormal pharyngeal pumping EAT-16, regulator of g-protein signaling 7 (54.7 kD) (eat-16) [Caenor
  Gene Ontology: Mol. function=GTPase activator activity; Biological process=regulation of G-protein coupled receptor protein signaling pathway
  Coding regions on vcDNA: vcDNA=SeqID_89015; Strand=+; Position=4-591
MKASETMTNWSEQFQEYDPFITQPHPTNPWVSDDPSLWALNADNVEVPTERRVKRWGLSVMELVRDPIGRQVLESFLDSEFSSENLRFWCCIQDLKFSPNCQVKTKGQHILDEFLAPGAPCQVNVDSRTLEETLRCLEESDQALRNQRFAFSVSEEHVFTLMSKDSYPRFLRSGIYKAVLDAAKAKGGRKRIIDLI

SEQ ID NO: 162593 - protein, 183 aa, Heterodera glycines
  Homolog annotation: Hit_ID=CAE72242.1; Match level="QueryCoverage =49%, HitCoverage=29%, E-value=5e-28, Identity=68%"; Hit description =Hypothetical protein CBG19360 [Caenorhabditis briggsae]
  Gene Ontology: Mol. function=transcription co-repressor activity; Cellular component=nucleus; Biological process=negative regulation of transcription from Pol II promoter
  Coding regions on vcDNA: vcDNA=SeqID_89016; Strand=+; Position=140-691
ESTQEVASSSSASDPTTQLIISSLNSVRKTNEGTVENATKKTDNKELSTDEDEQQNVASTSTPEDGEFSKISRIRKRRYSQARIQPTRVKKVMQSDEDIGRMVASVPVAIGSAMEVFAEKLLLAAAESVQHSSTKTLSPMHIKMAVSRVPQFSFLEPMLRDVPMNPKMAPSFGQQSSSTSNGE

SEQ ID NO: 162594 - protein, 218 aa, Heterodera glycines
  Homolog annotation: Hit_ID=CAE59552.1; Match level="QueryCoverage =94%, HitCoverage=11%, E-value=1e-43, Identity=47%"; Hit description =Hypothetical protein CBG02948 [Caenorhabditis briggsae]
  Coding regions on vcDNA: vcDNA=SeqID_89017; Strand=+; Position=1-654
EVILAAETVYDCVHSCYQQNCSRAAFTHFPRSVCLMHFGGEVPLDQKCAEVDRLGTTWDFSSVPEVVEIKCVKCAGRKESVEKSTDNEQNIAKRHFSNDENAVGQQETTARHILNPQGLTLKCDGRVEFVASPVANLHPLNITNDVPADTAADCARKCFEAIHCTLAAFIPTPGHESAGGICLLTSDAGDVACAGTSVRHSPQHASTVPFLIKCIRCS

SEQ ID NO: 162595 - protein, 209 aa, Heterodera glycines
  Coding regions on vcDNA: vcDNA=SeqID_89018; Strand=+; Position=3-632
NATQWIRAELENSWPLEIIRHVKIGIKNPVTDPYSYNYTANLIDDIVSPRGPFGYVSQILVTNDFDRIENFWQRCPASYCAVVKGYKGINFSLFRHKVGHLTRAHKAERWFERNRDKMYDIILKNDKTSDLGTLMRAIEMEIGPVTSPDLFHSYVIAHVSTMTAKACVVPVGLSFSQFTNYSGYSMIEAYSHYRFPTTHDERFKLFLFI

SEQ ID NO: 162596 - protein, 208 aa, Heterodera glycines
  Homolog annotation: Hit_ID=AAD37247.1; Match level="QueryCoverage =74%, HitCoverage=36%, E-value=6e-10, Identity=36%"; Hit description =chimeric AFGP/trypsinogen-like serine protease precursor [Dissostichus mawsoni]
  Coding regions on vcDNA: vcDNA=SeqID_89019; Strand=-; Position=3-629
ATGRRGRRGVAADAELDRATAAGGRRAPAATAAAPVTAARRGRWRGFWAFAANCQLNGTAAAAAAICTITATTTSAAAAAPATAARRGRRRAWGVAANCQFNGTAAATAATSAATAATAAARRLTTAARRGRWRARRVAADAELDRATAAGRRRAPAATALPTETCRVGRNLKAGEKRMGKGRDEKEEKRTFANEGHLDKGKHKLGGK

SEQ ID NO: 162597 - protein, 211 aa, Heterodera glycines
  Homolog annotation: Hit_ID=CAE60266.1; Match level="QueryCoverage =99%, HitCoverage=21%, E-value=5e-35, Identity=41%"; Hit description =Hypothetical protein CBG03843 [Caenorhabditis briggsae]
  Gene Ontology: Mol. function=translation elongation factor activity; Cellular component=nucleolus; Biological process=ribosome biogenesis
  Coding regions on vcDNA: vcDNA=SeqID_89020; Strand=+; Position=2-634
SLCRVMSGTLRIGDQLNVLRHSASSEDVWHSVKIGTLFLLMGRELLPVECVPAGRICGVEVSDGRWIGGQTLCSRALAVTEVPRMSWHQKFAEPLVRVTVRPTNAGMAEMEELRSALRQLSVLDSAVRVIEQEDGDLAMLTAGEVHLQKCLEDLKLLGQTEIVVSEPIVPFLETLIPDIRLPFSRILKDHETECFLRQFSLRITLRAVPLH

SEQ ID NO: 162598 - protein, 264 aa, Heterodera glycines
  misc_feature (57)..(57): Xaa can be any naturally occurring amino acid
  Homolog annotation: Hit_ID=AAS07042.1; Match level="QueryCoverage =87%, HitCoverage=23%, E-value=9e-46, Identity=38%"; Hit description =minus agglutinin [Chlamydomonas reinhardtii]
  Gene Ontology: Mol. function=structural constituent of cuticle; Cellular component=extracellular; Biological process=cell-matrix adhesion
  Coding regions on vcDNA: vcDNA=SeqID_89021; Strand=+; Position=3-794
ETPGPPGPSTETPGPPGPSTETPGPPGPSTETPGPPGPSTETPGPPGPSTETPGPPXPSTETPGPPGPSTETPGPPGPSTETPGPPGPSTETPGPPEPSTETPGPPGPSTETPGPPGPSTETPGPPGPSTETPGPPGPSTETPGPPGPSTETPGPPGPSTETPGPPGPSTETPGPPGPSTAGTSSTKTYTVPTTPKPPPCCYGCDYPVDCHTSGKDCDYSPLQPPYQSDPYPVGKCVFKNVTCAAPNTGKVLFMKLNNDPNSVV

SEQ ID NO: 162599 - protein, 215 aa, Heterodera glycines
  Homolog annotation: Hit_ID=CAE65078.1; Match level="QueryCoverage =100%, HitCoverage=24%, E-value=2e-76, Identity=66%"; Hit description= Hypothetical protein CBG09936 [Caenorhabditis briggsae]
  Gene Ontology: Cellular component=cytosol; Biological process =invasive growth
  Coding regions on vcDNA: vcDNA=SeqID_89022; Strand=+; Position=1-645
LKATNEVDLYKPLKSYIDSLSELTEELRIEANDGLTELNKLRNRACCQPLDKHQSSLDIVARYYDQLCAMETKLPITPTQNPVSFKWKDAFDKGSLFFSRASLTLNDSSFERACVLFNCGALMSAIASNQQTNTDEELKTVAHLFQQSAGVFSKLKDTVLASVHQEPTSDLLPDTLTALLTLMVAQAQEAIYIKAAKDKLKSTSLLKIAAQCADF

SEQ ID NO: 162600 - protein, 210 aa, Heterodera glycines
  Coding regions on vcDNA: vcDNA=SeqID_89023; Strand=+; Position=3-635
SCRDILTRETRFAELLYAHAAQLALAEPRALVDALLALQQQHASLDVLQLLPAFQQCLDKRLPDRQALADAIFVFLDYFPLQNASPPFVNFTIHLYAVFRPQKLLVHLQKCAGESSSQPPSALTARRTHNHCHFDVAQALRICTENGSIARVFCVFALPRASLRGSDAFGVASRWPRVCQRVRATFGRRLSRSRRIRPNRAFGVLSWAGG

SEQ ID NO: 162601 - protein, 215 aa, Heterodera glycines
  Homolog annotation: Hit_ID=AAD11968.1; Match level="QueryCoverage =77%, HitCoverage=75%, E-value=2e-33, Identity=40%"; Hit description =P22U [Dirofilaria immitis]
  Coding regions on vcDNA: vcDNA=SeqID_89024; Strand=+; Position=20-664
MRCLFALVPLSRAVLLPFFADAVPPPAAVRSARPAARQAVAAQRQPPAGMERQCKCAEIKPCKDRYQKTMEPCLDTCQSHITSLGGNFRQVKACFTPKESLLNSAMRCTERQHDNACSHSSAAQFVPKRYGQTLENEAMVEIDRMIGRMGLDKSGSMKKLVSVSKKLFGCLKQCMAKRAGNCEKQLKCGLLLPSDSAMVQKTKSCALNNGFNTAT

SEQ ID NO: 162602 - protein, 204 aa, Heterodera glycines
  Homolog annotation: Hit_ID=NP_491476.1; Match level="QueryCoverage =90%, HitCoverage=79%, E-value=1e-28, Identity=37%"; Hit description =putative protein, with at least 3 transmembrane domains (26.1 kD) (1F480) [Caenorhabditis elegans] gb|AAB
  Coding regions on vcDNA: vcDNA=SeqID_89025; Strand=+; Position=58-669
MVKHIRGRPLGQVRIGFGDADPLWDSENEKYKVLCRSIHVSKAALYIGYMRLLVSLVSSLFFAYQYMMAVTGQLSSDHWINQVTARFMSQAMMSICLQVIVVVLMVHGVKAEKKSLLLPFIAYAAIAVLAGSIKVMSDLVYLDTSVYKNNEAESRAAKVQFLTNLLRTVLQAWCLSVVWRCYGYLTEKKVARQIREQLNSTATA

SEQ ID NO: 162603 - protein, 193 aa, Heterodera glycines
  Homolog annotation: Hit_ID=NP_491069.1; Match level="QueryCoverage =99%, HitCoverage=15%, E-value=1e-68, Identity=64%"; Hit description =coatomer (137.7 kD) (1D464) [Caenorhabditis elegans] gb|AAF36010.2| Hypothetical protein Y71F9AL.17 [Caen
  Gene Ontology: Mol. function=transporter activity; Cellular component= secretory vesicle; Biological process=locomotory behavior
  Coding regions on vcDNA: vcDNA=SeqID_89026; Strand=+; Position=3-584
LLLLAVPLLVVDTKQEVSEAQQLIQICREYLVGLLLETARKELPRDSVEDAKRNLEMAAYFTHCDIQPVHKILTLRTAANLSFKNKQMRHCASFCRRCIELAPKPEIAAQMRKMLAVAERDNTNAFELNYDEHNPFVLCSRSFVPLYRGKPQTKCPFCGASYAPTFAGSVCDVCEVAEIGRETSSNLMISNFK

SEQ ID NO: 162604 - protein, 160 aa, Heterodera glycines
  Coding regions on vcDNA: vcDNA=SeqID_89027; Strand=+; Position=40-522
MSVFSSSDGSCKSINSEAVFETAEDLGEALNLDAGVVEWLKEAPRSDEDPILVLDYTDLFHALPGTLNYNKTWVANLLVGQNAEKIRDNVFKFNTWTDLYSAQENLKSDPLLRRLFYFPNPLIAQQLNIPANPVISSIVITFFSDVSGKFQTNPFDFFKF

SEQ ID NO: 162605 - protein, 212 aa, Heterodera glycines
  misc_feature (56)..(56): Xaa can be any naturally occurring amino acid
  misc_feature (99)..(99): Xaa can be any naturally occurring amino acid
  Homolog annotation: Hit_ID=AAT48618.1; Match level="QueryCoverage =70%, HitCoverage=32%, E-value=2e-53, Identity=64%"; Hit description =Acetylcholine receptor protein 17, isoform b [Caenorhabditis elegans]
  Gene Ontology: Mol. function=acetylcholine receptor activity; Cellular component=nicotinic acetylcholine-gated receptor-channel complex; Biological process=synaptic transmission
  Coding regions on vcDNA: vcDNA=SeqID_89028; Strand=+; Position=1-634
DCCPNPYPDICYYFSIKRNPSYYLFTLIMPSALITTITVVGFFTPHSTTGENTEKXMMVSDKLPATSNSVPVLGQYYIGLICIQFTATYVTTWTLGLQXGNSGRTIPRRLRRWLMRVNAHGNFFVRHLLGRELRCTQQSIRNRMNKFDQLVDRADDRPSFVYSPMGSTFDSSAFARMTTASAVSVQQPIQLRQRAEDGKVIMAEKCQKQTNG

SEQ ID NO: 162606 - protein, 323 aa, Heterodera glycines
  Homolog annotation: Hit_ID=CAE58522.1; Match level="QueryCoverage =99%, HitCoverage=100%, E-value=1e-120, Identity=67%"; Hit description=Hypothetical protein CBG01674 [Caenorhabditis briggsae]
  Gene Ontology: Mol. function=transaldolase activity; Cellular component=cytoplasm; Biological process=carbohydrate metabolism
  Coding regions on vcDNA: vcDNA=SeqID_89029; Strand=+; Position=30-1001
MSLSVLDQIKQHSTIVADTGDFHAIEVFKPTDATTNPSLILAAAKIEKYKELILKAVKYAKERAAGQSKEAVIELASNKLFVLFGKEILNIVPGRVSTEVDARLSFDKEGSIAKALSLIKLYEEEGIEKERILIKLSSTWEGIEAAKVLESQHGIHCNMTLLFNFYQAVACAQAKVTLISPFVGRILDWFVKNSDKKEFDRITDPGVQSVKRIFNYYKKFGHKTQVMAASFRNTEEIKGLVGCDLMTISPALLGELAKDSEAVGPMMTVENAKKCELEQIEVDEKIFRWQMNEDAMADEKLADGIRRFAVDAIKLEELIRSNL

SEQ ID NO: 162607 - protein, 205 aa, Heterodera glycines
  Homolog annotation: Hit_ID=CAE69606.1; Match level="QueryCoverage =89%, HitCoverage=28%, E-value=5e-20, Identity=30%"; Hit description =Hypothetical protein CBG15837 [Caenorhabditis briggsae]
  Coding regions on vcDNA: vcDNA=SeqID_89030; Strand=+; Position=25-639
MASPSDLDMKMVPQNGDFKHDVSEEVQQQQQQQHQEQKQPNDLVKNDEDGGGAEAGQDGTAPTETEQKPSPVNNTIPLQKELESDTTYDDTDTFKMFMGKSLSKPVAVILMRMFDELGLNTDEFDERAVEMLATFPFEQANFILKELKDSQLFGVQNKPQYLMSVMRNFRERLRTMGVQQAMELPLIPGPDPESIKTLITKSGYQ

SEQ ID NO: 162608 - protein, 224 aa, Heterodera glycines
  Homolog annotation: Hit_ID=NP_386546.1; Match level="QueryCoverage =90%, HitCoverage=40%, E-value=9e-64, Identity=59%"; Hit description =PROBABLE MANNITOL 2-DEHYDROGENASE PROTEIN [Sinorhizobium meliloti 1021] emb|CAC47019.1| PROBABLE MANNITOL
  Coding regions on vcDNA: vcDNA=SeqID_89031; Strand=+; Position=35-706
MATLLEYPASVVEQISVKLSAPNLNTIAMAYPKVEVPKYSRATLSAGIVHFGVGNFHRSHQAVFLSELFNMGQDLDWAIIGAGVMPTDERIRSCLSGQDFLTTVVGQDEYSNTVQITGAMIDFLPIGNAEAIVAQLSDPAIRIVSMTVTEGGYFINSATGEFDPTHPAIVADSKDPANPRTVFGLIVTALSRRRANGTDPFTVLSCDNITKNGEMARNACVGMA

SEQ ID NO: 162609 - protein, 128 aa, Heterodera glycines
  Coding regions on vcDNA: vcDNA=SeqID_89032; Strand=-; Position=91-477
SKSQKSVASTSVLLSIRLTRLTARSAQIRSHNGTLASRLLESLSTLSLLFVVAHSVQFLHAFCFNCRPFFAWFCYCRRRLIPWPPKSSGISAVLIRFRCVSIVILLRINFLRAQIVRYSPLLLMVAKP

SEQ ID NO: 162610 - protein, 248 aa, Heterodera glycines
  Homolog annotation: Hit_ID=NP_493982.1; Match level="QueryCoverage =100%, HitCoverage=49%, E-value=1e-71, Identity=56%"; Hit description= solute carrier family 2 member 3 (2B799) [Caenorhabditis elegans] gb|AAK31540.1| Hypothetical protein H1
  Gene Ontology: Mol. function=glucose transporter activity; Cellular component=integral to plasma membrane; Biological process=glucose transport
  Coding regions on vcDNA: vcDNA=SeqID_89033; Strand=+; Position=3-746
LAIIAAALMTLAKYVDVYYLITIGRFIIGLNTGFNSGLSPMYLMEISPSNLRGSIGSLHQLFITIAILASQIIGLPQIFGSSNLWPLIFAFTLVPVLFQLCALPFCPESPKYSLIVQGRKDQAEKDLKWLRGGNDVHAELEQINEEAVASRAHPKLSMRAMFCPPLLWPLVLAVFMMLSQQLTGINAAMFYSAGIFKSAGLQGQWPTVATIAMGTVNVLMTFVSVVLVERLGRRTLHITGLVGVLLSS

SEQ ID NO: 162611 - protein, 91 aa, Heterodera glycines
  Coding regions on vcDNA: vcDNA=SeqID_89034; Strand=+; Position=224-499
QSVRAESLSKYTVFWIYLSMGTFTLKYFFKKAVLERPWYFFPAFITISWLEYSYYKHGQWKIGMMKGHSKMWRERREEILRWDPNADLWKY

SEQ ID NO: 162612 - protein, 204 aa, Heterodera glycines
  Coding regions on vcDNA: vcDNA=SeqID_89035; Strand=+; Position=29-640
MTDIQAYAGPFIVNDVVSYFLKDGVWYYRNAFIPINLECKQPPPAEIVKEWMDKYGSAAPKSTKQAKQKVATPLKKSSHKPKLSSADKDSEMLKRKRKHEQMLSNSSTSSSSTSKPLPVSAQKVVSSSALPTPGAPSPNIPKQKQPAKPSSAPTPKTALSSNAINETPTKVCSTQKTQPQKVSTTVTDEAPPATEVAPAPLVMI

SEQ ID NO: 162613 - protein, 216 aa, Heterodera glycines
  Coding regions on vcDNA: vcDNA=SeqID_89036; Strand=+; Position=1-648
SLFTMYSNISSSGWVSSDHPQQQIGNFYSYDADPTLSPNGGGYNAYFDYPNQQPAASSNSNFVPLGSGRPFPHTISQHAQLSFSDNSNANFVPLGSGHFLPERDGDVVCYEDSFEMQKIGRKRRRGRKSGRRARMDIYGAGQPATHDFGEIVNYDDWQQWDNGWGGQQQFEQNEAASNYGQYGIEPSQNYEDYEIYYDNYETDQTKELWQEELEQQ

SEQ ID NO: 162614 - protein, 215 aa, Heterodera glycines
  Homolog annotation: Hit_ID=NP_501650.1; Match level="QueryCoverage =95%, HitCoverage=51%, E-value=6e-75, Identity=63%"; Hit description =aminoacylase family member (4K139) [Caenorhabditis elegans] emb|CAA92445.1| Hypothetical protein C10C5.3
  Gene Ontology: Mol. function=aminoacylase activity; Cellular component=cytosol; Biological process=amino acid metabolism
  Coding regions on vcDNA: vcDNA=SeqID_89037; Strand=+; Position=6-650
MQSAEETMALVAVTKFRDYLRINTEQPNPDYHKCRDFLFTYATELGFMPWEYECVPGKPMVGMTYAGSDQTLPSLLLYSHTDVVPTFPEHWTYPPYEAFKDIDGNIFGRGAQDMKCVGIQYMEALREILFENGQKPFLRTVHILWGPDEEIGSHDGMEKFVHTDKFRSLNIGFALDERLASETDTYSVFYGERCAWWLQITCPGAPGHGSRFLEN

SEQ ID NO: 162615 - protein, 267 aa, Heterodera glycines
  misc_feature (43)..(43): Xaa can be any naturally occurring amino acid
  Homolog annotation: Hit_ID=CAE70835.1; Match level="QueryCoverage =99%, HitCoverage=65%, E-value=1e-115, Identity=70%"; Hit description= Hypothetical protein CBG17615 [Caenorhabditis briggsae]
  Gene Ontology: Biological process=mRNA splicing
  Coding regions on vcDNA: vcDNA=SeqID_89038; Strand=+; Position=46-847
MSMSKSSYTYNRKTFEDAEFPILCETCLGPNPYLRMSKDTHGXECKICERPFTTFRWMPGRGARYKKTEICQTCAKLKNVCQTCLLDLEYGLPVQVRDTALQVKETVPKVGANRDYFIQNVDRALEQTDGTVPYGELAKLTDAGTNEMLRKLARNQPYYNRNLPHICSFFVKGECTRGEECPYRHEKPTDPDDPLSLQNMRDRYYGINDPVADKLMNRAKAMPKLTPPEDQSITTLFLGNLGRESRLVVTEADIRDYFYQFGEIRQV

SEQ ID NO: 162616 - protein, 123 aa, Heterodera glycines
  Coding regions on vcDNA: vcDNA=SeqID_89039; Strand=+; Position=37-408
MAPPPPPPKSKSSIEEDQTQQHELAASPEWAQNDVEHPVVKVFGFQPNRLGREWPPNPQQPEDTQLGQANKHKTLGDIDWMTSPAEATPVREQIPLRGKLNAQWPPPEKEYRVEVLLPEGVKQ

SEQ ID NO: 162617 - protein, 372 aa, Heterodera glycines
  misc_feature (307)..(307): Xaa can be any naturally occurring amino acid
  Coding regions on vcDNA: vcDNA=SeqID_89040; Strand=+; Position=3-1118
LMLLIPRSVRCFYGGLLDVSSLNVGNATRMELLRIAFSTPFAVSHCFLSVSSVRCLQTFEKRQQSQIEREASELSKFIDSLCNPNAFKRRPDALFAPKRIGGMDVAAVSFLDSLNLTEENISKEAISRFSKEVYKMSAIQLSQLLKATSNRKIEHPVLINHICTALKDRPLPPSLRHICQIAFYLSKHSFLDKPLLNRIKEDFLVYVRNEIISKTSFSHIVIAFAFFRLTDRHFWQQIIQIIETLANRPEYSTALIECVNSLAVVNVHPKLVSSVVEKTKSLEKDGLFLGKWLQLVHSLAILNSLDXQMAESVLNRNFFERLSEMQTDKAISEHLAQWNSICYRNIAASARFELPKGEVPPIDGPFLADADP

SEQ ID NO: 162618 - protein, 224 aa, Heterodera glycines
  Homolog annotation: Hit_ID=CAE60135.1; Match level="QueryCoverage =93%, HitCoverage=56%, E-value=1e-42, Identity=50%"; Hit description =Hypothetical protein CBG03681 [Caenorhabditis briggsae]
  Gene Ontology: Cellular component=mitochondrion
  Coding regions on vcDNA: vcDNA=SeqID_89041; Strand=+; Position=53-724
MTSEKEMLWDKACLLTRLVASSVRLSEAAGGIIKDIMKSGDLKIVNKDQTGQMKDLQTEADRSAQICIERSLRAKFGENLTIIGEEDIAPPSTPFQTLQPLPSSHHFHIIFNENATTAVPSSEVLSNDERVPNELRSIEMKDVVVWVDPLDGTSEFTKSKENPALLRQVTVLIGITHKGRPVAGIVHQPYYEGQQTADGLAPNGRTIWSIVGVGTFGHQKTAQQ

SEQ ID NO: 162619 - protein, 217 aa, Heterodera glycines
  Homolog annotation: Hit_ID=CAE62813.1; Match level="QueryCoverage =91%, HitCoverage=21%, E-value=1e-28, Identity=38%"; Hit description =Hypothetical protein CBG06989 [Caenorhabditis briggsae]
  Coding regions on vcDNA: vcDNA=SeqID_89042; Strand=+; Position=7-657
MTVLQNKQFLLCPSLFFRAVQLRRIRGRPVSRSRISPPPSGEGIQWAPATNAFRVSKDGEPRPLPSAFIDDDDQMDPISKAKENLRGPEKYKVINAVRKKRKHLLQLNFDHIPIIDQVVLMFPSQGAQHLQMGKKVIDNPSSARLFEEANEFLKFDLLSLCLNGPINKLDQTFYAQMALFVSCMAAFEKLKVEQPDLVDRLTDCAGFSIGGICALVA

SEQ ID NO: 162620 - protein, 104 aa, Heterodera glycines
  Homolog annotation: Hit_ID=XP_418962.1; Match level="QueryCoverage =81%, HitCoverage=39%, E-value=5e-09, Identity=41%"; Hit description =PREDICTED: similar to chromosome 6 open reading frame 149; CGI-203 protein [Gallus gallus]
  Coding regions on vcDNA: vcDNA=SeqID_89043; Strand=+; Position=114-428
MSSAVSSSPAVLTRLDWLKLYKALQRAGSEFPQYNYRHFARRRIRDYFEQYSKQTMTREKLSEVYQEGQSALGTIQRQSRISSLYPTRPLVIETIDEKKEGAVL

SEQ ID NO: 162621 - protein, 205 aa, Heterodera glycines
  Homolog annotation: Hit_ID=CAE62677.1; Match level="QueryCoverage =100%, HitCoverage=65%, E-value=2e-27, Identity=34%"; Hit description= Hypothetical protein CBG06820 [Caenorhabditis briggsae]
  Coding regions on vcDNA: vcDNA=SeqID_89044; Strand=+; Position=1-650
PELIVYPSTDFATNTHSIERLDALVFGPGLGRQKHTQNLLADVVNFGTSKQNLCLVIDADGLFFVKECSQLFKGCTDKVIITPNHREFVRLYTQMFPNQQKGEDTDELKIQCEMAEQLAKHLEVTVMRKGEIDIISNGSSQTRIVQAETSMRRCGGQGDILSGATALFAFWARKASDADIYSSEHLLDGAEAASLLVRNASLRTF

SEQ ID NO: 162622 - protein, 216 aa, Heterodera glycines
  Homolog annotation: Hit_ID=CAE58485.1; Match level="QueryCoverage =88%, HitCoverage=47%, E-value=5e-55, Identity=56%"; Hit description =Hypothetical protein CBG01629 [Caenorhabditis briggsae]
  Gene Ontology: Cellular component=nucleolus; Biological process=cell cycle
  Coding regions on vcDNA: vcDNA=SeqID_89045; Strand=+; Position=15-662
MSVNVKQKKTAPKRDVSSSPSQSSTSDSSEASNESVDEAKEETTPANDKVLTKYSMAAEIVNTVLKELISEVKEGVEVGHLCSVGDNRLLELTGNLFKKEKSVQKGISMPTCISVDNCVCHFSPLKSEPPVLLKQGQLVKVDLGAHVDGYIATAAHSVVVGASAENKTTGKKANAILAAYNTMEMVLRMLKPTKSFKNAEVTDRIGKFAKTYGTTP

SEQ ID NO: 162623 - protein, 125 aa, Heterodera glycines
  misc_feature (92)..(92): Xaa can be any naturally occurring amino acid
  misc_feature (97)..(97): Xaa can be any naturally occurring amino acid
  Homolog annotation: Hit_ID=NP_496066.2; Match level="QueryCoverage =94%, HitCoverage=23%, E-value=1e-28, Identity=54%"; Hit description =nuclear Hormone Receptor (nhr-19) [Caenorhabditis elegans] emb|CAD27185.1| Hypothetical protein E02H1.7 [
  Gene Ontology: Mol. function=ecdysteroid hormone receptor activity; Cellular component=nucleus; Biological process=neuronal remodeling
  Coding regions on vcDNA: vcDNA=SeqID_89046; Strand=+; Position=364-738
MCFSREKMAPRMPLTAVGGIPKSNAIGLCLICKELSFGKHYGCISCLGCKTFFRRAVMHNQDTVCKKPGFCEFEVSARRLCRSCRFRTCLDXCGMSXEALQPKRDLIGRQRRRRYQAVASSVTPP

SEQ ID NO: 162624 - protein, 326 aa, Heterodera glycines
  Homolog annotation: Hit_ID=AAV38461.1; Match level="QueryCoverage =84%, HitCoverage=45%, E-value=2e-49, Identity=37%"; Hit description =mitogen-activated protein kinase kinase kinase 7 [Homo sapiens]
  Gene Ontology: Mol. function=protein tyrosine kinase activity; Cellular component=cytoplasm; Biological process=TGFbeta receptor signaling pathway
  Coding regions on vcDNA: vcDNA=SeqID_89047; Strand=+; Position=9-989
MKPLKIDVDFPSNSHPTSQELNQDCIPLYEMLEFEELQFPNYYLSEQLGRGAHATVMPCHFHGKPAAAKLFNANVDFKTIQKEAKLLHEFRHENIIELYALFHGTMSGLVLELMEGGSLSELIHQRKSIVYQNCHVINWTFQVAKALEYLHKLSFIHRDVKPSNMLLSLDYVVLKLCDFGTIAKHRTDMTSTCGTAAWMAPEVFRGESYDFRCDVFSLGICLWEMLARSPPFADAPELNSLAVLWEVAESGLRPPPIEGVAEPLQQLMVRCWADEPNDRPPIDEVKEMLEALLKQLPHGALSPFVGRLLTGRPSPVDFSPQARTND

SEQ ID NO: 162625 - protein, 207 aa, Heterodera glycines
  Homolog annotation: Hit_ID=NP_503353.1; Match level="QueryCoverage =93%, HitCoverage=35%, E-value=1e-27, Identity=35%"; Hit description =HpaII tiny fragments locus 9c (5B389) [Caenorhabditis elegans]
  Coding regions on vcDNA: vcDNA=SeqID_89048; Strand=+; Position=204-824
DNAIFKKNCLSVTKASDLPKGPKTASGAQTDEAEKSCKMLVTPLFDIPYEEQLKIKFDHSKKVLELLQKKLTQAHATNSLIAKESLPKNVLPSPLIEQYRNKCEFSVGYSSGDNRSAVVGFMSGKMANRQSNVLAPDECSNLTRNTRSIVRHFEAFVRKFGEEPFDEFERKGFWKMLTVKDFSGDTMIIVTVHPHPNSEITDNAKTK

SEQ ID NO: 162626 - protein, 120 aa, Heterodera glycines
  Coding regions on vcDNA: vcDNA=SeqID_89049; Strand=+; Position=3-365
TIGPTNSPLPQNYLSKSNHFLVNVQMLLLVLLLILLFPSESLQAASFITLHCQGNGLYVSGRWNENGQTADLPLPSELTMQRLARLIKCLFICYIFFEGSCREKTKMAPFLSSAIPIECF

SEQ ID NO: 162627 - protein, 135 aa, Heterodera glycines
  Coding regions on vcDNA: vcDNA=SeqID_89050; Strand=+; Position=236-640
AVHQISLCQMAGLPKLPTRARLKLPSHCGQHQQQMTIEFVPDGFNHTELEADNTWYLTLQFNRTGTKEQGTFLLANYTLDVRFFNVQNASSHYNGTYLYAKAPSFKPEWSATVQNGQPNILTCSKNGLHLDEKSS

SEQ ID NO: 162628 - protein, 198 aa, Heterodera glycines
  Homolog annotation: Hit_ID=NP_957016.1; Match level="QueryCoverage =98%, HitCoverage=71%, E-value=7e-53, Identity=51%"; Hit description =hypothetical protein MGC73124 [Danio rerio] gb|AAH59487.1| Hypothetical protein MGC73124 [Danio rerio]
  Coding regions on vcDNA: vcDNA=SeqID_89051; Strand=+; Position=8-601
MTGESAYELVLLVKPEVFIYKIPPLTGNKGYKAADWKLDSPDWVGRLRLISIGDKLEIRLEDKTSGELFAKAPIGQLNSVDYESVSDSSRYFVVRLRNDNAQTAFVGIGFADRADSFDLNVAIQDHFKAVKKCDDSAEDNAETVPKLDLSFKEGQTITVNIGKKTITSNNNSSSAVPNLRTSLGGSSAVPLLPPPPAS

SEQ ID NO: 162629 - protein, 296 aa, Heterodera glycines
  misc_feature (181)..(181): Xaa can be any naturally occurring amino acid
  misc_feature (286)..(286): Xaa can be any naturally occurring amino acid
  Homolog annotation: Hit_ID=NP_508928.2; Match level="QueryCoverage =99%, HitCoverage=27%, E-value=8e-91, Identity=58%"; Hit description =drosophila Discs Large homolog (107.0 kD) (dlg-1) [Caenorhabditis elegans] gb|AAK39197.2| Drosophila disc
  Gene Ontology: Mol. function=guanylate kinase activity; Cellular component=apical cortex; Biological process=regulation of synapse
  Coding regions on vcDNA: vcDNA=SeqID_89052; Strand=+; Position=2-889
SEVQLVLQHLPQEYQRFEEKLERARAEMAQLQQNPQQPPYLPPDAMPPPQQIMPMPIRQDFYVRALFDNDPSRGDAVLPHRSLAFRYGDILHVTSVGDDDWWTARRVAENGDKGPEGIIPSKKREEKRERQRRKQVNFNAGSQSLGRNASMSAGGFGGGGGLDGRRGSRSQLSFSRKFPFXKSTEKLNEYPSDGGETGGGTIADEPIHSYVTVELRTVNYVRPVVVLGALKDRINDELVSRHPDRFSSCVPHTSRPPREGEVHGRNYYFVTKAEMERDGKSNLFIXAGQLQNNLYG

SEQ ID NO: 162630 - protein, 229 aa, Heterodera glycines
  Homolog annotation: Hit_ID=AAK26375.1; Match level="QueryCoverage =100%, HitCoverage=52%, E-value=1e-131, Identity=100%"; Hit description=class V aminotransferase [Heterodera glycines]
  Gene Ontology: Mol. function=alanine-glyoxylate aminotransferase activity; Cellular component=peroxisome
  Coding regions on vcDNA: vcDNA=SeqID_89053; Strand=+; Position=3-692
DICNAYDVLFLVDTVASICGAPFHADALKVDCVYAATQKVLNCPPGLAPISFSEKALEKITKRKTRVPSFYFDALELGNYWGCFDEPRRYHHTAPISLVYALREGLSAVAQEGIGHMVNRHKINAKLLYDAFDQLGLELFVQKENNRLPCLTTVRVPEGVDWKAVQDKLMAQGFEIAGGLGPTAGKIWRIGTFGINSNPEDIESLKQALKGALYEQEEKGQSDHFKAAI

SEQ ID NO: 162631 - protein, 173 aa, Heterodera glycines
  misc_feature (80)..(80): Xaa can be any naturally occurring amino acid
  Homolog annotation: Hit_ID=CAE64816.1; Match level="QueryCoverage =75%, HitCoverage=17%, E-value=8e-33, Identity=47%"; Hit description =Hypothetical protein CBG09610 [Caenorhabditis briggsae]
  Coding regions on vcDNA: vcDNA=SeqID_89054; Strand=+; Position=50-641
MMEMTILGNRISITADGAKVSPFGSKMDMGDYYVENNKLRKTRGLGWVMAALFVVADMAGGGIVALPTAVVRCQFFSGYXLGQCWEILLRRFPVYRTHCRKPYAEIGLKALGPKIRTIVSICVNVTQYGATTVFLLLCAKNIRDFIRAFLDKEISFCYLIVVIALVLLPVTLL

SEQ ID NO: 162632 - protein, 140 aa, Heterodera glycines
  Homolog annotation: Hit_ID=NP_506146.1; Match level="QueryCoverage =95%, HitCoverage=49%, E-value=1e-22, Identity=47%"; Hit description =putative protein, with 2 coiled coil-4 domains (5N52) [Caenorhabditis elegans] emb|CAB02877.1| Hypothetic
  Coding regions on vcDNA: vcDNA=SeqID_89055; Strand=+; Position=99-518
MIGSTARCVALLLLGATMAQAFLTTFNVAPNAFQNRRGCRGGGGGGCGGGCGAPPPSGGGAIKLTLGCEGPPPQAPAPCGCGGGCGGGCGGGYGGGCGAPPPSGGGAIKLTLGCEGPPPQAPAPCGCGSGCGCGCGGGCG

SEQ ID NO: 162633 - protein, 97 aa, Heterodera glycines; identical to SEQ ID NO: 146617
  Coding regions on vcDNA: vcDNA=SeqID_89056; Strand=+; Position=234-527

SEQ ID NO: 162634 - protein, 216 aa, Heterodera glycines
  Coding regions on vcDNA: vcDNA=SeqID_89057; Strand=+; Position=3-650
ETSSNSATSCFKPNRNQSADISNLPNYLQQLQLGPGGSSTTRRTGRFVEERRLRHVKQQPSYSFEVSGTWGQRFSSCQFLDVSEDGRTLIGCWTSEQNNLFEGHCSRVLSFGVTVDPNTAKKDTQRMALAEDVGDMASLLDSNGKYRCNTYGLCFEPIDNEICLGSSNRILIDMVLAPADRDVTCLLFATARSFYQEQQHSVGSCPKIVTKCTVNL

SEQ ID NO: 162635 - protein, 144 aa, Heterodera glycines
  Coding regions on vcDNA: vcDNA=SeqID_89058; Strand=-; Position=0-431
FWSLSLQFFLSAAAAAFAACKSAVDFDRIPLFLLALSQTPCPSVAQFPFALVKGCGGLSAVVQFRLSPCVCVVFSFGFVPFPFPVLFQKVAATLRFGHSADSADSPVKNGKKWRHFACRRTFGRLLPPSVRLRLFASLCRQRRL

SEQ ID NO: 162636 - protein, 104 aa, Heterodera glycines
  Homolog annotation: Hit_ID=NP_872102.1; Match level="QueryCoverage =78%, HitCoverage=12%, E-value=3e-09, Identity=40%"; Hit description =putative membrane protein, family 8 (4N121) [Caenorhabditis elegans] emb|CAD56618.1| Hypothetical protein
  Coding regions on vcDNA: vcDNA=SeqID_89059; Strand=-; Position=138-452
ARGNKANNNIFLNSLQFKRYLCLTQVLVLRDISIQVRKRFPNMESLVDSELIQVSRTTNIDQNGIIRFECKLIKLPELDLMENVKSEFPKYWMPINWSVNHYLC

SEQ ID NO: 162637 - protein, 149 aa, Heterodera glycines
  Homolog annotation: Hit_ID=CAE73695.1; Match level="QueryCoverage =65%, HitCoverage=33%, E-value=3e-16, Identity=42%"; Hit description =Hypothetical protein CBG21206 [Caenorhabditis briggsae]
  Gene Ontology: Mol. function=tRNA methyltransferase activity; Cellular component=cytoplasm; Biological process=tRNA methylation
  Coding regions on vcDNA: vcDNA=SeqID_89060; Strand=+; Position=18-520
MNFACCCHFSTVAQRYFSSSRKQTEQYLERQANDQYSRRAREHSYRARSAFKLMQINDKMHFIRPGLVAIDAGAAPGSWCQVLSELIFPNNFAPKKRTKADERTDECPFDGTEQRQGYILGVDLLVRPLLFLLSHFLRFISPLSDNKSN

SEQ ID NO: 162638 - protein, 227 aa, Heterodera glycines
  Homolog annotation: Hit_ID=NP_741466.1; Match level="QueryCoverage =97%, HitCoverage=94%, E-value=3e-41, Identity=38%"; Hit description =prosaposin precursor (27.3 kD) (4J243) [Caenorhabditis elegans] gb|AAB37550.2| Saposin-like protein famil
  Coding regions on vcDNA: vcDNA=SeqID_89061; Strand=+; Position=7-687
LIILQMKLFCPFVFLVLLSATAFAFSNLNKTPKTVHWEDACDECQLIIKRVVNVATDPEKVAELKILLSALCQETSYVEECRLFVSKLDLFLGRLLPFLRDAHHVCKELRICNNGRLQQFHVLGLHFARVNASFQRKDLICEECQLAARELAREVSEPKFQQYVEEWLQGNVCVHLGTLKSSCEQMLDEFLPEMWREMEDILSDQKKFCQDLELCPAGISSPSSARR

SEQ ID NO: 162639 - protein, 259 aa, Heterodera glycines
  Homolog annotation: Hit_ID=NP_491022.2; Match level="QueryCoverage =85%, HitCoverage=27%, E-value=5e-86, Identity=66%"; Hit description =glycine-rich protein (87.0 kD) (1D242) [Caenorhabditis elegans] gb|AAB54209.3| Hypothetical protein F32B5
  Coding regions on vcDNA: vcDNA=SeqID_89062; Strand=+; Position=159-935
MGSDPPAAVASFPSAGSATFASLHNARHNCISTCHYPCHSAAASLRSTHDQMRACISIDLLVACQREVNFLRMIDRKAPVLYEKVVVENAIRRYEMCWLPAQAAKPNLHNIPPLDVHWIWHTHMLSPTHYREDCLAICGTVVDHKLLNADEIQQRYEQSVSSWSEFCPEEPYDFLQSNDRVREQYQQKSKYDLAEAVQRQRNFNYQVSLPHFTAPRFLTDAIDRYIKFLQLKQTYADHFLTPCYDFDLVWHTHQVHPLD

SEQ ID NO: 162640 - protein, 205 aa, Heterodera glycines
  Homolog annotation: Hit_ID=CAE69260.1; Match level="QueryCoverage =72%, HitCoverage=21%, E-value=6e-27, Identity=39%"; Hit description =Hypothetical protein CBG15311 [Caenorhabditis briggsae]
  Coding regions on vcDNA: vcDNA=SeqID_89063; Strand=+; Position=76-690
MANPNSDHSLPLSPSPSPSHSSHSFSLRSVFAHHFCFFCSNSVLIALVVFTLSLLMAFLLGKRRSSQNELAKRRRDKSPEGIELEENPEVFKSSLLKDSKEHIISTYFPDVRTLFDAFQRGLKVAEHSACLGFRPAKGSPYQFLTYAEVAVRSQSFGHALISKLGLQPGNETFVAIYAQNCPEWMITAIGCTRHSMVIVPLYDTL

SEQ ID NO: 162641 - protein, 307 aa, Heterodera glycines
  Homolog annotation: Hit_ID=NP_506170.2; Match level="QueryCoverage =98%, HitCoverage=62%, E-value=6e-76, Identity=51%"; Hit description =putative nuclear protein of eukaryotic origin (47.8 kD) (5N183) [Caenorhabditis elegans] emb|CAA99907.2|
  Coding regions on vcDNA: vcDNA=SeqID_89064; Strand=+; Position=33-953
MSVSWGTQYSKLKTNLRLAANRLRLLQKKKTEQAVKARCEIADFLSTDKEDRARIRVETIIREDFVVEAYELLEMYCELLLARFGIIQQMKELDDGIAEAVSSLLWVAPRIGHEIAEFKVINDELTHKYGKQFAEAARMNQLPEPSRVSPKLVQKLSVSAPSKLLVEKYLVTIAQSAGVDFAPDAKVMREDDDEIARAERNLINFMNEEQYGWTVRHNDDPNSKGSGGGHFAAAVAGAVGPADPLMNQGSNNNNGGGATAMPMPPNGSGAFAMSPSTFVPSHPSPLATSSSPPPEYAPPPPLPAHGA

SEQ ID NO: 162642 - protein, 58 aa, Heterodera glycines
  Coding regions on vcDNA: vcDNA=SeqID_89065; Strand=-; Position=529-705
IINIFSETALKRTKFYLQVILGTQMLTLSKREMNKNLKIFNCFLNMRKILGLTFFFIN

SEQ ID NO: 162643 - protein, 141 aa, Heterodera glycines
  Coding regions on vcDNA: vcDNA=SeqID_89066; Strand=+; Position=3-428
TSQKMFFHSPLPRTPVLRRSTLSGSGQVEIGAALRHQLAEVFTPPSNIYQVAPQREQSVDDSGGPSAAETVPLIEHQLLMADQDQLNNNIVQQQNLYQQHQHNFVAPSILVSSSSMEKSASAQDLAGTAAALIRRHRSASK

SEQ ID NO: 162644 - protein, 428 aa, Heterodera glycines
  Homolog annotation: Hit_ID=AAH46263.1; Match level="QueryCoverage =88%, HitCoverage=60%, E-value=1e-24, Identity=25%"; Hit description =LOC398566 protein [Xenopus laevis]
  Gene Ontology: Mol. function=general transcriptional repressor activity; Cellular component=nucleus; Biological process=negative regulation of transcription
  Coding regions on vcDNA: vcDNA=SeqID_89067; Strand=+; Position=6-1289
MAIEAEEFGEQQETDEVEQQENGSGNSEEEEEEEEAPQIRRQQGQIRMMTSSGEETVQATEAAVPPPAAQQAPPQSPAATAAAPQSPAPTQTAAPASPGSAAAIPQSPAAAGAAAAAQQAALEEAKRRQQEAMEKARAEALRLQEEARARAEAARQQHQQAAEQARLQAEQQLKAQQEAAKRQAEERAQQLKAQQQQQQQQSVQVQQQKQQQPPISPSATAQQQKAAPAPAAQPPAKAPQQPQAPKAAVAPAQQQQQPKAAAPPPPKAAAAPQQPKATAVAAPPKPTAPPAVAPQKRAPSPVVREVQLPEAPTQPILRHAEYTPKLVDASVNKLPPGQEPDEEQLEASAVPRNPIIEDNAWQVQRRVQPEYQPVQPAKLNATGDFLVESEAKKSIVPEAVGYSKTKWNEFPEEEEKERQSVPKVKRRN

SEQ ID NO: 162645 - protein, 224 aa, Heterodera glycines
  Homolog annotation: Hit_ID=XP_319132.1; Match level="QueryCoverage =92%, HitCoverage=76%, E-value=3e-26, Identity=30%"; Hit description =ENSANGP00000011912 [Anopheles gambiae]
  Gene Ontology: Mol. function=chromatin binding; Cellular component =nucleus; Biological process=signal transduction
  Coding regions on vcDNA: vcDNA=SeqID_89068; Strand=+; Position=6-677
MEDLYEKCLKNSRPTHRKMEENLYDIRVLDVKAKLAENELRQKMTQMANTWKKTGKDERKRKYEEIEEQFAKANDLCNEKIQLAESTYEMVDSFIQKLDKETSSFNAFVKRSKRTAQSTPGTSKENIADEPSVVRRRGTAPSTSMATKRGGTTGRTSAREGTSSATKAESVRVDGAASSSGSGTQLVGKGDMPIDPNEPRYCTCQQVSFGHMVGCDNKECPLEW

SEQ ID NO: 162646 - protein, 72 aa, Heterodera glycines
  Homolog annotation: Hit_ID=NP_500396.1; Match level="QueryCoverage =81%, HitCoverage=14%, E-value=4e-16, Identity=66%"; Hit description =metallopeptidase family M24 (4E448) [Caenorhabditis elegans]
  Gene Ontology: Biological process=proteolysis and peptidolysis
  Coding regions on vcDNA: vcDNA=SeqID_89069; Strand=+; Position=79-447
IAFNFLKDDDQWPDGWTAVTKDGRASAQFEHTLLVTETGCDVLTERSVAGAPRPWFRDQLEQLGYNRKKRQQ

SEQ ID NO: 162647 - protein, 148 aa, Heterodera glycines
  Coding regions on vcDNA: vcDNA=SeqID_89070; Strand=-; Position=487-933
FFFFFFFFFFFFSLCLFISGIFALWQSKGRGIGFEFVTDHTYSWHFVFVSVRPSVGRFGSFSVRLSILSNVHIRNVYWHPALLLRTPTPLLLLPFDALHATVVGRVRIKRVVGISRDGSDQRHQKDHKQSQRGKFHNELMSGDLVGFD

SEQ ID NO: 162648 - protein, 287 aa, Heterodera glycines
  misc_feature (197)..(197): Xaa can be any naturally occurring amino acid
  Coding regions on vcDNA: vcDNA=SeqID_89071; Strand=+; Position=110-971
MAPKCLPLELLFEIVPFIPAEKAVPNALSSCRLLHKLLLPRVIKWKEQLLTDLMSFSAIVNNLSAKVDNLSGVVNNHSVKLDNLSGVVNNLSGVVNNLSAKVETIEKKMGETTGKAPNEQKERGNGHKAVMGAYNENNGTIEVPLHGYNVGKAIVERILNTENGTVHLHGMREPMSLAKAVEIGFFDNLSLTVVDPXPRQRLFLDEALERKVLDSNGRLQHQHRQLTLGEANRQRLVRLEKGKPTSKKKIIKLESDSSKMSIHLDKTSNSISKTTVEPDKTSNNTSN

SEQ ID NO: 162649 - protein, 296 aa, Heterodera glycines
  misc_feature (19)..(19): Xaa can be any naturally occurring amino acid
  misc_feature (100)..(100): Xaa can be any naturally occurring amino acid
  misc_feature (114)..(114): Xaa can be any naturally occurring amino acid
  misc_feature (126)..(126): Xaa can be any naturally occurring amino acid
  misc_feature (164)..(164): Xaa can be any naturally occurring amino acid
  misc_feature (222)..(222): Xaa can be any naturally occurring amino acid
  Homolog annotation: Hit_ID=T02995; Match level="QueryCoverage=87%, HitCoverage=49%, E-value=4e-59, Identity=52%"; Hit description =unspecific monooxygenase (EC 1.14.14.1) - common tobacco dbj|BAA10929.1| cytochrome P450 like_TBP [Nicotiana t
  Coding regions on vcDNA: vcDNA=SeqID_89072; Strand=+; Position=1135 -2068
MYRPSQTPRLTLSSARVAXHRVARLNTKMDTLSGALPFYRLSKESMKVVVFHWRLAAPTYATPLMILHKVRLESSSTGSSFPAKFAKPVPLAVVSLDSRXTVGISLIHSCASVXPTRHLGTLRESXTPAVYPRLSKFPWLNIQSTGQKSDTVNVHKDHPSPLFXLDSRIPRVRASSKLVVQRQPNAPQAALTTSPRTIPERTAHSHGQKPPVSRNSPADPTXSQFFSRSYESNLPTSLTYIILSTRGCSPWRPAADIGTIRQEIQIASLAFSRAVWSARDTTGTAVLYGRNIPISG

SEQ ID NO: 162650 - protein, 189 aa, Heterodera glycines
  Homolog annotation: Hit_ID=CAE70083.1; Match level="QueryCoverage =70%, HitCoverage=51%, E-value=1e-14, Identity=30%"; Hit description =Hypothetical protein CBG16524 [Caenorhabditis briggsae]
  Coding regions on vcDNA: vcDNA=SeqID_89073; Strand=+; Position=65-631
MSSTIAPVSSADGTAGSAAAVASAGPSSVEPMPPVEQLMEGIEEKCPPSLDQRLNAMDEVDMRIDDLLTVVAEVMAGLDKDKPLSKAKMEELYKKYELKLDEIQRGIAEQLTYMEQVCVGAEHQGSTYHYHQVAQLSAARLHSLHAHLAMLRNNMDNGSRESGVDGQQQPTGAADEQRKNSEKKGKEER

SEQ ID NO: 162651 - protein, 214 aa, Heterodera glycines
  Homolog annotation: Hit_ID=CAE60059.1; Match level="QueryCoverage =99%, HitCoverage=35%, E-value=7e-68, Identity=58%"; Hit description =Hypothetical protein CBG03574 [Caenorhabditis briggsae]
  Gene Ontology: Biological process=growth
  Coding regions on vcDNA: vcDNA=SeqID_89074; Strand=+; Position=15-656
MDPYLQELINKWLCWDKNETTRTEIERLVKENNVHELRLRMVGKLSFGTAGVRTHMEAGFARLNELTIIQLSHGMARHLTSEMGEDGKKKGVVIGFDGRHQSKRFAELAANVFVLNGLSAFLFSAVVPTPVGSFAVLSLGCAAGIMITASHNPKEDNGFKAYWANGAQILSPHDTEICPIVAEESKPEETYWDTVQLGTSACLHSADSVLEKYF

SEQ ID NO: 162652 - protein, 140 aa, Heterodera glycines
  Homolog annotation: Hit_ID=AAL18843.1; Match level="QueryCoverage =100%, HitCoverage=99%, E-value=1e-15, Identity=28%"; Hit description= LEA1 protein [Aphelenchus avenae] sp|Q95V77|LEA1_APHAV Late embryogenesis abundant protein 1 (Aavlea1)
  Coding regions on vcDNA: vcDNA=SeqID_89075; Strand=+; Position=15-437
MTTEQGKNEQQQGKGIYESTKESLSNVAEGTKEWLTSAKDKVADSLTSTKDTVTGKSAEMRDRASDSYEDAKQGAQDRYERAKEYGSEKTEQLKDYATDKKEEAGEKMEQNREKAAEKWDETKEAGGERMQRAGDKIRGK

SEQ ID NO: 162653 - protein, 387 aa, Heterodera glycines
  Homolog annotation: Hit_ID=NP_509045.1; Match level="QueryCoverage =94%, HitCoverage=95%, E-value=7e-76, Identity=44%"; Hit description =heat shock protein (43.2 kD) (hsp-43) [Caenorhabditis elegans] gb|AAA80366.1| Heat shock protein protein
  Gene Ontology: Mol. function=chaperone activity; Cellular component =cytoplasm; Biological process=muscle contraction
  Coding regions on vcDNA: vcDNA=SeqID_89076; Strand=+; Position=81-1244
MALVSKWRSDPFGRSDWPSLWRDRFSRDWDDWPRDWPRPGELMERFRSRDFDRDRWWRDWPTDWPRMDAIVPRFSSHLDRFDRNWRDDPFWRDLYPRWAEPIFKDGIDVKTNITNDSNRFAVEMDTYQFRPEELQVKTMDDTLLIEGRHEDVRDRDNYTKMYFVRKYQLPADVESHSISSHIDSSGRLSVEAQKRWQAVEGERSIPIESGSRRQGGGYGSRSSSYSPRDRYYADSGRGSANDYYRAESRLNGAANGGGGYLSPNPRSDGYRTEFEKRETDANGMRHEARREEFREEFRRSGSAANVLPPASPMLRTESRLSGAVGANASSGEERRESSHFRRTASAASREYRSGGAFAGGENLLRTAEELGGRSSAFGTRNVPIHRG

SEQ ID NO: 162654 - protein, 350 aa, Heterodera glycines
  Homolog annotation: Hit_ID=CAE67776.1; Match level="QueryCoverage =61%, HitCoverage=16%, E-value=2e-25, Identity=33%"; Hit description =Hypothetical protein CBG13351 [Caenorhabditis briggsae]
  Coding regions on vcDNA: vcDNA=SeqID_89077; Strand=+; Position=40-1092
MRNSGTKRRRAVQQQRHHHLVKRWNFAINARTDTLETCPDAFQRRATDGNDSAQFASHQRHPPTRKKVYLKSSRLPFLNHRQQLATDAPPLQNGLSSIAAAVPSSIESVANERDFMCEWLMQSEGDDDWSDEEGTAAGPIEPCARFFASASQMVFHVYNEHLVPLVQQHSDGEPPRIRCRWPICENTPRTLCNPSVLPYKEYVYHIRQQFERSRERTSAQNAYSDFAAQEAIRRHAFANLRKEITEDSEGPVTRSIRLTSALILRNICHHSVAGRRKLRTHESFISWLSLSHMESARTLAQCLSEMARHANNETEPQRNVIKRKTSCSSGDLQQNQPSFASEQMDDNDTA

SEQ ID NO: 162655 - protein, 219 aa, Heterodera glycines
  Homolog annotation: Hit_ID=CAF99257.1; Match level="QueryCoverage =78%, HitCoverage=84%, E-value=2e-54, Identity=58%"; Hit description =unnamed protein product [Tetraodon nigroviridis]
  Gene Ontology: Mol. function=zinc ion binding
  Coding regions on vcDNA: vcDNA=SeqID_89078; Strand=+; Position=24-683
MNSSEETTENVGMGGNKDERQTTSKDETDESSSENQRNEQRQRQMDSEKEDSRFECNICLDMAKDAVVSMCGHLFCWPCLFQWMDTRPYRQLCPVCKSAISKDKVIPLYGRGGGDSDPREKIPPRPQGQRTEETNQGFPGMFHWGGDNGGHGGGGVQFSLGIGVFPISFFASFFNTNFGGADRRPDPPPVGSRQMLEEQLLSNTFLYIGVLILLWLVFV

SEQ ID NO: 162656 - protein, 217 aa, Heterodera glycines
  Coding regions on vcDNA: vcDNA=SeqID_89079; Strand=+; Position=1-651
NANVRPQLQGVDNAKDCLTPSTTGNNQPTREQPKLMDIDERIGMDDEDNDDGDRFGEAAEVLGGGDNANRVGGERVVGNRLRKRRSVSCEPTANSPAKMAPHQPADDQSAGCLLQRTQSVNAFAVPSAHQQNAVVPIASSSRISSRMPSSVSICSYANSEVSARKRSPSGDGSLCSKEERSLSLTTPKISISICGKALYACASGRLDDLAALLKGHP

SEQ ID NO: 162657 - protein, 195 aa, Heterodera glycines
  Homolog annotation: Hit_ID=CAE62153.1; Match level="QueryCoverage =85%, HitCoverage=30%, E-value=2e-66, Identity=73%"; Hit description =Hypothetical protein CBG06199 [Caenorhabditis briggsae]
  Gene Ontology: Cellular component=mitochondrion; Biological process =glutamate catabolism
  Coding regions on vcDNA: vcDNA=SeqID_89080; Strand=+; Position=48-632
MLIAYIPKRIHLNLNVVGAALRQRMPFSAAVLDPHDQLKDSDKPMSEQMNPSFFKMVDYYFDKGAAVIEPKLVENFKASHGKSKEERVSSVKGILAAIKPVNKVLYVTFPLRRDDGSYEMIEAWRAMHSEHRTPTKGGIRFSMDVNEDEVKALSALMTAKCAVVDVPFGGAKGGVKIDPKKYSAYEIEKITRRFT

SEQ ID NO: 162658 - protein, 215 aa, Heterodera glycines
  misc_feature (64)..(64): Xaa can be any naturally occurring amino acid
  Homolog annotation: Hit_ID=NP_490730.2; Match level="QueryCoverage =42%, HitCoverage=18%, E-value=9e-23, Identity=49%"; Hit description =zinc finger Cezanne (72.7 kD) (1A885) [Caenorhabditis elegans] gb|AAF60741.2| Hypothetical protein Y50C1A
  Gene Ontology: Mol. function=ubiquitin C-terminal hydrolase activity; Cellular component=cytoplasm; Biological process=protein deubiquitination
  Coding regions on vcDNA: vcDNA=SeqID_89081; Strand=+; Position=27-675
MAIFIINDIRIHQFFRPFELVLSTWQQPTAVAVVPGDNHDGNGLLHAASLGIWGVHDRQLNWRXLHDVLKFGSRKHAIYRRWRWHESKNNFASGLVLSEEEWRREWTKVYESLECVHVFALAHILHRPIIVCWWTPFCAMRRPKNGHRFRLAATPAQTVPSLGEFSTEHWCAGQRPLWSTFDGRCAKVVHFCRQTVVAAQNCLRLPFRKADECRG

SEQ ID NO: 162659 - protein, 75 aa, Heterodera glycines
  Coding regions on vcDNA: vcDNA=SeqID_89082; Strand=-; Position=342-569
NLGIRNIALFEFLTLKSTRFSKISVGADPSPHTKFTAVNREKKVSTTLKNFLDFFSHKLKRVIIFNSINAFIKKC

SEQ ID NO: 162660 - protein, 279 aa, Heterodera glycines
  Homolog annotation: Hit_ID=NP_998183.1; Match level="QueryCoverage =75%, HitCoverage=29%, E-value=1e-17, Identity=29%"; Hit description =zgc:56071 [Danio rerio] gb|AAH47819.1| Zgc:56071 [Danio rerio]
  Gene Ontology: Mol. function=general RNA polymerase II transcription factor activity; Cellular component=transcription factor TFIID complex; Biological process=establishment and/or maintenance of chromatin architecture
  Coding regions on vcDNA: vcDNA=SeqID_89083; Strand=+; Position=58-926
MVASSFSNNGKNILESPFKLTGECKLLYYCTNELGHFLNQTSNALIGNPLRIVPFDGLSSPQKQVCTNTSNSLEFNCTERYISLTNGTALWIYDLQKGSTLRELHDHDGNISGVAWHRQSPWLLASVGDDCTLRLWDLPSHPAQIAIRRATKPYRRLEFSPDCNYIACAGELVSIYDLCMAQNVVHMLSCSSVFDINPVRFNPSECLLATADDDRTVRFWDVDTGECVTQTPIFNAKIGQIHFEPNGKYLIAVTEKQMASIRWEPFELVSQFDLSHQLH

SEQ ID NO: 162661 - protein, 93 aa, Heterodera glycines
  Coding regions on vcDNA: vcDNA=SeqID_89084; Strand=+; Position=234-515
FDDKTNEICMVLPGHRCPMNCLRRLKLKVTPKRPKMNFETDDRTFFLQEATQKWNFDDLHVMVMTSHFLRNHSVHFSQMMAPNLRMTAAAKKI

SEQ ID NO: 162662 - protein, 205 aa, Heterodera glycines
  misc_feature (163)..(163): Xaa can be any naturally occurring amino acid
  Homolog annotation: Hit_ID=NP_498662.1; Match level="QueryCoverage =95%, HitCoverage=30%, E-value=2e-54, Identity=54%"; Hit description =putative protein, with at least 8 transmembrane domains, of ancient origin (69.0 kD) (3I666) [Caenorhabdi
  Coding regions on vcDNA: vcDNA=SeqID_89085; Strand=+; Position=17-632
MDAPADAPGVHLFGTVVPKEVFLAQLFYLLYFASFGSLFPLLAVYFKQLGLSAAQAGILLGSRPLVEFVASPFWGSFADRFRKGKLLLLCSLCSMVVFTLAVGFVQPLTPYCVVLDQNSTGGECKFLVPASEIVRGGALGYIKKVAGIGRRRRGKTKKKNSTXRIVRLDILSIIDLSTFDSKNYLVAGKAPEYITKEKVCNYEKE

SEQ ID NO: 162663 - protein, 77 aa, Heterodera glycines
  Coding regions on vcDNA: vcDNA=SeqID_89086; Strand=+; Position=289-522
INFFPSSPKRSIGKVRLCSNSLNKNASSYIFRFSANRAGASALHFLKKMTKKSYFSKLKSLLNREETEDRLDFCSNK

SEQ ID NO: 162664 - protein, 99 aa, Heterodera glycines
  misc_feature (36)..(36): Xaa can be any naturally occurring amino acid
  Coding regions on vcDNA: vcDNA=SeqID_89087; Strand=-; Position=17-314
MAETAQRTTPRLTKDRRRNSGRRRRSASSSSSTANXRRSPPKRGKRPSGRASFRASTSISGRTRRSPPRNDEARKRSIAAHFYSSADDVHFLELLPFNE

SEQ ID NO: 162665 - protein, 246 aa, Heterodera glycines
  Homolog annotation: Hit_ID=CAA82344.2; Match level="QueryCoverage =97%, HitCoverage=46%, E-value=6e-78, Identity=59%"; Hit description =Hypothetical protein C07A9.6 [Caenorhabditis elegans] sp|P34317|YKT6_ CAEEL Hypothetical protein C07A9.6 in
  Coding regions on vcDNA: vcDNA=SeqID_89088; Strand=+; Position=2-803
RLSPLLFLSVLTFSVRSLRILQIVPGFTNSHVLFNYRLAQTLADMGHSVTLWTQMEMAMVFAGDLKLPEGVIEHRVPIHFRDRLKVEGLKVFQEMIFARGTPYELWWTGREFQEMRLEACEQMLNEADALRQKWAKFDLAIGHFHDLCPVILGKKFRLRESLMGWVTHGTSLYDFTAVTLGIRTLPSFVPHPLSSNGDRMSFTGRLKNVLWHLSGIEFVNLPEALLHDENKMYEQMSHGRDNLWAL

SEQ ID NO: 162666 - protein, 46 aa, Heterodera glycines
  Coding regions on vcDNA: vcDNA=SeqID_89089; Strand=+; Position=42-182
CQKLIENINLYSGYSSVKNDATLAIRPRKKSSFEWYLQIKKRLSGS

SEQ ID NO: 162667 - protein, 174 aa, Heterodera glycines
  Homolog annotation: Hit_ID=XP_319049.1; Match level="QueryCoverage =63%, HitCoverage=21%, E-value=2e-10, Identity=32%"; Hit description =ENSANGP00000013315 [Anopheles gambiae]
  Coding regions on vcDNA: vcDNA=SeqID_89090; Strand=+; Position=49-570
MADHQHNDIELAEDASATEQGTKQNVSVAVKWFFHGNWRRFQCSEWTYSALQAEIRTIEPNFSGQFFYRDADGDAIVFTTDAEMRVMLDHFQKKMNKDTVTLETMGGEGTVKTGVVKTGCPYINKIGKMRDVTNGNGDKSLHPHIMCDLCDGGVVGIRYKCMVCPDFDLCEQCE

SEQ ID NO: 162668 - protein, 245 aa, Heterodera glycines
  Coding regions on vcDNA: vcDNA=SeqID_89091; Strand=+; Position=1-735
LQLSSLRLPSVQWLCMPTTISVSPAIPDKLVVNGVDLVNRDQLSVSQNRELQRYIDANAHLLGFLDKDKEQQQTDGGGDKRTPLTISVTEQKFGPISPGQTSGISDKLPPSSAASSFSSPAYGRPPSAFAAASLNRAGSPYSMGGGSEYGGRRKGVSWSDVVEEPKPTTRTRSDSPPPASFIRHSMPALGKDSPSGYGTDEGRHYRNGASDDGTLDGGHDGRQNYDRYRHSSQNPFDRADGWVSS

SEQ ID NO: 162669 - protein, 205 aa, Heterodera glycines
  Coding regions on vcDNA: vcDNA=SeqID_89092; Strand=+; Position=28-642
MSSNLMGSPSCFFHPTAEQAAAAEEVDKYEVFSWHGDLSDQLAAQFLVTDQQLLKECREKLANSELRETKLLSKNGELNAENKALKAELEKQKMMTEHSQIKAKVEKMEQENQQQLDKKYVSFDVFNALVERIKRLENQQLKQNKEEGKKVTSSGDQSPPAVVSAKVAKELPNSKKQNGWDAKVCHKDIEIIGEKQLTINCKGNR

SEQ ID NO: 162670 - protein, 160 aa, Heterodera glycines
  Homolog annotation: Hit_ID=XP_417051.1; Match level="QueryCoverage =100%, HitCoverage=64%, E-value=1e-46, Identity=52%"; Hit description= PREDICTED: similar to esterase D [Gallus gallus]
  Gene Ontology: Mol. function=carboxylesterase activity; Cellular component=cytosol; Biological process=formaldehyde catabolism
  Coding regions on vcDNA: vcDNA=SeqID_89093; Strand=+; Position=144-623
MSLVELSKSRWFNGYQKIFEHNSAQLKCRMRFGVYLPDNQPESKLPVLFYLSGLKCTEENFVVKSAMQRFASNRKIIVVNPDTSPRGVVTGDGDDPSFGAAAGFYLDATETKWAQNYRMYSYILDELVPLVFSTFSVEKNKCGIFGHSMGGHGALTIALK

SEQ ID NO: 162671 - protein, 223 aa, Heterodera glycines
  misc_feature (91)..(91): Xaa can be any naturally occurring amino acid
  Homolog annotation: Hit_ID=AAH62376.1; Match level="QueryCoverage =100%, HitCoverage=62%, E-value=2e-48, Identity=49%"; Hit description= Unknown (protein for IMAGE:6391891) [Mus musculus]
  Gene Ontology: Mol. function=general RNA polymerase II transcription factor activity; Cellular component=transcription factor complex; Biological process=regulation of cell cycle
  Coding regions on vcDNA: vcDNA=SeqID_89094; Strand=+; Position=13-679
MAGNFWKSSHFEQWILDKGDLLRERGEDLKVYSEEEYQKLMIFFTNFIQEMGQCKERELGTQCNENTRDRPIQRMQAIATACVYFRRFYAXVRRSFKDIDPFLLSMTCTNLASKVEEMGHLTHTKLTATFQRAMKKWALFDPQQMALYHQIKHHHISETEFCLVELLDCSLIVYHPYRPLLQFRNDMKNASVQNAEHLYQDAWRVCNDSLKSDVPLLYPPHMV

SEQ ID NO: 162672 - protein, 158 aa, Heterodera glycines
  Coding regions on vcDNA: vcDNA=SeqID_89095; Strand=-; Position=172-648
AVQVNTQKVEVVFIETIDGRANGLKDSFALRLELKCLLEPFVDKSLQRVHLAFEFVQLIFGHNSVVHSFDLSRRCSHPIAQCFVFSRQPRLAPHNFLPFRFQSVFFRIKHFQQCDRLGREKRLVERRQPQKIQTDWSLLLGGFPSQKQYYGPLSLLIF

SEQ ID NO: 162673 - protein, 212 aa, Heterodera glycines
  Homolog annotation: Hit_ID=XP_395581.1; Match level="QueryCoverage =94%, HitCoverage=25%, E-value=2e-50, Identity=44%"; Hit description =similar to ENSANGP00000008472 [Apis mellifera]
  Gene Ontology: Cellular component=integral to membrane; Biological process=response to stress
  Coding regions on vcDNA: vcDNA=SeqID_89096; Strand=+; Position=3-638
TFDHFYQFYVFSVNRDSISSLDIYQRILRHRNYFVALVHKSLLPPQIRLPFVGSVHYLSSGLRFNIEWLLFWGPWSPWKSSYALKDEFKERDNLERIARNMQMNLLVMSVVNLVFLPFVVVYQVLFSFFSYSEHFQRDRHILGMRKYSNYGREKLRHFNEMDSELDARLNRSYEFAVRYTDQFVSTQSKIIAKNIAFIAAAVFVVLCSLTAY

SEQ ID NO: 162674 - protein, 182 aa, Heterodera glycines
  Homolog annotation: Hit_ID=NP_493175.1; Match level="QueryCoverage =90%, HitCoverage=44%, E-value=7e-24, Identity=39%"; Hit description =predicted CDS, zinc finger protein EZNF (1N119) [Caenorhabditis elegans] emb|CAB05558.1| Hypothetical pro
  Gene Ontology: Mol. function=RNA polymerase II transcription factor activity; Cellular component=nucleus; Biological process=regulation of transcription, DNA-dependent
  Coding regions on vcDNA: vcDNA=SeqID_89097; Strand=+; Position=1-549
INDRPYHCRYCPKRFTQKSHLDQHERIHTGLKPFTCQYCGRQFRQRSQQLGHEATHMNRERHSMGSMAMSAAVLGGLVGAAGGYGDAALCGTARERTTHLALKQPQQQQQEMAQAAAAQLTADEQRRQQQQQQSSSPTRPLGLGRPTVAGGVGGNGTRHFQRSQQQQMHQQQTNMDQCCAGG

SEQ ID NO: 162675 - protein, 203 aa, Heterodera glycines
  Homolog annotation: Hit_ID=CAE74248.1; Match level="QueryCoverage =90%, HitCoverage=41%, E-value=7e-51, Identity=53%"; Hit description =Hypothetical protein CBG21934 [Caenorhabditis briggsae]
  Gene Ontology: Cellular component=extracellular space
  Coding regions on vcDNA: vcDNA=SeqID_89098; Strand=+; Position=19-627
MLFSPSTVLLLLLIVLPFSLSFILIPQNVRQISPALSSRPFRRFGHFSVIAKRNPIVLIPGDGGSRLKANLTGKPSLVHYFCQRQTNDFFALWLDLQQFGPFVIDCWADNMRLNFNRTSGRAQDLEGVKVRVPGFGHTRTVEWIDSSKRSPSRYFAPIVASLAKLGYQRGIDVIGAPYDWRRAPEELLHYFVKLRSLIEQLYH

SEQ ID NO: 162676 - protein, 185 aa, Heterodera glycines
  Homolog annotation: Hit_ID=CAE69517.1; Match level="QueryCoverage =100%, HitCoverage=100%, E-value=4e-54, Identity=51%"; Hit description=Hypothetical protein CBG15726 [Caenorhabditis briggsae]
  Gene Ontology: Mol. function=ubiquitin conjugating enzyme activity; Cellular component=proteasome complex (sensu Eukarya); Biological process=protein modification
  Coding regions on vcDNA: vcDNA=SeqID_89099; Strand=+; Position=39-596
MSNIAFIRIQKECKEIILCKELQENGVTIEPVNETLFEIIGKIRGPPDSPYENGIFILDVKIPQEYPFQPPKTGAICLDILKDQWAASMTLRTVLLSVQSLLLSPEPKDPQDAIVAKQCLSDPALFRSTAKYWAQHYANAPGEIDRNKAKCVSTLQEMGASKDASISALSCYNWNLAKATEFLFT

SEQ ID NO: 162677 - protein, 177 aa, Heterodera glycines
  Homolog annotation: Hit_ID=EAA00341.2; Match level="QueryCoverage =93%, HitCoverage=95%, E-value=1e-56, Identity=62%"; Hit description =ENSANGP00000009226 [Anopheles gambiae str. PEST]
  Gene Ontology: Mol. function=lactoylglutathione lyase activity; Biological process=carbohydrate metabolism
  Coding regions on vcDNA: vcDNA=SeqID_89100; Strand=+; Position=24-557
MTSQNEGAVPAEETKKLVKEKDEATDGFYFQQTMYRIRDPRVSIPFYCNVLGMRLLKQLDFPEGKFSLFFMGYKDLDEIPSDDAAQKKFALSTHSTIELTHNWEHGTDFKGYHNGNSEPRGFGHIGIAVPDVDSACARFEQLGVKFVKKPNEGRMRGLAFITDPDGYWIEIFNPNNM

SEQ ID NO: 162678 - protein, 170 aa, Heterodera glycines
  Homolog annotation: Hit_ID=AAL00852.1; Match level="QueryCoverage =88%, HitCoverage=20%, E-value=4e-49, Identity=66%"; Hit description =Pctaire class cell cycle kinase protein 1, isoform b [Caenorhabditis elegans]
  Gene Ontology: Mol. function=protein serine/threonine kinase activity; Biological process=regulation of cell cycle
  Coding regions on vcDNA: vcDNA=SeqID_89101; Strand=+; Position=121-630
MHQMHQSCYAGVAGPNGGPLRPSVSLSVVHESSALGSDGESIEVSPCTSDQSAGGGDGNLGEGRQTTKTEYIPKVKLRQKPNRRWSEQDIQKRLSLPPDIRLPQNVIDKLNRTPTLDNPLTRKSKRASLNEIGFGKLETYKKIFDLGEGTYATVYLGKSLLTGKNVALKE

SEQ ID NO: 162679 - protein, 199 aa, Heterodera glycines
  Homolog annotation: Hit_ID=NP_510139.1; Match level="QueryCoverage =85%, HitCoverage=88%, E-value=6e-79, Identity=77%"; Hit description =i-36 protein like precursor family member (22.0 kD) (XN463) [Caenorhabditis elegans] emb|CAA91797.1| Hypo
  Coding regions on vcDNA: vcDNA=SeqID_89102; Strand=+; Position=35-634
MDIRRHFMCQKLFCLPLLMIITSFCTRSSNAELSQNNKKLSWIIGKWRSEFSGKVFWPSIPTMTFGEELIVAEAPLARTSGVQFLNWSARAWSHSTKDHFHDEWGYITVENNGNATLMTAGNNGFTTYEVGEVKSNKMVLTLKDIGRISFSRDLPVEDLRRTFIKHDDTYMEQVLEMRTATHPRVGYMEHTRVIYTKIT

SEQ ID NO: 162680 - protein, 108 aa, Heterodera glycines
  Homolog annotation: Hit_ID=NP_490812.1; Match level="QueryCoverage =95%, HitCoverage=98%, E-value=6e-29, Identity=57%"; Hit description =glutaredoxin (11.3 kD) (1B523) [Caenorhabditis elegans] gb|AAK29881.1| Hypothetical protein Y34D9A.6 [Cae
  Gene Ontology: Mol. function=glutaredoxin; Biological process=protein- disulfide reduction
  Coding regions on vcDNA: vcDNA=SeqID_89103; Strand=+; Position=74-400
MTAFKEFVNGLIKTKPVVIFSKEHCPFCVKAKDAINSFKLKPGALEIVELNQRNDCDQIQDFLKELTGARSVPRVFIGGTFFGGGDDTVVGLKNGMLEKQLKAADALQ

SEQ ID NO: 162681 - protein, 240 aa, Heterodera glycines
  Coding regions on vcDNA: vcDNA=SeqID_89104; Strand=+; Position=1-720
EQSNSTASPHIKITVNETGKQKRDNEQHNMEAVDDEFVNRLLKLSSRLDNLINVFGKKSSIKLKEDENNNKKFHSNSPNVVHALIGPTSCAVFPIHDYGEAFRKKYFGEILQCNLRSSDRILFDILKKIGDGRKVSFTCDSSRVAENSRVIVRLNLESNEISILQKDQSKIEGEIPVWKFIGSLVGTYCADDQSVNELTDQWLALASSVRIDELSRQMSVHLGAHDFLSSQHAICLPDLV

SEQ ID NO: 162682 - protein, 218 aa, Heterodera glycines
  Homolog annotation: Hit_ID=CAE66891.1; Match level="QueryCoverage =78%, HitCoverage=28%, E-value=4e-35, Identity=44%"; Hit description =Hypothetical protein CBG12272 [Caenorhabditis briggsae]
  Coding regions on vcDNA: vcDNA=SeqID_89105; Strand=+; Position=2-655
KILHIGNLICKLLTDVLPPTSLKNNNGPRRRRRQAGKADGTLRRCTRREYRMLSDDQRTRFHNALLQLKRGYGSYEYDRITALHSNINMMPSAHSGPTFPLWHREYNKRLEIALRSIDSSVCVPYWDSTLDQRLPNPSHSIMWTELFMGSTDSNNFVNSGFLANWITSDGNRVSRTMGADGGQLINETEANNVMSIQEINHIFAFAGGRPSQNCATNP

SEQ ID NO: 162683 - protein, 165 aa, Heterodera glycines
  Homolog annotation: Hit_ID=NP_491654.1; Match level="QueryCoverage =76%, HitCoverage=22%, E-value=4e-16, Identity=34%"; Hit description =CBF1 interacting corepressor (65.8 kD) (1G222) [Caenorhabditis elegans] gb|AAB37808.1| Hypothetical prote
  Gene Ontology: Biological process=growth
  Coding regions on vcDNA: vcDNA=SeqID_89106; Strand=+; Position=3-500
NEQIDIKPKIEVRKSHEEKKKKRRHYSSEEEEEGTEEEEKKPEPIDQEQLLVNMREEHNLKFKTGILIGLRADEHIKKMSAMVGGGEEKTFEAFLKGLDEKKRRKLMKKIMKTEVSDDSDIEKDKKQRRKQKKEEKRKADKKHKHRRSSSRETSRKRKEGKHHRH

SEQ ID NO: 162684 - protein, 231 aa, Heterodera glycines
  Homolog annotation: Hit_ID=AAK58432.1; Match level="QueryCoverage =91%, HitCoverage=73%, E-value=2e-09, Identity=28%"; Hit description =glycoprotein gp2 [Equine herpesvirus 4]
  Coding regions on vcDNA: vcDNA=SeqID_89107; Strand=+; Position=3-698
KGLHISLSPLSSLLLSQHNSNSSTASSLIDEMTSSRSRTRRATSNTASTTATAGRRRSRSRRRTRAEQVREATRRALRQNNGGNATRTRKKRGAAMRRPPKLKPLRGRPRGSRKSRAAPRTAGQKRGRGRPRTVKKGRARRGRSAAQRQTTTTADAATNTDAHWVTIAELRAATNTEATAAATAPTTTADGAAATNNDPTGAATTPTTNAATNTEAPAATTPATTADVALD

SEQ ID NO: 162685 - protein, 354 aa, Heterodera glycines
  misc_feature (279)..(279): Xaa can be any naturally occurring amino acid
  Homolog annotation: Hit_ID=XP_419512.1; Match level="QueryCoverage =92%, HitCoverage=9%, E-value=2e-73, Identity=46%"; Hit description =PREDICTED: similar to baculoviral IAP repeat-containing 6 [Gallus gallus]
  Gene Ontology: Mol. function=ubiquitin conjugating enzyme activity; Biological process=anti-apoptosis
  Coding regions on vcDNA: vcDNA=SeqID_89108; Strand=+; Position=3-1068
TAANKEEEEQLHELSSICKQVISIFNEQNGSKIGKASGAILRQANSNKYVLEATPGPSSSSAISSALFETKYCTAMFLQKFSVLSFEKIFTKDAYYYRIKLSQEQTSGTANMTLRRIAREIQSLQSNLMLTASTSAFVRSCEEHLDAMKVLITGPEGTPYQNGCFEFDFFFPSTFPQTPPQVHLRTTGNNTVRFNPNLYNEGKVCLSILGTWHGRPEEQWNAERSSVLQVIISIQSLIFVNDPYYNEPGYERYHSTQQGDLSSRRYNATIQVATVRWAXLEQLKRPPTEFESAVQLHFWLKRDEITAQIKRWADEWRSQAKQDKRFASSANELEKLLKQVSEELEKLKKLNLPE

SEQ ID NO: 162686 - protein, 629 aa, Heterodera glycines
  Homolog annotation: Hit_ID=CAE62199.1; Match level="QueryCoverage =96%, HitCoverage=96%, E-value=1e-106, Identity=36%"; Hit description= Hypothetical protein CBG06249 [Caenorhabditis briggsae]
  Gene Ontology: Biological process=regulation of cell cycle
  Coding regions on vcDNA: vcDNA=SeqID_89109; Strand=+; Position=43-1932
MLAATGRWPSSSSNSGLRIAMAICAILACCSLPNSTEAALAEVGQQPKGNNPLLYSVDDPIVHLDADTFEDTVLRPNRDRAYIVEFYKDWCGYCRRFAPYFKVLSESIKSWPFVQVAAINCADAYNVKICKANDIPTVPKLKYFPRNARSFEEGQVIEHSYESAMEMREQVHKKIMEEFNAETGKGNADFYLQKMEAQRQHNNENSQPEPWRDMPNSTQFLAQLFEKDAKDGLPFSLDLLLYKPSVEVRQVLVGSADEVPRNVPKPAKGKATEAAAFKLPYVRAMERGKTEPILAESLNDQTLAKLRELVKPMMVELNKTEQAKAHHKEPVQVVDCAQSPEKCKQMFFVSETDMLKAIHTALLDEVISSGGDEINGDRFAALRKFVELLIQRFPKKTFERNPQLSAHPKGTALSSIGKPLLRSQRAFKVFEQMKRFLDAKAGDGKVSMDEWRAEFDQAKKQNGDPFPVTAEWEHCKGTRTIFRGFTCGLWTAFHAMTVQAYLGQEQQPLKPLKAIQGWVANFFSCSGCRRHFMAMTTEKFPMEAKNVNKPEDVVLYLWKAHNIVNKRLHGDEATEDPQFIKEQFPPQYLCPGCHKTPSSASDGNDPTELDPEKTLRFLLQYSTNIKPRP

SEQ ID NO: 162687 - protein, 222 aa, Heterodera glycines
  Coding regions on vcDNA: vcDNA=SeqID_89110; Strand=+; Position=1-666
QSLQTSILLEQQQKAFLSNSGTTHNNLGTLLNRLPSLNGGSPVETALHRNGAVVAEQPVLGNNRQQQQQLTGIERLLNVAALIPQLHPFQQLQRTQQTTTATKHEGNGGGGGANVRKVMEENSVLFWSQMRSMGLLDDLLNTLSTTLERLKHIYLNGGNAVSEEFAARRLSGVALALDLCTLFSDKIHNRCIQATLETNLITKELLELHRQTRRSTSGKVEK

SEQ ID NO: 162688 - protein, 276 aa, Heterodera glycines
  Homolog annotation: Hit_ID=CAE62330.1; Match level="QueryCoverage =96%, HitCoverage=29%, E-value=4e-27, Identity=31%"; Hit description =Hypothetical protein CBG06401 [Caenorhabditis briggsae]
  Gene Ontology: Mol. function=translation initiation factor activity; Cellular component=eukaryotic translation initiation factor 2 complex; Biological process=regulation of translational initiation
  Coding regions on vcDNA: vcDNA=SeqID_89111; Strand=+; Position=48-875
MQQLSDRRIQFLLYIDKKFVKSHAILKLNEKKYGLLTQHVTFEVASKARAMTLSNVLNKMNMKLFGFNYMPMFPQASKSKFNMDGGDVLVIGVDTSRPPKATPFEKFMLRKKGVEGLISEDPLIVGICANYLKNPYKFCGDYYFQPCTQDVLEPNMLSYKMSWILDKVKKNRSKPPSTIFIIRDGVSEGMVPNNIHDEFPSYVRACKKYDPTWEPKFVYCIVDKNHNKRFFVKGQQQVENTAPGAVIDSKVVRVDIHEFWMQSHVPLKGTSKMPQY

SEQ ID NO: 162689 - protein, 158 aa, Heterodera glycines
  Homolog annotation: Hit_ID=NP_506352.1; Match level="QueryCoverage =93%, HitCoverage=94%, E-value=3e-47, Identity=61%"; Hit description =transthyretin-like protein precursor family member (17.8 kD) (5O10) [Caenorhabditis elegans] emb|CAB01136
  Coding regions on vcDNA: vcDNA=SeqID_89112; Strand=+; Position=1-477
SSTSLCLLLFAVFYLIDARTQSVAVKGRLLCGTAPARNVRVKLYDEDAGVDPDDQLDAGYSDPNGNFQLSGHTSELTNIDVVFKVYHDCDDGIKPGSRKLKFKIPNSYVTDSATPKKTFDIGVLNLETVFKDEERELIVTMKKKRRSHRYQDFLDILP

SEQ ID NO: 162690 - protein, 156 aa, Heterodera glycines
  Homolog annotation: Hit_ID=NP_956270.1; Match level="QueryCoverage =98%, HitCoverage=68%, E-value=8e-62, Identity=70%"; Hit description =manganese-containing superoxide dismutase precursor [Danio rerio] emb|CAI11702.1| superoxide dismutase 2,
  Gene Ontology: Mol. function=manganese superoxide dismutase activity; Cellular component=mitochondrion; Biological process=superoxide metabolism
  Coding regions on vcDNA: vcDNA=SeqID_89113; Strand=+; Position=1-471
EKTQEALSKGDFRTAIQLQPMLKFNGGGHINHSIFWTVLAKDGGEPSGDLLKTIERDFASVQKMQEKVSTKAVGVQGSGWSWLGYNKELKRLQVAACMNQDPLEETTGLIPLFGIDVWEHAYYLQYKNVRPDYIKAVWTVVNWKNVEERFMNALNE

SEQ ID NO: 162691 - protein, 242 aa, Heterodera glycines
  Coding regions on vcDNA: vcDNA=SeqID_89114; Strand=+; Position=31-759
MSAFFVVALPVMLAVLTEAQNFGGQGGALNAPLPFGGPINPGFVQEQLPHMLHHPNLKSGEDIEAAFQNGGGQVAGVQHQQSNNNLPPPPPQNFGNNNFNQQKRPKFNNGQFSGVRRAQPHLTQQQQRLNQAETPCPQATWQKIMEDNIKANDSTSTLNAIQSGFGKAFKNQIFMVLCTTTEEKKRFGQKVQLDIKGDGYCNVEREGRLVPSGQAECRKWHHIERIGRIWPRHFIGWTQMIV

SEQ ID NO: 162692 - protein, 177 aa, Heterodera glycines
  misc_feature (81)..(81): Xaa can be any naturally occurring amino acid
  Homolog annotation: Hit_ID=NP_491709.1; Match level="QueryCoverage =70%, HitCoverage=27%, E-value=4e-34, Identity=50%"; Hit description =tyrosinase family member (82.2 kD) (1G477) [Caenorhabditis elegans] gb|AAB52481.1| Hypothetical protein C
  Coding regions on vcDNA: vcDNA=SeqID_89115; Strand=+; Position=1-532
QVTRGQVCNGGAQSQQNQFRITEKPPAHQAPQCASQGCFNENICCQLWGLAGECRRNPTWMNCFCKVSCGKCIPQDYVFGXSCTDYHPRCWEWAEEGECRNNAWMSENCKQSCGTCVSQYELKQMCRRGGRGKRQISMLLEGAAGSPPGGHSEDQKDSLGPPKTAASGAKEFISGQK

SEQ ID NO: 162693 - protein, 209 aa, Heterodera glycines
  Homolog annotation: Hit_ID=NP_501862.1; Match level="QueryCoverage =86%, HitCoverage=37%, E-value=3e-67, Identity=66%"; Hit description =GABA TransAminase (53.1 kD) (gta-1) [Caenorhabditis elegans] emb|CAA93517.1| Hypothetical protein K04D7.3
  Gene Ontology: Mol. function=4-aminobutyrate aminotransferase activity; Cellular component=intracellular; Biological process =nitrogen metabolism
  Coding regions on vcDNA: vcDNA=SeqID_89116; Strand=+; Position=17-643
MINFRVSFAAASFRFGSGCQSIVNRFAHSLSSIASSEPDAPSMLTQIPGPKSKALKEEMEQVHQTTSINFFADYERSFGNYLIDADGNALLDLFTQISSLPLGYNHPELIKLATDARLITTAVSRPALGAFPRSDFAQLVARSLHSVAPRGLRHVQTMLCGSSANENAIKTAFIHYQTRLRGGSPPTAQHLSSCMRNEAPGTPQLSCLG

SEQ ID NO: 162694 - protein, 208 aa, Heterodera glycines
  Coding regions on vcDNA: vcDNA=SeqID_89117; Strand=+; Position=22-645
MELEIFKDACGQTALKLVGRHPITVTASAVPDLPTFETIRVSFFDGFVAAVFTERKKQLSRNRIELAIFSQPTDESKNAFKSLWSLFNSQIGAITSVCNASAADRRNAKNTSIYNLDPNFDTVPDWLVAPTLRRVDGVFGLETIYKWIHNDEGGDVVKTFTMHPPEEGVKIPAGDFERFLLSFFRFRGAKTPGYTAKFKHGVVDKYVR

SEQ ID NO: 162695 - protein, 172 aa, Heterodera glycines
  Homolog annotation: Hit_ID=NP_492323.1; Match level="QueryCoverage =90%, HitCoverage=91%, E-value=1e-26, Identity=40%"; Hit description =putative protein, with at least 2 transmembrane domains, of bilaterial origin (19.0 kD) (1J169) [Caenorha
  Coding regions on vcDNA: vcDNA=SeqID_89118; Strand=+; Position=3-521
MNQQKSAKRATRGQRQIYEENKQTLLCYVLASICSSVLVFSLNYFLFLPQKGAWIGLALSSASQAFSVILMSMMMKTVRNERNLLVDAGLDLNDPNAFGEYCKDIVILSVSAQLLSLIWTGFFFVLLSIPFFTLYKLWTNILGPWFFRPTLDDDEKEDKKKQKKPKFVHVRR

SEQ ID NO: 162696 - protein, 224 aa, Heterodera glycines
  Homolog annotation: Hit_ID=NP_506750.1; Match level="QueryCoverage =61%, HitCoverage=43%, E-value=2e-12, Identity=34%"; Hit description =BTB/POZ domain and Meprin/TRAF-like MATH family member (5P667) [Caenorhabditis elegans] emb|CAA21761.1| H
  Coding regions on vcDNA: vcDNA=SeqID_89119; Strand=-; Position=150-824
GAQVQLQHNAGAANAAPSDGFFNVLIRLLEKREHQIIENPCPPCDSEDEVVLKVGPEQFTVSKHFLMSVSPVFHKMFSVDMLEKAQGEVSLEETNGEEFGAFLDAISPKMASPNPANVMGMLKLADRFQVDALRTRCEAHLINCVEISLIERLLCFEMYRLEKLKNFILKSLNGVGMREFCEENQAALNLLSKDLLIQLTVRICSSSKIDRSALCHNCTKNLNE

SEQ ID NO: 162697 - protein, 209 aa, Heterodera glycines
  Homolog annotation: Hit_ID=AAH79686.1; Match level="QueryCoverage =100%, HitCoverage=22%, E-value=2e-70, Identity=58%"; Hit description= MGC80263 protein [Xenopus laevis]
  Gene Ontology: Mol. function=pre-mRNA splicing factor activity; Cellular component=nucleus; Biological process=RNA processing
  Coding regions on vcDNA: vcDNA=SeqID_89120; Strand=+; Position=3-629
QILTQQAQFEEARKQYLEGTRRSPHSIAIWLLLIRLEDSRGRHIKARSQLDIAKTKNSKCDQLWLEGIRMELRAGQKELAQSMLARALQECEHSGRLWAEAIFMEQRHARKTKIVDALKKCEHDPNVLLAGSKLVWAERKTKKARSWFQRTVKVDPDFGDAWAYFYRFELMHGTQEEQEEVKKRCLQSEPRHGELWQEASKDVKNWRKK

SEQ ID NO: 162698 - protein, 169 aa, Heterodera glycines
  Homolog annotation: Hit_ID=NP_491991.1; Match level="QueryCoverage =96%, HitCoverage=39%, E-value=7e-17, Identity=32%"; Hit description =putative membrane protein (1H568) [Caenorhabditis elegans] gb|AAK85451.1| Hypothetical protein C30F12.5 [
  Coding regions on vcDNA: vcDNA=SeqID_89121; Strand=+; Position=193-699
MECVRHLLHLLLLLTFSGQLLVTLADLYDDYEQCKSSGHFGAEDGSPSLVCDSEGRLTPQALAQLNGILTDMGRDAGCQCADGCDGKPFSVRLLVTSGERVEQSGGTTALNETAGRIWESEGMGTEQCDNGMLMLYIRDQKRMVTFQGHRRLQIYSDRDIDNLHELTSR

SEQ ID NO: 162699 - protein, 199 aa, Heterodera glycines
  Homolog annotation: Hit_ID=NP_497886.1; Match level="QueryCoverage =91%, HitCoverage=85%, E-value=5e-76, Identity=70%"; Hit description =lysosomal thiol reductase IP30 like family member (3F485) [Caenorhabditis elegans] emb|CAA83624.1| Hypoth
  Gene Ontology: Biological process=regulation of protein activity, epigenetic
  Coding regions on vcDNA: vcDNA=SeqID_89122; Strand=+; Position=61-660
MANSSLSRPFGLCLCSLLLFICAFPPISTQRVNVTLFTESQCPFCTRLLREQIWQFHSRFPGIMNLQVIPFGKGNCEFTRDRRIICKCMHGPTECDLNRLQNCAISYFPRRHIGLVTCIQGLKNLDEAYRRCLSRLSPRTQFRLKQCAETQTGEVLNYVSMLNTHRAGVRIWPTAYVNGHFFDRSYPMETKICEHTAWC

SEQ ID NO: 162700 - protein, 178 aa, Heterodera glycines
  misc_feature (54)..(54): Xaa can be any naturally occurring amino acid
  Homolog annotation: Hit_ID=AAC47437.1; Match level="QueryCoverage =100%, HitCoverage=82%, E-value=3e-67, Identity=51%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_89123; Strand=+; Position=2-539
QHNAKDIWSEVSQLKGMPLLVAGNRTARSAYGSCQECCSGGAQGQPGQPGQPGXPPPCTPCPGGQPGNNGPPGPPGAPGAPGQPGTGGGQPQPGEPGPPGPNGQPGQPGQPGAPGQPGAAGQPGPKGPPGGPGQPGNGGAPGQPGQPGQPGNPGERGICPKYCAVDGGVFFEDGTPRR

SEQ ID NO: 162701 - protein, 221 aa, Heterodera glycines
  misc_feature (169)..(169): Xaa can be any naturally occurring amino acid
  Homolog annotation: Hit_ID=CAA74206.1; Match level="QueryCoverage =100%, HitCoverage=63%, E-value=1e-123, Identity=98%"; Hit description=serine proteinase [Heterodera glycines]
  Coding regions on vcDNA: vcDNA=SeqID_89124; Strand=+; Position=1-661
LKLCLTIILVTIGYKSFSLSEHISEFSECGISDFEPEFPIAPKVEIGTNHIFKGKTIVDDKSLPWMARILSGVSCTATIIGPRHVLTAAHCVEGQALENFVVSYGSADASNQQHKSGVEAIKYHPKTQHYEIKDKFRKNTRAYLFLNDIGVIKIKNSIKLSQNARPICXLHGFHLTNSTKSDGKSIKYDEYSKFINNTQCVVAGWGITKPTCSNDDDKPLS

SEQ ID NO: 162702 - protein, 193 aa, Heterodera glycines
  Homolog annotation: Hit_ID=NP_595618.1; Match level="QueryCoverage =100%, HitCoverage=51%, E-value=5e-99, Identity=90%"; Hit description= actin [Schizosaccharomyces pombe] emb|CAA68501.1| unnamed protein product [Schizosaccharomyces pombe] em
  Gene Ontology: Cellular component=actin filament; Biological process =cytoskeleton organization and biogenesis
  Coding regions on vcDNA: vcDNA=SeqID_89125; Strand=+; Position=77-655
MSDEISALVIDNGSGMCKAGFAGDDAPRSVFPSIVGRPRHHNVMAGMGQKDSYVGDEAQSKRGILTLKYPIEHGIVNNWDDMEKIWHHTFYNELRVAPEEHPVLLTEAPLNPKVNREKMTQIMFETFNTPAFYVQIQAVLSLYASGRTTGIVLDSGDGGTHTVPIYESYALPHAIQRLDLAGRDLTHHLQTIL

SEQ ID NO: 162703 - protein, 203 aa, Heterodera glycines
  Coding regions on vcDNA: vcDNA=SeqID_89126; Strand=+; Position=26-634
SKVPSLLRTDSKNRKCTDVMALFSLPRQLALFKRTETIVCDGTFKMAPRGIYQIYRVFGFIAQTHCVPLATALLRGKSRVLYDQFWTRLRQELDKIPGILMISQANFDYESASVNAFCDVFPTVRPKMCAFHVKQAINRRIQSMGFMQLYSSKEPNGLEFQRLPVRFNSRAISSHAPPLETLQQGALSELLDYCNNTWINNRI

SEQ ID NO: 162704 - protein, 215 aa, Heterodera glycines
  Homolog annotation: Hit_ID=EAA76590.1; Match level="QueryCoverage =78%, HitCoverage=69%, E-value=4e-34, Identity=45%"; Hit description =conserved hypothetical protein [Gibberella zeae PH-1] ref|XP _387207.1| conserved hypothetical protein [Gib
  Gene Ontology: Biological process=pentose-phosphate shunt
  Coding regions on vcDNA: vcDNA=SeqID_89127; Strand=+; Position=6-650
MSIKNYELRLSKNADEQSEAFYCYLKSVIEERSKCRQTVIIGFSGGSMPAFLAQQLVRLSDQTIAGLRLFPVDERHVSVNSEESNAGTLLRLLPDKFRENVLSIQPDDSGLLTAQRFEQQLRVLSPQLDVNGWPVFDLLLLGLGPDGHTCSLFPGHPLLKEESVWVAPIDDSPKPPPRRITITIPLLNAAANLAFIANGASKAAVLKKILWIMIK

SEQ ID NO: 162705 - protein, 221 aa, Heterodera glycines
  Homolog annotation: Hit_ID=CAE62917.1; Match level="QueryCoverage =99%, HitCoverage=75%, E-value=1e-63, Identity=55%"; Hit description =Hypothetical protein CBG07111 [Caenorhabditis briggsae]
  Coding regions on vcDNA: vcDNA=SeqID_89128; Strand=+; Position=37-699
MQDDWRSLTYEEANATLKKWREEHARRSEEVVEIWEFVLSRYAAALKGELWAVLEQVTIAALDQARHDLAIECLQQLHRRFPKSTRVTKLQAMRLEAIGNYEDAEELYRRLIEGDDTNPLFRKRCIAILIARGDRQLAIRELNKYLEIFANDSEAWLQQGELFLQEADFGRAAFCFEELLLSNPQNPTYLLKMAEIRYTLGGTDNVEDARAYYERSLALAP

SEQ ID NO: 162706 - protein, 132 aa, Heterodera glycines
  Homolog annotation: Hit_ID=CAE59627.1; Match level="QueryCoverage =91%, HitCoverage=27%, E-value=8e-16, Identity=39%"; Hit description =Hypothetical protein CBG03040 [Caenorhabditis briggsae]
  Gene Ontology: Mol. function=pre-mRNA splicing factor activity; Cellular component=nucleus; Biological process=transcription
  Coding regions on vcDNA: vcDNA=SeqID_89129; Strand=+; Position=44-656
MAEDEVDDLLEEAFKNVDEAEKNGTKMDDVIKKKAKEVGIKMSDSEGKRKRSRSGSRERKRRRSRSREKKKRDSSRERRRRSPSENSKRKRRSRDRRRSRSRSRDRRRSPISRRRSRSRSPLEKRRSPAPRR

SEQ ID NO: 162707 - protein, 113 aa, Heterodera glycines
  Coding regions on vcDNA: vcDNA=SeqID_89130; Strand=+; Position=25-366
GDRIDGKTVEWVTEKKFGGTVKFDAEIEAGIFRFDQCEDHHCGVGTQQKRNLTDKWTKCTICHPSQKHLCPWHYPLGTAIFTKTQIHGRSPSSNPNKQSFENGKFKKKRRGTM

SEQ ID NO: 162708 - protein, 163 aa, Heterodera glycines
  Coding regions on vcDNA: vcDNA=SeqID_89131; Strand=+; Position=2-493
SKAGNLAKGVDRLLKAIDKAHKKLCIREKLCDEFIENGRKLTREYLRKSAKEESAEMLEVFEFVPIDHHGNFDYSLMANLSLPRTSIDSSAGGAFSPNNNPSISNIAINFLADYRPFAYGVPITRDSPSATVISRCKSPFCKMSADDERRLSLRCRCLRLAWT

SEQ ID NO: 162709 - protein, 189 aa, Heterodera glycines
  Homolog annotation: Hit_ID=NP_741261.1; Match level="QueryCoverage =97%, HitCoverage=19%, E-value=2e-61, Identity=62%"; Hit description =V-ATPase a subunit; ATP-dependent proton pump involved in the acidification of intracellular compartments
  Gene Ontology: Mol. function=hydrogen-transporting ATPase activity, rotational mechanism; Cellular component=hydrogen-transporting ATPase V0 domain; Biological process=negative regulation of locomotion
  Coding regions on vcDNA: vcDNA=SeqID_89132; Strand=+; Position=1-570
EGFVDEHHQQQHISTSVHANMQEDGAEVLHHEDTSPTHKNHETATGGEKGGGQGQQHGDGSFGDIMVYQAIHTIEFALGCISHTASYLRLWALSLAHAQLSDVLWSMVLRNGFVQSGYLGAVITYLIFIVFGTLTLSILVLMEGLSAFLHALRLHWVEFQSKFYGGMGHPFVPFSFEKILEESRQSEDS

SEQ ID NO: 162710 - protein, 213 aa, Heterodera glycines
  misc_feature (196)..(196): Xaa can be any naturally occurring amino acid
  misc_feature (198)..(198): Xaa can be any naturally occurring amino acid
  Homolog annotation: Hit_ID=CAA74206.1; Match level="QueryCoverage =97%, HitCoverage=61%, E-value=1e-36, Identity=37%"; Hit description =serine proteinase [Heterodera glycines]
  Coding regions on vcDNA: vcDNA=SeqID_89133; Strand=+; Position=6-645
MVKFWLTLFFVFTGNNLYSIFAHKPNFSQCGISDFEPDLDNVPNVKIGTNHIYKGQPVENANSMPWMVTLLSLQGLCTGTIISHKYILTAYHCVSGIISVPSSIQISYGTVNVANEKHKTNARNIIIHPNASLSEMRVKINGSEFGTDSVSNDLAIIEVENALKFSPNVGPICLFGLDASGNDKFGTFSPLINSQXLXAGWGLTQPMCQKYPT

SEQ ID NO: 162711 - protein, 308 aa, Heterodera glycines
  Homolog annotation: Hit_ID=NP_510513.1; Match level="QueryCoverage =75%, HitCoverage=46%, E-value=2e-51, Identity=48%"; Hit description =putative protein, with at least 5 transmembrane domains (XP730) [Caenorhabditis elegans] pir||T20628 hypo
  Coding regions on vcDNA: vcDNA=SeqID_89134; Strand=+; Position=3-926
VLSVLLHHTRHHLSTVTILFIFNILFSNVLFLASFLCLYSDIALDTKYTRPIANSNEEAEEDSADASAEDEDTTTPQLFIAEILQIHLYKPSEFLKNLIQETLLSLAQNGSLLGLTNLLVLVLVVINRSMSGKGIRISRAKVIAVFAGVWLFLVVSHVLFSALQYFAVSQLHELLELTSSNPSQFACRRSATFMVYNEIGERCDRLAVYQELGHFLLKGHTLFTVVLLSISLVIFVITVYCHRRVQRQHHFLNENATNGKNAGGRSDGGTDSEAGGSTVRRRRDSSPFRRRETLFQTLVLSLIAFFLS

SEQ ID NO: 162712 - protein, 266 aa, Heterodera glycines
  Homolog annotation: Hit_ID=CAE59693.1; Match level="QueryCoverage =67%, HitCoverage=18%, E-value=6e-32, Identity=46%"; Hit description =Hypothetical protein CBG03117 [Caenorhabditis briggsae]
  Gene Ontology: Mol. function=voltage-gated chloride channel activity; Cellular component=integral to membrane; Biological process=transport
  Coding regions on vcDNA: vcDNA=SeqID_89135; Strand=+; Position=39-836
MSGFSEGTFHRNSTPNNTLATTAVPANYKMSMINDRNLFGNTLLSISPLHDDQSKSGRLVPLLMRHQKEAKSINQQQAFLGRSTSVRDRAAQLRKPIDLDEVAIDAAPFQLVIGTSLYRVHTLFALLGLNHAYVTNRGRLVGVVALRELRAALAHIYTRGALPTAQSMSRLRLNSLNFGLCSTDRSRANSGVEGNSDNLNGSSLRTAMSPTSLSGPLTQSTTVTGEETSDGTLQNLFLTDETQRILSLDDTLPKFLITCPLRSYPS

SEQ ID NO: 162713 - protein, 126 aa, Heterodera glycines
  Homolog annotation: Hit_ID=NP_500737.1; Match level="QueryCoverage =86%, HitCoverage=28%, E-value=2e-22, Identity=44%"; Hit description =peptide chain release factor (43.5 kD) (4F953) [Caenorhabditis elegans] gb|AAB94190.1| Hypothetical prote
  Gene Ontology: Cellular component=mitochondrion
  Coding regions on vcDNA: vcDNA=SeqID_89136; Strand=+; Position=1-381
HKPTRVSVKVMDERYLAQNIKIAHQRLAAILLKQKVDEATRRHESHRKLRVGTMERAEKIRTYNYRDNRITDHRLKVTVHGVGQFLDGGQMLEQMVDALIEMYEQESVEQTGEQPKNEEEETGKKV

SEQ ID NO: 162714 - protein, 225 aa, Heterodera glycines
  Homolog annotation: Hit_ID=XP_521029.1; Match level="QueryCoverage =98%, HitCoverage=71%, E-value=4e-24, Identity=30%"; Hit description =PREDICTED: similar to XRP2 protein [Pan troglodytes]
  Gene Ontology: Mol. function=chaperone activity; Cellular component =microtubule; Biological process=beta-tubulin folding
  Coding regions on vcDNA: vcDNA=SeqID_89137; Strand=+; Position=2-676
FTFSQKPEKRPKKDDTNENNDTFEQNTQSNSFVGAAISALQLSAKDVDTTFQGIVEQTVFRGSADGNPFAIRECTGSLLVLLGHAATITIDKCSNCVIICGPCRGSIFMRNCANCLLLAACHQFRLQNSRDIEAHLHCSTNPTIEDSDLIVAPLLMRYDGFKEDMESARLDNAPNLWDKVQNFTAETGQFQRMNFDPFANGAINSEVVSDELLEKLSTVMEEPEA

SEQ ID NO: 162715 - protein, 94 aa, Heterodera glycines
  Coding regions on vcDNA: vcDNA=SeqID_89138; Strand=+; Position=211-495
LTAKWEKHRRQEPTKLWNRVIVDNLTARRMRREQSNRKEEEKATEERDERHKDEEEGEEEEKQREGEEKQGEEMEEAMGTSRKQSEKRDICQIY

SEQ ID NO: 162716 - protein, 166 aa, Heterodera glycines
  Coding regions on vcDNA: vcDNA=SeqID_89139; Strand=+; Position=153-650
LQRDRIMTQILLRLAKHKHGMALTRNSRHGFRCFCGWTNANSCALFCTPSMFSLVFCGHCSPTRMFCCWHCFVPVLSRSLCRWHFTNYKKPHTNSRWCWPKPCSRRRRAEPPAERFSNLSATIWKRPDCSPPLILCWNWCQKAKLTSECQFCSIAVKWRTKTQIPA

SEQ ID NO: 162717 - protein, 181 aa, Heterodera glycines
  Homolog annotation: Hit_ID=AAK83075.1; Match level="QueryCoverage =99%, HitCoverage=51%, E-value=1e-84, Identity=78%"; Hit description =collagen [Meloidogyne javanica]
  Gene Ontology: Mol. function=structural constituent of cuticle; Cellular component=extracellular; Biological process=positive regulation of body size
  Coding regions on vcDNA: vcDNA=SeqID_89140; Strand=+; Position=3-548
HNGKDGAPGRDAQSIPAPLEEPCIICPPGPAGPQGPAGPKGPPGPKGSPGEPPKDGVPGEQGMQGLPGPVGRPGREGPRGAPGQPGRLIPVPGPQGPPGPSGPPGEQGPKGQPGPDGQSFEGPPGPPGDAGRPGREGRPGGTGPSGPPGQDGEKGSCDHCPEPRTPPGYFVEAGKSGGHYH

SEQ ID NO: 162718 - protein, 218 aa, Heterodera glycines
  Homolog annotation: Hit_ID=NP_942574.1; Match level="QueryCoverage =96%, HitCoverage=22%, E-value=2e-45, Identity=42%"; Hit description =WD repeat domain 3 [Danio rerio] gb|AAH57490.1| WD repeat domain 3 [Danio rerio]
  Gene Ontology: Mol. function=snoRNA binding; Cellular component =nucleus; Biological process=processing of 20S pre-rRNA
  Coding regions on vcDNA: vcDNA=SeqID_89141; Strand=+; Position=1-654
VSLGQRSHRFDVRSVCIASDSSFFVTGSHDCALVWDSETLSPVNKLTEDGLSQISASIVVFGDKQIVLGTRTGALFLFDLLSCELLAMDDKAHESAISEICAFPEKDGFISCGNDKQARFWHYEWLSELDGSKHLSMRSVRRLELNDEALCAALSPNGKFVAFGMLDTTARVFFRDSLKFFVSLYGHSLPIYCIDISADSKLVVTGSADKSVKIWGLD

SEQ ID NO: 162719 - protein, 179 aa, Heterodera glycines
  Homolog annotation: Hit_ID=AAL78214.1; Match level="QueryCoverage =86%, HitCoverage=78%, E-value=5e-11, Identity=29%"; Hit description =putative esophageal gland cell protein Hgg-20 [Heterodera glycines]
  Coding regions on vcDNA: vcDNA=SeqID_89142; Strand=+; Position=46-582
MNRRWICGDVWMDILPSFDRPQLGLKMALLSDRFDVLVDKHFDRKSELTIWRRIRIDKDKGPKAKLSVLIDDKCVAFPLPDHSLPIKIRFKELQIDYIGHSVITFLSSNQQIWDRKGTNLDLFIFATDHNNIQSIWDVLAREIWPIFATNIRHLAFRNGDHLDNLRSYTSPKILTDLDQ

SEQ ID NO: 162720 - protein, 202 aa, Heterodera glycines
  Homolog annotation: Hit_ID=CAE73733.1; Match level="QueryCoverage =95%, HitCoverage=70%, E-value=3e-54, Identity=55%"; Hit description =Hypothetical protein CBG21259 [Caenorhabditis briggsae]
  Coding regions on vcDNA: vcDNA=SeqID_89143; Strand=+; Position=39-644
MISRLFLQPNNLPSIRYLATSAFSKARYGFRPSGGAGQYAFRFKEAFAARQVAPTLRERLLGPTTGKPFIVGTYALAGASVFGIGMLCYYGLTTTVDSAAVRSNLWPDYVRQRLQSTYAYLAGSLALTAGAGVAAARSPGILALTSAPSLLVWFGSLAAIIGSGIVVQKIDYHGNSAAKHLAWLAHCGILGAVLAPLCFVGG

SEQ ID NO: 162721 - protein, 189 aa, Heterodera glycines
  Homolog annotation: Hit_ID=EAL47348.1; Match level="QueryCoverage =82%, HitCoverage=93%, E-value=1e-34, Identity=46%"; Hit description =ubiquitin-conjugating enzyme, putative [Entamoeba histolytica HM -1:IMSS]
  Gene Ontology: Mol. function=ubiquitin-protein ligase activity; Cellular component=endoplasmic reticulum; Biological process =conjugation with cellular fusion
  Coding regions on vcDNA: vcDNA=SeqID_89144; Strand=+; Position=85-651
MSSSHRETGRSPRSVLMRQYEMLLQNSNDNSGFRAWFDNNNLFKWRILIDGPPGTPYAGCKLTALLHFPASYSNDPPTMTFLTDILHPNIDQSGKVCISILHAPGIDPLGHEQPSERWNPNRSVESILVSIQVLLAEPNFNSPANVDAAILFRNDPAQYRKEVRRRVERASASTPRARSSSTPPPVAQP

SEQ ID NO: 162722 - protein, 141 aa, Heterodera glycines
  misc_feature (71)..(71): Xaa can be any naturally occurring amino acid
  Homolog annotation: Hit_ID=NP_506713.1; Match level="QueryCoverage =73%, HitCoverage=24%, E-value=7e-15, Identity=43%"; Hit description =o-sialoglycoprotein endopeptidase (5P562) [Caenorhabditis elegans] emb|CAB02716.1| Hypothetical protein C
  Coding regions on vcDNA: vcDNA=SeqID_89145; Strand=+; Position=3-427
SLRRVFGKLVVPSAPLGRRRFLHILGIESSCDDAAVAIVNWEERRVLADRRSADNDSLLRLGGVSPYVSAXHRSMIGPLIENALSDSDLRSSDIDAVSVSNCPGLVYCLKVGVEHALAFARCWKELMTNRAQLINWLISPN

SEQ ID NO: 162723 - protein, 198 aa, Heterodera glycines
  Coding regions on vcDNA: vcDNA=SeqID_89146; Strand=+; Position=3-599
LVFKPNAQMGRPFLPLAFSLVLLLLAVVISTNCANASPIVGEEQPMAPEQKATKGTNDGQMGDDNRTNRRNNMAAAQHQQQNRNATSLVALGWLGLRSGASSVNAVNVASCYDSRLSSFINDGLRYYSHNMGQLSKYIIDQIKRVRYSGYWFVHAAMIGGQTQGLQWQSQSNGDIFAQTSRHGCYYHDTQTYIIIIRY

SEQ ID NO: 162724 - protein, 307 aa, Heterodera glycines
  Homolog annotation: Hit_ID=CAE64958.1; Match level="QueryCoverage =86%, HitCoverage=95%, E-value=4e-81, Identity=58%"; Hit description =Hypothetical protein CBG09792 [Caenorhabditis briggsae]
  Gene Ontology: Cellular component=lateral plasma membrane; Biological process=RAS protein signal transduction
  Coding regions on vcDNA: vcDNA=SeqID_89147; Strand=+; Position=188 -1111
MPKNDRSAHPPHSQSAPAEDNTEIDCVDRGIHNFGQLRLNFENSRVTRLTLSHNKLTSIPANISDLVNLEQLNLWNNHIEELPVTISALPNLKLLNVGMNRLYKLPRGFGSFAKLELLDLTYNNLREQSLPGNFFFMPTLRALYLGDNDFESFPEDIGHLTNLQVLVLRENDLIDLPRQMGTLQKLKELHIQGNRLQVIPPELGQLDLIDPNDENAKTLRVENNPWIVPLKDALTRGAQGGDWQSGVESFWNYIRSDNYRRLYESHPVGVGSPPPKRNKEKKVSRVKGSAAGGAAEGSRGQSRERTE

SEQ ID NO: 162725 - protein, 62 aa, Heterodera glycines
  Homolog annotation: Hit_ID=CAB62280.1; Match level="QueryCoverage =58%, HitCoverage=8%, E-value=7e-09, Identity=69%"; Hit description =hydroxyproline-rich glycoprotein DZ-HRGP [Volvox carteri f. nagariensis]
  Coding regions on vcDNA: vcDNA=SeqID_89148; Strand=-; Position=180-368
FLLLFLFHYLFIDNPIIGAINFTDQRPNPMPIPLPMPMPIPPPMPIPPPIPPPNPPPPIPPP

SEQ ID NO: 162726 - protein, 423 aa, Heterodera glycines
  Homolog annotation: Hit_ID=NP_503577.1; Match level="QueryCoverage =98%, HitCoverage=98%, E-value=1e-130, Identity=53%"; Hit description= putative protein family member of ancient origin (47.3 kD) (5C607) [Caenorhabditis elegans] gb|AAF99915.
  Coding regions on vcDNA: vcDNA=SeqID_89149; Strand=+; Position=35-1306
MSTDRYDIVLYGASGFTGQHVLESFVKNGHLDQFNFAVAGRSEKKLKQTLEDIEFITGKVLTKIPIIIADSSDAQQLAEMAKQAKVIVNVVGPYRLYGEAVVKAAVENGASHVDISGEPAWIEAMQMKYSEKAKEQGVFIVSACGWDSVPCDLGMNYLKQYFKGTLSHAETFAHIQIGEAGYSFNAGTYQTLILGLWQAKNDDLGKIRRSIMPEKMEKTKWRPPKRGMFWWNDSLDAYCLPFMGADKSIVQRSQYFDNIADKTYPASLETYILVKSWFWAVALMMWLTIFNFAVKFDFTRGILQKNPGICSGYLFKETGPTRVQAQQASFTYWFFGWGWEQSSPQPDEAPTKRMVVRCDGPDAGYIGTAGCILSCALTILKERSAMPSEGGVFTTAEAFKNTNIYETLSSFGVTFRVDSSVKV

SEQ ID NO: 162727 - protein, 197 aa, Heterodera glycines
  Homolog annotation: Hit_ID=NP_491614.1; Match level="QueryCoverage =50%, HitCoverage=30%, E-value=3e-25, Identity=58%"; Hit description =zinc transporter ZIP (34.2 kD) (1G76) [Caenorhabditis elegans] gb|AAB37816.1| Hypothetical protein F59A3.
  Coding regions on vcDNA: vcDNA=SeqID_89150; Strand=+; Position=30-620
MLFSLSHFSPIVQSLFASLFTWAVTALGAAVVFVFPSSNRVFLDASLGFSSGVMLAASFWSLLSPAIEISERQMAKLAFVPVAVGFALGAFFVYLSDRLTQNFNGSALSDQINQLENWHSANQQNGIHSENAPFDFETDRQRSENPENAGELAASLRQRCVKAPNSKGMADKETIRLDGQQQQNDQQQQQKRSQEQS

SEQ ID NO: 162728 - protein, 209 aa, Heterodera glycines
  Homolog annotation: Hit_ID=NP_504167.1; Match level="QueryCoverage =88%, HitCoverage=67%, E-value=3e-25, Identity=36%"; Hit description =putative nuclear protein, with a coiled coil-4 domain, of eukaryotic origin (5E683) [Caenorhabditis elega
  Coding regions on vcDNA: vcDNA=SeqID_89151; Strand=+; Position=28-657
MGLPIIQIYMIVARQLSKPITGYFMGLGKEHPAFRNRVLIPIGKTITNWSTKLRMKNLDLGSPTSVVNVSEETALEQASEVIHQVAIFGYTVVVFYAYSYFTHKEEKELASAEELRELSKKTSQEIMRLNVLVTELQDEMRMPRRDRNWTFPWSGESKSALRESAVVNPMLPSVVMTDSQPKEQKKDMTKSISRTEALNRLTNATETSS

SEQ ID NO: 162729 - protein, 125 aa, Heterodera glycines
  Coding regions on vcDNA: vcDNA=SeqID_89152; Strand=+; Position=2-379
QNALLITLISVQQAIRCLTSTASSTISQIVYHDAYVASAQRSLGFLVSAAHRRRLGRTTRRRAAAAPKSALASSCAVILTLIVLVIGGLVLAAVLTPETFKNAPLLSLFVGKKNGGVDGEEKETE

SEQ ID NO: 162730 - protein, 214 aa, Heterodera glycines
  misc_feature (122)..(122): Xaa can be any naturally occurring amino acid
  Homolog annotation: Hit_ID=CAE71936.1; Match level="QueryCoverage =90%, HitCoverage=54%, E-value=4e-20, Identity=31%"; Hit description =Hypothetical protein CBG19000 [Caenorhabditis briggsae]
  Coding regions on vcDNA: vcDNA=SeqID_89153; Strand=+; Position=74-716
MCHIETYIFMDFETTGLFDDGHNNPLTNPNRSNETARERAQRLDNLIKSDGNRFPKITEMAYMSVPRVLFLEGTEQMSARHLSSMSQDGEESIEPVQVVTNVHVRQLNPQLNDKERFKYEEXNGKCQEWPGVVHLLQTVPKPACLVAHNGLNFDFRILCHELRKSDLFRTHPIPEQVYFLDTLSCFYELEKEYNREIELTMENVDWTLVLSQFQ

SEQ ID NO: 162731 - protein, 218 aa, Heterodera glycines
  Coding regions on vcDNA: vcDNA=SeqID_89154; Strand=+; Position=3-656
ATKSPIPGVIRRTFVLPSCKGHKQQQQVSIGDEKDGKTTTLLVPMFSQELASLLAPEQSTDFSIRLQSKSNNCISLRVQVCCTLPSKSENEGQPLEEPAELVQHFPIRCVDPFEPKIAIFCENGGKAQCLVFGQKFRVQLQLKCNGRVAVHNVHWKLNDAFEHFDAIPLDSLIKQHFEKLKISSVDSSEFLNTHSVWVKVTNGDGQSPMRETGQSNGG

SEQ ID NO: 162732 - protein, 200 aa, Heterodera glycines
  Homolog annotation: Hit_ID=BAD62537.1; Match level="QueryCoverage =65%, HitCoverage=4%, E-value=5e-10, Identity=32%"; Hit description =putative AtRAD3 [Oryza sativa (japonica cultivar-group)] dbj|BAD61693.1| putative AtRAD3 [Oryza sativa (jap
  Coding regions on vcDNA: vcDNA=SeqID_89155; Strand=+; Position=12-614
MLSVWLDLAPKCAIAEAIASGTGTTVGGTARTSASKRGGKAAAAAAAPAGVATQPHDPNREMRDAFKRLDRAYFFSSYSQMISRITHSDAATYALLKEMLSELIVHFPHRSLWLSQSIVRSTRVAVRSKRCLEIFELAKKKARSNNDNNAAVVDLNLLIQQYDYLTTLPMSVGGQVARLIEIATDDAKLSAMYIGWCPFI

SEQ ID NO: 162733 - protein, 161 aa, Heterodera glycines
  Coding regions on vcDNA: vcDNA=SeqID_89156; Strand=+; Position=3-488
AYQNNFPIITHRQFGHSSSAASFLLRRIAVLVLLLLPHNDGSPRLPGPPIFEAISHYPSICYLPPESGMCPPATNRTTDTDHIKVAAATVDDSRATVGEGLADGDDDASQLRHASTPLLTRYYFDAVTAQCYPFGAQTCGGNENRFETKEKCLTKCRIGTD

SEQ ID NO: 162734 - protein, 229 aa, Heterodera glycines
  Homolog annotation: Hit_ID=CAE63588.1; Match level="QueryCoverage =78%, HitCoverage=66%, E-value=1e-30, Identity=39%"; Hit description =Hypothetical protein CBG08079 [Caenorhabditis briggsae]
  Coding regions on vcDNA: vcDNA=SeqID_89157; Strand=+; Position=3-689
KKERISLCSFAVPSPIFPSSPFIHFSSQFLPQNALLRWPLFLFRFAHPSFLLLDSAVHFALGAFLFFCPSTCAHFLLKRPSSDGVHWHLLRCVGGQLMASATLSWRCASPRRLPELRSSCLMLRLLGSVLFVFLFLHIRAVHPDLMPFLVLRQLIWFCFSMIALCVALLIVSGWPIGDKLFAANRWGNVLYQIDTIASISIGMAWVMAPQWLLHRQVRVPMDQSHEFCG

SEQ ID NO: 162735 - protein, 180 aa, Heterodera glycines
  Coding regions on vcDNA: vcDNA=SeqID_89158; Strand=+; Position=103-642
MAGINRTSTTPDENSKPMELTDKGKTPKLKQQTLSRFFGTMTKNSAPTPVPPMGQQQLQNYTNPKQKQPRKRSSPGSLSTSSSSSIIAISSTSPTAVPDSVSPPFRPLETTGPTNSKATKLHNAEEMLAKADNEQRRVQRFVNRLKKSFNELDRESLAKNLAFTAVRLDSDGVDKIQNSF

SEQ ID NO: 162736 - protein, 280 aa, Heterodera glycines
  Homolog annotation: Hit_ID=CAE62536.1; Match level="QueryCoverage =96%, HitCoverage=35%, E-value=1e-66, Identity=51%"; Hit description =Hypothetical protein CBG06645 [Caenorhabditis briggsae]
  Gene Ontology: Mol. function=NADH dehydrogenase (ubiquinone) activity; Cellular component=membrane fraction; Biological process =mitochondrial electron transport, NADH to ubiquinone
  Coding regions on vcDNA: vcDNA=SeqID_89159; Strand=+; Position=1-843
FSKKLENAKHPMIVVGAQAFQGENSSSLLQKLHQLAEKLRSTSQTKQNTKGNGQPKVLNLLHEFAGHVAAFDLGFRPFNELNSEVKRSIKLLYLLGSDEKPISRKEFHPDVFVIYQGHHGDNGAEVADLVLPGGAYTEKEATWVNMEGRAQRGYPAVVPPGDARVDWKIIRALSEVAGRKLRYDSLDDIRQRLSEIAPHLTRYGLAEDANFSRQALILSQKVPISASNKNLEPRQRSLSDYWLTNSIARASPTMAQCVKASRDYAVQPHTDPLRLANPHA

SEQ ID NO: 162737 - protein, 231 aa, Heterodera glycines
  Homolog annotation: Hit_ID=CAE56797.1; Match level="QueryCoverage =96%, HitCoverage=46%, E-value=3e-56, Identity=52%"; Hit description =Hypothetical protein CBG24609 [Caenorhabditis briggsae]
  Gene Ontology: Mol. function=phospholipase inhibitor activity; Cellular component=plasma membrane; Biological process=skeletal development
  Coding regions on vcDNA: vcDNA=SeqID_89160; Strand=+; Position=194-886
MSSGGYNNQSNYPGGAHPQQYGTGNTGNAGGYPPAAPPSAGAYPPQQYGGIAPPYGTAGYPPQYQPTPYPTSTGAMSAPSIRANPNFNAQMTAELLRKAMKGFGCDKSKVIQALVNCNNAQRQEVIRTFKQMYGKELIPELKSELTGDFEHLIIALMELPAVYDAAQLRRSMEGLGTKEHILIEIMTTRPNAQIYAVKMAYRQMYNSDLERDIIGETSGYFQRLLISLCSG

SEQ ID NO: 162738 - protein, 214 aa, Heterodera glycines
  Homolog annotation: Hit_ID=CAE69251.1; Match level="QueryCoverage =96%, HitCoverage=89%, E-value=3e-40, Identity=42%"; Hit description =Hypothetical protein CBG15298 [Caenorhabditis briggsae]
  Gene Ontology: Mol. function=v-SNARE activity; Cellular component =Golgi membrane; Biological process=ER to Golgi transport
  Coding regions on vcDNA: vcDNA=SeqID_89161; Strand=+; Position=1-642
VVTSALDDLQRKARLLENEIDAQLISLNKFNPSDALSSYSYNSNQTKGQGKRAVFDSLTTDIENKLSKLSEINDAMRDCFENDMAEFSKTSVQHIVRRHRDILRDYSTEFTRTTSNIGNQLHREELMAIESESSVNNRCKPTDYLLKEHESISSCDRLLNEQISIAMSVKENLYTQSTGLGSIGKRLNQLTKKYPAINHLMNKIRMKKRKDTLI

SEQ ID NO: 162739 - protein, 208 aa, Heterodera glycines
  Homolog annotation: Hit_ID=AAL78214.1; Match level="QueryCoverage =85%, HitCoverage=92%, E-value=2e-26, Identity=35%"; Hit description =putative esophageal gland cell protein Hgg-20 [Heterodera glycines]
  Coding regions on vcDNA: vcDNA=SeqID_89162; Strand=+; Position=104-727
MSDHPREEKRIFEKIFICNDILLDSLPFCGHAKIGLEFAVVSYRFDVVADTHLKRRKWKLGSLRIERSSTNDGAEIVKCNSDKTVKRLPIPLKPLPPNLIGFKRIAVYHINRKVIAFLHRIQRLFATDITLELAIFFRQRQSWDVVTYGIWPALNAARIVKIRFHNINNVTALQTHISPTILHDCANLRSIDVNHIYRPLTGQIGDEF

SEQ ID NO: 162740 - protein, 203 aa, Heterodera glycines
  Homolog annotation: Hit_ID=CAE68995.1; Match level="QueryCoverage =82%, HitCoverage=43%, E-value=2e-44, Identity=49%"; Hit description =Hypothetical protein CBG14982 [Caenorhabditis briggsae]
  Coding regions on vcDNA: vcDNA=SeqID_89163; Strand=+; Position=33-641
MATVAVHVLLDSRVPAQFHSKFIHSFPFRCICPLFRGNVEGHLCILPNGKPLKRAIRKDFRQFSHEEMALFLEVMGRYKSSGLYTRLGMIHRRSGVHSGPSFLTWHREFLKRLEIIFRSLFPQNTDPSLGLPYWDSSLDGDLPSPEDSVMFSEFLLGEADNSGFVFNGLFPNWTTMDGRHSYQRMFGDQQDGEFLNEARIDWV

SEQ ID NO: 162741 - protein, 217 aa, Heterodera glycines
  Homolog annotation: Hit_ID=NP_509832.1; Match level="QueryCoverage =94%, HitCoverage=35%, E-value=4e-25, Identity=33%"; Hit description =astacin and metridin-like ShK toxin family member (XL580) [Caenorhabditis elegans] emb|CAA91996.1| Hypoth
  Gene Ontology: Biological process=embryogenesis and morphogenesis
  Coding regions on vcDNA: vcDNA=SeqID_89164; Strand=+; Position=3-653
MDKDVKPEDPSVSFGFLSEEAREAMLKNCLSGAVDCKAQPFGMIQKRTMVLQHEMDFMRKVRPYQSGEMVQKRVEMVQKLKQKMLEVAGLDEHVQPVNDGTFQHDVLLTEKQSEELIKALNNVPKPAKKLHRYGYGHRFKRASLFLEQFAAQKWPIGQPIAFFFDPKIEEFEKQMVRQAHQMIEAQTCIRFRPSDSKPNSDFLYYIKVSTPTFCGLS

SEQ ID NO: 162742 - protein, 243 aa, Heterodera glycines
  Homolog annotation: Hit_ID=NP_504291.1; Match level="QueryCoverage =100%, HitCoverage=36%, E-value=1e-100, Identity=74%"; Hit description=heat shock protein (70.8 kD) (hsp-6) [Caenorhabditis elegans] gb|AAB42371.1| Heat shock protein protein
  Gene Ontology: Mol. function=enzyme regulator activity; Cellular component=mitochondrial inner membrane; Biological process =mitochondrial translocation
  Coding regions on vcDNA: vcDNA=SeqID_89165; Strand=+; Position=1-729
QEVFGKQPSKAVNPDEAVAIGAAIQGGVLAGHVTDLLLLDVTPLSLGIETLGGVFTKLITRNTTIPTKKSQVFSTAADGQTQVEIKVFQGERDMALDNKMLGQFSLVGIPPAPRGVPQIEVAFDIDANGIVNVSARDRGTGKEQQIIIQSSGGLNKDQIENMVREAERHAAADAEKKETIEAINHAESVLHDTESKITEYAEHLNADEVNVVKEKLEELKKKLANREGLKSAEVKESVNELQQ

SEQ ID NO: 162743 - protein, 306 aa, Heterodera glycines
  Homolog annotation: Hit_ID=NP_741348.1; Match level="QueryCoverage =98%, HitCoverage=38%, E-value=1e-120, Identity=64%"; Hit description= ATP-dependent RNA helicase (4D454) [Caenorhabditis elegans]
  Gene Ontology: Mol. function=ATP dependent RNA helicase activity; Cellular component=nucleolus; Biological process=nucleobase, nucleoside, nucleotide and nucleic acid metabolism
  Coding regions on vcDNA: vcDNA=SeqID_89166; Strand=+; Position=3-920
EVDFEDEGDYEQLNANQNRKQKKAGGWQSMGLDHSVFKGILRKGYRQPTPIQRKAIPLMCDGRDLVAMSRTGSGKTAAFVVPLLQRLKQRDARGIRALLFSPTRELALQTFKIVKELGRFTGLYCACLIGGDSMDEQFNALHQHPDILIATPGRLLHLVVEMNLKLQTVQFVVFDEADRLFEVGFADQLKEILKRIPDSRQTLLFSATLPKMLVDFAKAGLSDPELVRLDVESKLSDKLSMAFALCRQVEKLPVLLNLCRVLCKQKKKTIIFCATMKHVEHVVAVFQEANLDPAYLFSQLDPGARK

SEQ ID NO: 162744 - protein, 193 aa, Heterodera glycines
  Homolog annotation: Hit_ID=CAE57522.1; Match level="QueryCoverage =52%, HitCoverage=5%, E-value=9e-16, Identity=41%"; Hit description =Hypothetical protein CBG00497 [Caenorhabditis briggsae]
  Gene Ontology: Cellular component=nucleus; Biological process =establishment and/or maintenance of chromatin architecture
  Coding regions on vcDNA: vcDNA=SeqID_89167; Strand=+; Position=34-612
MDFTAGNTPNLFEVLLRNFCSESSSIQEKAVSSIPSIEQRFAEVETNEFKAAFGELSGGTLRLVADDRPSTSAEANDQQYKPIEIVIGDDAEIVQQPSSSSSLISSHPETVQDAKVYARIRELREAGLWSATRLPKCEDPPRRKLHWDYLLEKMRWIATDFTNDRKGEKRSGPESWQSERRPNGTGCSVQPTK

SEQ ID NO: 162745 - protein, 199 aa, Heterodera glycines
  Coding regions on vcDNA: vcDNA=SeqID_89168; Strand=+; Position=1-600
LDLSINSTVILRDEWLLLGAQEGLFATPMSPQQLRAPFRIAGVSCVYWMELLPEFDMLLAICGSARQLAVIHLQQIHRAFKVAQQPTVSCTNIANIEQCHIAVVSNSEHHRDKRTITDDRSLFKCRAAHRTGNGLNAGELLFTVSSEDRVELHIFGHADAAHLQQPQQHQQSVKSILKRKILIHAFRQLLFILSNLIFV

SEQ ID NO: 162746 - protein, 384 aa, Heterodera glycines
  Homolog annotation: Hit_ID=NP_082253.1; Match level="QueryCoverage =97%, HitCoverage=88%, E-value=4e-56, Identity=37%"; Hit description =RIKEN cDNA 2310001A20 [Mus musculus] gb|AAH55706.1| RIKEN cDNA 2310001A20 [Mus musculus] sp|Q9D7N9|APMA_M
  Coding regions on vcDNA: vcDNA=SeqID_89169; Strand=+; Position=6-1160
MGFLGKLSIGLSVIFLGIAVWFSTSKFLPKEYHLPPPPALTGLLTVNKPKVLEKLLEGQVLGPESAVIENDVIYTCTLDGMCLKIVDGKIEKSVPVTAHATNCDGKRKTIPICGRPLGIRRFNSQQFIVADAVLGLLLINFEEETKEVLLPSITVVDKKRLGFPDDLDIVDNDTILFTDLSAKYGYSDCDLAFFEHVRDGRLLEYKVSTGQLRVLMDGLAVANGVQLHPDKNSVLVCETAMARIHRYYFAGPKKGMQQIFVDNLPGFPDNIRISRSADSFYVALPFHRSEQKPHIFDRLGPWPLARKFIGELLKILPDNVLQRFVVGSTHGIVLQLDLNGMILRSWHDPEGSVISHISEVDDDGGDFLYLSSFVNNYIGRMSKE

SEQ ID NO: 162747 - protein, 291 aa, Heterodera glycines
  Homolog annotation: Hit_ID=NP_740900.1; Match level="QueryCoverage =98%, HitCoverage=8%, E-value=3e-62, Identity=43%"; Hit description =chorein A (359.3 kD) (1J482) [Caenorhabditis elegans] emb|CAB02304.1| Hypothetical protein T08G11.1a [Caen
  Gene Ontology: Mol. function=intracellular transporter activity; Cellular component=extrinsic to membrane; Biological process=Golgi to endosome transport
  Coding regions on vcDNA: vcDNA=SeqID_89170; Strand=+; Position=235 -1107
MSAFLQKKSDEESLKMATGFWCQYRQTTHQQTLHVKLHNFQMDNQLPASTFPSLLAMVPQPKYMVKNGCLFKSFWHKCYKFFISDPKPFLECAFVMSQSEHTNIVQIKLLEALVQEFAIRIDRTLLNELLDIIPKETIQTGYTRESFQMDMELTEKALNKRAIQTRVTQAKAYYQRMHISPLMIHLSFSQGHVEEEGTDRAGIQWEFMNLILKSVGVTLTEIQDVIFKLAFFQREATFYSRAQLQSEIQAHYTRQFIKQLYALVLGLDILGNPFGLVRDLRTGAVDLFYQP

SEQ ID NO: 162748 - protein, 211 aa, Heterodera glycines
  Coding regions on vcDNA: vcDNA=SeqID_89171; Strand=+; Position=1-633
ATFKTPDNNTKKFCKTKGSPLFKKFSKTRQMERDRILFQRQRFPTVASIHHQPATSSASGVLVPIPTTDGAAAVPGSAGGYQRRYSTHREQQLQQRNRRDSKFSRRLAVYTSPPEDSAAGAISLRPLNTTIISSSPRTGSSSDAELDTDEIANAAATTERRRRLQQRQRRRLSADDGESQVIAASPSRRQLLTQPLTNPDAGLIPQIDKPM

SEQ ID NO: 162749 - protein, 278 aa, Heterodera glycines
  Homolog annotation: Hit_ID=A34220; Match level="QueryCoverage=73%, HitCoverage=44%, E-value=9e-09, Identity=28%"; Hit description =homeotic protein Abd-B - fruit fly (Drosophila melanogaster) emb|CAB57859.1| Abdominal-B protein [Drosophila m
  Coding regions on vcDNA: vcDNA=SeqID_89172; Strand=+; Position=3-836
LCFINSLLLSSPPPHNLFPSSIRSPSVSPFYFLYFCFSVRADPPVLIHSFLPLLLHLPSLFCVFCCSSIAMEQQNITYYPTEIVHGQTNGDSQEQFHREHVFHSDANVNFHATNDTNFGGGGRRAAFRPSQLQQRQQHIVVQQGPTSIPQRVSTTNIPASTAGQQTVHVQLVPHNQQGNSPIPGQQQQQRQQIVVQHAPTSMPQRISTTSIPTSTASGQQTVHLQLVPQQGNSPIPGQQQQQQQQQHIIISAQPVQTTNTTTESADGNPIAAFMEYFV

SEQ ID NO: 162750 - protein, 188 aa, Heterodera glycines
  Coding regions on vcDNA: vcDNA=SeqID_89173; Strand=+; Position=3-569
ATVWSKFASQLSSWLSEMPSEKRRGRAETRPNGGDGVAGVRNSRSLSALSRRHNLVRTSKSSENLHRISLLSTATTIGNGQQRQKPFLAQFGLNGPNAHSEEGSVPCQNSRKGSVEGHQSPLTPARTKTRRFPFFGKENETTAAPGGEGESGYSSGSSSRRKKSNGRFVPCASFLGIFPQFKRAAQKQ

SEQ ID NO: 162751 - protein, 202 aa, Heterodera glycines
  Homolog annotation: Hit_ID=CAE67897.1; Match level="QueryCoverage =99%, HitCoverage=30%, E-value=1e-100, Identity=89%"; Hit description= Hypothetical protein CBG13493 [Caenorhabditis briggsae]
  Gene Ontology: Mol. function=ATP binding; Cellular component =nucleolus; Biological process=signal transduction
  Coding regions on vcDNA: vcDNA=SeqID_89174; Strand=+; Position=59-664
MASSLYNFKKITVVPSASDLKDVVLSKTQRKTPTVVRKSWQISRIRAFYARKIKFLQQTLHDKLTSIITEFPKLEDVHPFYSDLMNILYDRDHYKIAMGQMNTARHLVDGIAREYVRLMKYADSLYRCKMLKRAALGRMVKLLRRQKSSFEYLEQVRQHLSRLPSIDPNTRTLILCGFPNVGKSSFINKVTRADVEVQPYAF

SEQ ID NO: 162752 - protein, 88 aa, Heterodera glycines
  Coding regions on vcDNA: vcDNA=SeqID_89175; Strand=+; Position=584-850
ICSDETINALKLRIYEKIDQSPVDQLLYMGGQVLDGNLTLERARVPANNFDNPLILIVQQRRKSGDDDDSDQKAGSSGGGGFHDTALS

SEQ ID NO: 162753 - protein, 160 aa, Heterodera glycines
  Homolog annotation: Hit_ID=NP_498245.2; Match level="QueryCoverage =65%, HitCoverage=13%, E-value=3e-18, Identity=46%"; Hit description =related to Islet cell Diabetes Autoantigen phogrin, IA2 type transmembrane protein-tyrosine phosphatase (
  Gene Ontology: Mol. function=transmembrane receptor protein tyrosine phosphatase activity; Cellular component=trans-Golgi network transport vesicle; Biological process=exocytosis
  Coding regions on vcDNA: vcDNA=SeqID_89176; Strand=+; Position=176-655
MNKMGPTSENDGPKKQKKGGRRRDGMPKPTPKPKGMAAASTALRQLSPLHKVLLVVVALLQWTTTGGRAALLQGCDFSEDLCTDGEVCLPDRLFGQCYSDDESALVRPLVLNRPINGVQSELLRAELTQLAELGLDWPDARAQCVLAYFKLGVGFRLDYN

SEQ ID NO: 162754 - protein, 219 aa, Heterodera glycines
  Homolog annotation: Hit_ID=CAE63553.1; Match level="QueryCoverage =94%, HitCoverage=33%, E-value=3e-75, Identity=66%"; Hit description =Hypothetical protein CBG08039 [Caenorhabditis briggsae]
  Gene Ontology: Mol. function=neurotransmitter:sodium symporter activity; Cellular component=integral to plasma membrane; Biological process=protein folding
  Coding regions on vcDNA: vcDNA=SeqID_89177; Strand=+; Position=262 -1247
YICTISLPPGNNRFYLFTNVEPYAEEADGVFWSTHSRDVYNEKPLKEDMITAIEVMGFVLPHPFISPFLFSNFMYLRLFPDKTPRTVENFCTHARRGYYNGHAFHRVIKSFMIQTGDPTGRGTGGQSIWGGDFEDEFHPALRHDKAFRVSMANAGPNTNGSQFFITICPAEWLDGKNTIFGQVVEGFNVVQKINQVPVYEKSGRPREEISIISISLKSV

SEQ ID NO: 162755 - protein, 238 aa, Heterodera glycines
  Homolog annotation: Hit_ID=NP_500389.1; Match level="QueryCoverage =44%, HitCoverage=76%, E-value=2e-11, Identity=30%"; Hit description =dorsal interacting protein 3 like (4E403) [Caenorhabditis elegans] gb|AAK68607.1| Hypothetical protein ZC
  Coding regions on vcDNA: vcDNA=SeqID_89178; Strand=+; Position=121-834
MISNLFGTHPLRTEIKKKRPSQRRGNAEEETFHFIIDCHGKFDAKDTRNFNSSLVEEVSRHPALFDFTRDEYKSTEARNRHWAEVAEEMQQSVEFVRTRWKTLRDRFKKEVRRQHQCVEGPIWQHYDKMLYLLPFIRDKDDSTEVGTTVSNGSVGIRSKNGARRAEGPTDNTDRGTTLWHGEREQKRRTNNGNLLHPSPINSCTAAILDLAMSAVTKLSPPPTDEMTSSDGRQCAISE

SEQ ID NO: 162756 - protein, 273 aa, Heterodera glycines
  Homolog annotation: Hit_ID=CAE72546.1; Match level="QueryCoverage =100%, HitCoverage=54%, E-value=7e-97, Identity=29%"; Hit description= Hypothetical protein CBG19730 [Caenorhabditis briggsae]
  Gene Ontology: Mol. function=structural constituent of muscle; Cellular component=striated muscle thick filament; Biological process=striated muscle contraction
  Coding regions on vcDNA: vcDNA=SeqID_89179; Strand=+; Position=1-819
RISESEEESEAEHQSRQKADRSRSELQRELEELSERLDEAGGATSAQIEVNKKREAELAKLRRDLEENNLNHETQLNALRKKHNDAVAELTDQLEQKQKIKVKVEKDKQQIQRELEDATQTADSELRARQEAEKVIKNIELQLSELQSKTDEQSRLLNDFAALKSRLHNENADLEHQVEDLENQVNSLHRLKSQLVSQLEEAKRTADEESRERQTLAGQLKNVHYENDSLREQLDDEQEGKAECLRQISKLNAEIQQWKARFESEGLVKMEEI

SEQ ID NO: 162757 - protein, 212 aa, Heterodera glycines
  Coding regions on vcDNA: vcDNA=SeqID_89180; Strand=+; Position=98-736
MSDQQSGSSSSSAVLTSPTPFPPQQQKPPLLRRCSMSEPHLDIVPHFLKEEKSVHPFDRVLSGLFDKGSTFSVNSTDSVDHHYSAKSDRHDHPFSPTNQQLTKGKSAIGMMSNSAAVAPSSADGLLRKSATSASALYSSSPQHGTTANHFPTIPEDQGLTMSAGRDKMPQTAASASPPKSGFMNFFGTGGFLSRPVTHTPEENYRLIMALDR

SEQ ID NO: 162758 - protein, 279 aa, Heterodera glycines
  misc_feature (46)..(46): Xaa can be any naturally occurring amino acid
  Homolog annotation: Hit_ID=CAE67517.1; Match level="QueryCoverage =97%, HitCoverage=36%, E-value=2e-53, Identity=41%"; Hit description =Hypothetical protein CBG13036 [Caenorhabditis briggsae]
  Coding regions on vcDNA: vcDNA=SeqID_89181; Strand=+; Position=2-838
DEMVNSVFGVKQEGNVPALADPHGELRGKNILHRVDEYEMSKIASXNKMTIEQLKQCMEDAKRFLALVRSKRPSPHLDNKILTAWNALAISGFCAAAQAVPTRAAEFQKRAEKAVAFIRSHLFHGGELLRSAYLDNLGQVVQIRHPIKAFADDYAFLIEALLSLYSLNLDENLLQWAHNLQLQMDELFWDSTFDSGYFMSRVGDPSIIVRMQDEQDGAEPCTNSVAASNLLCLGFLLDSADFRRRANDCFAGAAKRIEKYPFIMPRMLIALHAATHPPY

SEQ ID NO: 162759 - protein, 200 aa, Heterodera glycines
  Coding regions on vcDNA: vcDNA=SeqID_89182; Strand=+; Position=290-889
RRKRPKRINKNKLSIRHHTTKIKSKGKNKRRQKAAKIAEPKVKKIMELAKELIAEVLRDRTKQFSSGDNAKFGLALANADRFLAEGAAVSIHLMMAHANCKASAKEFCEATQTLEVWTFKLQREVPYEVSARPPMLPLFLRQAVRSQLHFSPFRSWLTARQRAGPSDGFLPLLRVCAASDSAAPPFSSDRLQSHQFPPCL

SEQ ID NO: 162760 - protein, 238 aa, Heterodera glycines
  Homolog annotation: Hit_ID=CAE65122.1; Match level="QueryCoverage =99%, HitCoverage=38%, E-value=2e-80, Identity=57%"; Hit description =Hypothetical protein CBG09987 [Caenorhabditis briggsae]
  Gene Ontology: Mol. function=chaperone activity; Cellular component =integral to membrane; Biological process=fertilization (sensu Animalia)
  Coding regions on vcDNA: vcDNA=SeqID_89183; Strand=+; Position=3-716
AEEAISKYNGEWQIGSPTDEILANDYGLIVRTKARHHAISARLRKPFKFDGSPLVVQYEVKYEQGQECGGGYLKLLRDDASKDLKQFNDKTPYVIMFGPDKCGMTSKVHLILKHKNPKNGTISEHHAKQPSKSLSNYFEDKKNHLYTLVIRPDNAFSVSVDHTEIMSGKLLTDLEPSGVPPKQIPDPEDKKPADWDNREQIADPEAKKPEDWDENQPKEVEDTDAVKPDDWLEEAEAL

SEQ ID NO: 162761 - protein, 268 aa, Heterodera glycines
  Homolog annotation: Hit_ID=CAE59883.1; Match level="QueryCoverage =84%, HitCoverage=5%, E-value=1e-32, Identity=39%"; Hit description =Hypothetical protein CBG03363 [Caenorhabditis briggsae]
  Gene Ontology: Mol. function=ubiquitin-protein ligase activity; Cellular component=ubiquitin ligase complex; Biological process =nucleocytoplasmic transport
  Coding regions on vcDNA: vcDNA=SeqID_89184; Strand=+; Position=60-863
VWRRTTKLVARVCKEVSGRESVPGKFLKSLETFQYLCNQCAKRWRNSRKKAQLTKKKDDTEKEGAEEQQQATTSKPQADTHAKEESDEATLVRNMVDELAPLWEELSNCLSLLEKAEDSQHAVLCLQNAAEAFFLSYSLVIPQTAQLAQSALPETAPTGDSSPQLASSSAGGNSGEDELGRYQKEMFTFAEKHRSVLNQILRGNTQNLEGSAFAILTHFPKLLDFDVKTKYFHKELKKMDERSRYRHEDVAIRVRRSHLFRDSFRELY

SEQ ID NO: 162762 - protein, 115 aa, Heterodera glycines
  Coding regions on vcDNA: vcDNA=SeqID_89185; Strand=+; Position=45-392
LDRRSYTIVELVTFTHMLQSIVPPRFHGVVLCRVWLDFVGDAEQPKERDQLPPITICKTKLATEGRRISNEGGAILTINLWPTTDGMLKGTGIPSLTSLITRKSIEFHFNFPFLT

SEQ ID NO: 162763 - protein, 160 aa, Heterodera glycines
  misc_feature (151)..(151): Xaa can be any naturally occurring amino acid
  Homolog annotation: Hit_ID=NP_291028.3; Match level="QueryCoverage =76%, HitCoverage=45%, E-value=6e-22, Identity=45%"; Hit description =p53-related protein kinase [Homo sapiens] gb|AAH09727.1| P53-related protein kinase [Homo sapiens] sp|Q96
  Gene Ontology: Mol. function=protein binding; Cellular component =nucleus; Biological process=cell cycle
  Coding regions on vcDNA: vcDNA=SeqID_89186; Strand=+; Position=287-768
MTRQIPSARVSAPACSPSNKRIYSPPFSKRWALPFWAQLAEFGHEFGRILRTMHDANLIHGDLTTANVLVLTQRGPVELALIDFGLAQFSSKPGDKAVDLYVLERAIRSAHIGMGKMMDAILDAYKTEGGGGDEDGTNAKPVLLKLDEVRXQGRKRDMIG

SEQ ID NO: 162764 - protein, 84 aa, Heterodera glycines
  Coding regions on vcDNA: vcDNA=SeqID_89187; Strand=-; Position=1-252
TRINYLSYSPKNGSSSTCCQGKILVLQKSLLLIMLKRNKINLFLIINNFVGPRFLDSYVLLLFSTGVCLFWHFLRFAPVFGHIF

SEQ ID NO: 162765 - protein, 208 aa, Heterodera glycines
  Homolog annotation: Hit_ID=NP_497599.2; Match level="QueryCoverage =100%, HitCoverage=45%, E-value=8e-63, Identity=34%"; Hit description= myotactin, LEThal LET-805 (479.6 kD) (let-805C) [Caenorhabditis elegans] gb|AAK21414.2| Lethal protein 8
  Coding regions on vcDNA: vcDNA=SeqID_89188; Strand=+; Position=3-626
PFSEYVRFQTLPGAPPPPTDLREEQQLAHALEISFLPPYPPNGILDQYRIRWTVHGKFNYREQRVPAFELECSDSRMRGRLCYRISGLEPEQEYEIQAAAHTERGDWSDWSEPLVTKTTEQDIPVLEHPLELEFAKSTSIGVRWRGLEENLAEHITGYALEYKSETDTDWKEWNGVVRHRARQPDYRAHVKGLTESTEYFFRLRVVGK

SEQ ID NO: 162766 - protein, 176 aa, Heterodera glycines
  Coding regions on vcDNA: vcDNA=SeqID_89189; Strand=+; Position=3-533
RRHCSLSLPSTTALCQHITAIKKFHCQLNVLTKLNCITRLSLWLKDQIILFISFPKYHYYLYSCGFLGRKSSFSFFTRFVKLMCNTPKVYDDQDVRWSSVRMSVWWCLCSLWSPSPFMCIKELASFCSKKYRNTTTGKESKFQIFLTYRALFAQNTKFSAPNEWSTPKMVMVSLIW

SEQ ID NO: 162767 - protein, 98 aa, Heterodera glycines
  Coding regions on vcDNA: vcDNA=SeqID_89190; Strand=-; Position=1-294
IGMSILFFASLPTLIAMVMTMVIFVKIFIKEIFDPSFVDSIFSHTIFHFYIYKPIFFFAFFFVCLSETINFCFEIPSSYLKIYQILSTLDPYKLWPTC

SEQ ID NO: 162768 - protein, 348 aa, Heterodera glycines
  Homolog annotation: Hit_ID=NP_741017.1; Match level="QueryCoverage =91%, HitCoverage=48%, E-value=2e-45, Identity=38%"; Hit description =C.Elegans Homeobox (ceh-38) [Caenorhabditis elegans] gb|AAL27244.1| C.elegans homeobox protein 38, isofor
  Gene Ontology: Mol. function=transcriptional activator activity; Cellular component=nucleus; Biological process=regulation of transcription, DNA-dependent
  Coding regions on vcDNA: vcDNA=SeqID_89191; Strand=+; Position=7-1050
MEQHLGHHQQLHSNQLEKTNFGNGPAGLLSPLHLEGTRRGDPEGSLGLLSSVSVSHLHRPNGGSRTSDLLNGIRRSSNNVAYIKEEINPSNELGGYHSAASVSHHHEAYGDAGPYTLQGPTAQELERMANAETPPALSNVEITSSILASLSRESPSPNIQQQSPHQPTHFIVHQMSRQPQQLEHQIVQRHPITSTPSTTARRSKVKQQSLSQNLGQNSQNSDQQIILASNGSGTQSGYGPMGPGAGIPRTTYSTTDTTDPLNAEIDDEIYIDTKDLCKRVAYELKQHSIPQAIFAERILCRSQGTLSDLLRNPKPWNRLKSGRETFRRMFNWLQQPLHIRLSILDMYK

SEQ ID NO: 162769 - protein, 112 aa, Heterodera glycines
  Coding regions on vcDNA: vcDNA=SeqID_89192; Strand=-; Position=185-523
MVLAADTHLPAFVHRHRHFQVTEQLLLQRGDHVLPVVVVVSHDAFAAIGSNDHVSEKIDGFSLFSEDVVDEADVYRQMRKIADREGWEGDGNIVEMSDEVAGGGGGGAGVRG

SEQ ID NO: 162770 - protein, 140 aa, Heterodera glycines
  Homolog annotation: Hit_ID=CAE67540.1; Match level="QueryCoverage =97%, HitCoverage=13%, E-value=6e-32, Identity=50%"; Hit description =Hypothetical protein CBG13065 [Caenorhabditis briggsae]
  Coding regions on vcDNA: vcDNA=SeqID_89193; Strand=+; Position=2-481
ELQLESEDRYNRFPFSQKEFIEDCPAERLYVRILPEMTEYVIALLKVILASVPSSKEKIDAVTILSDVLTPETDTNEDLSNSISLDLASFSHTNVLEETVRVAIDINRHKELIIKSASSLLILLLKHLRLNHTLQFENLA

SEQ ID NO: 162771 - protein, 155 aa, Heterodera glycines
  misc_feature (42)..(42): Xaa can be any naturally occurring amino acid
  Homolog annotation: Hit_ID=NP_690845.1; Match level="QueryCoverage =47%, HitCoverage=58%, E-value=9e-10, Identity=49%"; Hit description =Mitochondrial protein of unknown function, overexpression suppresses an rpo41 mutation affecting mitochon
  Coding regions on vcDNA: vcDNA=SeqID_89194; Strand=-; Position=1022 -1490
MPHSPLNRRTANPSLEASSPTYSNKRVNADQIRQLCPFPPHXFTSSLTLSSKCFATFPHGTCSLSDSWPYLVLDEVYHLIWAAIPNNPTPRHVKMGRHRQLDRSCTFSGAPVKGNLNKRANPSSRSIRYTSQPQRSCDSTLDSSQFTRRYYGNPR

SEQ ID NO: 162772 - protein, 200 aa, Heterodera glycines
  Homolog annotation: Hit_ID=CAE57429.1; Match level="QueryCoverage =97%, HitCoverage=59%, E-value=3e-20, Identity=40%"; Hit description =Hypothetical protein CBG00388 [Caenorhabditis briggsae]
  Coding regions on vcDNA: vcDNA=SeqID_89195; Strand=+; Position=37-636
MVVEMSSGAATTASAAAVAGTAPSAGPVPSCICSSTSQLLTAAGMDGIPPAKTPANSGPDANFLADSVGVSPLYRQEDTKRWQTAAKVYQSSRSQMHSPTSGTCAPHHFHFGESLTAEGHLTQKIRQCRSSGSPISLEDIAAENRQFHRQMDSGQHRRVNGPALNGSLELEAIAAVHELASQVKQISVSEILPRTSDLIF

SEQ ID NO: 162773 - protein, 267 aa, Heterodera glycines
  misc_feature (69)..(69): Xaa can be any naturally occurring amino acid
  Homolog annotation: Hit_ID=NP_495467.1; Match level="QueryCoverage =100%, HitCoverage=26%, E-value=1e-52, Identity=43%"; Hit description= adenosylhomocysteinase 3 (2H392) [Caenorhabditis elegans] gb|AAA82421.1| Hypothetical protein F10E7.8 [C
  Coding regions on vcDNA: vcDNA=SeqID_89196; Strand=+; Position=2-800
ELQLSSDYRYNRFPFSQKEFIENWPVERLYAPILPNMTEHAIALLEDDLASLPSYEAKIDAATISIRCXLTPETDTNEEIKSRLFPFGTLTPIPELFKVLSNSITLDLASFSHTNVLEETVRVAIDINRHKELIIKSASSLLILLLKHLRLNHTLQFENLARYLVLANCLPLVLKFLDQNICRYFQAKHELAPFNYPQCALFFVRNGYVCPPLTAENVDGCGGSSDSPSYFLWRNGFSSINLLRVINKLTKGKQSRTQMLVVYKWAP

SEQ ID NO: 162774 - protein, 266 aa, Heterodera glycines
  Homolog annotation: Hit_ID=AAQ12016.1; Match level="QueryCoverage =100%, HitCoverage=93%, E-value=1e-139, Identity=99%"; Hit description=tropomyosin [Heterodera glycines]
  Gene Ontology: Mol. function=structural constituent of muscle; Cellular component=muscle thin filament tropomyosin; Biological process=pole plasm oskar mRNA localization
  Coding regions on vcDNA: vcDNA=SeqID_89197; Strand=+; Position=77-874
MDAIKKKMQAMKIEKDNAIDRADAAEEKCRQTQERLERVEEELRDTQKKMMATENELDKAQEDLTAANNLLEEKEKKVQEAEAEVASLNRRMVLLEEELDKLEERLKLATEKMEEATANCDESERVRKVMENRSLQDEERANAIEEQLKEAQSLAEEADRKYDEVARKLAMVEADLERAEERAEAGENKIVELEEELRVVGNNLKSLELSEEKALQREEAYEEQVRQMEVRLKEAETRAEFAERSGQKLQKGVDRLEDELVHEKER

SEQ ID NO: 162775 - protein, 259 aa, Heterodera glycines
  Coding regions on vcDNA: vcDNA=SeqID_89198; Strand=+; Position=22-798
NSIAMKNLPPELLSEMTLYILYPNKNFPNIFSSSWLLREFLIPHVTKRKEIFKKRRNELERLYNGARQEPIWLCIVSSTGPEKQKQTIDNFLFYLEEYLNYPISNRPTVEEEKELSDRFLLLVKFFYHCEETIAWKYLKTTTSRTVQQFLDELSSFFALVLDLSPEHSQHQQQSDHEAVPTDQTSSADSDLRPLPVVTESVPEESTYDPPWDDRSLRFIETMAALQSHRSTNVLPTVPSTSADSDPRPLPVVTESVPTS

SEQ ID NO: 162776 - protein, 212 aa, Heterodera glycines
  Homolog annotation: Hit_ID=NP_501035.1; Match level="QueryCoverage =49%, HitCoverage=11%, E-value=2e-15, Identity=42%"; Hit description =ubiquitin specific protease 15 (102.6 kD) (4H525) [Caenorhabditis elegans] gb|AAC68977.1| Hypothetical pr
  Coding regions on vcDNA: vcDNA=SeqID_89199; Strand=+; Position=3-638
SIIVDLLHGQHKSTLTCNVCSKISIKFEPFCFLSVPVPTKEHKAQSTIVFMRAEKWAKFHVTHTSKTTAGQLKQMLREEVQLPSNTQMIIYSTYSNRILKDDSTLSSTYMYNYSMKLYAYAVEPGPVILVENLFMATSPPLFFPRPTKLTRRALLAELVPRVRELCLSLSPTTTTAVEDCGDAGTSSAAPSSSYCTALIPALPASFSSPSSS

SEQ ID NO: 162777 - protein, 209 aa, Heterodera glycines
  Coding regions on vcDNA: vcDNA=SeqID_89200; Strand=+; Position=49-675
MLFPSFGMLSSAIHQNQHRRSVHSVRYHSPLLSWPKLFLISIATIPLLLLSCIDFVSAVSDDGAPFLSDQQKRGGARAFNLFASAAFPPPNEKRSGGRAFGGGIQTINDDFDANLAGELKRAGARLFRMSDLSSDGDSFVPEGTKRGGARPFYGGGYIDGAWKRAGGRYFLRQFDDVPFGGGWMAKRGGGRSFFESTKGPFNSANYWAP

SEQ ID NO: 162778 - protein, 122 aa, Heterodera glycines
  Coding regions on vcDNA: vcDNA=SeqID_89201; Strand=+; Position=8-376
FRFVKKSNYHCILMILASSSKRLACQFLIRKVPHFAVTSSRKESNWSEVLDEAVPARKSYRDFQTLNGNQRDALAASLFFLLVNGHRLWAHRVLENTWWRGKRCIRGALDNTRGGKKRRGRG

SEQ ID NO: 162779 - protein, 204 aa, Heterodera glycines
  Homolog annotation: Hit_ID=CAE73289.1; Match level="QueryCoverage =91%, HitCoverage=22%, E-value=6e-21, Identity=28%"; Hit description =Hypothetical protein CBG20708 [Caenorhabditis briggsae]
  Coding regions on vcDNA: vcDNA=SeqID_89202; Strand=-; Position=3-614
MLQITQSECKQMAENGKCSLGLLTNDSGLSHTDKKLDLSPRMWLIGSFSWSIVSTENCYLFKTKIMSQHGSTVMQSPLGSVNNCQFKAGQCEMEDKTLLMWDTNTTRACEFSKIGTCKGLQLDNIWISDEVSFLLTFLNNTKKVNSCGLNLIKSEEGFAVQDLPSDDSNESSKRSRKTRSLESWVTESEMNSKLGYLDEQVREM

SEQ ID NO: 162780 - protein, 261 aa, Heterodera glycines
  Homolog annotation: Hit_ID=CAE64837.1; Match level="QueryCoverage =100%, HitCoverage=54%, E-value=1e-78, Identity=54%"; Hit description= Hypothetical protein CBG09633 [Caenorhabditis briggsae]
  Gene Ontology: Mol. function=protein phosphatase type 2C activity; Biological process=cell cycle
  Coding regions on vcDNA: vcDNA=SeqID_89203; Strand=+; Position=48-830
MGAFLDKPKTEKTNDAGVGRDYKYVVASMQGWRIDMEDAHHVQITIRKESPFEEWSFFAVFDGHAGNKVAFHSAQNLLQTLLNTAEFQAVKEELKTNGPKITEKAKSLIQDGIRMGFLELDSSLGELQGGGERERNGTTAICAILTPDYIFFANLGDSRGLLSRRSNTIFSTEDHKPYLEKERERIIKAGGSVMIQRVNGSLAVSRALGDFEYKSVPGLCVTEQLVSPEPDIYIVPRDKEDDEFLVLACDGIYDVLANEDL

SEQ ID NO: 162781 - protein, 317 aa, Heterodera glycines
  Homolog annotation: Hit_ID=CAE59764.1; Match level="QueryCoverage =70%, HitCoverage=84%, E-value=2e-37, Identity=39%"; Hit description =Hypothetical protein CBG03216 [Caenorhabditis briggsae]
  Coding regions on vcDNA: vcDNA=SeqID_89204; Strand=+; Position=2-952
EDKKAANNTCSSNNNNSLSDVKQNDDVSSLDSLGVFLNRFRQMDTKKLQQLASNPTVVAQPNRPNEGTAKDTNNDNTSITSTREKMLEVVYGNKLMGKEKQPKFMCFVVDAQERKIRIMSREEQKKQESSAIILEDLTDDQFSRFGKSVKDKEADNSDAFVHCEKCSLFYEFCCLDHPLYQCKDRVPSSSPTEIEDRAAATLPAFLFIQNSSIPSAGKGVFTKVDIPIGIVFGPYEGILTQNLSEMEFGAYTWELRVGYGKPSYYIDAKDPRYFNWMRYINSPRNESEQNLIAFQYQGRVYYRVFSPLTDLRNYWYG

SEQ ID NO: 162782 - protein, 83 aa, Heterodera glycines
  Coding regions on vcDNA: vcDNA=SeqID_89205; Strand=+; Position=190-441
MSDMSAYMGSGPAEPAPSSGAAEASSSSGVASAYMGSGPAEPAPSSGAAEASPSSGVASAYMGASPAYEPPAQEKSPDQSAYM

SEQ ID NO: 162783 - protein, 199 aa, Heterodera glycines
  Coding regions on vcDNA: vcDNA=SeqID_89206; Strand=+; Position=392-988
LINNKELQMALFANVFTTKYLPKEVTLLVFRRSNSEFFCVRRSPTIFEQTRQQHSNSSPRNDQIQQILDQFDKMQLPSQNEPLATSQQQIVQLSERLIQLALTATNLVCNLLQKNGAAATDQFKGQTKMPTVATIEPKNTKRDGRAAENEKGWTWICEKCRKRNSILRYECQSCEKGHPTEVQREAIGRALTGVWLCFN

SEQ ID NO: 162784 - protein, 296 aa, Heterodera glycines
  Homolog annotation: Hit_ID=XP_419811.1; Match level="QueryCoverage =100%, HitCoverage=14%, E-value=4e-83, Identity=51%"; Hit description= PREDICTED: similar to Prolyl endopeptidase (Post-proline cleaving enzyme) (PE) [Gallus gallus]
  Gene Ontology: Mol. function=prolyl oligopeptidase activity; Cellular component=cytoplasm; Biological process=protein metabolism
  Coding regions on vcDNA: vcDNA=SeqID_89207; Strand=+; Position=2-889
NTLYVHSLDGRELYKLPLPIGSVGGVFAEKSQSKICVGFEAILDPFIFFFGDFSKCPSRESPLQLTETRRVNVPGMDCDAFHSKQVLYPRDDGTKIPMFIGHRKGVKLDGSNPAILNGYGGFNIAQPPYFSITRLMLAKHFGIVSVIANIRGGSEYGEKWHEAGMLSRKLNVFDDFIAAAEFLISEKYTNNKKLAIHGGSNGGLLTAVCSQQRPDLFGAVVTRVGVLDMLRFNKFTIGAAWATEYGDPDKPGDFSFIYRYSPLHCLRLTNGVNWPATLLMSADHDDRVVPLHTLKY

SEQ ID NO: 162785 - protein, 221 aa, Heterodera glycines
  Coding regions on vcDNA: vcDNA=SeqID_89208; Strand=+; Position=134-796
KVSFSFWAPISNKILLFEIKTPKLNSLSLSLFPLYLSLSIISFSLLSDSHSLPSHSSLSLSSLTLSLPPALDLDQNTATLEEQERQRTLVFIGLPESNAIRPSERVQEDREAITKILDHLEVEAQPTAVFRLGRYDPQRTTPRPLKVVMPTPTHQHVALGGWKRERVRLRSQQNLNRLFVRPALSKEQLKEEYEARLRKRQQNPAPMAPATQLPQTNAPTP

SEQ ID NO: 162786 - protein, 89 aa, Heterodera glycines
  Homolog annotation: Hit_ID=NP_495487.1; Match level="QueryCoverage =98%, HitCoverage=31%, E-value=1e-22, Identity=54%"; Hit description =COLlagen structural gene (col-36) [Caenorhabditis elegans] gb|AAK84492.1| Collagen protein 36 [Caenorhabd
  Gene Ontology: Mol. function=structural constituent of cuticle; Cellular component=extracellular; Biological process=positive regulation of body size
  Coding regions on vcDNA: vcDNA=SeqID_89209; Strand=+; Position=245-514
SEEHRQLRRVAFFSIVISTAAVIASIVTLPMLYSYVASFQSHLVQETDFCKTRSRDMWTEMSILHQDQGGAHGVGKRQYGTASGRPPAG

SEQ ID NO: 162787 - protein, 188 aa, Heterodera glycines
  Homolog annotation: Hit_ID=CAE61486.1; Match level="QueryCoverage =81%, HitCoverage=16%, E-value=3e-39, Identity=52%"; Hit description =Hypothetical protein CBG05381 [Caenorhabditis briggsae]
  Gene Ontology: Mol. function=ubiquitin-specific protease activity; Biological process=protein modification
  Coding regions on vcDNA: vcDNA=SeqID_89210; Strand=+; Position=9-572
MQKIYERPEKYNGGGRVATIPFSNGALPTNHSLYSLPGRYPKGLCGLANLGNTCFMNSALQCLSNIPELATFFINGEYSEQINTQNPLGTQGKLAQEFAELLKNMWSGRYCTFRPFRLKCVVGMFATRFNGFAQQDSHEFIAFLLDGLHEDLNRRINHRQISNNRMDETEKREDNEEEGQCAEDGKSE

SEQ ID NO: 162788 - protein, 210 aa, Heterodera glycines
  Homolog annotation: Hit_ID=NP_872058.1; Match level="QueryCoverage =55%, HitCoverage=33%, E-value=1e-46, Identity=78%"; Hit description =RhoGAP domain containing protein (37.9 kD) (2P555) [Caenorhabditis elegans] emb|CAD59137.1| Hypothetical
  Coding regions on vcDNA: vcDNA=SeqID_89211; Strand=+; Position=28-657
MASADQKNTSSATASSAAFASDPPKMGAETIAKPTAPPQKMNTHFLNSSTTPQQTHHRNNSKQPPQPQQQPQTARRNSAARRHTTPDMAASAAYGMVLCGSDEMEQRYRGRIEKVKFGVPVNEAFCPDIPATLLVLLLKVNKEGPLKKDIWRAPGNQAQVRKLSHIMQHGRLVNISNISVYTAASVIKRFLAKLPGGIFGVENERQLFEV

SEQ ID NO: 162789 - protein, 200 aa, Heterodera glycines
  Coding regions on vcDNA: vcDNA=SeqID_89212; Strand=-; Position=1-600
GDQSAHQLLEILDQTAVIGPKNGTLAETVRTLKPVVLSSKVKAALIIAGRDSLLRGETVEMMMEQYEMIANLCRRFAHVKFFWTCPPYVHDKHDEYEELVARLGPMMSLNPFIPVWVTKKGRSIHELFRFGNSFDNMRVTSDGLMKDAGVRALKAWLFTQSDFSGDQKLKIRTIRSAVHVAASVGLGDHRQPSTSSSGSI

SEQ ID NO: 162790 - protein, 195 aa, Heterodera glycines
  Coding regions on vcDNA: vcDNA=SeqID_89213; Strand=+; Position=62-646
MPKFPVPFLANSLKISSPVCADVTPTEKKATTIREVRTQKQQIKKEEKSEAQIAQEKERERVKREKEREKRRTKLSDAFSALRSSIPTLDYKTPFSDKMDCVKRLLPFGLYSETELSDDFLQKFDGEMQRHSEFLCERMDSLKERFQSIFLTESLCEMKEQRNLLLRLDVEFEKAQLQKATEAKGASFPFPINSS

SEQ ID NO: 162791 - protein, 219 aa, Heterodera glycines
  Coding regions on vcDNA: vcDNA=SeqID_89214; Strand=+; Position=3-659
NLTSFENASFFSMFKIVLLYHIYSAFIYCKPLKNNCDGIHHYNFLLLLFAVLGYIPYNSLINAFFKFWVLICQIFDYLLCILFLWAEMSWLPNENLLDVFAFLSDVRLLRSVSFVCHRFWRLSELALFKFHPMVAKSVRIGWDPKNASHYFFVQSVKCAVALSNLALSVGPSDNSSSNWPPSLPPPNIVGIRRIRMEGHQFNSVELFKICKHFLVAFFV

SEQ ID NO: 162792 - protein, 209 aa, Heterodera glycines
  Coding regions on vcDNA: vcDNA=SeqID_89215; Strand=-; Position=195-824
QLSNLFDSFTAFADNYAQVLRERWHLGECGEDILILIVQTPPQMQPTDGPQSSAHSQPNGPFPMLFLSLGPLITSRLHPDFAGHALRHILFDANAQLQHDARPLFKVLNEMLLRMDAEVFGALAPAEFSAGVGTAPSSFVSTPHARHRHSYADGPTVPSRSHIPPWAWSRNLEFNLAIHYGRNSGASRIKARFLSSERCDWPKPRKFEN

SEQ ID NO: 162793 - protein, 80 aa, Heterodera glycines
  Coding regions on vcDNA: vcDNA=SeqID_89216; Strand=+; Position=278-520
IFKISRLVPVPNKNRGPGPGFSGPGKSRSRFCPKFPVPLHSSKNLRILSLLMIQLQFANLLNVFAIVNVRALYCAFGSHL

SEQ ID NO: 162794 - protein, 74 aa, Heterodera glycines
  Homolog annotation: Hit_ID=AAH63374.1; Match level="QueryCoverage =85%, HitCoverage=10%, E-value=3e-11, Identity=50%"; Hit description =Hypothetical protein MGC76021 [Xenopus tropicalis] ref|NP_989196.1| hypothetical protein MGC76021 [Xenopus
  Coding regions on vcDNA: vcDNA=SeqID_89217; Strand=+; Position=95-319
MRIETNLGHDLKGHAETGSGKSAAFLLPIIDAVMKLKKGGHYKSRRCCPFALIVEPTRELTVQVYDQARKLAEG

SEQ ID NO: 162795 - protein, 80 aa, Heterodera glycines
  Coding regions on vcDNA: vcDNA=SeqID_89218; Strand=-; Position=405-647
MPTVSQSSRHGSGNKERDKRKRGMCHKRKQKKRIPLLIWMTLILIEWREERKNQSEKIKIESSRISFNNLLNLSKFCSFF

SEQ ID NO: 162796 - protein, 327 aa, Heterodera glycines
  Coding regions on vcDNA: vcDNA=SeqID_89219; Strand=+; Position=3-983
YNESQANWTHKHYTDLSSPIVHYPSSTNSPSISPFLPQFRSLSSAPNRPQQLSSSSSASSDSSLTSSTASSTLNSTNNTTESEEPFHGQSRKGTSQEESRNETHASRLDDSILNRLLHIEPPNGNKQKSLNNTCHTFVTNSRNESPSDFRWIETADGLGENNGRKSCDHNIGKELDKLRDDFHSLQFLHAQNGRQTKDRLETLENRMTELNVKLRRLDIQTETNVGEQKAQMTSLMVKNGRLCEKLGEHQMGLKAVQNRIELLEQCHLREFVAGLPPVHEDGSLVLSQFENGNYFAEMKILFQSGSRFCSGFAIKSSAHFRNYPSNL

SEQ ID NO: 162797 - protein, 92 aa, Heterodera glycines
  Coding regions on vcDNA: vcDNA=SeqID_89220; Strand=+; Position=308-586
ANLSRDFPSPDFSFVETVFLPITAQINENHPPIVLSFFLFSHNPISDSAPSSGFIECACLSHFLLSVPPPQKGASAVVVLPKPSAGQSICDH

SEQ ID NO: 162798 - protein, 144 aa, Heterodera glycines
  Homolog annotation: Hit_ID=CAE58316.1; Match level="QueryCoverage =74%, HitCoverage=77%, E-value=5e-21, Identity=48%"; Hit description =Hypothetical protein CBG01427 [Caenorhabditis briggsae]
  Coding regions on vcDNA: vcDNA=SeqID_89221; Strand=+; Position=16-450
MISPCSSSSIHWPLNWRPFALFVVLFGFFTANSQMFVSASDDKRNSFGRDFLPFGKRIANSEENFQRDFMAFGKRSPNEAFQREFMAFGKRGAPSDHFQRDFMAFGKRVPDGFQREFMTFGKRSSDIGRGGSFDREFMAFGRRK

SEQ ID NO: 162799 - protein, 96 aa, Heterodera glycines
  Coding regions on vcDNA: vcDNA=SeqID_89222; Strand=+; Position=38-328
HFVRSLMDFENVGTSVAAPFLAPLSGIVVTFTGLSKEKRQELIGLLHEMGAQSMAAMNCKVTHLIAERCDPESEKYKATFPETNGAVLSCLATTAI

SEQ ID NO: 162800 - protein, 317 aa, Heterodera glycines
  Homolog annotation: Hit_ID=NP_497763.1; Match level="QueryCoverage =86%, HitCoverage=96%, E-value=1e-51, Identity=41%"; Hit description =galectin (32.4 kD) (lec-4) [Caenorhabditis elegans] emb|CAA88850.1| Hypothetical protein C44F1.3 [Caenorh
  Coding regions on vcDNA: vcDNA=SeqID_89223; Strand=+; Position=84-1037
MPSSDFPMPYTSRLSEPCLAPGQSLVFQGSVDSDARHFELSLISGVPNSGQERIALQICFHFEVGITILNSMLENGEWGEEEFHSNPFFHGKPFDVRIRVHEKRFDFFVNQVPWAVFEHRTDFRKIDHIQASGDVSLSAVHWGGRYFEMPYEMTFHDHALESGQRLFVYGIPRGDFAVSLISDSLEELFRMSALFDKQIVVRNAQTDKEWGAEESEGGPFPFRKGEGFDLVILNEPLALQISINGTPFCSFFHRTIDAHKDYKKVRISGEVELTGMEVSLCWESVGGVSNCCKYPEGRAQRTNAAGENVQQPIGLSR

SEQ ID NO: 162801 - protein, 182 aa, Heterodera glycines
  Coding regions on vcDNA: vcDNA=SeqID_89224; Strand=+; Position=108-653
FSVICRTMCQKFVAMPSFVHHHLTLLCLFLGALCAFGAVPSLCQLLGAPGGCSPIAVLSAAQQPNGGGAAAQFQQPFGPAFGCPLNPLGAFGRPFPPPPPPPPPGIGGQFPSMQGQTVNLSPNFMGGGQQQQQNGGECLRHNGRRRQLQLWHVLSAAAGDERQQQQQQFYWHANSQRIYRLQ

SEQ ID NO: 162802 - protein, 254 aa, Heterodera glycines
  Homolog annotation: Hit_ID=NP_500135.1; Match level="QueryCoverage =86%, HitCoverage=63%, E-value=3e-58, Identity=49%"; Hit description =rhodopsin-like GPCR superfamily (4C542) [Caenorhabditis elegans] gb|AAK68458.1| Hypothetical protein Y41D
  Coding regions on vcDNA: vcDNA=SeqID_89225; Strand=+; Position=39-800
MFDQQQNLTLPGPSSVYLPPNDSEMFGRGQNESAIVSVVCEEHYDYYQPTEKWLLGVVALPFILCGLCANGMSVAIFSHRQMRQQSVNWYLLVLGFSDLIVLLGAFFVLTLPRLSEILHWWRGTAISYYSTPLMYSLMTMAQTTSVWMTVAMSLHRFVGVCFPYQSGTVLATRNVKSLIVGILFVAIFFNGCRFFEVSFQVCRMKPINVELPVLRMTALRQNELYRKVFYEWAYTLIMFAIPFTILIVVNSMVI

SEQ ID NO: 162803 - protein, 302 aa, Heterodera glycines
  Coding regions on vcDNA: vcDNA=SeqID_89226; Strand=+; Position=39-944
MDAEKSALNETVPTESTANLTTMEQTVPKVKEVKPRRSLLAQASQQRPPLPRASAQSSASAPTQVALPRSHSRSRITPSARPVLSSRENTSIALKGTAPMSGMTRRSMTTKSQSVEHVAVAQKHLSGIGRNIANGRTKESKSANASDRQRKEVEDELNRTKQMLKQTTKTLDVFAVVASHFDRKLDNANTESAVLMAQKGDEAAQHQRAIAELDCNWKKRLQRAKEDHRVEFDELRAKISSEQAENITKIQLQHQKTVNELEKHVQKLGKKLAEQEEKHRRELAESASQSTNRLHKELESRN

SEQ ID NO: 162804 - protein, 163 aa, Heterodera glycines; identical to SEQ ID NO: 160991
  Coding regions on vcDNA: vcDNA=SeqID_89227; Strand=-; Position=21-512

SEQ ID NO: 162805 - protein, 64 aa, Heterodera glycines
  Coding regions on vcDNA: vcDNA=SeqID_89228; Strand=-; Position=684-878
PIPSFMRHQLHFFLVLPNCLKCIPKNALKMIKPVFSRISCQYFPIRNDTVNSFASLIHSCFASD

SEQ ID NO: 162806 - protein, 195 aa, Heterodera glycines
  Homolog annotation: Hit_ID=NP_510363.1; Match level="QueryCoverage =96%, HitCoverage=72%, E-value=2e-29, Identity=35%"; Hit description =androgen induced protein like (XO797) [Caenorhabditis elegans] emb|CAB02823.1| Hypothetical protein C37E2
  Coding regions on vcDNA: vcDNA=SeqID_89229; Strand=+; Position=12-596
MGLFRVLIYGIILGVYASALFYDVRFMPRLGVVWWVEKLVMLSMLNLSLQSFYALLCFVCALFDWNEEFVHGEQHKKVKATHVPSYWRRSRLHRICDFVYATAAFPVGMASSLMFWALYVADPELVMPAWVAKLVPDWLNHVSHTAPVAFVLVDTLLTCHHAPDRKIGSTVVVALFLFYVGIIISVRLISGHWLY

SEQ ID NO: 162807 - protein, 162 aa, Heterodera glycines
  Coding regions on vcDNA: vcDNA=SeqID_89230; Strand=+; Position=64-552
SQPFFPCIHSIFWTRNSVFRKLTSRPWSTNLPFPQQTFLTQQNLGLALHCSTLIKTNEFCLGLTCPVPTEYTREPKNKTFFVCPFWRIENVQSPRSPFTNTAPPPQSQISRINQFHSRLVSQINNSLPTPRLRGRRTGRGSGEMSNKYPNPTPAPPSLFNVI

SEQ ID NO: 162808 - protein, 378 aa, Heterodera glycines
  Homolog annotation: Hit_ID=CAE65931.1; Match level="QueryCoverage =94%, HitCoverage=23%, E-value=1e-104, Identity=53%"; Hit description= Hypothetical protein CBG11104 [Caenorhabditis briggsae]
  Gene Ontology: Mol. function=amylo-16-glucosidase activity; Biological process=glycogen catabolism
  Coding regions on vcDNA: vcDNA=SeqID_89231; Strand=+; Position=2-1138
SVLRLYPTDEVEYGEQTKTEPLSATMFEALSRHFLGIDFRERNAGHRIDEHMRDEGFNVKAYIDGHSGLIFGGNRWNCGTWMDKMGSSERAGNRGEPATPRDGAAVELQGLALCVARGLDRLCRDRAFPYNGMKGESSSFLSWSDWAAKIQHSFEQHFFVDHNCQSEFVHRRPIVKDSFGASLAFADFQLRPNFCIALNASPDILPPEKAWAALEIAGEVLAKNAPYGICTLDPKDWAYNGNYDNDDDGTNRISAKGWNYHQGPEWLWVAACYMSAKLKVASLLLHKSGDSSAWLSAVGEIRQRLFALEQCLNRSDWASLPELTNRAGAFCAHSCPAQAWSVGCVMETLDTLEAMEKEGMNLEGRKSDRRANDKQKKH

SEQ ID NO: 162809 - protein, 339 aa, Heterodera glycines
  Homolog annotation: Hit_ID=CAE69126.1; Match level="QueryCoverage =96%, HitCoverage=67%, E-value=1e-130, Identity=70%"; Hit description= Hypothetical protein CBG15152 [Caenorhabditis briggsae]
  Gene Ontology: Mol. function=pre-mRNA splicing factor activity; Cellular component=nucleoplasm; Biological process=mRNA processing
  Coding regions on vcDNA: vcDNA=SeqID_89232; Strand=+; Position=713 -1729
HSHFLEFTTFILATGAIPRATLQSSVPVVGPSVTCQARRLYVGNIPFGSNEDAMLDFFNQQMHLCGLAQAPGNPVIACQINLDKNFAFIEFRSIDETTAGMAFDGINFMGQQLKIRRPRDYVAPTTNYELLGRMPVSNIVVDSPFKLYIGGLPNHLNSEQVKELLSAFGQLKAFNLVMDTTTGMSKGYAFCEYLDQSLTDQAVVGLNGMQLGDSRLLVQLAAAGARQSVTHPSTAVQIAGIDLSRGAGPPTEVLCLMNMVTEEELQQDEVYEDITEDIRVECNKFGNVVSMEIPRPGYDERGVGKVFVEFQSKEECQKAQAALTGRKFDSRVVVTSYFD

SEQ ID NO: 162810 - protein, 311 aa, Heterodera glycines
  Homolog annotation: Hit_ID=NP_507998.1; Match level="QueryCoverage =60%, HitCoverage=50%, E-value=3e-21, Identity=35%"; Hit description =sterile alpha motif SAM (5V168) [Caenorhabditis elegans] emb|CAB04458.1| Hypothetical protein F53F8.5 [Ca
  Coding regions on vcDNA: vcDNA=SeqID_89233; Strand=+; Position=36-968
MSAAFERFFVACDIPATMVPKYASRFVKERIHPALMKDLGKDDLRELGVTALGDQLAIMRYIKQCEGNPPEFNSVEQSKRKSESRGRETADFESDEDEPMLVDSNSSSSFKAPDREDIYHIKMPIGTLPKTRKILEKNRSLRDRGVLKRGVSGVRRSGIELNKPLNTISTRSKVIGRKAITLQDTDITSSTAFVPLGSMRSDSISTKTTVVADNTGNSRPVSLANRFASLSGAAPNILFQLGKVVSPSVQLIPSRRPLVRYSSDIDDFSTTAEPFSELTTEMVRKVRKNNSVTFQPPAFRAPIAERIQIGG

SEQ ID NO: 162811 - protein, 196 aa, Heterodera glycines
  Homolog annotation: Hit_ID=CAE71361.1; Match level="QueryCoverage =79%, HitCoverage=30%, E-value=3e-48, Identity=63%"; Hit description =Hypothetical protein CBG18265 [Caenorhabditis briggsae]
  Gene Ontology: Mol. function=UTP-glucose-1-phosphate uridylyltransferase activity; Biological process=embryogenesis and morphogenesis
  Coding regions on vcDNA: vcDNA=SeqID_89234; Strand=+; Position=43-633
MPMLNASFDKFNISNSDKIRTQRLISMSESCEEWKTCTKRETYALLDQELNKLLTTSPPEKMEYWKNLLDGFMDLFARFLRAKTTVEWSKIEPLPEGAITPYSKLEQTPRDRVRELLNGLVVVKLNGGLGTSMGCKGPKSIISVRNELTFLDLTLQQIQSLNREFEVNVPLGLMNSFQHRPTTLRSCLKTDPTCLR

SEQ ID NO: 162812 - protein, 291 aa, Heterodera glycines
  Homolog annotation: Hit_ID=CAD58848.2; Match level="QueryCoverage =99%, HitCoverage=24%, E-value=1e-50, Identity=38%"; Hit description =SMC2 protein [Takifugu rubripes]
  Gene Ontology: Mol. function=ATP-binding cassette (ABC) transporter activity; Cellular component=membrane; Biological process=chromosome organization and biogenesis (sensu Eukarya)
  Coding regions on vcDNA: vcDNA=SeqID_89235; Strand=+; Position=3-875
NVKKAEMRLGQLNKTLSKKRSELQQTSRHSLSQNDTKRELEVGIEQLEQKLRALYFDPQLDHQLEQERVQLARERGQCAQELDRFEARNFKLRFDYTMPYNGFDRNKVKGVVAKLFKMNEQRYATALEVVAGGRLFHVVIDKVKTGEDLLKAGLPRRGTMLPLDKISANVLDQRLIGQAKRMVGEENVFFPGELIEYEREIELAILSVFGNCLICGDMDQAKQLTFDRAINCRTVTLSGEDFKPTGVLTGGFRKPDASILTALNEISGQYERIRELDHRIGAIERELARLR

SEQ ID NO: 162813 - protein, 229 aa, Heterodera glycines
  Coding regions on vcDNA: vcDNA=SeqID_89236; Strand=-; Position=226-915
MSLSSAVVRIAFSNVRHPTTTGSRFRCRAARRALSASAPKSAASSASSLCRCCSAPAASSSSRFKCIEWAAPSALPSRHSPPSPINLPAKRGICCCCWWRTSSSIIITSSCASLLTRPAPKSETMRVTAAPKSGIEMGSSSSSRSFSSSSVIVGCRPSKADIAGVVELFSVRKFIVSAAVAAPPSVLSNSAKTPGPIDGGTETGRCRCCSCCCCLVLLTEVCRKRTESE

SEQ ID NO: 162814 - protein, 84 aa, Heterodera glycines
  Coding regions on vcDNA: vcDNA=SeqID_89237; Strand=+; Position=86-340
FLKNGIFNFIKKIMNPCTIGSIFHMFFKMLTIRQNIANFFTANHFLNLIFHLNKNYYHELTTKHSPLVHIDRNFWMINELTKKG

SEQ ID NO: 162815 - protein, 48 aa, Heterodera glycines
  misc_feature (15)..(15): Xaa can be any naturally occurring amino acid
  Coding regions on vcDNA: vcDNA=SeqID_89238; Strand=-; Position=98-244
YQECLIYLTLTKVMXQFLVEICRGVLKLAIFRSFVQDLVFMNFLSDWR

SEQ ID NO: 162816 - protein, 137 aa, Heterodera glycines
  misc_feature (73)..(73): Xaa can be any naturally occurring amino acid
  misc_feature (93)..(93): Xaa can be any naturally occurring amino acid
  Homolog annotation: Hit_ID=EAA16552.1; Match level="QueryCoverage =68%, HitCoverage=87%, E-value=8e-16, Identity=55%"; Hit description =hypothetical protein [Plasmodium yoelii yoelii]
  Coding regions on vcDNA: vcDNA=SeqID_89239; Strand=-; Position=1064 -1512
FVQSKLASPPTPTGKGQRRGKTGRKANQTSNTQSVHRTASTDPTTSFLTAAIILCILRAGITAAAGTRLALSXYSLKGLNCTHSDDRPHKRSXLVISRHYLLALRVVAISQAPSPESNPYPPLPVITMVVRYTTIES

SEQ ID NO: 162817 - protein, 163 aa, Heterodera glycines
  Coding regions on vcDNA: vcDNA=SeqID_89240; Strand=+; Position=58-549
KTAMDDSVGFLSIINLAFGWSSTPYDSKISLFRSFTVILSTAPFRLLLLKISSNLLYNFFYFRMLNSCKFPKIILQVCGRGIQKLIWMLKLKHRVEHFGRRPNGKETPSRTFVRNCSLCSKRTCPREHLPLVPCFMQINATSCFIMAENLGFSMILDVSAFFF

SEQ ID NO: 162818 - protein, 225 aa, Heterodera glycines
  Homolog annotation: Hit_ID=AAO51879.1; Match level="QueryCoverage =99%, HitCoverage=58%, E-value=5e-15, Identity=31%"; Hit description =similar to F53F10.5.p [Caenorhabditis elegans] [Dictyostelium discoideum]
  Gene Ontology: Mol. function=cell adhesion receptor activity; Cellular component=cell wall (sensu Fungi); Biological process =agglutination during conjugation with cellular fusion
  Coding regions on vcDNA: vcDNA=SeqID_89241; Strand=+; Position=1-675
GTCANFLFGIGASKTTAPMTPTTTALTTSAGSPFAFGSSASTTASPGATTTTASATLPLLFGTQQKTTAPAAVPSSVPAFSFGTAKFPSFGSSAAGGTLFGSTTANTLTTSSQPHVNGGSRKRSAAQSVDDISPYGKRTASSSLTETSSIANAPLFGGALTMTTKPNTAIDAPFLANSTAFSSTTITATAIPSDAGTGANFLFGIGASKTTATMTPTTTALTTSA

SEQ ID NO: 162819 - protein, 221 aa, Heterodera glycines
  Homolog annotation: Hit_ID=NP_499653.1; Match level="QueryCoverage =98%, HitCoverage=11%, E-value=1e-101, Identity=80%"; Hit description= prion-like Q/N-rich domain protein PQN-81, Prion-like Q/N-rich domain protein (pqn-81) [Caenorhabditis e
  Gene Ontology: Mol. function=helicase activity; Cellular component =nucleus; Biological process=establishment and/or maintenance of chromatin architecture
  Coding regions on vcDNA: vcDNA=SeqID_89242; Strand=+; Position=1-663
EKPDLNNVDYAGLRSDNSEVRRKQLDNIAVAALEFQPKGNTLETTEVKTEVPFLIRGDLREYQLVGLDWLVTLYEKNLNGILADEMGLGKTIQTIALLAHLACDRAVWGPHLIIVPTSVILNWEMELKKWCPALKVLTYFGTAKERAEKRKGWSKSNAFHVCITSYKLATQDIRAFKKKAWQYLILDEAQNIKNFKSQRWQTLLRIQSRRRLLLTGTPLQN

SEQ ID NO: 162820 - protein, 74 aa, Heterodera glycines; identical to SEQ ID NO: 127609
  Coding regions on vcDNA: vcDNA=SeqID_89243; Strand=+; Position=277-501

SEQ ID NO: 162821 - protein, 203 aa, Heterodera glycines
  Homolog annotation: Hit_ID=NP_508149.1; Match level="QueryCoverage =99%, HitCoverage=36%, E-value=8e-31, Identity=38%"; Hit description =microtubule-interacting protein that associates with TRAF3 (XB385) [Caenorhabditis elegans] gb|AAC47924.1
  Coding regions on vcDNA: vcDNA=SeqID_89244; Strand=+; Position=72-680
MGSTDQTKALFSTLIQRPTLTDQLLQRPPFKFIHDIVHETLRVTGFLDGLFTSDELDSTKAGSSRDNKMAFLQKLIDALNMDGHLDDVKPAKIVAGKEAEMTNLLLQSFASEATMYAKQDNNKQQQGDVAVKKSASHSSASSKSKSTTVEAASSSPSASKSKNDDDEKRKSKKESSSRRDKEKKEEEHRRSSLTKHRSKDKGS

SEQ ID NO: 162822 - protein, 124 aa, Heterodera glycines
  Homolog annotation: Hit_ID=S02771; Match level="QueryCoverage=100%, HitCoverage=6%, E-value=2e-46, Identity=74%"; Hit description=myosin heavy chain A [similarity] - Caenorhabditis elegans
  Gene Ontology: Mol. function=ATP binding; Cellular component=striated muscle thick filament; Biological process=striated muscle contraction
  Coding regions on vcDNA: vcDNA=SeqID_89245; Strand=+; Position=1-372
KKIIAKLEERIRALEQELDGEQRRHQETDKNYRKAERRVKELDFQVEEDKKNTERLTDLIDKLQGKLKVYKRQVDEAEEVAATNLGKYRQLQAQLDEAEERADMAENSLSKLRAKNRSSASIAP

SEQ ID NO: 162823 - protein, 280 aa, Heterodera glycines
  Coding regions on vcDNA: vcDNA=SeqID_89246; Strand=+; Position=18-857
LAGKTLIGFFLPQMIILFFSPFVLHKFCVFRWNSKGTHWRREIIPKSERELPTRDNGSIVDYNKFELWRREYEEGVAQLEQEHVKKLKELEESFFKELDEQNRSLDSEVNALDIAIPPLGNGEESLANCATQLGQCQHHPNPLSANHGITTAISGKKFLRSRQNDVIPSSSVGAESALHLGAIGLTDAAGTAKRRTQTKKSGSPFGFLGFGRTESAVGGFAGAIGGGPTIGGTSTSSLMLPYLLSESAISEDVHSLGSDSANHCHLAERSSAGCGGLSQD

SEQ ID NO: 162824 - protein, 254 aa, Heterodera glycines
  Coding regions on vcDNA: vcDNA=SeqID_89247; Strand=+; Position=3-764
QMQQNQQHQQGNTMEDGNDNTVVVVMGQQGGTTVDWDSREEQQQHLDMETARTSRTEDIIHYPSMDTLIDQILLADSSEEMRRNDDDDDDEFKQYTNRTSAAAADGSADEWTTARNGNSDRCELEAVVSCHPSPCSSSSASSSTSGCSPTRNIPPTATVFSATVPLPPAVLPFGAATAPSTFPPAVFFTGAASDLFMSSQDYAHECGTAAAAGGGSDSAVAARRQTALAVPAWPRPLGALPALTQSLFDAFVVT

SEQ ID NO: 162825 - protein, 355 aa, Heterodera glycines
  Homolog annotation: Hit_ID=AAO92288.2; Match level="QueryCoverage =100%, HitCoverage=100%, E-value=0.0, Identity=98%"; Hit description =peptidylglycine alpha-hydroxylating monooxygenase [Heterodera glycines]
  Gene Ontology: Mol. function=peptidyl-glycine monooxygenase activity; Cellular component=integral to plasma membrane; Biological process =peptide metabolism
  Coding regions on vcDNA: vcDNA=SeqID_89248; Strand=+; Position=17-1084
MGHFFPGTVSFPIPLYMLGSARCWWHFGAKQPRVFASSHAQLTPPEGIESADLRMPGVSPQMNESYLCSAFPLDSERDHFIVGFEPVLSSRHIHHVIVYGCEMPGSEDKAWDCGEMASPRGSYSHSPVCASQPDIVYAWAHNAPELLLPDGVAFRVGGSSAVQFLVLQVHYMRAEEDDTSGIRIIHTDRPQPRQAATLLLATDGRIGPKRKEQLEVACVVDESVVLHPFAFRVHTHRHGRKVGGWAVREEPKSGTDKWTLLGQRDPQLPQMLQLVANQSVTITQGDVLAARCSMENEEKREIKIGPTGEDEMCNFYLMYWTKNGQTLEQNMCFSPGPPIYRWTKSAGLNHTPKRK

SEQ ID NO: 162826 - protein, 262 aa, Heterodera glycines
  Homolog annotation: Hit_ID=EAL31098.1; Match level="QueryCoverage =98%, HitCoverage=99%, E-value=1e-109, Identity=72%"; Hit description= GA10883-PA [Drosophila pseudoobscura]
  Gene Ontology: Mol. function=structural constituent of ribosome; Cellular component=eukaryotic 48S initiation complex; Biological process=protein biosynthesis
  Coding regions on vcDNA: vcDNA=SeqID_89249; Strand=+; Position=52-840
MARGPKKHLKRLAAPKKWMLDKLGGVFAPRPMCGPHKLRESLPLILFLRNRLKYAQSYNEARMICKQRLIKVDGKVRTEMRFPCGIMDVISIEKTNETFRLLYDVKGRFVIHRIQSREGQYKLCKVKKQAVGDKQVPYIVTHDARTIRYPDPHIKADDTVVIDIGTGKVTDYVKFDAGNICMITGGHNIGRVGIVGHRERHPGSFDIVHIKDAAGHSFATRMTNVFIIGKGATPLISLPASKGIRLSIAEERDRRLAQKQKV

SEQ ID NO: 162827 - protein, 317 aa, Heterodera glycines
  Homolog annotation: Hit_ID=CAE68915.1; Match level="QueryCoverage =100%, HitCoverage=58%, E-value=4e-73, Identity=45%"; Hit description= Hypothetical protein CBG14894 [Caenorhabditis briggsae]
  Coding regions on vcDNA: vcDNA=SeqID_89250; Strand=+; Position=30-1146
MSTIGVHEIFKLSQKDHQPPEKRSKLSDGSTQIVPSVATAKNGGDILEALEKSEDTSELNEIDEASVKRICFLLERKQGKNAELRIKYAEEPPKFMESEIELNNAIQEMHVIAAEPQFYDVLVEQGSVQLLLQLLSHENTDIIAAVCNLLQELTDVEILHESEDGAKLLVDELIKGHVVETLVQQPLVKLNEQNQDEADAVYNAMNLLDFHPQANDLCVSQGLFDWLMVRATKRKVFDANKLFASQLFAMLLQSCESARKRLTEKRDGIDMTLRALAVYKRHNPGSPDEHEHMENLFDALCAALMYVPNRQVFLDGE

SEQ ID NO: 162828 - protein, 82 aa, Heterodera glycines
  misc_feature (26)..(26): Xaa can be any naturally occurring amino acid
  Homolog annotation: Hit_ID=NP_740900.1; Match level="QueryCoverage =98%, HitCoverage=2%, E-value=1e-09, Identity=43%"; Hit description =chorein A (359.3 kD) (1J482) [Caenorhabditis elegans] emb|CAB02304.1| Hypothetical protein T08G11.1a [Caen
  Coding regions on vcDNA: vcDNA=SeqID_89251; Strand=+; Position=366-615
TIDVFRPPKSVRLHQLFWEPEDGKIXIESRSATVLQHMVDVRKKLELEVKIDPAIFVVCSGGAFDPTKTTLIAELGQLKLNT

SEQ ID NO: 162829 - protein, 221 aa, Heterodera glycines
  Coding regions on vcDNA: vcDNA=SeqID_89252; Strand=+; Position=2-664
NHWPTMGQSQGIPQSPPEGPSQENNGRTAQPNGATDEGIFRVKVSNCPNTSPRNLRQTFQMQHNRRQSRSKSLEPNAALDIRTIGHRKSSRFGTKTELKKRGQNQNLWNPEKAATQIIGQQLQNPHTQPPTIQLQTVSIHLKQFRNQNGKTDLLEDNKKDGITGLSAHQIQILQKIWERSPEVEISDCARNIMAHLLRSNAQMYQFFDLLGLSDREISSSP

SEQ ID NO: 162830 - protein, 75 aa, Heterodera glycines
  Coding regions on vcDNA: vcDNA=SeqID_89253; Strand=+; Position=43-270
KSKCLIFKTGIPPIIYLAFNKTVRRDVYIMLVRPLAMVLPCITVPPELSATQNFGSNSRVAGAGTRIVSISLTVQ

SEQ ID NO: 162831 - protein, 389 aa, Heterodera glycines
  Homolog annotation: Hit_ID=NP_497509.2; Match level="QueryCoverage =100%, HitCoverage=22%, E-value=1e-60, Identity=35%"; Hit description= yeast translation activator GCN1 like (3D287) [Caenorhabditis elegans] gb|AAK29920.2| Hypothetical prote
  Gene Ontology: Mol. function=translation factor activity, nucleic acid binding; Cellular component=ribosome; Biological process =regulation of translation
  Coding regions on vcDNA: vcDNA=SeqID_89254; Strand=+; Position=3-1169
MFELMLHCLSSAVVDRQQMAVRCLSELVKKMGERILEIVLPLLEDRLRQGGVNDRRGVALALNEIIGNVHREIVENHASSFIGSIRICLSDSDSSVRDAAGQAFAAYHSATSYLAVEQIVAPMLDTYNKTGEPFILDGLCSVMAGPNGRQLFQSLLPKLARSPVNSAALCRLALSTDAMKRNLNKVMEAMLNGDINTSVDEHIQNCIPVLLTLDDEDDMRAMFSLLLKFASKKESAEVASLLLRTYIDECDGMEYSESQLDTLFCGLVGLYNSDNPNVLQNAIESLVALVKQIDPSSYIQLSLLLKRAIKGLANDTRELSSDGCSRGLCVSTGWQPFLAILREALLMGGVEIKEVAANCLSQLIPLSSEAGLRPHVVNMAGPLFRILGD

SEQ ID NO: 162832 - protein, 238 aa, Heterodera glycines
  misc_feature (75)..(75): Xaa can be any naturally occurring amino acid
  Homolog annotation: Hit_ID=NP_990594.1; Match level="QueryCoverage =96%, HitCoverage=24%, E-value=1e-30, Identity=34%"; Hit description =poly(ADP-ribose) polymerase [Gallus gallus] emb|CAA36917.1| unnamed protein product [Gallus gallus] pir||
  Coding regions on vcDNA: vcDNA=SeqID_89255; Strand=+; Position=28-740
MENEDETPKEPPYGAEYAKSNRASCKGCKQLISQGELRMAVRFPSRFFDGMQENWHHFECFWKKARKNDINEASXIRGMEWLKWEDQEKIRARITELKESDDSAYTPKAAVMTIEHAKSGSSKCYKCKNSIAKGDLRVSSKASFYHLECFHSLGIFQKSAEDSNGYNDLNADEQKRLDELFPKATQTPAEEGIKRKNEISETETPTSKRMKSDGENKEQTEALKKQSELLWNTRIALR

SEQ ID NO: 162833 - protein, 226 aa, Heterodera glycines
  Coding regions on vcDNA: vcDNA=SeqID_89256; Strand=+; Position=27-707
MLSLLSILPIVLAAFVAPFANAVFSTPSVTLSLNPKEIELLMDTAQNCKNLSDDQQVAAFQVLAEEQGGDLKASIDNVLMKVNVSDDQFKQNIEEAKQKLSSSKAKETADQLEDLFLDGSLPFIDKVKKSVELVQELPEEIRTECEPVLMVINSITRCPFKEQCTPSEEIGGGNIGNVGQGGGGGIGLQQGQNKQGQQQLQQNQQEQPCFHIKLLKVCTISKNQKE

SEQ ID NO: 162834 - protein, 389 aa, Heterodera glycines
  misc_feature (319)..(319): Xaa can be any naturally occurring amino acid
  Homolog annotation: Hit_ID=CAE68824.1; Match level="QueryCoverage =99%, HitCoverage=53%, E-value=1e-158, Identity=68%"; Hit description= Hypothetical protein CBG14783 [Caenorhabditis briggsae]
  Gene Ontology: Mol. function=long-chain-fatty-acid-CoA-ligase activity; Cellular component=lipid particle; Biological process =gametogenesis
  Coding regions on vcDNA: vcDNA=SeqID_89257; Strand=+; Position=2-1171
LAHILEVCAEIVCLSKGCRVGYSSPSTLHDRAVKIKRGTTGDCVELKPTLIACVPAIMDKIFKAVSDEVKEKSPIQRELFRICYERKRNRFEEGYTSLVMNSLAFNKIRNILGGNLRFLLSGGAPLNPETQRFMNICFCCPVVQGYGLTETCGGATLADEHDLSTGSVGPPLRSCEIRLREWTEAGYLPSNSPPQGEVLIHGANVALGYFKNEEKTKEDFVELDGKRWFATGDIGEFREDGSLCIIDRKKDLIKLAHGEYIALGKVETALLTNPNVDNICVYGESHKDYLIALVVPNLKNLQVLAEKNDVNEPSIERIXANKEMPKILQKELHSFVSGKLRREEIPRKVIICAEPWTADSGMLTEALKLKRKNIEKKFEEEIRQLYEEN

SEQ ID NO: 162835 - protein, 200 aa, Heterodera glycines
  Homolog annotation: Hit_ID=AAV28375.1; Match level="QueryCoverage =89%, HitCoverage=49%, E-value=2e-11, Identity=28%"; Hit description =Hc38 [Haemonchus contortus]
  Coding regions on vcDNA: vcDNA=SeqID_89258; Strand=+; Position=1-600
EEEERMSSSRANKFAVAFLDDEQTDETTEANSETENEENLTNESKQTKAKNEGKNKNRKGTKKQKRTKAEKAKEFGTSEQMPMATKKTMPPNETAQKSNLVDDPLERLLKVDLRSLNPDDELRRLLGRTFGAEQRRRGGQQQQQRRIGAAQLGGSRLTKPRLDWPPPRQIGLQMILDDEKVMSTATSADTLSNEAEMPLL

SEQ ID NO: 162836 - protein, 198 aa, Heterodera glycines
  Homolog annotation: Hit_ID=XP_317885.1; Match level="QueryCoverage =93%, HitCoverage=19%, E-value=7e-45, Identity=44%"; Hit description =ENSANGP00000004923 [Anopheles gambiae]
  Gene Ontology: Mol. function=ARF guanyl-nucleotide exchange factor activity; Cellular component=mitochondrion; Biological process =endocytosis
  Coding regions on vcDNA: vcDNA=SeqID_89259; Strand=+; Position=27-623
MQMRVEWNEQQRRRLYRIALNFFNKTPDLGVQLLISWGFVRNSPRELALLFMERRGISKQMIGEYLGTLRSQFHTAVLNCFIEQISMYDMEIDIALRQLLKHIRLPLEAQKIDHIIQAFAQHYVACNRNRLCALDTPDSMYILAFAVIMLNTDLHTPSLKDSRRMKLDEFVQNLYRLEEARHMDRGKTINFYNCRYLH

SEQ ID NO: 162837 - protein, 136 aa, Heterodera glycines
  Homolog annotation: Hit_ID=NP_501359.1; Match level="QueryCoverage =100%, HitCoverage=37%, E-value=7e-36, Identity=48%"; Hit description= molybdenum cofactor synthesis 3 (44.5 kD) (4I895) [Caenorhabditis elegans] gb|AAB92067.2| Hypothetical p
  Gene Ontology: Mol. function=URM1 activating enzyme activity; Biological process=coenzymes and prosthetic group metabolism
  Coding regions on vcDNA: vcDNA=SeqID_89260; Strand=+; Position=1-686
DIVADCSDNVATRYLINDACVLSGKPLVYGSALGWEGQFTVYNNGTNCPCFRCIFPDPPSPEHVMSCSEALEIIKIAVSGKSSFAGNLWMFDRFEGISKRISLREKMSNCAICSENPRITELQDYQKFCRSDPSDK

SEQ ID NO: 162838 - protein, 174 aa, Heterodera glycines
  misc_feature (21)..(21): Xaa can be any naturally occurring amino acid
  Coding regions on vcDNA: vcDNA=SeqID_89261; Strand=+; Position=153-673
WHVLPLHPPLLLPSLLLPPPXPPPPPPLPKSSSASSSFSSYSSCSSSSSLAANREFVPKNKGEPKKMPKRHQQRWKRWRTVTSESAFFYRSSSSSLLSLDSATSTTTSSSNSSGIGTSDAETPPLAFEGEQRQQQKPNTSSRSGTSKTQNLGGGPALKWAETEKNSKKWAQTAP

SEQ ID NO: 162839 - protein, 232 aa, Heterodera glycines
  misc_feature (215)..(215): Xaa can be any naturally occurring amino acid
  Homolog annotation: Hit_ID=NP_508993.2; Match level="QueryCoverage =94%, HitCoverage=30%, E-value=3e-39, Identity=40%"; Hit description =fatty ligase long (79.9 kD) (XG556) [Caenorhabditis elegans] gb|AAA80409.2| Hypothetical protein C46F4.2
  Gene Ontology: Mol. function=long-chain-fatty-acid-CoA-ligase activity; Biological process=gametogenesis
  Coding regions on vcDNA: vcDNA=SeqID_89262; Strand=+; Position=3-698
MSDRKDSVTGGKRIEQELAEDGRPVYIVVLTIFLKGFFFLYDLLVFIPFKLFADPELKKERSREQKAVPIDGNPASPWRHVDTIGTALYTELFEDCPTLGKIWDKAAELHRGHNCMGTRDILEVIQERQSDGKTFQKLALGKYSWMDYEHVDEVIVESASGLHNLGIEQGQKVIIYAENRKGRDDLRHPLASNWALPIVTVYPTLGDEAIAFALXECDAVLAFTSRPLLSKV

SEQ ID NO: 162840 - protein, 309 aa, Heterodera glycines
  Coding regions on vcDNA: vcDNA=SeqID_89263; Strand=+; Position=24-950
SAMAATSKLQKSGRKRLRYDSEESSDDDGIGGDGATVAIIPTPSIDLVLQNLATNALAFTAAPEMEENEEQGDAIQLDCSGSSAAEEEHHHHQQQPNGQTVSSGCSSSSRPSTDKEGEQKLRRMQAQARRQRVSKWKISETAQRKKQMQKSKGNKGVGGGGALVYSVRSSSTTANNNSISKKPPNKKKQNVADRTARKNNIGGAGGEEAPAVTKTAKTLAELLQYSNVVAANLENKLTSPTTSKNDGPPTADGFTFTAAAQEECPSSSSSKSIATLITDRFTPNRGTFYRYTPAPVVTPAVVHKLLLNA

SEQ ID NO: 162841 - protein, 181 aa, Heterodera glycines
  Homolog annotation: Hit_ID=CAE58890.1; Match level="QueryCoverage =65%, HitCoverage=64%, E-value=1e-20, Identity=54%"; Hit description =Hypothetical protein CBG02131 [Caenorhabditis briggsae]
  Coding regions on vcDNA: vcDNA=SeqID_89264; Strand=+; Position=25-693
MKMAIRSFLGPACCSPTGAAVLLLISGLANTVSLASIATGNGARLGIFRPTRSISYDGQQEETEYEVEPGFEKRSMTLGRLSFRPGKRWSFPPSVVRHINFRLLPETGNEQENDLAEIGLRESAMGKRTAALGRVGFRPGKRSMAVGRTGFRPGKRSIATGRVGFRPGKRSNSPGGYYVTL

SEQ ID NO: 162842 - protein, 147 aa, Heterodera glycines
  Coding regions on vcDNA: vcDNA=SeqID_89265; Strand=-; Position=1-441
YIRECFRILIMNSLRRTIASFDQLTMIALIFIRSVRSQKTLDDFRRRSRPSFARNSVSSSPRPSDGSPLHQLRPMTPSLAHLADFRHPSSIDQHHNAQHSLGAAFSNFCAKISGGGKLKSGIIMARVSALLLLQALTNTLRRSAPSH

SEQ ID NO: 162843 - protein, 228 aa, Heterodera glycines
  Homolog annotation: Hit_ID=CAE62876.1; Match level="QueryCoverage =91%, HitCoverage=32%, E-value=6e-47, Identity=47%"; Hit description =Hypothetical protein CBG07062 [Caenorhabditis briggsae]
  Gene Ontology: Mol. function=ATP dependent RNA helicase activity; Cellular component=nucleolus; Biological process=nucleobase, nucleoside, nucleotide and nucleic acid metabolism
  Coding regions on vcDNA: vcDNA=SeqID_89266; Strand=+; Position=3-686
KNNNSSKNDATKSDDRNGKQSKTFADFKDFDFDDRLLLAISEMGWERPTPVQSSMIPLALDGKNILARARTGSGKTAAFLLPLIQKSIQLSQNSIIRKSNGPFSLVIAPTKELASQIFALLERLSESLVFIHSLNLAQYAEANDEMLENESLDVLVSTPGRLLAAVKKVPKLLINVAHVVLDEADLLFSYGYRDEIGRLKSALPPHFQTVMTSATLNEDMTELKRTFV

SEQ ID NO: 162844 - protein, 105 aa, Heterodera glycines
  Coding regions on vcDNA: vcDNA=SeqID_89267; Strand=+; Position=1-318
LFKLDRLETRRKVIDLTTAFKIINCHTHLDPQKLYTFSKRLRFNCIRLISKHKTNKTENSFINRTIKQWNNLDSKITASSSICSFKNKVIKWVKAPKYNKNIYIA

SEQ ID NO: 162845 - protein, 202 aa, Heterodera glycines; identical to SEQ ID NO: 128937
  Coding regions on vcDNA: vcDNA=SeqID_89268; Strand=-; Position=2-607

SEQ ID NO: 162846 - protein, 422 aa, Heterodera glycines
  misc_feature (150)..(150): Xaa can be any naturally occurring amino acid
  Homolog annotation: Hit_ID=CAE71936.1; Match level="QueryCoverage =94%, HitCoverage=87%, E-value=2e-26, Identity=26%"; Hit description =Hypothetical protein CBG19000 [Caenorhabditis briggsae]
  Coding regions on vcDNA: vcDNA=SeqID_89269; Strand=+; Position=70-1339
MCHIETYIFMDFETTGLFDDGHNNPLTNPNRSNETARERAQRLDNLIKSDGNRFPKITEMAYMSVPRVLFLEGTEQMSARHLSSMSQDGEESIEPVQVVTNVHVRQLNPQLNDKERFKYEELQRKVPSVLLKQSDLTCKCTFAQEWPAIXHLLQTVPKPACLVAHNGLNFDFRILCHELRKSDLFRTHPIPEQVYFLDTLSCFYELEKEYNREIELTMENVDWTLVLSQFQPNSETVVATAEIEETVQQNGTASEGTQNSNGHKSTTVLHRLFDQKCSLTSNANGLPNSHKKINPILRHWSLALPLIMFMRKTHWSPAKRRCIDAKFFESNNRGEWNFNGNHARRLLCGRGNFKLENMFKRFFSIAPQFHRAQSDCEALLQVCLSYGMDFVKFVDRNCSYFPDCFYTSSKKTQTLNSLNTDL

SEQ ID NO: 162847 - protein, 271 aa, Heterodera glycines
  Homolog annotation: Hit_ID=NP_497763.1; Match level="QueryCoverage =98%, HitCoverage=94%, E-value=2e-68, Identity=46%"; Hit description =galectin (32.4 kD) (lec-4) [Caenorhabditis elegans] emb|CAA88850.1| Hypothetical protein C44F1.3 [Caenorh
  Gene Ontology: Mol. function=lectin; Cellular component=extracellular space; Biological process=cell adhesion
  Coding regions on vcDNA: vcDNA=SeqID_89270; Strand=+; Position=63-875
MDRSILVPYTSRLMSEISPGQTLNIHGNVNADAHRFEVNLLSNCVEIDAHMGSAPLHFSVRFDEGKVVLNSFAAGEWGKEERHSNPFTKGQPFDLRFRVHEDRIEIFANQKQITEFKHRILYTNVDHIQVRGDVTLSGVHWGGRYFELPFQANFHGTSLKSGQRLFVYGIPKGNFSINLIGANGDTLFHLNPRFSEKKIVRGSQKDGVWGEEEREGAFPLKKEQAADIAVFNEPYSLQIFIHGHHYCAFAHRVEAPNTDYNLVPVEGDHGL

SEQ ID NO: 162848 - protein, 295 aa, Heterodera glycines
  Homolog annotation: Hit_ID=NP_506153.1; Match level="QueryCoverage =99%, HitCoverage=15%, E-value=3e-53, Identity=38%"; Hit description =TEMO (5N87) [Caenorhabditis elegans] emb|CAA98425.1| Hypothetical protein C14C10.5 [Caenorhabditis elegan
  Coding regions on vcDNA: vcDNA=SeqID_89271; Strand=+; Position=2-886
SIVDEILLILGKPNAHDQLKGALYVLTNGKEQSLLLRQDWAVLLQLWPALCLVDNSENKQSIIQLTDLARDLIVSNFSSFQIEYYLPDSVMPLAEQLLSDYPGICHKPAWPLPDKQKLGEFREREAEICGRNRENFLALAEKLLTIAKDENLHWRQVDFAETLLSLLLRKDCDLPDGVVLHFFKRLTADTINTRKIAIDFCSSWLKIHRQKAVKEDVVIPDCPPGRGPGAQWPITFGIRSDNKFLLFDAANAPSNADKWDSANFHSKVYPGFYTWPSKFRVYAPPSEQKWANREF

SEQ ID NO: 162849 - protein, 407 aa, Heterodera glycines
  Homolog annotation: Hit_ID=CAE68086.1; Match level="QueryCoverage =93%, HitCoverage=72%, E-value=2e-60, Identity=38%"; Hit description =Hypothetical protein CBG13719 [Caenorhabditis briggsae]
  Gene Ontology: Mol. function=transcription factor activity; Cellular component=transcription factor TFIIH complex; Biological process=DNA repair
  Coding regions on vcDNA: vcDNA=SeqID_89272; Strand=+; Position=1-1221
VQNEFGRRPLLGYLASLSDELVQQLFESRPCVVAIFRLLPAFAQQSVLQLMFHKSSDWRSWTRSRFHLAMSSAVQLLFRLRILEGNSNGDFQINLDFRMNYVSSLLANPLELSNLKMHHLDEEKARKATKDLMGKSVERWESILCYLALPSEAAEKSVSETTKDLFQFIGLVRGRAKEPEISSIGFQFLLLSRSEQIWAYLIHYMRFIASKGEEVFPVLDFLLRLTLCINGDDALAQPLRLDPNWPEIVQAFVVTLRELGLIFIRKRKDGWFLLTPLMTQLSVAASAEPLEENAGQNGVALRNSPLTNSHATNGTKGGRNGDGFLIVETNYRVYAYTNSTLQLAILSTFTELLYRFQDIAIGVLSRDAVRRAFQTGITARQITQYLSTNIRQPPSARNNSQLSDSSV

SEQ ID NO: 162850 - protein, 211 aa, Heterodera glycines
  Homolog annotation: Hit_ID=CAE65897.1; Match level="QueryCoverage =99%, HitCoverage=8%, E-value=2e-47, Identity=47%"; Hit description =Hypothetical protein CBG11064 [Caenorhabditis briggsae]
  Coding regions on vcDNA: vcDNA=SeqID_89273; Strand=+; Position=3-635
MTTVGILGGSHQWFPADQPAELICAASVSSLVERVEWKRAGGDALPSDASDEEHRGVLRFDPFKPADHAGEYECNAYRNEEVIATSKVEVHPEGDTRPDLLHVDISPPQVRMVNAGDSIVLDCVVHGRSADEFTYSWSLARGGALIRELGRQSQLLVKSADPSNDYGIYRCEVESEDRETVGQAQAAVSVGFDSENNAVEAKFDGDSQAVL

SEQ ID NO: 162851 - protein, 171 aa, Heterodera glycines
  Coding regions on vcDNA: vcDNA=SeqID_89274; Strand=+; Position=3-518
AIHRDYESPFSGYIEMHEHTSAFCFTMVERDMRIFYDSGAGTPMGRYTLVLHGIVQGNYLGNDSGLGLPIFFFWFYWEGRSQTNRNGFFRSRLFLAKVQMLKVMALAWGKELLTSPIEVLLNVFFNRMDRSLTIKNLYVIIITENCLALGRCSIGSLQVSLIFLAELLQKK

SEQ ID NO: 162852 - protein, 291 aa, Heterodera glycines
  Coding regions on vcDNA: vcDNA=SeqID_89275; Strand=+; Position=1-873
ELIREPMFGNYYQFDGTFLESDVLEPTSVTALANDSKALLDARAKLWDEKFGNDKCTLQKIKEMGIDSLVKKIFDSSVSEEAMEENETEQKANGNVKLHVEVKRSGIKNKNGAEIYCSDNFPLVIDSSGLLNRFLEDEPIIRHAPDRKFGVWCAPRKYSIDGIQWKIVRIDPESKPKKSVPNGVSKMNGRSKECVSNGGQTDECISSSPSTVPSLPSTTVRNSPKLEEEEEKVDENELFEGLICSQNETHFLVFSPGRRWLGRLDKAKCGKDSASILGMWIQFKIKNKAGM

SEQ ID NO: 162853 - protein, 147 aa, Heterodera glycines
  Homolog annotation: Hit_ID=BAB10116.1; Match level="QueryCoverage =67%, HitCoverage=32%, E-value=1e-10, Identity=35%"; Hit description =late embryogenesis abundant protein-like [Arabidopsis thaliana] ref|NP_199244.1| late embryogenesis abunda
  Coding regions on vcDNA: vcDNA=SeqID_89276; Strand=+; Position=34-477
MHSKTALNCLLIWALAFIVVGFVQVTVQQPPNEQQREEDKGIFEKSKDTLSNAAEGTKDWLVGAKDSVADTFSSAKETATDKATETKDKASDYAESAREKASEGYEGAKQGAQERYESAKEYGKEKTEQLKEGGRKVAGEADRKTEI

SEQ ID NO: 162854 - protein, 161 aa, Heterodera glycines
  Coding regions on vcDNA: vcDNA=SeqID_89277; Strand=+; Position=200-682
MDGRGQRQRQPIWQWRRVCRACGRIAYVATHQCPRDQPADDGICRRCNGPHTVDEPCYIQPIDDGSVRQRASIAVDNDDSDDDDDDDEELPLRLCFFDAETSQDTPLQLNNRTVQKHVPLLIVAEVICERCLQAGISVSDGLGRRAPGCVCMTGMVRGQLF

SEQ ID NO: 162855 - protein, 141 aa, Heterodera glycines
  misc_feature (48)..(48): Xaa can be any naturally occurring amino acid
  misc_feature (91)..(91): Xaa can be any naturally occurring amino acid
  Homolog annotation: Hit_ID=AAH84352.1; Match level="QueryCoverage =100%, HitCoverage=18%, E-value=1e-22, Identity=41%"; Hit description= Unknown (protein for IMAGE:5078020) [Xenopus laevis]
  Gene Ontology: Mol. function=DNA binding; Cellular component=nucleus; Biological process=regulation of transcription, DNA-dependent
  Coding regions on vcDNA: vcDNA=SeqID_89278; Strand=-; Position=2-426
RLTERREVKRESKTEIVKLETKRERESKRKKGREMERKGRLTESEKKXVRKEIRERKRSRRESKRERENAMVKRNREEERERERDLLIVDXEKRESERQSQRERKRGRERERGRKEEREKEKEKGRERAREGETMKEWSDQ

SEQ ID NO: 162856 - protein, 371 aa, Heterodera glycines
  Homolog annotation: Hit_ID=CAE62369.1; Match level="QueryCoverage =100%, HitCoverage=59%, E-value=1e-141, Identity=68%"; Hit description=Hypothetical protein CBG06453 [Caenorhabditis briggsae]
  Gene Ontology: Mol. function=pre-mRNA splicing factor activity; Cellular component=nucleoplasm; Biological process=mRNA splicing
  Coding regions on vcDNA: vcDNA=SeqID_89279; Strand=+; Position=2-1114
KRKYLAGKRGFERPPFELPEFIKRTGIMEMRETMWEKEEHQSLKNKMRERTRPKLGRIDIDYQKLHDAFFKWQTKPQMTKMGELYYEGKELEAQMREKKPGTLSDELRIALGMPVGPNSNKFPPPWLIAMQRYGPPPSYPNLKIQGLNCPIPEGCAFGYHAGGWGKPPVDEYGKPLYGDVFGLTVPQVADDVDESRIERRHWGEIGSDEEESEEESEAEEDDEEGTGAVPPPPPEGGYVTPAPTEGFVTPSGITTVPGVETPSSTIELRKKRTMDESSLSGPETPAPPLYTILAEKKVDRVGTQLMATSHVYDIAAQRKIPVPNEGVEVSLNPEELEDQGGLERKYEEQLRKQAKIRMENEEDFSDMVAEH

SEQ ID NO: 162857 - protein, 220 aa, Heterodera glycines
  Coding regions on vcDNA: vcDNA=SeqID_89280; Strand=+; Position=3-662
ESYHIGRMEEEVILDDERGTKAAAFSPHSNGTISFGFQMLAIGAGFCMFIMLLALFAAVQHRKRRRSSGSVGSFRSPLIHKRSYGGHSTGGRLSQAIPPPPAPQYLRCSNQSLRKCSSPGGSDYSLSSSYSSSAASAHSLSPMSPYGHGTVAAGYQQQQQQQQSPFAALNFIPYGAAPPEGIEERHNANHNNKMMMMMNSNERKRHSINTTAAAEAALMG

SEQ ID NO: 162858 - protein, 196 aa, Heterodera glycines
  Homolog annotation: Hit_ID=XP_308624.1; Match level="QueryCoverage =72%, HitCoverage=16%, E-value=1e-18, Identity=34%"; Hit description =ENSANGP00000024486 [Anopheles gambiae]
  Coding regions on vcDNA: vcDNA=SeqID_89281; Strand=-; Position=1-588
MSSKPILGLCSRVSACGPIQASDFQFAERFLIELAQRDCTNLAKQRPEVRLRTDEQGLIRLETRLGNCAASDDWKNPILLPDQSPITRLIIRDRHEKMRHSGVEATLTSFLEKFWCPKARGTVTREVKKCLRCRRIQGPAFALPAMPSLPTDRVVRSAPFEHVGIDYLGPTMTRIVTGPTTAAHKAWIVLITCLAT

SEQ ID NO: 162859 - protein, 366 aa, Heterodera glycines
  Homolog annotation: Hit_ID=AAV68383.1; Match level="QueryCoverage =69%, HitCoverage=24%, E-value=2e-42, Identity=39%"; Hit description =antigen h11 [Haemonchus contortus]
  Gene Ontology: Mol. function=metallopeptidase activity; Cellular component=proteoglycan integral to plasma membrane; Biological process=pathogenesis
  Coding regions on vcDNA: vcDNA=SeqID_89282; Strand=+; Position=42-1139
MAKRAKSSSPALSLSHCQLYCSLLLFLLSILLSVLITFLLTRNAIRSQIERVNQNEAVTAKLVAPHGAIASLNAGHDITRLRMPGKSLLANARPRGNETADEAKEERPEKRKEPGAEELRLSGELFPIWYNLSLKVFVPGFGPEISPQLNLTFNGDLLLNFAVNRTTRTIELNALKLRFDPNNLMAYELKRTDNLATGDEVDRTPKVIGIRVDEAREKVFFDLDGDLTLGNHYALRIPYSGPIASKLSGLYLTTYTTLSGEHKCAAVTQMEPTDARRMVPSFDEPEFKAIFRLSVTHPKGSRAVSNAKELREQQQTEETEWIRTDFEETLPMSSYLLALVVSDFEFVEGNTSRGHRFRIWARKDDL

SEQ ID NO: 162860 - protein, 282 aa, Heterodera glycines
  Homolog annotation: Hit_ID=NP_499162.1; Match level="QueryCoverage =100%, HitCoverage=70%, E-value=1e-101, Identity=63%"; Hit description=ubiquitin-specific protease, possibly N-myristoylated (46.6 kD) (3K867) [Caenorhabditis elegans] emb|CA
  Gene Ontology: Mol. function=ubiquitin-specific protease activity; Cellular component=cytoplasm; Biological process=protein modification
  Coding regions on vcDNA: vcDNA=SeqID_89283; Strand=+; Position=68-913
MGTTASSQLEKELSADHVFSNEHFYGLINFGNTCYANSVIQALYFCKQFREKILAYKQTHKKSGMQRDNLLTCLADLFSNISSQKRRVGTIAPKRFVTKLKRENELFDNFMQQDAHEFFNYLLNAISEVLMEEKKKEQLGGSLRKANSAMAPNKRSFSANAKGQPNDLSAKQLTSTSDITGQQELTWIQEVFQGTLTNETKCLNCETISSKDEDFLDLSVDIEQNVSISHCLRNFSNMETLSGDQKYLCETCGSKHEAQKRMRIRKLPQLLAPHLKRFKYVE

SEQ ID NO: 162861 - protein, 312 aa, Heterodera glycines
  misc_feature (44)..(44): Xaa can be any naturally occurring amino acid
  misc_feature (268)..(268): Xaa can be any naturally occurring amino acid
  Homolog annotation: Hit_ID=NP_663384.1; Match level="QueryCoverage =91%, HitCoverage=29%, E-value=9e-27, Identity=30%"; Hit description =CTF18, chromosome transmission fidelity factor 18 homolog [Mus musculus] gb|AAH24142.1| CTF18, chromosome
  Gene Ontology: Cellular component=nucleus; Biological process=cell proliferation
  Coding regions on vcDNA: vcDNA=SeqID_89284; Strand=+; Position=7-942
MEVDKFHSSQTLIGKGTHKFTLWADKYAPNTFLDLLTEDETNRXLWLRLWDEYVFEKRGGKKWEGSHRRISQRNNANATSLWDTLEERDRTLFEMERPKGTDSRMPKQKILALFGPSGVGKTSLARVAAEQAGYRPVIIPISELQNMAELKSRLENATDCTSIDALFHNLSVSAASTGEAPPPHVGTRPCCFIVDAVEQASPEMVQFLCSWVRRSRASSVVCRCPVICTCASLWRAPALRELRANCLPVRVQRCNRQRMQRRLEFAIXEGVRIGRDQLDELFLSHGSDIRLCLNTLQFSTLKTHTSDRIQAN

SEQ ID NO: 162862 - protein, 477 aa, Heterodera glycines
  misc_feature (260)..(261): Xaa can be any naturally occurring amino acid
  Homolog annotation: Hit_ID=CAE74243.1; Match level="QueryCoverage =96%, HitCoverage=72%, E-value=9e-62, Identity=33%"; Hit description =Hypothetical protein CBG21928 [Caenorhabditis briggsae]
  Gene Ontology: Mol. function=zinc ion binding; Cellular component =nucleus; Biological process=transcription
  Coding regions on vcDNA: vcDNA=SeqID_89285; Strand=+; Position=50-1481
MSYDPYLSGTSSNARRLLGAPPSLSRDVITKSFVKMDCSHEASLGTECSGEESEAAKTADETEGELKPSQRDEEEENGTTGKRQQKRRKRRIRLTDIGPKAKKKAERREKPMAEKKNEVQDETNPTETHCQSSKMSPPLLEIENELGQNPPNKVKPSPHFFTPFQLLCDNLIRKFMAKDPEKYFAQPVTELEAPGYHSIVDYPMSFSTINDKIDNNMYLNLDQFKSDICLVSDNAMLYNNTGSVYFLAAQKLKVLAKYYXXEKYLLFLVYSLPFGKALTEEQLGIRLRRKEEQTPRQLKEKSGRERPLPFLSDSQKTEEILNTAPVKIKDRLTGRRPCQIAYLDNREGAFALNVLTETATTKLTLGDHVKPLGKGNPGICAPFEPRICSDYLVSYTNPGPFASFAPHFDLTWATMSKRDSDLLLSCYGDRDNVTDATALRQMDSNVGTPTSDVGESMVNDLTDHEHLGTITSLGNTS

SEQ ID NO: 162863 - protein, 339 aa, Heterodera glycines
  Homolog annotation: Hit_ID=CAE62132.1; Match level="QueryCoverage =58%, HitCoverage=32%, E-value=1e-52, Identity=55%"; Hit description =Hypothetical protein CBG06176 [Caenorhabditis briggsae]
  Gene Ontology: Mol. function=protein binding
  Coding regions on vcDNA: vcDNA=SeqID_89286; Strand=+; Position=22-1038
MASQKQLREKKCSEVEDKTNDGTEREMTNSTSNFYKLTKTDSQSSVEQNVANLERNLSSNLVVPSTSGRCANRRDEEETSNPKNAQLSEQTKCTPEQHEEKTDECPPKESNVRLTNKICKRRMNKVENVAHLNGRGGIGALGWQATLPSARERLTFMLMNDTLADIFFIFRGSDGSVQRIPAHKFVLSGGSAVFEAMFRFGDSSDCANCILELELVDVEREAFEALLTFLYTDDIQSITKESVMSILYTAKKYAVPTLESACVNFLENCLNGDNAFMLLSKARFYDEQRLANQCLEIIDEETQEAMKSDDFLSIDHETLCVVLGRDTLRVKELTLFKAS

SEQ ID NO: 162864 - protein, 221 aa, Heterodera glycines
  Homolog annotation: Hit_ID=NP_505876.1; Match level="QueryCoverage =94%, HitCoverage=26%, E-value=1e-48, Identity=41%"; Hit description =zn-finger, RING and Zn-finger, B-box (5L798) [Caenorhabditis elegans] emb|CAA98481.1| Hypothetical protei
  Coding regions on vcDNA: vcDNA=SeqID_89287; Strand=+; Position=7-669
EIADEEEGICTDTVQQNPLHCLRCFSPIKCPVRLPCQHYFCRLCIADEKCCVICGHPIGCSELVEDKVLNYVLESSSEVTETCANCDQISQPMFFCDTCHQPLCSGCRETTHKAKIFSTHHIFELEERGRLRSRPICPQHNEPFILFCLDSKSLMCIECFNSSSLERRGHFVNIELAHKICCDKLEKNALNLRIFQEELREQIELRKRLTDELSKNSENLR

SEQ ID NO: 162865 - protein, 487 aa, Heterodera glycines
  Homolog annotation: Hit_ID=NP_504712.1; Match level="QueryCoverage =79%, HitCoverage=95%, E-value=1e-160, Identity=71%"; Hit description= calponin (44.4 kD) (5H246) [Caenorhabditis elegans] gb|AAB04989.1| Hypothetical protein T25F10.6a [Caeno
  Gene Ontology: Mol. function=troponin C binding; Cellular component =cytoskeleton; Biological process=muscle contraction
  Coding regions on vcDNA: vcDNA=SeqID_89288; Strand=+; Position=57-1520
MADEASEYTDEEYTYEYEDEEEPEANENAAPAPVEELPKDEPKKAGEDAAAKKKETSPPKSLKKEGSPPKSPKKEASPKKEASPKKEASPDKSPVGKRKGRTPRQSMEEKPKVEKAKAKTEEKPIEEGEAADGLAPPAVDRTETKSPEPGYQPMTKSVQKKMALYAGGKPSKHDKAKLMKSEGIIPIQAGTNKYASQRGMTGFGRPRDVVDKVKSENLAEITDEEKLASLKGSTWLQSGTNKFASQKGMTGIGTPRDVNYRTKGTGGAGEVPEDKARLTDGIVPLQSGTNKLASQAGMTGMGMPRIIDVRKTVDQDRESQGFIHLQMGTNRFASQQGMTMFGMPRREVTQYKDEVRGQMPHDEGTISRQTTGWKEGASQQGMTGFGAFRNNTQVQLQAQDQRSQGMIPYQMGVNFLDSQAGKTAFGMPRRTYTPYVDDSHEELPADITRRPEVPFWTGMEVDFANQQGMLAFGTPRDVRGEYVRRMW

SEQ ID NO: 162866 - protein, 146 aa, Heterodera glycines
  Homolog annotation: Hit_ID=CAE73105.1; Match level="QueryCoverage =93%, HitCoverage=10%, E-value=1e-30, Identity=47%"; Hit description =Hypothetical protein CBG20485 [Caenorhabditis briggsae]
  Gene Ontology: Mol. function=protein binding; Cellular component =synaptonemal complex; Biological process=transport
  Coding regions on vcDNA: vcDNA=SeqID_89289; Strand=+; Position=2-442
FVCGNSLVCETPDHARQLAYGTDGRSERFRAVALDGTQFQPNGVISGGGADLKAKAKKWDENAIRKLKDRRTALQEELQKLHRTGKRELDVEMKREQITSLEARLRFTQQELKKSENETLRRLEQDAEVESAEPETIEVIKAELTI

SEQ ID NO: 162867 - protein, 60 aa, Heterodera glycines
  Coding regions on vcDNA: vcDNA=SeqID_89290; Strand=-; Position=1-180
FLTFNLKKKKSSRVERDRDRGGKSRVFQVPVPIPVFGKTEIPVPGFFAVPVEKLCPGPDF

SEQ ID NO: 162868 - protein, 311 aa, Heterodera glycines
  Coding regions on vcDNA: vcDNA=SeqID_89291; Strand=+; Position=188 -1120
MPPKPIPTKAANVEQSQQQENMHLSFSDDIDLDAIRKDFERLNPLPSAANESEVFARLRSTAFRLHTQNAFWCQFDLSEETKAKMEQCRMGNNPMAFVKRCIVLQELKKSTEAMEQNNEQMPSQIQLDFHVFTLPYVLPHYACLSLFDGEIHHGAIATSKQRAKISCAAVLCEVLVKMGWADVKRAKKRKNSDGEKALKKKKRKGENGQTEDVEEGNVRLSHQFLLTLHPNESLDPTTHFFLASSAKSPIQLLKEVADRESFEVSYTKGMDEYFNKHIVHVNTIEGTAEGRSEVSISEAKCSAARKGIDAL

SEQ ID NO: 162869 - protein, 142 aa, Heterodera glycines
  Coding regions on vcDNA: vcDNA=SeqID_89292; Strand=+; Position=1-429
SDRRTERNALPRHLFELFRGTVNGKCQFVENVSVRSCRADPSISPTVRHFAKPFHRRFGPLHYNRRFGTLGDQQLARQKGRTPAEWGRRARDSSAHRSLGGRVGDDGTGNGIPFSLDNPVPFHRFLPMVGTKTVNWSDWTSR

SEQ ID NO: 162870 - protein, 157 aa, Heterodera glycines
  Homolog annotation: Hit_ID=NP_741633.1; Match level="QueryCoverage =63%, HitCoverage=20%, E-value=7e-18, Identity=44%"; Hit description =OSMotic avoidance abnormal OSM-6, protist raft-like and intraflagellar transport protein component IFT52,
  Coding regions on vcDNA: vcDNA=SeqID_89293; Strand=+; Position=2-475
WQIGCCWCFFSAFPIAFHFSLPPFLFLGSVQMFTDLSSPKKTMQRHLFEVIVKFLSDGFELNQIDDAEPNISDFHPIPDNLQLSNQPKMCLQESEIEQTFTGDIIKLFGTSLSSISLEHWPEAIRAENELICTFARRERFWTLAKHFCAVSDRRREK

SEQ ID NO: 162871 - protein, 511 aa, Heterodera glycines
  Homolog annotation: Hit_ID=CAE72644.1; Match level="QueryCoverage =100%, HitCoverage=82%, E-value=1e-146, Identity=53%"; Hit description=Hypothetical protein CBG19850 [Caenorhabditis briggsae]
  Coding regions on vcDNA: vcDNA=SeqID_89294; Strand=+; Position=2-1534
MDEAKNMALLFFVDHLMQKGGQRTIHDLSCQFGARGFTDEMRQAVGTTQEGLYEFLSQYPSLFTLQDGDKVQLKGYGDGDEGRTHLSHIPPSGRQRDYVAEAVQFFVAKLEKFGPEMQVKSLLGHRSQAAPEVRLVHGRHLKEFADFLANQTNHFTVEGDRVKLKHMPEPNGTDAKQFLDEEGRPLVGHRAKLAAVDFMRGVLEQNEEMPIPLDIFYRRFCDRFPHSIRQEVATNPKELLLFLKLNRHVFFIRSNKVQLVRNRPGDEHGSESGRSTGEDGGSSDRSATSPAENGGGCAPPRAPTDGMSPETNALFPLNRDNLHRVQIVQTLQQAQEAVRCLRVDLDSVPSSAFLALDFKLLSFGSVPSADLPLVVLAVVASPLRLVVFDLAQSDKVLSESGLRTLLEDDSVLKVTHDVQRIAPLLANRWDIRIGRLFDTQIAHSVIQHDKFSKPLGDLRAISFVNLQRVYFPQSLVLSDVPPRKLSQTPNWSDRPLSTDLLLAACEECHCL

SEQ ID NO: 162872 - protein, 212 aa, Heterodera glycines
  Homolog annotation: Hit_ID=EAA48249.1; Match level="QueryCoverage =91%, HitCoverage=31%, E-value=1e-20, Identity=33%"; Hit description =hypothetical protein MG10312.4 [Magnaporthe grisea 70-15] ref|XP _366092.1| hypothetical protein MG10312.4
  Gene Ontology: Mol. function=ATP dependent RNA helicase activity; Cellular component=nucleolus; Biological process=ribosomal large subunit assembly and maintenance
  Coding regions on vcDNA: vcDNA=SeqID_89295; Strand=+; Position=42-677
MVKVEKQISSGTSDDPLSLVDSIIKDHFLNDLKHKQLTPVQACTLRHMLANFDCVVQSPTGTGKTLAFMLPTLQILVQKKLTGAGEGKEQPTSVSDSCRILALVVAPGRDLIVQLFHLFSPLCKKLGLSTLKLHGAGGKQKKKSPKKHMKGKCILICTPGSFEHFLEKEAELKQYLKHLEVLIIDEADRYSDRESMSSLTTLLAALPKQRRT

SEQ ID NO: 162873 - protein, 233 aa, Heterodera glycines
  Homolog annotation: Hit_ID=CAF99704.1; Match level="QueryCoverage =90%, HitCoverage=25%, E-value=8e-26, Identity=35%"; Hit description =unnamed protein product [Tetraodon nigroviridis]
  Gene Ontology: Mol. function=chaperone activity; Cellular component =mitochondrion; Biological process=cell organization and biogenesis
  Coding regions on vcDNA: vcDNA=SeqID_89296; Strand=+; Position=1-699
KQRSDSLLLPNDPNSYLAVLNQVTWSDFIERIVPTGTVSNVHLKVSRGPERRISKKALVTVMPGARWPDGKMLPRMFFVNVPDIGRVEQEIRKAEVDAGLAPEHWSNIQWMQPGPMSLIIPSLVIFALFVLPLVFLGRMMTGSKMGNFSESISSMMGHRLRIYDPALKDGKLKIKFRDVAGLHEAKVEISEFVDYLRRPNKYTRLGARLPKGALLTGPPGCGKTLLAKALGAE

SEQ ID NO: 162874 - protein, 208 aa, Heterodera glycines
  Coding regions on vcDNA: vcDNA=SeqID_89297; Strand=+; Position=13-636
MPNIRQQKKHEMVDSDDERNEYGSTKAEPSPLTDQSATSMMTHNSSNAAEGGHIISSNGGAQICGGNGTVPMPLISCWSPCSASSAGDPLLWYETDKCQYCNQKCRKPRRLLDCLHYVCEECVPEQCLLLDNLEPDEIRCPNCSQVEMSSISGQSTESSRVEICIKHKEKFTRVCLSCARLLCVNCEQQLSLPTAQVNNITNVVAVPQ

SEQ ID NO: 162875 - protein, 209 aa, Heterodera glycines
  Homolog annotation: Hit_ID=XP_319335.1; Match level="QueryCoverage =100%, HitCoverage=28%, E-value=3e-37, Identity=40%"; Hit description= ENSANGP00000006147 [Anopheles gambiae]
  Gene Ontology: Mol. function=carnitine O-palmitoyltransferase activity; Cellular component=mitochondrion; Biological process=fatty acid beta-oxidation
  Coding regions on vcDNA: vcDNA=SeqID_89298; Strand=+; Position=60-686
MAEARNIAALSFTVTHDGISVSYDQEVLRDIWHAFSRSYKKRIAKFENDFFAGIFPANIRSLAIVIFLVAALNVSFGNDKTPFNLADKLNYYVFSNITTLDVLSRTLSIAFAGCILWFLLVQFFRLLLKWFLMYKGWMYEAPHSGQISQTTKLWFYVLHKIAAYEPMTHSFQGALPHLPLPSLASTMERHLRSMRPILSDRDYDELVEL

SEQ ID NO: 162876 - protein, 198 aa, Heterodera glycines
  Homolog annotation: Hit_ID=CAE62746.1; Match level="QueryCoverage =85%, HitCoverage=63%, E-value=7e-34, Identity=40%"; Hit description =Hypothetical protein CBG06909 [Caenorhabditis briggsae]
  Coding regions on vcDNA: vcDNA=SeqID_89299; Strand=+; Position=565 -1158
MGMGGGWEVTIRADKLVCFHGKGNFLSQLFPLSLVVDGNEYGSLEHYYQACKLFSLVSAQAAQELRSIKDPLKTKTRTRDLLFSMGVSKARIDAWKNSHGVQVILHAMRHKFSDQHQELCDQLLATEDALLVQAYDKDSFFAAGMVEKRVREWAKENEGKVLKFPSELSDETFKHIPLVGISMEGISLHSLRHFRFDL

SEQ ID NO: 162877 - protein, 117 aa, Heterodera glycines
  Coding regions on vcDNA: vcDNA=SeqID_89300; Strand=-; Position=106-459
FFFFTAKLVPTVAFSCLALSNNLTIFETQTKKILDQKWLSLFSHFLPQNWYQQLPSLVWPYQTILRYLKRKQKKFLTKNGYLFFLIFLPQTWYQQLPSLVWPYQTILRYLKRKQKIS

SEQ ID NO: 162878 - protein, 264 aa, Heterodera glycines
  Homolog annotation: Hit_ID=NP_505065.1; Match level="QueryCoverage =77%, HitCoverage=36%, E-value=1e-45, Identity=44%"; Hit description =serine palmitoyltransferase 2 (62.7 kD) (5I501) [Caenorhabditis elegans] gb|AAA92303.1| Hypothetical prot
  Gene Ontology: Mol. function=serine C-palmitoyltransferase activity; Cellular component=mitochondrion; Biological process=gametogenesis
  Coding regions on vcDNA: vcDNA=SeqID_89301; Strand=+; Position=25-816
MRSEHSLYKLNLGRCANNFFLHKISSLGDCSLLHTSPVRENGHTKLTVNGFHCPPKETKNWEEKKDKTSQEKEDGEKGKANGQRKKEQIEPKAWEEEEEFEKCHSLVAFSVYFTWFVLTVHAYFREFLRRYGIESNKAAVERTELRGFAPLVDSFEAIYARNCYMRVRDVFERPIGGVPGAKVKLVDRQTDDFCWTFKFPGSQTEVINVSSYNYLGFAQSDGPCAEMAAKAVEKGGLSTCGSALEGGQCSIQSDLEKLVAKFLG

SEQ ID NO: 162879 - protein, 208 aa, Heterodera glycines
  Homolog annotation: Hit_ID=CAE58428.1; Match level="QueryCoverage =97%, HitCoverage=34%, E-value=6e-66, Identity=61%"; Hit description =Hypothetical protein CBG01560 [Caenorhabditis briggsae]
  Gene Ontology: Mol. function=protein binding; Cellular component =filopodium; Biological process=regulation of cell cycle
  Coding regions on vcDNA: vcDNA=SeqID_89302; Strand=+; Position=2-625
QPICLPNIRLFLVQLLRGLAYCHAKRILHRDLKPQNLLISKNGELKLADFGLARAQSVPTKSYTAEVVTLWYRPPDVLLGSTDYSTHIDMWGVGCILFEMLARKPMFPGNKVEDQLDLIYRKLGTPTPQLHPRLCALPAFNCHPRHLRRHSPRALVCLASRITHERADLLQRLLAYEDKNRLSAVEAMRHPFLKCFPEAIFGLPDTES

SEQ ID NO: 162880 - protein, 100 aa, Heterodera glycines
  Coding regions on vcDNA: vcDNA=SeqID_89303; Strand=+; Position=744 -1043
RGKYFQKAKGRKACRIASPTMPIPTAAPVSFCTWNDHSNSVFVSRGGSLNVSCPWPGLYEPSQFSAFLYELGERFNRRLLGHALIIFYQLFAPTNKRFIM

SEQ ID NO: 162881 - protein, 260 aa, Heterodera glycines
  Coding regions on vcDNA: vcDNA=SeqID_89304; Strand=+; Position=36-815
MSSLSEEVKKVKQAANIPPPAVCNRFVEGFSSEDVFETRPSSHGGAFAFRYDVEMVQLTRNKSLTSGGGDDGKNGLLRGVCFELIKFVHDSTQGFGQAAQFVYDNRKILFTNKRIEQFVLEIDTEKVQGIVRDFLRGSSVKIEIKPCQTDKHELDLNDVFSSISRRPDEQSDRSLRTFLEMLTSQPFLNAGTHDIIGAGRLFKRQICKELEDGIVTREGIAKGVRVIDNNGEPKAALVADVKTCAFFASRNLEEIVMEMV

SEQ ID NO: 162882 - protein, 213 aa, Heterodera glycines
  Homolog annotation: Hit_ID=NP_495035.1; Match level="QueryCoverage =87%, HitCoverage=48%, E-value=6e-54, Identity=55%"; Hit description =DeHydrogenase, Short chain (42.1 kD) (dhs-5) [Caenorhabditis elegans] gb|AAK68388.1| Dehydrogenases, shor
  Gene Ontology: Cellular component=integral to membrane; Biological process=fatty acid biosynthesis
  Coding regions on vcDNA: vcDNA=SeqID_89305; Strand=+; Position=17-655
MPFSAFFSAFSLWCPSVLCSAQFGFALLLPLSYLLYRLTRTSLALFQAIFVYRLAPFVYAPKLSTFRHRWTVVTGGTDGIGKAYTFELARRGLRKFMLIGRNEQKLERVKEEIESEFPGSSVLLFQFDFFDAVNAEDADRLRRELAKLDIGIAVNSVGVGRELMERFGERPEADRQLFRVNAIGAAEFISAVLPLMERCGGGHLVVLSSSQGF

SEQ ID NO: 162883 - protein, 195 aa, Heterodera glycines
  Homolog annotation: Hit_ID=NP_496571.1; Match level="QueryCoverage =98%, HitCoverage=94%, E-value=4e-21, Identity=37%"; Hit description =myeloid leukemia factor like (2M384) [Caenorhabditis elegans] pir||T26510 hypothetical protein Y17G7B.17
  Coding regions on vcDNA: vcDNA=SeqID_89306; Strand=+; Position=71-655
MFGGGGDPFRNPFDQMHQQMRQMDNMMNSMLGDAWDMLNGFGMMGPPFPNHPMLTDGLNRQNQALRRQQPPQHHFGPDTMMSPFGGFGLFGGMMQQMQNMHNHAISDPNSVVFSESTMVSYDGNGQPKVVQHSTRKAGDVKETRNALRDGVREEMTVGHSIGDRSHVIEKKRDKDGKVRQQQKFFNLAEDEAEDF

SEQ ID NO: 162884 - protein, 195 aa, Heterodera glycines
  Homolog annotation: Hit_ID=CAE66579.1; Match level="QueryCoverage =87%, HitCoverage=23%, E-value=3e-57, Identity=69%"; Hit description =Hypothetical protein CBG11896 [Caenorhabditis briggsae]
  Gene Ontology: Mol. function=calcium ion binding; Cellular component =mitochondrion; Biological process=glucose catabolism
  Coding regions on vcDNA: vcDNA=SeqID_89307; Strand=+; Position=80-664
MSASNSRKAFVPFSNALRRRKLLFGFGVGTVIGAGFYYMDKNNERRFKRDKDVYFVSNAHAATVDTKAALNKRPSGSLPTRAELLKGMRDEEFDILVIGGGATGAGVALDAQTRGLKTALVELDDFSSGTSSRSTKLIHGGVRYLQAAIMKFDREQYKMVKEALFERANLLEIAPHLSYPLPNMLPIYKLWQGPY

SEQ ID NO: 162885 - protein, 168 aa, Heterodera glycines
  Coding regions on vcDNA: vcDNA=SeqID_89308; Strand=+; Position=159-662
MPPLGRCEWNVNQRARLIQLVRQFEIIWLPVGATDKSKISACRRAAFEQIRQHFLEDGFTVDDLASQWRNLKDIFYKRLKEMNRRIQMGEVNVKPPWRFFDALSFLAGSKAMDENRREAFGESANEVFADEDGVIEDNLSNFGLMDELNQPSAEEGLLNLVKAVKEEQ

SEQ ID NO: 162886 - protein, 171 aa, Heterodera glycines
  Homolog annotation: Hit_ID=CAE75494.1; Match level="QueryCoverage =88%, HitCoverage=27%, E-value=5e-70, Identity=80%"; Hit description =Hypothetical protein CBG23499 [Caenorhabditis briggsae]
  Gene Ontology: Mol. function=regulator of G-protein signaling activity; Biological process=G-protein coupled receptor protein signaling pathway
  Coding regions on vcDNA: vcDNA=SeqID_89309; Strand=+; Position=138-650
MNVQQQQPVTSAYPQQGNFAEEKQLHPNHNVYRKMERLISLMLNVDDGVPIKTVKSFLSKLPRIPSVFTGQDLVGWLLQNVDIADLGDALHLAHLLASHGYVFQIDDHVLTVKNDNTYYRFQTPYFWPSNCWEPENTDYAVYLCKRTMQNNAHLELEDFEAENLAKLQKMF

SEQ ID NO: 162887 - protein, 192 aa, Heterodera glycines
  Homolog annotation: Hit_ID=NP_496333.2; Match level="QueryCoverage =88%, HitCoverage=32%, E-value=1e-20, Identity=31%"; Hit description =putative protein, with at least 4 transmembrane domains, a coiled coil-4 domain (2L132) [Caenorhabditis e
  Gene Ontology: Cellular component=integral to membrane
  Coding regions on vcDNA: vcDNA=SeqID_89310; Strand=+; Position=566 -1144
MTFLDHVDKDFFKAWPFGVLKTIHWFAPLAILITLGNSRYIYDSLGFVLFTAWNAFIVSLITWLCYIFRLNRKAFQFGAGYLFVPFALIDFIVSLLAVLCFGISSLICAIALLDSLEYSLGHIISYLLATVFCLISGSAFGYFAILVYRLIPNGQFRHLMTMVIEGHQTTTLDGQGGVGPVNAGPPPGRPPV

SEQ ID NO: 162888 - protein, 246 aa, Heterodera glycines
  misc_feature (116)..(116): Xaa can be any naturally occurring amino acid
  misc_feature (127)..(127): Xaa can be any naturally occurring amino acid
  Homolog annotation: Hit_ID=P90682; Match level="QueryCoverage=99%, HitCoverage=44%, E-value=1e-107, Identity=75%"; Hit description =Catalase emb|CAA71618.1| catalase [Ascaris suum]
  Gene Ontology: Mol. function=catalase activity; Cellular component =peroxisomal matrix; Biological process=determination of adult life span
  Coding regions on vcDNA: vcDNA=SeqID_89311; Strand=+; Position=2-754
SNGSPIHNKNAVLSVGPHGPMLMQDVVYLDEIAHFDRERIPERVVHAKGAGAHGYFEVTSKDMAEHCKAAMFSEIGKRTPLFIRFSHKGGESGSADTARDPRGFAIKFYTEEGNWXLVANNTPASQXIFFIRDPFLFPNFIHSQKRNPATHLKDPEMMWDFWTLRPESLHQVMFLFSDRGIPDGFRFMNGYGSHTFKLVNKTGEAVYCKFHIKTRQGIKNLSPQKALQLSAEDPDYAIRDLYHAIA

SEQ ID NO: 162889 - protein, 353 aa, Heterodera glycines
  Homolog annotation: Hit_ID=NP_503978.1; Match level="QueryCoverage =98%, HitCoverage=65%, E-value=3e-23, Identity=25%"; Hit description =udp-glucuronosyltransferase family member (58.0 kD) (5D982) [Caenorhabditis elegans] gb|AAB65381.1| Hypot
  Coding regions on vcDNA: vcDNA=SeqID_89312; Strand=+; Position=56-1114
MALAKLKTSVFAIFVVLFVSIDKCRCTNILFTFFHDTGSHFQSVFPLMQKLASRGNNVSVLDTVYEQDHSLEIHHFRALLPKHHNDETSKRHFANDIWSRRLSATDLALYFGTCDKELGILMQNHSQKIVQLFDTNWDVIVLDDLFWSFGFAFATLSHRRWHLAPNERKEPHIVAYATAQSGLNSHNSIRATSQFWVGRPTLCPLYPTDSNDVFSPDRFVHRIYALLDIIQEAVAVNIFALHFLMPNIAKFGVPNFSFTEFYSRSQLFLHDSIDRLGLPVTTAADIFGVGAHCKTPKDSSALSAKIKQFLEDPSSKGTIYIAFGSHIDWKFAPRKFLDDFVTVFRKLPQYRFI

SEQ ID NO: 162890 - protein, 250 aa, Heterodera glycines
  Homolog annotation: Hit_ID=NP_502813.1; Match level="QueryCoverage =96%, HitCoverage=55%, E-value=4e-72, Identity=54%"; Hit description =putative cytoplasmic protein of bilaterial origin (49.4 kD) (4P789) [Caenorhabditis elegans] emb|CAB09005
  Coding regions on vcDNA: vcDNA=SeqID_89313; Strand=+; Position=3-755
SDSPPNIDPEKGFQLSAGVGHSKHSSTPNGRVRDVDELAEEVPGESDVSDEEDAESPLPSVHAQMGLFCHTNPEVAPASMWTSKNVQEFKDNIKKEGTEGVLKIGHGETVTVRVPTHPEGNSLVWDFATDYYDLGFGVYFEWTIAETNQVTVQVEESEDELEDDQAAGGEGRTGGQTAGDDVEADAAKRQKDANKPRVDEIIPTFRRDCHEEVFSGSHVYPGQGIYLLKFDNSYSLWRSKTLYYRVFYSK

SEQ ID NO: 162891 - protein, 181 aa, Heterodera glycines
  Coding regions on vcDNA: vcDNA=SeqID_89314; Strand=+; Position=2-547
GMQELSNIRLATPPPQPPPVLRNVPLPPVTSNVSEMMVDRNYIAKGVSPPKFKPIGELSDYQQQINGSQEVSNIRFATPPPQPPPVLRNVPLPPVTSNNNEMMVDRTCRNNTAKPSASDFGLAASSSSTSTGEEDDAQLFGRRVVKFLRSLNNGRRRRRACIGIEQVMIEFETEEEEEQKR

SEQ ID NO: 162892 - protein, 157 aa, Heterodera glycines
  Homolog annotation: Hit_ID=CAE56085.1; Match level="QueryCoverage =96%, HitCoverage=29%, E-value=1e-52, Identity=56%"; Hit description =Hypothetical protein CBG23668 [Caenorhabditis briggsae]
  Gene Ontology: Mol. function=sphingomyelin phosphodiesterase activity; Cellular component=integral to plasma membrane; Biological process=sphingomyelin metabolism
  Coding regions on vcDNA: vcDNA=SeqID_89315; Strand=+; Position=102-572
MQCAYRFNVATLNCWLLPHPWPIGSKHKQFRLQKLIDELKNSRFDVIALQEVWSEKIFLQIAHELNGFFPHSHYFHSGFTGSGTCVISKHPIVSTLLHRYSLNGFPHHVHRGDWFGGKIVGMVEIMVEQYRVAFYTTHLHAEYNRKNHLFLPHRISQ

SEQ ID NO: 162893 - protein, 166 aa, Heterodera glycines
  Coding regions on vcDNA: vcDNA=SeqID_89316; Strand=+; Position=2-502
PTELQFLDESVADEEAVLGSEITLHQHKMEKEEETTFEEHDDMTAPKSVFGSSSFGCNKREHCKSDDEDYCHSACEEGPTEETKNHSPPEESSKEKEGEQAEDTGTGMTDIVEAEALTEPGTPLRQMDETTNSQRNEEETCPIREEEQQTKTEENSTEATEEGRRS

SEQ ID NO: 162894 - protein, 197 aa, Heterodera glycines
  misc_feature (169)..(169): Xaa can be any naturally occurring amino acid
  Homolog annotation: Hit_ID=NP_499187.1; Match level="QueryCoverage =97%, HitCoverage=52%, E-value=8e-68, Identity=67%"; Hit description =solute carrier family 25 member 1 (34.2 kD) (3K943) [Caenorhabditis elegans] emb|CAA80178.1| Hypothetical
  Gene Ontology: Mol. function=citrate transporter activity; Cellular component=mitochondrial inner membrane; Biological process =mitochondrial citrate transport
  Coding regions on vcDNA: vcDNA=SeqID_89317; Strand=+; Position=3-593
SIPKSAFRFGTFEFLKGHAVDERGNLSPFMRLACGLGAGISEAIFAVTPMETVKVKFIHDQTLEKPRFRGFMHGMGVIMKADGPRGFYQGLTATMAKQGSNQAIRFFVMETLKDWYRDGDPNVPVSKPVVGLFGAIAGAASVYVAFAIVTILFFYFRPFHFRFYFSLPXFSYGNTPIDVVKTRMQGLEASKYKTLST

SEQ ID NO: 162895 - protein, 152 aa, Heterodera glycines
  Coding regions on vcDNA: vcDNA=SeqID_89318; Strand=+; Position=174-632
THFQFDFAHFAFVWKCADNCWRNARAKNQQNVSTISDHYRMFLAINSDHYRMFLAIITTAISFAITAFPELVGKVLRFIRAGFDTHYFLDLWPYTLALISIWLYPIVYRAYKFVQQNEEHKNGGPYGQNAKVINQQYAKVVPMPLPNAEMIG

SEQ ID NO: 162896 - protein, 201 aa, Heterodera glycines
  Homolog annotation: Hit_ID=EAA10890.2; Match level="QueryCoverage =91%, HitCoverage=90%, E-value=4e-43, Identity=50%"; Hit description =ENSANGP00000017070 [Anopheles gambiae str. PEST]
  Gene Ontology: Mol. function=RNA binding
  Coding regions on vcDNA: vcDNA=SeqID_89319; Strand=+; Position=106-711
MTTEEPISGGQPNTPPIPAIELSYPVSVIYCGECSMPVEYCEYSGKFERCQQWLERNLPDLAEKQMKIGAGDGKAAEEGNGEETEAKKHQKRGGKGLPKASGGGKGSKEQSAAVPRITLKTEVRSKNKAVTVVKGLTTCGVDLKTASKFFANRFACGCSVTVGSADELVIQGDFKDKLFVEIPKKWGVNEEVIEDLDDQKK

SEQ ID NO: 162897 - protein, 283 aa, Heterodera glycines
  Homolog annotation: Hit_ID=CAE66840.1; Match level="QueryCoverage =90%, HitCoverage=35%, E-value=1e-29, Identity=33%"; Hit description =Hypothetical protein CBG12210 [Caenorhabditis briggsae]
  Gene Ontology: Mol. function=DNA helicase activity; Cellular component=alpha DNA polymerase:primase complex; Biological process =DNA replication
  Coding regions on vcDNA: vcDNA=SeqID_89320; Strand=+; Position=3-851
SPVNSAERLHISLLEYINETFKNEDFYHFLSVQYRSNELIQKWSNKIFYDNKLVTYQLTKNIHLRQIINQQNDLSSGPLSSKQKFLIDGPLVLIDTDKGISDSKWQKVYSLFKLWYPLSFREGQNEHTHSFHNIGEAFCAVLHLHALNLFGGLDLSKIGCITPYSAQAEKIQKLMAMGRDEGPRFEVSSVDAFQGQQREAIVMSLVRNNKMRDIGFLREHRRTNVAITRAKRQFLLIASSRMLNVDRLLRELYGVIRTDGLVGGPDALLPIAHEIWQCHLERK

SEQ ID NO: 162898 - protein, 218 aa, Heterodera glycines
  Homolog annotation: Hit_ID=CAB88203.1; Match level="QueryCoverage =100%, HitCoverage=93%, E-value=1e-104, Identity=68%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_89321; Strand=+; Position=3-656
ETHIVLGIGTVCSLLAIIATVVTLPSLYSEMNQLSNKVRDGVEAFRVNTDSAWTDLMDVQVVVAPPSKARDNPFSSIFRAKRQLPGHCHCGPPQRPNCPPGPPGPAGPPGQPGQPGSAGLQGQPGAPGQPAPPCPPQNIPCPLCPAGPPGSPGTQGPPGQQGAPGQPGAPAPGGGQGPPGASGPQGQPGQPGRSGTPGQPGQPGNNAVIYNTIPGPEG

SEQ ID NO: 162899 - protein, 311 aa, Heterodera glycines
  Coding regions on vcDNA: vcDNA=SeqID_89322; Strand=+; Position=17-949
MKRKRTSNTSSRPIKQQSVARSSGSFFTPWGQRKSARFLKMGRRIYLCNDVLYDIFADIDIVRLGLGIAPVSAHFDALVDSCFKTKKRKLRRLWIRQAILTMRRSIQRKTDKAELVNYEGKQLPFAKAPPPNGIVGFKSISISYLDADAMAFLEHSRPLFDRVGIVFKCDGAIKGRGKEFVQIWPLFRANIVKMALSQRLLVRLRRLCGPTVLCACANLRFVNVDDENFAMKSPADDAAGASPGQALLKWLYTPREDGQPKVLTMKEKPKKMMDDIAKEFSTATTPVSFIVRFRKSSWDAYDDAALKPFEL

SEQ ID NO: 162900 - protein, 271 aa, Heterodera glycines
  Homolog annotation: Hit_ID=CAE60769.1; Match level="QueryCoverage =99%, HitCoverage=84%, E-value=1e-101, Identity=62%"; Hit description= Hypothetical protein CBG04457 [Caenorhabditis briggsae]
  Gene Ontology: Mol. function=UDP-N-acetylglucosamine-peptide N -acetylglucosaminyltransferase activity; Cellular component =perinuclear space; Biological process=protein folding
  Coding regions on vcDNA: vcDNA=SeqID_89323; Strand=+; Position=84-896
MSSEQALKAKQLGNEAYKRKEFATAHKYYDEAIKYEPTNIVFYSNKAAVFFEEGKYDECIEMCGKAVEVGRENRADYALVAKAYARMANSYKMKDDPKKALHFYEKALSEHRDPDIVKKHKELAKEVKEMEQKAYIDPELSDKEKNLGNQLFKKGDYPGAMRHYNEAIKRNPDNAVLYSNRAACFTKLMEFQRAVDDCDLCLKKDPSFVKAYIRKGAALSAMREFGRAQKAYEDALQMDPSNHEAMEGLRTCMQSNEENPERARERGLAGP

SEQ ID NO: 162901 - protein, 616 aa, Heterodera glycines
  misc_feature (214)..(214): Xaa can be any naturally occurring amino acid
  Homolog annotation: Hit_ID=ZP_00041351.2; Match level="QueryCoverage =99%, HitCoverage=77%, E-value=1e-149, Identity=47%"; Hit description= COG0620: Methionine synthase II (cobalamin-independent) [Xylella fastidiosa Ann-1]
  Gene Ontology: Mol. function=5-methyltetrahydropteroyltriglutamate -homocysteine S-methyltransferase activity; Biological process =cysteine metabolism
  Coding regions on vcDNA: vcDNA=SeqID_89324; Strand=+; Position=1-1849
PALPMKKWFDTNYHFIVPELSTDQSFSVGLNKPLNDFLLAKNALNLVTKPVLVGPVTFLHLSRVGERKELATEEQQKVHNLKLLPSLLPHYVKVVQSLVDAGAKWIQIDEPIFALTFAENEAPAYYDAFRQTARALQQVTAKKAHLLFATYFSSIAKNVQIVKDLPEGTGIHIDLVRAPEQLDPVLSALPANCFVSLGLVDGRNVWLSPLRQSXNALRVVQKLAPGRVLVSSSCSLLHVPYSTKTEKRSAEMPKTVATGMASSKIIHWLSFGIEKCEQLVTVAKMINGGDCAKELAENDALLKDHSVSPLIHNGTVKERVTAIEASGVESYFRKSPYEQRIVQQKACLQLPPLPTTTIGSFPQSATVRAMRAKFKAHKMADADYWAFINAETERCIRMQEDIGLDVLVHGEFERNDMVEYFAEHLHGFCVTSNGWVQSYGSRCVKPPVLYGDVQRAGPMTVAMTKFAQSLTKKPVKGMLTGPMTILKWSFVRNDQPQKDTLFQVALALRDDVAELEKEGINCIQMDEPAFREGLPLDPAQHNEYLKITVQAFKISTGCVADSTQIYSHMCYSDFGDIFTHIAELDADVLCIECSRSDLSLLSCFDRFGYPLMVGPG

SEQ ID NO: 162902 - protein, 217 aa, Heterodera glycines
  Homolog annotation: Hit_ID=NP_508280.1; Match level="QueryCoverage =100%, HitCoverage=19%, E-value=1e-100, Identity=80%"; Hit description=atp citrate lyase (XC101) [Caenorhabditis elegans] gb|AAB00585.1| Hypothetical protein D1005.1 [Caenorh
  Gene Ontology: Mol. function=ATP citrate synthase activity; Cellular component=citrate lyase complex; Biological process=ATP catabolism
  Coding regions on vcDNA: vcDNA=SeqID_89325; Strand=+; Position=3-653
VFQTVLEALEYPQIKAIAIIAEGVPENQTRKLIKVARQKGVTVIGPATVGGIKPGCFKIGNTGGMMDNILASKLYRSGSVAYVSRSGGMSNELNNIISHNTDGVFEGVAIGGDRYPGSTYTDHILRYQDEPKSKMMGLLGEHGGEEEYKIVQALKEKRINKPLISWCIGTCADHITSEVQFGHAGASANAVKETAAHKNAALKSAGAHVPDSFDDFG

SEQ ID NO: 162903 - protein, 206 aa, Heterodera glycines
  Homolog annotation: Hit_ID=AAR09676.1; Match level="QueryCoverage =43%, HitCoverage=53%, E-value=9e-09, Identity=39%"; Hit description =similar to Drosophila melanogaster Su(var)205 [Drosophila yakuba]
  Coding regions on vcDNA: vcDNA=SeqID_89326; Strand=+; Position=43-660
MSSFPKAVNIKIEHNNSFSDHDYCYKESAVEEMDEENRSFFVDVENDDEYDDEYNARGRKRRSVKQPDFFMINNKANNSNKKTSKARPRKSESKRGKSGEKKVKYEVEYIWGKRTDKLRPDKVEYRVYWKGYPIEKSTWEPEDNLRLCQESIDRYEQREMYFNDKGEKEMHSKGLKKDNTAGNGVKVVVVNGAKPLKQILPTMQAP

SEQ ID NO: 162904 - protein, 274 aa, Heterodera glycines
  Homolog annotation: Hit_ID=CAE66560.1; Match level="QueryCoverage =27%, HitCoverage=25%, E-value=1e-11, Identity=42%"; Hit description =Hypothetical protein CBG11872 [Caenorhabditis briggsae]
  Coding regions on vcDNA: vcDNA=SeqID_89327; Strand=+; Position=19-840
LIMPCQLPNEIATVTDDVFSYMCNLAMEKCSKKADKKKASCGGAAMRKRLLIKNFVAQMLAQDRHSRELSSPTSDCSSHLNQTFDESFDFPSCQSGANAVDQFGDDMEMDAIGEEVPSNATNDAFLCLDQPSSLLTDLDDVSCDPQQQCHSSRNRKRPWSLVFSADATATADSMPMPSLCSMGVVVDQYNHHHLSNTNNSVVDMFTAATSAQHHHFINSTANNINNNGVLHSSAPPLLSPLCCGMLQMSPFGSATAAGEAMLFNGAGGGAGGVG

SEQ ID NO: 162905 - protein, 225 aa, Heterodera glycines
  Coding regions on vcDNA: vcDNA=SeqID_89328; Strand=+; Position=3-677
FEMLRKLSDAYQKALLTPIWNLVQQILDENCRVFFGTLNGVFRQLEDREIAANCLISGRGGIKGQIRLAQGAEKVLSVSGQIHSPSIEPDRMEVHDLGNVTAGSSSTGRSLHTLCTFASVGAANDYVPAGVVTAPLALSGSKINCIGRSLVVFQEGRSALGSGVIGYAKDTRIFSDEFDEIFRNLITQYRNVNVSDCWLVLRDGTSSNPDCRAFFDMLDEILATE

SEQ ID NO: 162906 - protein, 145 aa, Heterodera glycines
  Coding regions on vcDNA: vcDNA=SeqID_89329; Strand=+; Position=10-447
MAKFLSGIMFCALLALLDTTSAWKREFLRMPKSNEIGTADDSSESGKNLKSQSELIASMLPKRKTLQCYYGVDMFRTNNGTEGGAFEEVKCDDEDYDRCLIGKCKGQNFVEVRKFCATKDGCAAFGCAVEEELECKTCFGELCNL

SEQ ID NO: 162907 - protein, 276 aa, Heterodera glycines
  misc_feature (271)..(271): Xaa can be any naturally occurring amino acid
  Homolog annotation: Hit_ID=XP_309756.1; Match level="QueryCoverage =98%, HitCoverage=98%, E-value=7e-44, Identity=36%"; Hit description =ENSANGP00000012467 [Anopheles gambiae]
  Gene Ontology: Cellular component=cytoplasm; Biological process =autophagy
  Coding regions on vcDNA: vcDNA=SeqID_89330; Strand=+; Position=17-844
MDSKSNDFEARRTVWDSKVPVEFTLDNSESVLASHQSCFMMLSRVSYFPVYLDKALKVLTSGDASEEQLLNVWLQFDGQILRWHYPIGVLYDIYHGNAGDGQTTPWPITVHLKNFPDELIRCRTKETLKFCFLQSLKEACQLKLGSNIAASMTKDEHGRLFDGLCNDRFNDFWMVNDKLMGLRSSSGEEQFSTIPARFYESSYSFRQLLLHSKKQLDDGNMGEVLLIDALHKVFPDYAIETDFEAVTHGILLPLNTPLIWLARNLVYPDNXAHIVI

SEQ ID NO: 162908 - protein, 214 aa, Heterodera glycines
  Homolog annotation: Hit_ID=CAE58471.1; Match level="QueryCoverage =78%, HitCoverage=47%, E-value=5e-18, Identity=33%"; Hit description =Hypothetical protein CBG01611 [Caenorhabditis briggsae]
  Coding regions on vcDNA: vcDNA=SeqID_89331; Strand=+; Position=13-654
MSDQQQSKIVGTAGAVCALGTVAVLLLLLVQRKKKQRQCNTEEYVRAGHVEQLYIYPMKSCRGNKVDWLDCGERGCAHGEQRDRHFLVVDSARQNQMLTGRIYPKMLLISVHVEQGVLRVDFPNRSSPVEVNLKEVEERNVVLRAKLFSDLQTDGLDCGDEVATALDEFLLEGKAAATTTEDGSGGGTVGRKLRLIYYGGDWLYTERDPKPDKS

SEQ ID NO: 162909 - protein, 301 aa, Heterodera glycines
  Homolog annotation: Hit_ID=AAS38911.1; Match level="QueryCoverage =91%, HitCoverage=85%, E-value=8e-17, Identity=24%"; Hit description =similar to Leishmania major. Ppg3 [Dictyostelium discoideum]
  Coding regions on vcDNA: vcDNA=SeqID_89332; Strand=+; Position=30-932
MSPNTLCSIVCLLLVCNFIWADDEHRSFAEELVRRLRRSHGYSVGYGGNCACSSSAYPATASHTSYTAPKQTSYSSYSCSGSGCGHQAYQPPQKTSYHWCTGTACNKAQAVAHPVPVSSNSYKSSCTTCGSSSHQQHYSTVTETKTVYPVKTYSWCTGTACGAQAQPVAPAASGGGTSISTGSSCSSGTCGQQKQQVQPVAPVQPAAPASTSSCSGGSSCGAAAQEVQPAAESSSGSSSSGGYDTQETQPSGSDSSSGACSGASCGEAAQPGASSSSSCSGASCGQAAQPAASSSSSCSGG

SEQ ID NO: 162910 - protein, 137 aa, Heterodera glycines
  Homolog annotation: Hit_ID=AAH78189.1; Match level="QueryCoverage =57%, HitCoverage=74%, E-value=1e-12, Identity=44%"; Hit description =Zgc:100870 protein [Danio rerio]
  Coding regions on vcDNA: vcDNA=SeqID_89333; Strand=+; Position=9-422
MSVWCRFPFRKAFLSSAFFPKCVSASDFAFVPTSSALRSFRLFVDGPMSSDALSADRVAAVLRSKFPATDGSAVHVEDTSGGCGAMFHVRVESPQFSGVSRVNQHKMINEVLRSEIRDMHGITIETKAVDRGRDSGQ

SEQ ID NO: 162911 - protein, 208 aa, Heterodera glycines
  Coding regions on vcDNA: vcDNA=SeqID_89334; Strand=+; Position=3-626
TVVLSEPLLSSSTVGRRSTTVMTTVVDPSLGSTSHQQHSPSTAETKQHAPTAGDNKKGGGGAKANPFRNHPSLLNSITTDSDAHHLMENCNTVTNESCADVAETEPNDEVFAILNETTSTTAENELGEGLSANNGASSVVTLGEEAASASTTNASTFATAPLMSKSGIWLGARDTDGALYFYHRDTREARWDLPEGEELLIIDKSNVG

SEQ ID NO: 162912 - protein, 257 aa, Heterodera glycines
  Coding regions on vcDNA: vcDNA=SeqID_89335; Strand=+; Position=1-774
ILRHNLAAIRDIVYTVEFALGELVESLGRISLDVREVRQQNQLRQLARPVKTTLAMLKRVRHSLDSTGWSLSTLSRSAGTYAGQDALDQFVAMLPQLPKDCYKLVQWVYSLSVWRDLPRGGATSVFLPPSSGTVPFHAKMHPPPPPPAPFPQQRPSSPSSSLLNYYSSESIEDEQNNNNEDSFRNWATVPMNGSLTDRHGGQAKGGRMFVEQQQWHPQNGGALANDVMDGGESTSSTSSILTAEERTGGGGRRKKQW

SEQ ID NO: 162913 - protein, 75 aa, Heterodera glycines
  Coding regions on vcDNA: vcDNA=SeqID_89336; Strand=+; Position=3-230
GKGGEVFLSRERHVHCLERAVTHLEESESALALWNDPAMAALSLRLCLSAVGEIAGRVVHEQVLDSIFSQFCIGK

SEQ ID NO: 162914 - protein, 184 aa, Heterodera glycines
  Homolog annotation: Hit_ID=NP_492133.1; Match level="QueryCoverage =97%, HitCoverage=79%, E-value=2e-63, Identity=66%"; Hit description =dual specificity phosphatase 1 (25.6 kD) (1I234) [Caenorhabditis elegans] emb|CAB01700.1| Hypothetical pr
  Gene Ontology: Mol. function=protein binding; Cellular component =cytoplasm; Biological process=MAPKKK cascade
  Coding regions on vcDNA: vcDNA=SeqID_89337; Strand=+; Position=103-654
MAPLCFQVNEYYAQISELVPGLYICGVTGLTPANMKAFRIELIVNATREVPNLKSLGHIQRMKLWVEDTTDEDLFPHFDIVADQIHAVIQDRGAVLVHCVAGVSRSAAICLAYLLKYRTRSLRAAYHLMCSKRPMVRPNLSFWRQLIHYKQQGKGNVGSVRIVRDEAQPDKLLPDVYLKIVIPD

SEQ ID NO: 162915 - protein, 138 aa, Heterodera glycines
  Homolog annotation: Hit_ID=AAA29908.1; Match level="QueryCoverage =94%, HitCoverage=85%, E-value=3e-16, Identity=42%"; Hit description =p48 eggshell protein
  Coding regions on vcDNA: vcDNA=SeqID_89338; Strand=+; Position=78-494
MKLSLFLLALFGIVLVFVAAGDYGYGGYGKKKYGSGSHEYGYGKKKHYKKKHYDSGSYEYGKGSYGKKKYGDYGGKKYDDYGGYGKDYGYGGYGKKYSYGSGSHEYGKSYGGYGKSYGGYGKSYSAYGKAYDDYYKKY

SEQ ID NO: 162916 - protein, 123 aa, Heterodera glycines
  Coding regions on vcDNA: vcDNA=SeqID_89339; Strand=-; Position=1-369
EWTSSHFTDNSTDVNQLSSIDSFGLLPDAFGDFDGPNATAGQVLSKWLHIPRKDGLPTQLRCKDFNEQADFGWVNIFKEVATRDGPCHHFFRLIPIHFTVHAPSMPIMPFEFNWQLTLRFLSN

SEQ ID NO: 162917 - protein, 118 aa, Heterodera glycines
  Coding regions on vcDNA: vcDNA=SeqID_89340; Strand=+; Position=360-713
MRNKQKKDEEEAQQKLQSEQIVPIPQHEQIQQQPSTFQTPTDWRNSPTDDEDEIEILGCYEIERTNISTEVEGNNEQNSDNNNIITTNCELVHSTNNENNQEDAEKESHEENTVVDVA

SEQ ID NO: 162918 - protein, 196 aa, Heterodera glycines
  Homolog annotation: Hit_ID=CAE66008.1; Match level="QueryCoverage =84%, HitCoverage=70%, E-value=1e-58, Identity=66%"; Hit description =Hypothetical protein CBG11199 [Caenorhabditis briggsae]
  Coding regions on vcDNA: vcDNA=SeqID_89341; Strand=+; Position=46-636
MFVRCFILPFISLTFFVSFCTAMRRNPSDYDQSRVPSNLRIISWLLGVWRSEHDGKAMFPTIPKFTYGEEISIALSDTRMNGLPAFNYSAFAWSAHDQDELHSENGYITVSGGKVMLTTVMNNGFVTVEEGPAGGSRIRFKLVDIGRISFSRDLPVHDLVREWTQLDHNHFEARLDMETLTHGMQEHTVIVYTKVM

SEQ ID NO: 162919 - protein, 217 aa, Heterodera glycines
  Homolog annotation: Hit_ID=NP_500655.1; Match level="QueryCoverage =80%, HitCoverage=11%, E-value=1e-09, Identity=29%"; Hit description =putative protein, with at least 10 transmembrane domains, of ancient origin (4F594) [Caenorhabditis elega
  Coding regions on vcDNA: vcDNA=SeqID_89342; Strand=+; Position=3-653
AMKQTAPITKTGLAKRSLRSGYAFSHCSGFGELIAKGTMFKNIEHLRIPSFQFALHHDSHSNHRSRRHSLSRVHPALSSANSSTGHSSDQQILNPIVLNSDNDDGEGAAVSSMTHFSPTSSNMTTTTTLGGGNAKSQQKIRPILPPPPAVPNSSRLHQSQHHSHQYRHHKHHQPTSTRRSTIESLVIEQPPSADDEKDDGMTPMITQIVVVKEEDEE

SEQ ID NO: 162920 - protein, 257 aa, Heterodera glycines
  Coding regions on vcDNA: vcDNA=SeqID_89343; Strand=+; Position=48-818
SCPFIPAFPIKMSQFGPAFAVNANNPYAHFKCCCATFNIKDHAQFCGVLSFALFLCLVLISMMLFGSLSLFYIFVGVVVYILLMKTLFGVVNKLSLLFYIFFEAIQIGFYLALMLYIIVPLLFLEIPRRNCRNVEINSEICDEPRNRSEDYVELLLFVSLLASIKLHFARVFAHFYRYLTWNEQCSVHRAQYINGRGIHITMDQPQFAASFSPYYGWDTHTVKGCDRRGRQNETNNPNQLPITELPPTYAQVIGQNA

SEQ ID NO: 162921 - protein, 202 aa, Heterodera glycines
  Homolog annotation: Hit_ID=NP_500214.1; Match level="QueryCoverage =94%, HitCoverage=60%, E-value=1e-57, Identity=61%"; Hit description =ATP synthase mitochondrial (32.4 kD) (4D261) [Caenorhabditis elegans] gb|AAK68562.1| Hypothetical protein
  Gene Ontology: Mol. function=hydrogen-transporting ATP synthase activity, rotational mechanism; Cellular component=proton -transporting ATP synthase, central stalk (sensu Eukarya); Biological process=ATP synthesis coupled proton transport
  Coding regions on vcDNA: vcDNA=SeqID_89344; Strand=+; Position=31-636
MFRVAKTPAHYQQSVRSFATLKDISIRLKSIKNIQKITKSMKMVSAAKYAKAERELKGARTYGEGAQFFVSNITAGDQTEPVKVAESVVESAGRKRLLILMSSDRGLCGSVHTSVAKTAKNIMANKPADVDYKIVCIGDKAKMLMQRLYAKEFLFTVNDIGRSPPTFQDASIAANAILSSGYEFDGGEILFNRFKTVVSFET

SEQ ID NO: 162922 - protein, 238 aa, Heterodera glycines
  Homolog annotation: Hit_ID=CAH93155.1; Match level="QueryCoverage =91%, HitCoverage=33%, E-value=3e-93, Identity=76%"; Hit description =hypothetical protein [Pongo pygmaeus]
  Gene Ontology: Mol. function=enzyme regulator activity; Cellular component=mitochondrion; Biological process=mitochondrial translocation
  Coding regions on vcDNA: vcDNA=SeqID_89345; Strand=+; Position=7-720
MLHGWRVFASCSKSVLKSPSLQSGGYGLSRRLKSDEVRGPVIGIDLGTTNSCVAVMEGKQAKVIENAEGSRTTPSIVAFTKDNERLVGAPARRQAVTNSENTLYATKRLIGRRFDDPEVQKDIKVVPYKIVKASNGDAWLEAQGKLYSPSQIGAFVLMKMKETAESFLGTSVANSVVTVPAYFNDSQRQATKDAGKIAGLHVLRVINEPNAAALAYGLDKGEDKVIVVYDLRGGTFDI

SEQ ID NO: 162923 - protein, 229 aa, Heterodera glycines
  Homolog annotation: Hit_ID=CAG04372.1; Match level="QueryCoverage =79%, HitCoverage=30%, E-value=1e-43, Identity=50%"; Hit description =unnamed protein product [Tetraodon nigroviridis]
  Gene Ontology: Mol. function=3-phosphoinositide-dependent protein kinase activity; Cellular component=plasma membrane; Biological process=signal transduction
  Coding regions on vcDNA: vcDNA=SeqID_89346; Strand=+; Position=27-713
MSSHTETMKSSSNGSDWPFCSDRMKMMQKPAKLNLNEAGPAPPSPCSVKTPLEGVSTEDTLQRLRPKEDQAEQSPTGTLATRTPKDFFFIKVLGEGSFSTVYFAKEVTTGDEYAIKVLLKSEIRREAKVRYVLREKDIMAALTYVHGGHPFVIRLYCTFQDNDRLYFALAYAKHGELLDWLRRLGSFDEAGTLFYASETLCALEFLHRCKGIHRDLKPEDILVGADWHI

SEQ ID NO: 162924 - protein, 185 aa, Heterodera glycines
  Homolog annotation: Hit_ID=NP_780438.1; Match level="QueryCoverage =97%, HitCoverage=6%, E-value=3e-10, Identity=32%"; Hit description =serine/arginine repetitive matrix 2 [Mus musculus] dbj|BAC41104.1| unnamed protein product [Mus musculus]
  Coding regions on vcDNA: vcDNA=SeqID_89347; Strand=+; Position=88-645
MTSSRSRTRRTTTNAASTAAAGRSRSRSTHTGRRSASRRAIGNRATGRSSSVRNASRRVSRRVSSARKSSRRRRRIVARRATPKKRSKSAKKRGRGRPRKPQRGRSARAQRRITITQGVLDVPGHGQMTEAELREIFMAGTTANEPTNRPLGGAEVITTTNANNRTTGGNATSSSSSSPSLSDSV

SEQ ID NO: 162925 - protein, 203 aa, Heterodera glycines
  Homolog annotation: Hit_ID=NP_490770.1; Match level="QueryCoverage =99%, HitCoverage=90%, E-value=1e-53, Identity=51%"; Hit description =phosphoglycerate/bisphosphoglycerate mutase (24.9 kD) (1B166) [Caenorhabditis elegans] gb|AAK21514.2| Hyp
  Coding regions on vcDNA: vcDNA=SeqID_89348; Strand=+; Position=36-644
MVKTLWIVRHAEREDNINSNWQKNANPQKLKSDNSPLSSRGIKQATELAERFSNVQIDHIFASPFERTVQTATFLISQRKIPIKVEPGLAEALYLCESPPGFEESAELRRRFPLVDSEYRSIYEKPMPREGFGDESCIQRIRQTLEEILRRYNEATSIVFVSHGSPIGALHEVLVGDWNYVGQATVSKFVETGDGTGKFRQEF

SEQ ID NO: 162926 - protein, 122 aa, Heterodera glycines
  Homolog annotation: Hit_ID=XP_310184.1; Match level="QueryCoverage =100%, HitCoverage=4%, E-value=4e-52, Identity=77%"; Hit description =ENSANGP00000005472 [Anopheles gambiae]
  Gene Ontology: Mol. function=ligand-dependent thyroid hormone receptor interactor activity; Biological process=embryogenesis and morphogenesis
  Coding regions on vcDNA: vcDNA=SeqID_89349; Strand=+; Position=3-557
LISGEQSPRWTREDLLRYSEPKLGYTRDSVGFLNFVEVLMGFNSAERKAFLQFTTGCSSLPPGGLANLHPRLTVVRKVGSGDGSYPSVNTCVHYLKLPEYSSAGILRDRLLAATAEKGFHLN

SEQ ID NO: 162927 - protein, 320 aa, Heterodera glycines
  Homolog annotation: Hit_ID=CAE75409.1; Match level="QueryCoverage =99%, HitCoverage=58%, E-value=1e-155, Identity=81%"; Hit description= Hypothetical protein CBG23399 [Caenorhabditis briggsae]
  Gene Ontology: Mol. function=Pol II transcription elongation factor activity; Cellular component=DNA-directed RNA polymerase II, holoenzyme; Biological process=establishment and/or maintenance of chromatin architecture
  Coding regions on vcDNA: vcDNA=SeqID_89350; Strand=+; Position=1-960
CVNEIIAQLIVAQKEGRDVNLNKLKCEIASKYGIKTQPKLVDIIGAVPPQFKELLLPKLKAKPVRTASGIVIVAVMCKPHRCPHINFTGNICVYCPGGPDSDFEYSTQSYTGYEPTSMRAIRARYNPYLQAVGRISQLQSLGHSIDKVEFIVMGGTFMSLPEDYRDYFIRNLHDALSGHRSCNVKEAVAYGEHSRTKCIGITIETRPDYCLPRHLDDMLSYGCTRLEIGVQSTYEDVARDTNRGHTVKAVCECFHMSKDTGYKVVIHMMPNLPNVDIERDIEQFIELFENPEFRPDGLKIYPTLVIRGTGLYELWSANKY

SEQ ID NO: 162928 - protein, 107 aa, Heterodera glycines
  Coding regions on vcDNA: vcDNA=SeqID_89351; Strand=-; Position=1-321
CAYINYRPSFYLFNHPIIRQHILLIPLLPLKSVATTRPTSNASANSRANDCANATGGDACLSELASENGRERGVYGTDRHRHHCKTAPQCLSVCPATCSPTICNGRR

SEQ ID NO: 162929 - protein, 203 aa, Heterodera glycines
  Homolog annotation: Hit_ID=NP_492746.1; Match level="QueryCoverage =33%, HitCoverage=15%, E-value=2e-14, Identity=56%"; Hit description =mothers against decapentaplegic homolog 6 like (1L81) [Caenorhabditis elegans]
  Coding regions on vcDNA: vcDNA=SeqID_89352; Strand=+; Position=25-633
MPLTVDVSFLQSGGYPRTFTLSLAMKVTDDERKAKRRFLNLMRGFDTEDLDVLRKAIESGGINIKQCAPGPPMDLVEEREESISSGEEAEQEPEMMPGCSATIVSTRPRHSIKQMERDRILFQRQRFPTVASIHHQPATSSASGVLVPIPTTDGAAAVPGSAGGYQRRYSTHREQQLQQRNRRDSKFSRRLAVYTSPPEDSAA

SEQ ID NO: 162930 - protein, 314 aa, Heterodera glycines
  Homolog annotation: Hit_ID=BAC06575.1; Match level="QueryCoverage =98%, HitCoverage=96%, E-value=1e-161, Identity=64%"; Hit description= As37 [Ascaris suum]
  Gene Ontology: Mol. function=structural constituent of muscle; Cellular component=sarcomere; Biological process=striated muscle contraction
  Coding regions on vcDNA: vcDNA=SeqID_89353; Strand=+; Position=18-962
MPDGKAPHFPQQPVARQNDDGSLELECFLEANPVPEIKWFYENNELKPTKRFSFRLDNRGSEAFSAILQIKDLADSDTGAYRCAIVNPFGKGNANFNLKLTGFSSPTFIEKPQISSRDDGRVMIMEFKAKSILKPTFVWQKGDEIVAESDRYKIILKETGNHEYYAALEIVEPKKEKDAGQFVCTAKNESGKLTATFSVKFEVPQGAPTFTRKPQILQKTSDSGDPAIVFDIGFQADQNPEVIWLNPKGKKMKESSRIKFGLTPDGGANTYTAQLELKNYKAKDSGTYTCNIKNDAGEANVELTLNIEDDEVKQ

SEQ ID NO: 162931 - protein, 213 aa, Heterodera glycines
  Homolog annotation: Hit_ID=CAE67580.1; Match level="QueryCoverage =100%, HitCoverage=24%, E-value=4e-83, Identity=67%"; Hit description= Hypothetical protein CBG13113 [Caenorhabditis briggsae]
  Gene Ontology: Mol. function=electron transporter activity; Cellular component=integral to plasma membrane; Biological process=thyroid hormone generation
  Coding regions on vcDNA: vcDNA=SeqID_89354; Strand=+; Position=1-639
REYLPKVLGSSFAATIGPYRGYDPNIDPTVANEFTSQAYRFGHGMIQEFYPRLDSAGRTIPSGGFAFVDGTLHSDHFIFQGGPDPIIRGMMSQQLKRPQRLTRTITEQMFGTTDLGTINIQRGRDHGVPSYMRFRQLCGLSTATTFDQLSREIMSVEARQNLQRIYGTPDRIDLFVGGMLEDPVVRGLVGPTVACIIGPQFARTRDGDRFYFE

SEQ ID NO: 162932 - protein, 148 aa, Heterodera glycines
  Coding regions on vcDNA: vcDNA=SeqID_89355; Strand=+; Position=1-447
AFGSQDGVVSFVDIRQVNRQLPVAFKVSQHPISRIKFHPIFANNFFSSSDSGLIHWDASALAQGANLNPPTNGREMTGHESAADMRTTGENEHTNIWLSPHASTSVNLRVLIDEDPLLLSSFDVVNGAIVAASHTAELVFMSNDKFTN

SEQ ID NO: 162933 - protein, 249 aa, Heterodera glycines
  misc_feature (243)..(243): Xaa can be any naturally occurring amino acid
  Homolog annotation: Hit_ID=NP_001002618.1; Match level="QueryCoverage= 95%, HitCoverage=83%, E-value=1e-62, Identity=51%"; Hit description =zgc:92263 [Danio rerio] gb|AAH75969.1| Zgc:92263 [Danio rerio]
  Coding regions on vcDNA: vcDNA=SeqID_89356; Strand=+; Position=45-791
MSVFLNSVRRLSVISSAMKFLRQQEAIDIDRELFTSCGFSVDQLMELAGLACAQAIGETFEKGNVLILSGPGNNGGDGLVCARHLKHFGFSPSILCPKPSQNDLMQRLMLQLECLGIPFVESFPDPNSIEKFNFLVDAIFGFSFRPPIREPFNKILKQMESVQNRVPIVSIDIPSGWDVEKGPPDEKSGLPILSPLALISLTAPKQCAQFFKGEYHFLGGRFVPPALVQKFGLENMPPYEGSXQFMRLN

SEQ ID NO: 162934 - protein, 90 aa, Heterodera glycines
  Homolog annotation: Hit_ID=CAE71408.1; Match level="QueryCoverage =86%, HitCoverage=9%, E-value=1e-23, Identity=61%"; Hit description =Hypothetical protein CBG18318 [Caenorhabditis briggsae]
  Coding regions on vcDNA: vcDNA=SeqID_89357; Strand=+; Position=1-642
ASPCFLPFANFLPSDSEFGEDTSFGMRPVLPGSGQEFALALGGNRPREQFTIIILAYNREQVLLNTLERLNNLPYLNRVLVIWNDVHRLP

SEQ ID NO: 162935 - protein, 322 aa, Heterodera glycines
  Homolog annotation: Hit_ID=NP_496723.2; Match level="QueryCoverage =96%, HitCoverage=99%, E-value=1e-116, Identity=63%"; Hit description= spermidine synthase (35.0 kD) (2N99) [Caenorhabditis elegans] emb|CAB60361.2| Hypothetical protein Y46G5
  Gene Ontology: Mol. function=spermidine synthase activity; Biological process=cell organization and biogenesis
  Coding regions on vcDNA: vcDNA=SeqID_89358; Strand=+; Position=8-976
MNLLHKEWYTEFSPDDAQRIAGTGDGCSKMMKLDGAELSGAWTGQAFSLNVDKILFSERSKFQDVLVFKSKTFGNVLVLDGAIQTTDRDEFAYQEMLAHLPMCSHPDPKQVLIIGGGDGGILREVLKHPSVERVVMCEIDEMVVQVAKKFLHGLATSFDSPKLQLHIGDGFEFLKGHEAEFDVIITDSSDPIGPAESLFGKSYYQLVRNALKEDGVLASQAESIWLHLPLISKLMNCARDLFPSVAYASATVPTYPSGTIGYLLASKRQMHVLSVPLRPLNDSECQSMGLKFYNRLLHSASFVLPNFAEEALNQQQNSGRDQ

SEQ ID NO: 162936 - protein, 291 aa, Heterodera glycines
  Homolog annotation: Hit_ID=AAN15806.1; Match level="QueryCoverage =79%, HitCoverage=89%, E-value=4e-70, Identity=55%"; Hit description =putative esophageal gland cell secretory protein 26 [Meloidogyne incognita]
  Coding regions on vcDNA: vcDNA=SeqID_89359; Strand=+; Position=106-978
MLFLPLSLLLFLLHRPFANALGCMSAVCAAGGPSPSSHAVNRIIRCASDSFCGHFRALRRNDQFVEAVDLSCPEFAVVRAPFDGEISAYRPMGGSRAQEGTKGECVPDQGVRIDGRGQWQGYHALISSVQLFRFGGEVNAGQRIGVARDLECAGTRPKPRGDENFVRMELFREDKPIDPTHHLIDCMCTGQICETNRANALEGLPFKFDSRFNGVRGWEIVCPNVRPEEPNSSGESPEQSDNRQTMSPKIYSPIEGEVIGRVRLSASSNSQSYSGCANEGIFVVGTGKWTD

SEQ ID NO: 162937 - protein, 166 aa, Heterodera glycines
  Coding regions on vcDNA: vcDNA=SeqID_89360; Strand=+; Position=88-588
MIGMMNNAGMDGPAEFFAGRRDLCELLVPASSLAAVDGQAQPHAPPPKVFEPTQQKKLSYTGSGRRLVDGKPEVNETPEEMWRKAMLRATCTRAVKEMLGEKRRKSSKLRQLISSQSGSIRNFFGTAKNLRHRTTGANQPQQQVEAGGKVISSRTEGPGKPDRMII

SEQ ID NO: 162938 - protein, 197 aa, Heterodera glycines
  Homolog annotation: Hit_ID=NP_497875.1; Match level="QueryCoverage =98%, HitCoverage=59%, E-value=1e-45, Identity=48%"; Hit description =leucine carboxyl methyltransferase (37.8 kD) (3F433) [Caenorhabditis elegans] emb|CAA84295.1| Hypothetica
  Gene Ontology: Biological process=leucine metabolism
  Coding regions on vcDNA: vcDNA=SeqID_89361; Strand=+; Position=48-638
MEAEADFDSGLLSTEVSHRRRSASVSEDYSVQKTNDDATECKFVAAQLGYYSDRFIPAFIHACNSEKPHHRDPEITRGYWARTNAITSMVVQFVQLAGPSTQILNLGAGFDTLYWRLKDAGLSFYKFVELDFSSVTAKKICQIKRNKNVNLTEFFSKTVEEKQHSDLHAGDYHLIGTDLRQIREFDGKLATADLDFS

SEQ ID NO: 162939 - protein, 177 aa, Heterodera glycines
  Homolog annotation: Hit_ID=XP_417810.1; Match level="QueryCoverage =92%, HitCoverage=87%, E-value=1e-31, Identity=46%"; Hit description =PREDICTED: similar to archease [Gallus gallus]
  Coding regions on vcDNA: vcDNA=SeqID_89362; Strand=+; Position=3-536
SVSPPPPPSSNECPPPLVPCQYEYLDHTADVQLHAWGQSLGEALEQLTIALYGDMTIEIDRVEPIYTMDFSASGHDLSALVYNLLDNCLYSFCAEPFFIGRFAKFLNLKKPSGNTGEELSVQIRIWGESFDPQKHPQGTEIKAITYSNMQIIRKEEEEDEGGKVPIGRTDIFVIVDI

SEQ ID NO: 162940 - protein, 238 aa, Heterodera glycines
  Homolog annotation: Hit_ID=NP_500051.2; Match level="QueryCoverage =96%, HitCoverage=36%, E-value=3e-36, Identity=35%"; Hit description =lyase (68.1 kD) (4B953) [Caenorhabditis elegans] gb|AAK68403.2| Hypothetical protein Y104H12D.3 [Caenorha
  Gene Ontology: Mol. function=sphinganine-1-phosphate aldolase activity; Biological process=cellular response to starvation
  Coding regions on vcDNA: vcDNA=SeqID_89363; Strand=+; Position=16-732
MDHTPWRVVLYVIDDFRIHLNRRFDHLEQWQIVLYTLSFVLFVQWVRKVLKFEEFVSFRQLWNDSLLSFSTYKHKWEENKENAYKELEDRMHRADRLKEFYKYLPDRGLPPDDIIREATAYKTMSDILFERGRLCGSLYAVEDEDSNYQRMIKQVFELYSHTNAAFPEACPSIRKMEAECIRILCSLFHGGAKSCGVVTTSGSESIILACLAYRNSAHKNGIRRPEIIVPLNAHVGIF

SEQ ID NO: 162941 - protein, 292 aa, Heterodera glycines
  Homolog annotation: Hit_ID=AAC47437.1; Match level="QueryCoverage =99%, HitCoverage=99%, E-value=1e-129, Identity=68%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_89364; Strand=+; Position=31-909
MADFEGRVKAYRFVAYTTVSFSIISLLSVCLTLPMLKSYVSNVGMKMDSELSSCQHNAKDIWSEVSQLKGLPLLVSGNRTARSAYGSCQECCSGGAQGQPGQPGQPGRPGNPGAPGSPGQPGQTPQTPCEQVHPPPCTPCPGGQPGNNGPPGPPGAPGSPGQPGTGGGQPQPGEPGPPGPNGQPGQPGQPGAPGQPGQPASPPQTEPPPPGPPGEAGAPGQPGQPGAPGQPGASGQPGPKGPPGGPGQPGNGGAPGQPGQPGQPGNPGERGICPKYCAVDGGVFFEDGTRRR

SEQ ID NO: 162942 - protein, 116 aa, Heterodera glycines
  Coding regions on vcDNA: vcDNA=SeqID_89365; Strand=-; Position=33-383
PICPSKINDTIRTFPKIRPFLSFISQLPLLPIPRPFPSLLRFRSVGSVCLPLFSALGIIPAVGRADGPSTKDSVRFRLFHRSVPTRVSRYPPLGSSICELPIPFLSISNSSCPSDL

SEQ ID NO: 162943 - protein, 271 aa, Heterodera glycines
  Homolog annotation: Hit_ID=CAB88203.1; Match level="QueryCoverage =100%, HitCoverage=90%, E-value=1e-142, Identity=83%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_89366; Strand=+; Position=31-843
MQETHIVLGIASVCSLLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGGAGQPGQPGQPGQPAPPCPPQNIPCPRCPAGPPGRPGGQGPPGQQGAPGQPGTPAQGGGPGTPGAPGPQGQPGQPGRPGAAGQPGQPGANGVVSRPIPGPKGPPGAPGQNGNPGSQGQPGQPGGQGPPGPPGAPGQPGQPGNSGQPGQPGAPG

SEQ ID NO: 162944 - protein, 80 aa, Heterodera glycines
  Homolog annotation: Hit_ID=CAG07889.1; Match level="QueryCoverage =86%, HitCoverage=97%, E-value=5e-21, Identity=65%"; Hit description =unnamed protein product [Tetraodon nigroviridis]
  Coding regions on vcDNA: vcDNA=SeqID_89367; Strand=+; Position=42-284
FINFYKHSAKLSAIFNLQSLITVVLLLICTCAFLRALLPRLIDRNKQGISGVFWKCARIGERLSLWVSAGCFCMAIYLLF

SEQ ID NO: 162945 - protein, 106 aa, Heterodera glycines
  Homolog annotation: Hit_ID=NP_496375.1; Match level="QueryCoverage =100%, HitCoverage=100%, E-value=1e-50, Identity=90%"; Hit description=60S ribosomal protein L44 (12.4 kD) (2L388) [Caenorhabditis elegans] emb|CAA90434.1| Hypothetical prote
  Gene Ontology: Cellular component=cytosolic ribosome (sensu Eukarya); Biological process=protein biosynthesis
  Coding regions on vcDNA: vcDNA=SeqID_89368; Strand=+; Position=39-359
MVNVPKARRTFCPGKKCRKHTNHKVTQYKKGKESTFAQGRRRYDRKQKGYGGQTKPIFRKKAKTTKKIVLRMECVECKHRVQKAIKRCKHFELGGQKKSRGQVIQF

SEQ ID NO: 162946 - protein, 209 aa, Heterodera glycines
  Homolog annotation: Hit_ID=CAE57443.1; Match level="QueryCoverage =87%, HitCoverage=51%, E-value=7e-23, Identity=39%"; Hit description =Hypothetical protein CBG00405 [Caenorhabditis briggsae]
  Gene Ontology: Mol. function=dihydrolipoamide S-acetyltransferase activity; Cellular component=mitochondrion; Biological process =coenzymes and prosthetic group metabolism
  Coding regions on vcDNA: vcDNA=SeqID_89369; Strand=+; Position=28-654
MIPLFPLRGPFSSFPRTFHSKSPLHQTKTSLLVGPAVRLLLGHYDIKTSVLRASGPKKNILKSDVLSHINDKKLSPIKAFSAKPPSKMSLENEVISASSHPIIPLKSSGRSEPTHRHVHVDIQLSEMRQNQTKQFVQSRNSIPHAYASAQISANKILELLNRLSERVDFKLSLNDFIIKACSLSLRSVPELNVHWHGNSIHHLSSVGIS

SEQ ID NO: 162947 - protein, 212 aa, Heterodera glycines
  Homolog annotation: Hit_ID=XP_326988.1; Match level="QueryCoverage =62%, HitCoverage=80%, E-value=4e-16, Identity=34%"; Hit description =hypothetical protein [Neurospora crassa] emb|CAD70926.1| related to Ypt-interacting protein YIP2 [Neurosp
  Gene Ontology: Cellular component=integral to membrane; Biological process=membrane organization and biogenesis
  Coding regions on vcDNA: vcDNA=SeqID_89370; Strand=+; Position=3-641
MSNQSTSSAAAAAGSTAPPSPSNEASSPSAAQASSQSSSAAGDSSASPNGPRLKPRKVPVNRFRDVRPALQLRLSQLKHPLIRKLEQDTGIDRERLFYMAMAYFVFLLLFTQCKLLLSTLIGSVYPAYQSIVTVHTQAKSEEIQWLTYWCLFSLFSLCDISFSVALPFYALVKTIILLYLALPQTYGAHNFYVIYVDPLVEQWMLMVNEIAG

SEQ ID NO: 162948 - protein, 212 aa, Heterodera glycines
  Homolog annotation: Hit_ID=NP_498939.1; Match level="QueryCoverage =95%, HitCoverage=37%, E-value=2e-35, Identity=43%"; Hit description =putative Nipsnap protein (3J865) [Caenorhabditis elegans]
  Gene Ontology: Biological process=phosphate metabolism
  Coding regions on vcDNA: vcDNA=SeqID_89371; Strand=+; Position=14-649
MASPLRLPQRIGAHHFWHNFDNFLFDADGVLWREQQPLQGAVELIGTLLKAGKKVVVVTNNSTQSCAEYVKKCQRIGFTDLDEQNIVSSGMVLAHQLNKMKRSAEFGSTAHLPVYLFGSVGLQRLLKESGIDSFGTAPDPIPADTATFVSDLPNLDLGVPRPFAVVAGYDIHLSYAKVMRAANWLKEKAVPFLVTNEDATFPRTNPEIVIPG

SEQ ID NO: 162949 - protein, 213 aa, Heterodera glycines
  misc_feature (61)..(61): Xaa can be any naturally occurring amino acid
  Homolog annotation: Hit_ID=AAC47437.1; Match level="QueryCoverage =100%, HitCoverage=95%, E-value=1e-104, Identity=63%"; Hit description=COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_89372; Strand=+; Position=28-667
MDFEARIKAYRFVAYSTVSFSIISLLSVCFTLPMLQNYVSNVAQNMDRELSACQGSAKDIXSEVNQLKSIPVVGGNRTARQADGYGRGGGAVSGGGGGGGSCSECCSGGGPGPAGPPGPPGNPGNPGAPGSPGQPGKSVSAPCEQATPPPCKPCPGGQPGQPGPPGPPGQPGSPGQPGSGGGNPEPGPPGPPGPPGNPGGPGQPGGPGQPGQP

SEQ ID NO: 162950 - protein, 215 aa, Heterodera glycines
  Coding regions on vcDNA: vcDNA=SeqID_89373; Strand=+; Position=11-655
MAEKLKRAKVRLEFSEKMFYERALTEWRDKILKDSGNKNHAFVLRKALCNLKLFSLDVNGFSDLRKIRGIGVDIATRLSSAWKFTCATHFCTESPTIGQIKSLKSGEAFVLIEQSSTENGGRVPLVAGAKQRKAIPSQIGQQQKSQTNGKQKGHHFETAPLVRSNSQECVVMHKSESLEVMDFDHLLNVSVSNQPFLLLLLRIVGQLSQCLLRPL

SEQ ID NO: 162951 - protein, 211 aa, Heterodera glycines
  Homolog annotation: Hit_ID=CAE65741.1; Match level="QueryCoverage =81%, HitCoverage=16%, E-value=1e-18, Identity=33%"; Hit description =Hypothetical protein CBG10826 [Caenorhabditis briggsae]
  Coding regions on vcDNA: vcDNA=SeqID_89374; Strand=+; Position=3-635
KDDVLAFGDSAGRVGVWDLARSQCRQTGLGQSTRGPVQRVVFSRLTGDYTLAAQHPTSVVVWDTERLQSLFSLQKPGHSIIDIDMCGLNPVYIASDGMFRFAFSDTDEKSRTNNTNLNTSPPLIKSDIPLLLRPSYCQALLSLLSTDTPPAAVAEQNNNDDDTTTKSNQENFVPFGGDHDGHQLHTFDDPDIDHLINRLSAKCCRTPLDRA

SEQ ID NO: 162952 - protein, 212 aa, Heterodera glycines
  Homolog annotation: Hit_ID=AAH32191.1; Match level="QueryCoverage =91%, HitCoverage=19%, E-value=4e-34, Identity=44%"; Hit description =Cherp protein [Mus musculus]
  Gene Ontology: Biological process=neurogenesis
  Coding regions on vcDNA: vcDNA=SeqID_89375; Strand=+; Position=2-637
APPQQRPPVDLIPKAPYYELPAGMMVPLIGIEDITYESLREKDLRLPPPEAPSDQLMREIDRFYIALQPPPPVDCVRDADGWEVNGLLEHYIKKREQKVKLEAELKEKGKTFEDAITNKYVPPQTTKKSESKKSKSRSPPSSSSSASSSGSTSGESSSESSSRSRSRSRSRSSSRSRSTSPLNQKSQSPTFKRLRRSRTRSPTPGGPTKFWR

SEQ ID NO: 162953 - protein, 211 aa, Heterodera glycines
  Homolog annotation: Hit_ID=AAC50927.1; Match level="QueryCoverage =76%, HitCoverage=7%, E-value=5e-26, Identity=38%"; Hit description =myosin VIIa [Homo sapiens] pir||A59255 myosin VIIa, long form - human
  Gene Ontology: Mol. function=myosin ATPase activity; Biological process=hearing
  Coding regions on vcDNA: vcDNA=SeqID_89376; Strand=+; Position=1-633
AESTGYIIGDSELELARAFRTPCPLCLITISVPASLYAVFRDEAKSNSRNFVSHTTPPAQLRSCSIFDDAQMFVPIHLTDGRVISLPIDSQSTPFELCEMLCQQICLKDAFGFGLFLAVGRRFIRSLGVGSECVIDAIASLETKSEKNWRIFFKKELFRAHQSESDDPLAIELAFRQILGGIHSKEYQCEKEDDLVTLAAQQHFIDINGQD

SEQ ID NO: 162954 - protein, 185 aa, Heterodera glycines
  Coding regions on vcDNA: vcDNA=SeqID_89377; Strand=-; Position=4-561
WIDRSVVSICPPLFLLRLRLLFHGRFLFHLNWDGSSAFASRFHSADAQATAVQLALDALLLDALRDEHTARELTVDRFAVVLLAMFPIDDDFITNHLHVDLLGAEAADIDFVSEFALVRDVQLSGVVTKHGLHPVKEVVEFALQLAEGRKDVANGGHRPQRTAIERVVGEGRKHFDEKRIGWKFF

SEQ ID NO: 162955 - protein, 206 aa, Heterodera glycines
  Coding regions on vcDNA: vcDNA=SeqID_89378; Strand=+; Position=3-620
DSENALQSFKEFTGCTDDDSARRLLSKCAWNLERAIDFFFSGRREEGDGEVMWDEQQPMTSQGTRRRISHFANSLWTTPAIGGNAANGNRRTDETSHNQFRTARMDDDSVQTLDDSDVQMVEESDRKAAPPPKAVNGSASSDGVRAPIAPVQGVLIEQSFRETYQNRERLWNPVFEQYRQDHQQPSSSSAAASFLSRRANGANNRI

SEQ ID NO: 162956 - protein, 281 aa, Heterodera glycines
  Homolog annotation: Hit_ID=CAE71808.1; Match level="QueryCoverage =97%, HitCoverage=59%, E-value=1e-17, Identity=30%"; Hit description =Hypothetical protein CBG18822 [Caenorhabditis briggsae]
  Gene Ontology: Biological process=locomotory behavior
  Coding regions on vcDNA: vcDNA=SeqID_89379; Strand=+; Position=27-869
MNKTTLKARFGSDIRKNWIHHSNDISLNDLVTKMQRYFDIKDANAIKLKYRDQESDWVTLADDDDLAYALASMELLYVDVIVEKYQFKQDEETVEKTAPPAEVVKAVAPPRDATPVDNGDVAQLQKQQRSSTTPVSSIGELTEIPLNGPVTPPVNMGGMYGQPQQLPQQAPVPQQTPIPPPPVSGGGMFYGQPQQQQPPQHQQQTPFPLPPVSVGGMFYGQQQQPQAPMPQQQQPPHAPMQQQQTTVPPVTGGGAFYGQPQQQPPLHQQTPMPPPPVSAGA

SEQ ID NO: 162957 - protein, 165 aa, Heterodera glycines
  Homolog annotation: Hit_ID=NP_506415.1; Match level="QueryCoverage =86%, HitCoverage=14%, E-value=3e-15, Identity=38%"; Hit description =putative protein, with a coiled coil domain (98.1 kD) (5O275) [Caenorhabditis elegans] emb|CAB02122.1| Hy
  Coding regions on vcDNA: vcDNA=SeqID_89380; Strand=+; Position=364-858
MRGTHNQPTKGQPKASAAKAVVQQQSPEMVAWLRRKEYDPRKAAADQSQREAQQRQQQNSFMACRFFSTSANAKTPFARWRQNRKSQQTMADQRSNRSHDDLSRLGESMDDESLHGVAVDPCSNSLQRTVDELTQKCHKSIELLKLCNQSGLSSSVEQLLEKVVE

SEQ ID NO: 162958 - protein, 284 aa, Heterodera glycines
  Homolog annotation: Hit_ID=NP_495430.1; Match level="QueryCoverage =98%, HitCoverage=91%, E-value=6e-99, Identity=60%"; Hit description =steroid Alpha ReducTase family, 3-oxo-5-alpha-steroid 4 -dehydrogenase similar to vertebrate synaptic glyc
  Gene Ontology: Mol. function=oxidoreductase activity; Cellular component=endoplasmic reticulum membrane; Biological process=lipid metabolism
  Coding regions on vcDNA: vcDNA=SeqID_89381; Strand=+; Position=145-996
MTISVEIFDAKSPSRPGFTIAEVEPEDTVRQLKRKISQKTHLSVDRIALRLEPKGKSLVDEQLVSQLNLPATNAQLYYRDLGPQIPWKTVFLMEYAGPFFIYPLFYLRPALIYGTGASMAPVATAVTIACICHTIHYAKRLYETQFVHRFSNGTMPFQNLFKNCTYYWGFSAFIAYFVNHPLYTSPSFTQVMIGLVGFTISELGNLSIHLLLRDLRPPGSRERKVPYPNSNPLTLMYNFVSCPNYTYEVYSWVFFCVMTQSLPAVFFTLAGFAQMKIWADGKHR

SEQ ID NO: 162959 - protein, 225 aa, Heterodera glycines
  misc_feature (198)..(198): Xaa can be any naturally occurring amino acid
  Homolog annotation: Hit_ID=NP_498263.1; Match level="QueryCoverage =99%, HitCoverage=43%, E-value=1e-89, Identity=70%"; Hit description =ALDH7A2, ALdehyde deHydrogenase (alh-9) [Caenorhabditis elegans] gb|AAC46640.1| Aldehyde dehydrogenase pr
  Gene Ontology: Mol. function=aldehyde dehydrogenase (NAD+) activity; Biological process=aldehyde metabolism
  Coding regions on vcDNA: vcDNA=SeqID_89382; Strand=+; Position=1-679
TFSSVGTAGQRCTSTRRLIIHEKVYDVVLERVVNAYKQLMDTRIGDPLDERTLIGPLHSRESVLKYKTAIAEAIATGGRILCGGKVLEESKGNYVLPKVITGLAHDAPVVLRETFAPIVYAVKVADFEEAVAVNNEASQGLSSSLFTQNVSLLSEWIGPKGSDCGIVNVNIGTSGAEIGGAFGGEKETGGGRESGSDXWKNYMRRSTCTINFGKELPLAQGVKFE

SEQ ID NO: 162960 - protein, 214 aa, Heterodera glycines
  Homolog annotation: Hit_ID=NP_492076.1; Match level="QueryCoverage =94%, HitCoverage=46%, E-value=3e-24, Identity=35%"; Hit description =kappa B-ras (1H925) [Caenorhabditis elegans] emb|CAA96623.1| Hypothetical protein F52A8.6a [Caenorhabditi
  Coding regions on vcDNA: vcDNA=SeqID_89383; Strand=+; Position=31-672
DSCPSAAHCQQKRRRKGKMRTKMHVVVLGPKKVGKTSLLKSLINQHDPKPSTSSSDGQLYVPTVEDTFHVQFGDFRSVDQMPQRSLLILFHDTAGITDFGSIELRKPYLQVADAFLLVYSVLDPLALSQMEALKKYLEREKNGTSKERKEVALSVPMPSKKYPFPFQVPIAVVGTNCEMSGKKVNTESALLWASREKVKLFEVSANDRKSVAEI

SEQ ID NO: 162961 - protein, 126 aa, Heterodera glycines
  Homolog annotation: Hit_ID=CAE66292.1; Match level="QueryCoverage =65%, HitCoverage=71%, E-value=9e-14, Identity=43%"; Hit description =Hypothetical protein CBG11539 [Caenorhabditis briggsae]
  Coding regions on vcDNA: vcDNA=SeqID_89384; Strand=+; Position=20-400
MKYSLLRPFVNRIFTPGKEQQQLVQRNQNEFGMVKTNAGQSAILLRFVSWISGREQIEQHFSRFGKIKETLMFYDRVTGMHRGFAVVHFISPQSAAQAIQHKPHIIDNKLLAVTYHTPPEIRRKTN

SEQ ID NO: 162962 - protein, 213 aa, Heterodera glycines
  Homolog annotation: Hit_ID=CAE69210.1; Match level="QueryCoverage =100%, HitCoverage=84%, E-value=7e-82, Identity=69%"; Hit description= Hypothetical protein CBG15250 [Caenorhabditis briggsae]
  Coding regions on vcDNA: vcDNA=SeqID_89385; Strand=+; Position=41-679
MSGQIKTPTNQKLLTNVAIVRMKKCGKRFEIACYKNKVLNWRNKTEKDIDEVLQTQTVFVNVSKGQLAKRDDLQASFGTEDQLEICKLILEKGDLQISDKERQVTSESSFKEVANLITDMCVNSETQRPFSLATIEKALHDAHFSLKSNRSTKQQALEMIPKLRESLKIDRAKMRIRVSVPAKNAKMLHPKLKAFFDTTQVENWDKGELEMVG

SEQ ID NO: 162963 - protein, 150 aa, Heterodera glycines
  Coding regions on vcDNA: vcDNA=SeqID_89386; Strand=+; Position=162-614
MEGFDIIIMEGTTSPPYFLRSRTRKEGPAVLELIEKLQQANDKVDQQIAEEHQLRNEVLQMAPRAMKKYLGTRFERLMNAKLEFPQMADSERKSEAELAKAKEELRQLKLQAVKEAEEQKRELEEAQRMERELKERVNRKLAKLRALEEM

SEQ ID NO: 162964 - protein, 212 aa, Heterodera glycines
  Homolog annotation: Hit_ID=XP_417265.1; Match level="QueryCoverage =100%, HitCoverage=43%, E-value=1e-60, Identity=40%"; Hit description= PREDICTED: similar to F-box-WD40 repeat protein 6 [Gallus gallus]
  Gene Ontology: Mol. function=protein binding; Cellular component =Golgi apparatus; Biological process=N signaling pathway
  Coding regions on vcDNA: vcDNA=SeqID_89387; Strand=+; Position=3-638
WKLRRPTAVCQLRGHDEHVITCLKLRGDLIVTGSDDCTLRVWSAATGTCVHVLNGHIGGVWALQLSQDGKIAVSGSIKAWDIVAGQCIRTLFGHVAAVHCVKFDGSLIVSGAYDNNIHVWNAADGSLMHVLEGHTNRVYSIHFVSETKLLISGSLNTTIRVWNVDTGECLQTLVGHQSLTSGMKLRDNILVSANDDSTIKVWNITDGTCVHT

SEQ ID NO: 162965 - protein, 98 aa, Heterodera glycines
  Coding regions on vcDNA: vcDNA=SeqID_89388; Strand=-; Position=12-308
SVGHSFVINQITTQNLSHCFASLPPLAHLRHQLKSPPPPGCKIVPLEKPSVKLNWRFSRGDKAAKDKNGRRRSRNRKRKKRRMGEGIGGLIDGQLLTN

SEQ ID NO: 162966 - protein, 194 aa, Heterodera glycines
  Homolog annotation: Hit_ID=EAA49400.1; Match level="QueryCoverage =89%, HitCoverage=62%, E-value=3e-70, Identity=73%"; Hit description =hypothetical protein MG01058.4 [Magnaporthe grisea 70-15] ref|XP _368186.1| hypothetical protein MG01058.4
  Gene Ontology: Mol. function=adenylate kinase activity; Cellular component=mitochondrial intermembrane space; Biological process=cell proliferation
  Coding regions on vcDNA: vcDNA=SeqID_89389; Strand=+; Position=64-645
MAPTATSSQEYRQQTYNLPRAIRMVIMGPPGAGKGTQAPAIRSLFGACHLATGDMLRAAVSAGTPLGKEAKKVMDAGGLVSDEIVVGLIRENLDTNPDCRNGFILDGFPRTVTQAEKLDDMLAAKHQALSHAVELKIDDALLVARITGRLIHPASGRSYHVEFSPPKVPGKDDLTGEPLIQRSDDNVDALKKRL

SEQ ID NO: 162967 - protein, 206 aa, Heterodera glycines
  Homolog annotation: Hit_ID=NP_505582.2; Match level="QueryCoverage =91%, HitCoverage=54%, E-value=3e-40, Identity=49%"; Hit description =yip1 interacting factor homolog (39.1 kD) (5K530) [Caenorhabditis elegans] emb|CAA94831.2| Hypothetical p
  Gene Ontology: Cellular component=COPII-coated vesicle; Biological process=intracellular protein transport
  Coding regions on vcDNA: vcDNA=SeqID_89390; Strand=+; Position=38-655
MTTPNLPYGAREGSGQFSTGTNFSPPPPPYDAGASSPFEQPHQQHQSPSPYGMMYSGGNVPSPPPPSSPYHQYQQQAPPQMSPPFQPPIGDPQQQFMYDPLLNTARHLGGQFAEQQKQKFTQYLSSTSFNLKYYFAVDTNYVRRKLGIILFPFFHRDWANKCEGDAPVLPCQDVNAPDLYIPLMAFITYVLVSGFVFGVQKRFSPE

SEQ ID NO: 162968 - protein, 144 aa, Heterodera glycines
  Homolog annotation: Hit_ID=NP_057213.2; Match level="QueryCoverage =86%, HitCoverage=30%, E-value=3e-24, Identity=47%"; Hit description =COP9 signalosome subunit 4 [Homo sapiens] gb|AAH09292.1| COP9 signalosome subunit 4 [Homo sapiens] gb|AAH
  Gene Ontology: Cellular component=signalosome complex; Biological process=photoreceptor differentiation (sensu Drosophila)
  Coding regions on vcDNA: vcDNA=SeqID_89391; Strand=+; Position=1-435
VKGPELTEFELSLCPHQRLLDAEGVSILQRSVLEHNILAASRLYANISFDGLGQLLGIPAAKAEKVATQMISGEKVQGAIDQLERTVSFEVPDSSNGGADSQIASICELVASINEKLATRFSEWHTERFNEYKRAHQQPNDPMQ

SEQ ID NO: 162969 - protein, 234 aa, Heterodera glycines
  Homolog annotation: Hit_ID=NP_506031.1; Match level="QueryCoverage =99%, HitCoverage=51%, E-value=1e-78, Identity=56%"; Hit description =Alpha-N-Acetylgalactosaminidase precursor (51.4 kD) (5M569) [Caenorhabditis elegans] emb|CAB00120.1| Hypo
  Gene Ontology: Mol. function=alpha-N-acetylgalactosaminidase activity; Cellular component=lysosome; Biological process =carbohydrate metabolism
  Coding regions on vcDNA: vcDNA=SeqID_89392; Strand=+; Position=1-702
AKHPFSCINEQLYMDMADRLAEDGFREVGYQFVHIDDCWAEKARDSQGRIVADPTRFPSGIRNLSDYMHNRGLKLGIYGDIGTETCENYPGSYQHYDIDAQTFADWKVDYLKLDGCYMNSSMMPDEYPKMGVALNRTGRQIVYSCSWPDYFDHNFEEKINYTAVAYWCNLWRNFDDIARSWASVIKIINFFTKHQDQFRKVQAPGRWNDPDMLIVGNTELTVDQAKVQMSIWAI

SEQ ID NO: 162970 - protein, 176 aa, Heterodera glycines
  Coding regions on vcDNA: vcDNA=SeqID_89393; Strand=+; Position=3-533
SVQWDKVPYFYPIQIIQFGLGQYNLDRKGAEVIVRPLANRATNAMGTENANGTMALGDGATVRVKLFRRLPLLLFSLKTHRMDSEFVLELEKRRREGGTMEMALFFKHSEAKGCVWSDESIKAPRLSAVFNIGPKPTMRWVDFVIDNDIYVTKALKMLCARKKRTQNKCDAKKGAF

SEQ ID NO: 162971 - protein, 151 aa, Heterodera glycines
  Homolog annotation: Hit_ID=NP_496453.1; Match level="QueryCoverage =100%, HitCoverage=100%, E-value=4e-30, Identity=47%"; Hit description=esophageal gland cell secretory protein 11 like precursor family member (15.2 kD) (2L776) [Caenorhabdit
  Coding regions on vcDNA: vcDNA=SeqID_89394; Strand=+; Position=39-494
MKFSLLLAFAFAVPLADAALTFPSIGYVQSAAVNGTLTCNGKPTHAKVKLYDEDDTDMDDLMDEGVTDEEGFFHLSGKESEITPIEPKVNIYHNCNDDESLNPLKKVCYKKISIDLPASYITDGPVAEKVFPLGTLNLAGSFKGETRDCLN

SEQ ID NO: 162972 - protein, 211 aa, Heterodera glycines
  Homolog annotation: Hit_ID=NP_502512.1; Match level="QueryCoverage =82%, HitCoverage=68%, E-value=3e-09, Identity=24%"; Hit description =putative protein (28.1 kD) (4N847) [Caenorhabditis elegans] emb|CAA94333.2| Hypothetical protein C39E9.8a
  Coding regions on vcDNA: vcDNA=SeqID_89395; Strand=+; Position=20-652
MFAKCLLFLAIIISVVPTENKGYENGYRQCSCGEQTECFEEIKSKTAQCFEQETGKLGNALTKNLVDPTKTKPCFDKFSAYVKDWLSCVDAKLVKESSCLTTKSDIKIQSGDFLTIYSKIVRENVDKRMNYLYGLAKHPLVQLEENWHESAKQCAFEKVAEINCFKKYNCVLKASEKEVQKVAKQCYKEFDVVKVQHNMCECMAKNVPGYG

SEQ ID NO: 162973 - protein, 203 aa, Heterodera glycines
  Homolog annotation: Hit_ID=CAE62112.1; Match level="QueryCoverage =95%, HitCoverage=16%, E-value=5e-65, Identity=62%"; Hit description =Hypothetical protein CBG06150 [Caenorhabditis briggsae]
  Gene Ontology: Mol. function=ATPase activity, coupled to transmembrane movement of ions, phosphorylative mechanism; Cellular component=membrane; Biological process=cell organization and biogenesis
  Coding regions on vcDNA: vcDNA=SeqID_89396; Strand=+; Position=3-614
QSVLYLDGVKFSDIQATIQGIFLAACFLFISRSKPLKTLAKQRPMTNIFNVYTLSTITIQFAVHFACLIHIVRLAHALEERPGKTELEKEFKPNLLNTAVYLMSASLQIATFAVNYRGRPFMESLVENKPLFYSIICSFGAMVAFASNTFPDLNNKFELVHIPVELRDTLICCILGDLVCCLLLDRMLNYLFGDQRVRKMLMY

SEQ ID NO: 162974 - protein, 214 aa, Heterodera glycines
  Homolog annotation: Hit_ID=CAF96997.1; Match level="QueryCoverage =85%, HitCoverage=71%, E-value=3e-19, Identity=37%"; Hit description =unnamed protein product [Tetraodon nigroviridis]
  Gene Ontology: Mol. function=RNA binding; Cellular component=nucleus; Biological process=RNA splicing
  Coding regions on vcDNA: vcDNA=SeqID_89397; Strand=+; Position=3-644
ANDSRSSSSASSRSRSPSHRRSPRRREQRRRRSRSTFSRSPSPGQKRLHIGNLDESVRRRDIEDVFGKYGRISDCWMASYPPFYAFVVFENNKDASACMKDLGNTAYIKGCRARVTVALPRNGATYRRGPPPPPRRYYDEEDSHRRRRRSRTRSPRRRRSPSRSRSRTPPRRSRSPRRSARRQRSPSPKRERRDREEKDTKPREAADEHEQQPI

SEQ ID NO: 162975 - protein, 148 aa, Heterodera glycines
  Homolog annotation: Hit_ID=CAE63849.1; Match level="QueryCoverage =81%, HitCoverage=33%, E-value=2e-20, Identity=43%"; Hit description =Hypothetical protein CBG08408 [Caenorhabditis briggsae]
  Gene Ontology: Mol. function=structural constituent of cuticle; Cellular component=extracellular; Biological process=cuticle biosynthesis (sensu Nematoda)
  Coding regions on vcDNA: vcDNA=SeqID_89398; Strand=+; Position=188-631
MKHQYQNELNTQSSRAVTSPLADDDETLDESRERAYKLVAYTAVGFSLVAILAVAICLPVVFNFVDHIQRQTKRELDFCKSSARDIMFEVGDKQRRIATAFEAVRNRTGGADASFASMPFPSLIAHLQNRRAKRQTEACESCCIPGHP

SEQ ID NO: 162976 - protein, 195 aa, Heterodera glycines
  Homolog annotation: Hit_ID=AAG21334.2; Match level="QueryCoverage =100%, HitCoverage=49%, E-value=1e-105, Identity=100%"; Hit description=hypothetical esophageal gland cell secretory protein 4 [Heterodera glycines]
  Coding regions on vcDNA: vcDNA=SeqID_89399; Strand=+; Position=2-589
PERDTKMDTTNAEVMDTKKEANAAAAAPVAASDNTAPAPMTWMMDGIVPRDVNVMVDRTTKELRKTTETDGFYDMSQRAQERVMLETAGKQGEIVKTKLKEAIEEARKMIERALGTVISYSEAPMESKMQLEQVFMTLTDETKTPKEKMERIKDIQQKWTPEIRAALKPSTDDKEIAEAIRFFTDLPAQIELGKK

SEQ ID NO: 162977 - protein, 93 aa, Heterodera glycines
  Coding regions on vcDNA: vcDNA=SeqID_89400; Strand=+; Position=381-659
FFNCIFGEFIASNSELWRGAFILELGAGIAALPSMTALRYDAAKVVITEQNQEVVEQIQCNLERNFDKKFTREKVRLMSLDWLQPDDSLARVV

SEQ ID NO: 162978 - protein, 278 aa, Heterodera glycines
  Homolog annotation: Hit_ID=NP_498608.1; Match level="QueryCoverage =51%, HitCoverage=75%, E-value=1e-39, Identity=56%"; Hit description =n/apple PAN precursor (22.0 kD) (3I388) [Caenorhabditis elegans] gb|AAK18868.1| Hypothetical protein B036
  Coding regions on vcDNA: vcDNA=SeqID_89401; Strand=+; Position=12-848
MIFNHFYTQFYILLNVLASTGFVFCTTEWFGDLRAHMNPPKFPPFYDIVYDEPDCPFGLESVAIPEFVYFGEMIATKFVQEHSQCLQFCLETSKCKAVNFFESIEGKNPEVGFCELLVEGQYDNPRLMRPFKKATYHEKIHCRAENEEEKQPFIFDEKEGKQLLIGNESNERKNTSSTAKQTEKGTNENGQKTTAENRQSEGRMNEQRSQKTTEKQPRREEQSEGRGNGGRKTETKEETAQKSETQEKATEPPTAQLNSLILKRLAERIQELKKRFRN

SEQ ID NO: 162979 - protein, 208 aa, Heterodera glycines
  Homolog annotation: Hit_ID=NP_499246.1; Match level="QueryCoverage =79%, HitCoverage=46%, E-value=1e-40, Identity=49%"; Hit description =blr7445 like (3L204) [Caenorhabditis elegans] emb|CAA87427.2| Hypothetical protein ZK1128.1 [Caenorhabdit
  Gene Ontology: Cellular component=mitochondrion
  Coding regions on vcDNA: vcDNA=SeqID_89402; Strand=+; Position=18-641
MFRNCLLDLTPLRCAFIANKLAHYSSKTPTFSNCIPSPILSGNQLFRIIRDKIRTSGPITVAEYMQICATSQLGYYAGQNEIFGERGDFVTSPELTQIFGELIGSWVVHELEMTSWKDRWQLVELGPGSGELMADVLNVLRQFDVLQNVEVYLVESSERLVERQRETLKKKFGEDLLRNIRWDDSLDDVPQRFSRVLANEFLDALPVH

SEQ ID NO: 162980 - protein, 220 aa, Heterodera glycines
  Homolog annotation: Hit_ID=NP_492315.3; Match level="QueryCoverage =43%, HitCoverage=4%, E-value=4e-18, Identity=47%"; Hit description =abnormal GONad development GON-2, putative TRP homologous cation channel ltrpc1 family member (gon-2) [Cae
  Gene Ontology: Mol. function=calcium channel activity; Cellular component=integral to plasma membrane; Biological process =gametogenesis
  Coding regions on vcDNA: vcDNA=SeqID_89403; Strand=+; Position=2-664
TPIYYVYMCFRYLNYRNLICICCAPKFRRLLFPDCLCFCARNKRCQNQNEEKADNDEKLSVVREQPLPNNSFEQRRSLGTTGQVSRSVKEGFALFDFSLKLFLSTEQVQKLHDFEGECMVDLAREKEDKRNRTSEERLNRTCERTELILLRVNDIVSREATFKGNIHDLETRLGIVENRQAEVLDYLRQFGAVLPSLVQSVQTLQQQQQQLLQRLSSIPE

SEQ ID NO: 162981 - protein, 274 aa, Heterodera glycines
  Homolog annotation: Hit_ID=NP_496397.1; Match level="QueryCoverage =69%, HitCoverage=70%, E-value=2e-45, Identity=43%"; Hit description =interferon gamma inducible protein 30 like precursor (2L479) [Caenorhabditis elegans] emb|CAB04345.1| Hyp
  Gene Ontology: Biological process=regulation of protein activity, epigenetic
  Coding regions on vcDNA: vcDNA=SeqID_89404; Strand=+; Position=9-830
MMPKNFCGKTSKFSSCLLPALLLIIILSILNSVSSSRRHHSPASGHNRRLSSISSPAVANGGSLFEHRTKHQSVAAADESAGGCAVVPPSLWCGCDKLQTQCGTGRLCGRYTGAMRNEPLHITLLYESLCPDCQSFITETLFDVYQKFKTHLRIEFVPFGNAKVLENGTIKCQHGPEECRINKFHSCAIHFMHDPMPFIYCLEKLISSGIPLEKASKKCYVKLHPIPHIYDQITHCFNGPTGDRLQREAGRLTAQIWPDQHEYVPWILENNASL

SEQ ID NO: 162982 - protein, 202 aa, Heterodera glycines
  Homolog annotation: Hit_ID=NP_509832.1; Match level="QueryCoverage =59%, HitCoverage=20%, E-value=6e-12, Identity=35%"; Hit description =astacin and metridin-like ShK toxin family member (XL580) [Caenorhabditis elegans] emb|CAA91996.1| Hypoth
  Coding regions on vcDNA: vcDNA=SeqID_89405; Strand=+; Position=31-636
MHQGIPNVPTVSNNGTSFGRVAPPGISDTISTTTQFTITATNLPITSFVTTQDPNVRSEFEKADAPEILKIFIPPKPPAVPQEAKKIFEDLCAGGKCLVQKPEFIQQKAAVEKESEQIELKLNPGKSAEQVKREVKVRMAKTQQLKKALVQNAGLEGQVEPADNGVFGHDQLLTETQANDLLNELTRHKANRAKRAGNAMFL

SEQ ID NO: 162983 - protein, 221 aa, Heterodera glycines
  Homolog annotation: Hit_ID=XP_396699.1; Match level="QueryCoverage =99%, HitCoverage=96%, E-value=2e-66, Identity=54%"; Hit description =similar to ubiquitin conjugating enzyme E2, J2 isoform 2; ubiquitin conjugating enzyme 6; yeast UBC6 homo
  Gene Ontology: Mol. function=ubiquitin conjugating enzyme activity; Cellular component=endoplasmic reticulum membrane; Biological process=protein modification
  Coding regions on vcDNA: vcDNA=SeqID_89406; Strand=+; Position=3-668
VTAVTRLKKDYQKLVRDPVPYAIAAPLPSNILEWHYVVTGAPDTPYEGGYYHGKLIFPQDFPFRPPAIYMITPSGRFQTNTRLCLSISDFHPDTWNPSWSVSTIIMGLISFMNENSPTLGALVSTDEEKRVFALRSRELNLKNAQFCELFVGLADQIRAELEAERAAASDNAEGQTASGESTTKKNSRHDSSSLTANLLMVAGVVILFFAVRYVILNATTV

SEQ ID NO: 162984 - protein, 169 aa, Heterodera glycines
  Homolog annotation: Hit_ID=AAH44091.1; Match level="QueryCoverage =98%, HitCoverage=29%, E-value=2e-54, Identity=58%"; Hit description =Cbs-prov protein [Xenopus laevis]
  Gene Ontology: Mol. function=cystathione beta-synthase activity; Cellular component=cytoplasm; Biological process=cysteine metabolism
  Coding regions on vcDNA: vcDNA=SeqID_89407; Strand=+; Position=2-511
NPLVHYEGTAEEIIWACDGKLDAMVVGAGTGGTMTGIANKMRQKLPNCKIIAIDPEGSILANPTNRQKHAYEIEGIGYHFVPYTTDRNLVDEWIKTNDANAFRTARRLISEEGLLCGGSSGANVWAAMEVAKTMGRGKRVVTILPDGIPNYMSKFIDDEWMRVKGFEGI

SEQ ID NO: 162985 - protein, 243 aa, Heterodera glycines
  Homolog annotation: Hit_ID=CAB88203.1; Match level="QueryCoverage =100%, HitCoverage=94%, E-value=1e-121, Identity=69%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_89408; Strand=+; Position=1-729
QETHIVLGIASLCSLLAIIATVVTLPSLYSEMSQLNNKVRDGVQAFRVNTDSAWTDLMDVQVVVAPPSKARDNPFSSIFRAKRQLPGHCNCGPPQRPNCPPGPPGPAGPPGQPGQPGGAGLQGQPGAPGQPAPPCPPQNIPCPRCPAGPPGSPGGQGPPGQQGAPGQPGAPAPGGGQGPPGPSGPQGQPGQPGRSGTPGQPGQPGNNAVIFNTIPGPRGAPGAPGQPGSPGSPGQPGQSGGQG

SEQ ID NO: 162986 - protein, 178 aa, Heterodera glycines
  Homolog annotation: Hit_ID=CAD38524.1; Match level="QueryCoverage =100%, HitCoverage=100%, E-value=7e-78, Identity=79%"; Hit description=putative glutathione peroxidase [Globodera rostochiensis]
  Gene Ontology: Mol. function=glutathione peroxidase activity; Cellular component=nucleus; Biological process=establishment and/or maintenance of chromatin architecture
  Coding regions on vcDNA: vcDNA=SeqID_89409; Strand=+; Position=60-596
MGAMSSSSSAAPSDPQQKSIYEFSAKDIDGNETSFGKYRGKVLLVVNVASNCGFTDSNYSQLKQLLDKYKSKGLEIAAFPCNQFNNQESGCAIDIKDFVTKKYNFEPDLYDKIDVNGPNEHPIYAYLKSVQGGILGFDAIKWNFTKFLIDKNGKVVERYAPTKEPKNIEKEIEKLLEA

SEQ ID NO: 162987 - protein, 307 aa, Heterodera glycines
  misc_feature (131)..(131): Xaa can be any naturally occurring amino acid
  Homolog annotation: Hit_ID=CAE72865.1; Match level="QueryCoverage =99%, HitCoverage=80%, E-value=2e-90, Identity=56%"; Hit description =Hypothetical protein CBG20164 [Caenorhabditis briggsae]
  Gene Ontology: Mol. function=Hsp70/Hsc70 protein regulator activity; Cellular component=cytosol; Biological process=protein-mitochondrial targeting
  Coding regions on vcDNA: vcDNA=SeqID_89410; Strand=+; Position=36-955
MKSNSKTADIGDFYEILGVPRNASEQEIKNAYRKLALTYHPDRNPGNEQAQEQFKKVSIDYSVLSDPNKRRQYDVSGPSMAMNDFEGLDISELGGVGRFFGAMFTKLGIPIPTQIGPKVLAQARDLSRGNXHKRPLEPGLVLSETVNNQEANFYAFQMTPEFQQHGVIIRCKSLAMSKFKLVLFDQEGAVRHIRESQKKKKYTSAELFFVPFQRINISEFIPIRFYMEDKDTPLPFHFLDTLETHGANVMELQPGKHILCVYGDNFLRMVSYEITFLPLNHYASAAINKINALEPVLASKKSEMQEF

SEQ ID NO: 162988 - protein, 49 aa, Heterodera glycines
  misc_feature (24)..(24): Xaa can be any naturally occurring amino acid
  Coding regions on vcDNA: vcDNA=SeqID_89411; Strand=+; Position=401-547
ERENQREETGLAKITSKIIDSQNXKKKKKKKDLRTKKKKKNFKKKKKKK

SEQ ID NO: 162989 - protein, 141 aa, Heterodera glycines
  Coding regions on vcDNA: vcDNA=SeqID_89412; Strand=-; Position=115-540
LSFTLKLYFYDFSEKMRTTKQLVNSIPGKGNTRDPSSEFHWDHWPGNLASVALSEVPRWRSMLSRRRSRSARRSAKRSSRRLSRRRSTSPTCSLVRRVIATSANETKTRIPKKIVIFSTLMRDSSSNLETTKGSRRALKTP

SEQ ID NO: 162990 - protein, 192 aa, Heterodera glycines
  misc_feature (150)..(150): Xaa can be any naturally occurring amino acid
  Homolog annotation: Hit_ID=CAE68486.1; Match level="QueryCoverage =100%, HitCoverage=52%, E-value=6e-56, Identity=57%"; Hit description= Hypothetical protein CBG14288 [Caenorhabditis briggsae]
  Coding regions on vcDNA: vcDNA=SeqID_89413; Strand=+; Position=57-630
MDFNLKTLAREASGMLSRAKQLTEEKLLNAEKTELDPHCEQLLAKADKTEEQSKKLLSAMEAYLQPNPALRMGDLFYEKMEITSPAPNRSNTLEYLSEAMQEAAQSFGTETPFGGALQKIAQTEAKLGAAEREMVQTTAGQTLVPIKRFXLEGEMRNIQKKRPVLQKKRLDLDAPKSRLKRARTLEGQATVN

SEQ ID NO: 162991 - protein, 249 aa, Heterodera glycines
  Coding regions on vcDNA: vcDNA=SeqID_89414; Strand=-; Position=184-933
PFFAPLPPPQLSSSLWSLFVVQQHVHLATASATFPRPFFLSVGRRPKCSLDSFAASATPKLRYQVRVGVRLEPTSFPHVFSGESHRLAPPVIFLNPNPGRRLESRRTLVVALRQMAPFQCQSVLLRPRPAFCNRLWVLPWWHHRRPSRRLIRSFFVVFVDLLAHFWVRNQHIAQLFHQFHQFTRCQHSFSGFVHPKVILSERLHSVRSEQLFQPLPRRQRHSESVLHSVQAVQADLVTVLALLSPGSEN

SEQ ID NO: 162992 - protein, 264 aa, Heterodera glycines
  misc_feature (258)..(258): Xaa can be any naturally occurring amino acid
  Homolog annotation: Hit_ID=NP_501065.1; Match level="QueryCoverage =85%, HitCoverage=36%, E-value=2e-41, Identity=41%"; Hit description =ribophorin I (4H677) [Caenorhabditis elegans] pir||T32708 hypothetical protein T22D1.4 - Caenorhabditis e
  Gene Ontology: Mol. function=oligosaccharyl transferase activity; Cellular component=oligosaccharyl transferase complex; Biological process=protein modification
  Coding regions on vcDNA: vcDNA=SeqID_89415; Strand=+; Position=36-827
MEHGSLPLQLIILFVLTLQISTQSPEISVPSDVQILSAVRNVDLTTQIVKVKTDFELKNGRNEELSSFVHAMSAEEAARLSWMSAYESGKESGKLRISRVRVKGVSSDMVFHKIEFLDLLMSGSNIKLSVDYALTEYLVPSPKDILQSENQLVIFSGTANVLSAYPVMKENCVYKIGSSKPISFTEIAPSKHSQEKISYGPYENTKAYSKKPITIHYENNAPFLVASSVERIIEVSHWGGNIAVEENVEILHKGAKLXGSFSRL

SEQ ID NO: 162993 - protein, 98 aa, Heterodera glycines
  Homolog annotation: Hit_ID=CAE61974.1; Match level="QueryCoverage =93%, HitCoverage=95%, E-value=3e-14, Identity=49%"; Hit description =Hypothetical protein CBG05978 [Caenorhabditis briggsae]
  Coding regions on vcDNA: vcDNA=SeqID_89416; Strand=+; Position=232-528
MSAPPPYNPNMQQYPQQPQPNYGQPGYGGGGGGYGYPSQPYPQQPNSYGGGGYPQQQQPQPQVVYVERDRPQQQGSNNCCLWALLACCCGCCLAECCD

SEQ ID NO: 162994 - protein, 205 aa, Heterodera glycines
  Homolog annotation: Hit_ID=NP_740883.1; Match level="QueryCoverage =94%, HitCoverage=40%, E-value=6e-45, Identity=42%"; Hit description =ubiquitin domain and Ubiquitin-associated domain containing protein (54.1 kD) (1H603) [Caenorhabditis ele
  Gene Ontology: Mol. function=protein binding; Biological process =ubiquitin cycle
  Coding regions on vcDNA: vcDNA=SeqID_89417; Strand=+; Position=18-632
MSESASDDENAHLIEIKFKTIQETYNVKVNENSTIKQLKKTMAKKLNQPEEKICLIFSGKILKDHENLSQHHIGDGMVLHMVIRNQPSTSTASAATTSSVSTAPTGGAAPNLAGTPPSLGGIGDLFNNPELVQGILNSPFMESMLANPDIIRTMLSQNPQFQQIIQNNPELGHIMNDPGTMRQAMEMIRNPTALNELMRNHDQAI

SEQ ID NO: 162995 - protein, 311 aa, Heterodera glycines
  Homolog annotation: Hit_ID=NP_494848.3; Match level="QueryCoverage =97%, HitCoverage=58%, E-value=5e-63, Identity=41%"; Hit description =AMP-dependent synthetase and ligase family member (55.7 kD) (2F35) [Caenorhabditis elegans] gb|AAC46810.4
  Coding regions on vcDNA: vcDNA=SeqID_89418; Strand=+; Position=26-958
MLFQRQKLPKICATLFPKCQIRRSSNFVELAGFTASTDSKQYAAKKLLLLKNGSSRSYNDVNVAAGRFAALLNKKYGIQKGDTVLCRTSKNVDALALYLAVLRLGAIYVPLNPTYTKRETEHFVNDAKPKVMVSLNASEDASFTQSGFDVKHVLCEKRLAEEALKQEPSCEVEPAEKDDVACILYTSGTTGRPKGAMVTHGGLVANAETCTDIWHFSENDINLHVLPFYHIHGLFISFNCTLMSKSSRIFLPKFDVDETIAYLPKSTAMMGVPTFYARMVEHAGLNRAAGKNMRVFISGSAQLTPQVVEKF

SEQ ID NO: 162996 - protein, 261 aa, Heterodera glycines
  Homolog annotation: Hit_ID=NP_741797.1; Match level="QueryCoverage =91%, HitCoverage=48%, E-value=4e-86, Identity=67%"; Hit description =MEChanosensory abnormality MEC-2, stomatin-like protein required for mechanosensation (51.9 kD) (mec-2) [
  Gene Ontology: Mol. function=protein binding; Cellular component =lipid raft; Biological process=signal transduction
  Coding regions on vcDNA: vcDNA=SeqID_89419; Strand=+; Position=50-832
MSSSTAELNPEDGGHPPQNTAVAIEQSQQAIHPPAQSGSGKIAAWASPNADDTEPYGICAKILIVLSYIITIITFPISVFMCIKIVQQYERAVIFRLGQLKKGGAKGPGLFFIIPCIDEYRKIDLRVVSFQVPPQEILSKDSVTVEVDAVVYFRVFNATISIVNIENSTGSTKLLAQTTLRNVLGTKTLSEMLSERENISHQMQEVLDEATEHWGVKVERVEVKDVRLPREMQRAMAAEAEATREAKAKVIAAQGEQQASR

SEQ ID NO: 162997 - protein, 272 aa, Heterodera glycines
  misc_feature (192)..(192): Xaa can be any naturally occurring amino acid
  Homolog annotation: Hit_ID=NP_506417.1; Match level="QueryCoverage =87%, HitCoverage=50%, E-value=2e-91, Identity=64%"; Hit description =WD-repeat protein (5O282) [Caenorhabditis elegans] emb|CAB02116.2| Hypothetical protein F53C11.7 [Caenorh
  Coding regions on vcDNA: vcDNA=SeqID_89420; Strand=+; Position=49-863
MTSTLRGFCLSPADQQTNLFSFCSEMATNASQKRKEIYRYKASFNVYAMGWSTKLDNHLKFRLAIGSFIEEYNNKVSIVQLHEDQGEFGHLGTFDHPYPSTKVLWIPDPKSAFPDLLATTGDYLRIWRIGGHNGASLEVRLDNNRSSEYCAPLTSADWNEVDVSLIGTSSIDTTCTIWQIETGQAVANTEPXIGGNVKTQLIAHDKEVYDIEFSKLSSGRDIFASAGADGSIRMFDLRHMEYSTIVFEEPSKKPLLRLAWNKQDHNYLATFA

SEQ ID NO: 162998 - protein, 176 aa, Heterodera glycines
  misc_feature (155)..(155): Xaa can be any naturally occurring amino acid
  Homolog annotation: Hit_ID=NP_492588.1; Match level="QueryCoverage =97%, HitCoverage=32%, E-value=8e-33, Identity=49%"; Hit description =protein phosphatase 1 regulatory, GEI-4(Four) Interacting protein GFI-2 (53.7 kD) (gfi-2) [Caenorhabditis
  Coding regions on vcDNA: vcDNA=SeqID_89421; Strand=+; Position=3-533
ARRKRIGHFGVRDSRRQSRKRKKFESPQAVPPAANTDFIQTARGAIRRQSLRDRSGMTLARLDSQREGSDLIRSWSKEDVSNEEMSAHHFGNGGPSTSHQPTANQQRRDSPPKRMQKQSQQKQKQMSPDEWLKKLEAESGGLRDEEEEQAEKNVXERERRGEHAEGSESTERQRGD

SEQ ID NO: 162999 - protein, 213 aa, Heterodera glycines
  Homolog annotation: Hit_ID=CAE68444.1; Match level="QueryCoverage =91%, HitCoverage=66%, E-value=2e-64, Identity=59%"; Hit description =Hypothetical protein CBG14232 [Caenorhabditis briggsae]
  Gene Ontology: Mol. function=glycogenin glucosyltransferase activity; Cellular component=soluble fraction; Biological process=glycogen biosynthesis
  Coding regions on vcDNA: vcDNA=SeqID_89422; Strand=+; Position=1-639
LDSADAENLALINRPDLGVTFTKLHCWRLTQYSKCVFLDADTFVVKNCDELFERPEFSAAPDVGWPDIFNTGVFVFVPSEQTYRNLLDFALVYGSFDGGDQGLLNAYFSTWRESDATHRLPFTYNVTTVAIYGYAAALKRFAPNIKIIHFLGKQKPWALLYGDGAAGMAFVSDYHKQWYQLYANIVQQLLPPSSSVISSSTPSSLPSSSFSII

SEQ ID NO: 163000 - protein, 208 aa, Heterodera glycines
  Homolog annotation: Hit_ID=CAE62158.1; Match level="QueryCoverage =93%, HitCoverage=5%, E-value=8e-26, Identity=42%"; Hit description =Hypothetical protein CBG06205 [Caenorhabditis briggsae]
  Coding regions on vcDNA: vcDNA=SeqID_89423; Strand=+; Position=51-677
MPLTDDRVRCQTDGDTGHVSLIISKCRPQDGDEYTLMVKNAHGKHKVGAKLLVTPAAESNLDIRAKQKKRGTGFSNSEQEKQRQRSDAEPKSKAERRKRQVYVVEEPRDTFVVPLNSQHANEKENATFECEVNDKEIDVKWFHDGAEIGMDGRHFKERAGCRRRLLIINVLIEDHGEYKCTAKDDETMAQLIVHPKFVKKAERKPVTF

SEQ ID NO: 163001 - protein, 111 aa, Heterodera glycines
  Homolog annotation: Hit_ID=NP_492071.1; Match level="QueryCoverage =93%, HitCoverage=94%, E-value=6e-18, Identity=40%"; Hit description =putative membrane protein family member (1H895) [Caenorhabditis elegans] emb|CAA95822.1| Hypothetical pro
  Coding regions on vcDNA: vcDNA=SeqID_89424; Strand=+; Position=60-395
MLRPPHFPLLLTAIVVVICLLSGTANGDKNLLDELRDLDIFQLKSGVSACPLLVGERCPESSPLYYFKCCGDLYSSCCVRLQDWAVGVIALLIVLILVAAFINLIRCIFCA

SEQ ID NO: 163002 - protein, 165 aa, Heterodera glycines
  Homolog annotation: Hit_ID=NP_509390.2; Match level="QueryCoverage =85%, HitCoverage=66%, E-value=1e-40, Identity=49%"; Hit description =putative protein family member, with at least 3 transmembrane domains (XI852) [Caenorhabditis elegans]
  Coding regions on vcDNA: vcDNA=SeqID_89425; Strand=+; Position=3-500
IANCPFLFDRFFYFRRFSSPPKMGEVRFHSDYVSSNRGITKIIQIVLGFVVCSVLCSNWYGGYSCFGEGRLGYVSGLNFVCLMINIILFLLNLFNIRPLKLEQLYNVAAALLLLVGIVLLLWYIIQYSYWNIWMIIAAVCVLIIFLLFQWDFKGNRTMSEGHLPI

SEQ ID NO: 163003 - protein, 357 aa, Heterodera glycines
  Homolog annotation: Hit_ID=NP_499504.1; Match level="QueryCoverage =93%, HitCoverage=78%, E-value=2e-97, Identity=52%"; Hit description =GLYcosylation related, UDP-N-acetyl-D-galactosamine:polypeptide N -acetylgalactosaminyltransferase, with E
  Gene Ontology: Mol. function=polypeptide N -acetylgalactosaminyltransferase activity; Cellular component =integral to membrane; Biological process=O-linked glycosylation
  Coding regions on vcDNA: vcDNA=SeqID_89426; Strand=+; Position=43-1113
MALLPLFLLLLPFFCPSLCSSDLPECPWVNPEKELQKWANLPVFPSKCNVTKDTPAEESGDEKEYWERGQHRYYFNQWVSDKIGPTRKLDKMAHPKCAEIDFSKVHSKVTVVVIYHNEMLSVLVRMINSIFNESPAHLLTEVILYDDFTESNLDIGDSLKEYAKIAKGNWESKIRFIKASERQGLIRAKVLASREAKGDVLIFLDSHCEVTPGWLEPLLAPIEENPKRVILPVIDLINANTFNYEKAMVAKGTFDWGLYYKWDYFDWSYFDVEENNVKPYKTPAMSGGLLAVSRDYFREIGEYDMGMEIWGAENIEFSIRVWLCGGEVLVAPCSRVGHVFRMRRPYRGKPGVDSSLY

SEQ ID NO: 163004 - protein, 264 aa, Heterodera glycines
  Homolog annotation: Hit_ID=NP_497622.1; Match level="QueryCoverage =92%, HitCoverage=38%, E-value=2e-11, Identity=24%"; Hit description =predicted CDS, cathepsin family member (3D897) [Caenorhabditis elegans] gb|AAK29976.1| Hypothetical prote
  Coding regions on vcDNA: vcDNA=SeqID_89427; Strand=+; Position=14-808
MENCLSNGNDLCRSGSFLLEMKPSTDLASLFVSLPGPVSNEGKAVDEPLGIMRVDNQSLEIAFDVQDIAEQTGCQSADFSSSMFFQKFGAKFVDIMLEPTTLCSPSWADAQQRLIMCKVRAEADCVTFAPKTIGRLEEELAQRCLLREYVERIEHNRTFHVNCRRCGHLIHSHSKGDFVFGVFPNDDWLETAPQMDYFCALSSDCCGAHLEMSSVQPRNSGEGILGFSPVLSADSSRHWLPGERKIVFSNSFILFQTLINWQRK

SEQ ID NO: 163005 - protein, 172 aa, Heterodera glycines
  Homolog annotation: Hit_ID=CAE64583.1; Match level="QueryCoverage =93%, HitCoverage=39%, E-value=2e-47, Identity=58%"; Hit description =Hypothetical protein CBG09336 [Caenorhabditis briggsae]
  Gene Ontology: Mol. function=glycine dehydrogenase (decarboxylating) activity; Cellular component=mitochondrion; Biological process =glycine metabolism
  Coding regions on vcDNA: vcDNA=SeqID_89428; Strand=+; Position=1-519
LSSKVARPKLAGLGARDVLRTEARLCLFGNEIDERTTPVEAGIAFVIAKRRRQTLGFPGAERIIRQLEKKDFVKKRVGLASTKAGRAARNKMPIANPTDGSSVGFVTSGCPSPTLGKNIGMGYVDKAYAKVGNILTVEAGRDRMIEVEVVKMPFVKSAYYLKPTSVNEDKKK

SEQ ID NO: 163006 - protein, 114 aa, Heterodera glycines
  Homolog annotation: Hit_ID=CAE63460.1; Match level="QueryCoverage =82%, HitCoverage=84%, E-value=2e-17, Identity=50%"; Hit description =Hypothetical protein CBG07924 [Caenorhabditis briggsae]
  Coding regions on vcDNA: vcDNA=SeqID_89429; Strand=+; Position=91-435
FLLRRRFRPQHQNRENQQQHPAEKQPFNAYLNPGFDKRSFDSFTGPGFTGLDKRAAFDTGFTNYDKRAFDSFTGPGFTGLDKRFEPFDGYGFNGFEKRSFDSFTGPGFTGMDRK

SEQ ID NO: 163007 - protein, 202 aa, Heterodera glycines
  Homolog annotation: Hit_ID=NP_491530.1; Match level="QueryCoverage =96%, HitCoverage=44%, E-value=3e-81, Identity=72%"; Hit description =2-kinase fructose-2 6-bisphosphatase (1F701) [Caenorhabditis elegans] gb|AAK68884.2| Hypothetical protein
  Gene Ontology: Mol. function=6-phosphofructo-2-kinase activity; Biological process=fructose 26-bisphosphate metabolism
  Coding regions on vcDNA: vcDNA=SeqID_89430; Strand=+; Position=65-670
MHSRVHQYSTRDQVRVPNVIALVGLPARGKTYISHKLCRYLNWIGIKTRAFNVGEYRRQACDFFQQGASEFFSPNNQIGTQIRDHCAKLAMEDMGLYLEKKEGEVAVFDATNTTRQRRKWLVDYCQRERINPKFRIFFVESVCDDPDIIAANISEVKVNSPDYRGKMTEEEAKADFLRRIENYKLQYEPLDNEKDDHLSYIK

SEQ ID NO: 163008 - protein, 196 aa, Heterodera glycines
  misc_feature (102)..(102): Xaa can be any naturally occurring amino acid
  Homolog annotation: Hit_ID=NP_505967.1; Match level="QueryCoverage =86%, HitCoverage=88%, E-value=6e-58, Identity=65%"; Hit description =stem cell derived neuronal survival protein like (5M244) [Caenorhabditis elegans] emb|CAA96655.1| Hypothe
  Coding regions on vcDNA: vcDNA=SeqID_89431; Strand=+; Position=1-589
RHEAQFICLFVFLFSKNYLANSHQLPSFPGQQEPLQGHHQQHAQQQQQQQQVNAGAEHQQQHAQFGGEQVKDEGHIKEHLEGKVDPTAHMTPEQLQFHYFNXHDLDKNGKLDGIELIKAITHFHQENASPGHQGASIPPPLPNENELENMIDSILREDDFNGDGYIDYGEFLKAQKLREDQAKSQQQQQQTPPPPQ

SEQ ID NO: 163009 - protein, 208 aa, Heterodera glycines
  misc_feature (45)..(45): Xaa can be any naturally occurring amino acid
  Homolog annotation: Hit_ID=CAE70938.1; Match level="QueryCoverage =77%, HitCoverage=38%, E-value=9e-12, Identity=30%"; Hit description =Hypothetical protein CBG17741 [Caenorhabditis briggsae]
  Coding regions on vcDNA: vcDNA=SeqID_89432; Strand=+; Position=3-627
DPDIFSVPPKFPLSIEQTIAHPLRVSAAHLQPTKDKMMTRRAFRXCSECATMLYRDQLSPNDVKPLLQSFALDHFPEIHISRPVKLGPGQNSAIFLTLTNNSSGPIDISLTGKRLEEEENCVNNSDFSLQIVLSNRDSTDEQPKMAHQQSDSRIINISQHRVGICAECVPSADSIDHYALFSLSFSHTSSDLPEKKLKSDVKVSLKQS

SEQ ID NO: 163010 - protein, 219 aa, Heterodera glycines
  Homolog annotation: Hit_ID=NP_501646.1; Match level="QueryCoverage =75%, HitCoverage=16%, E-value=1e-26, Identity=38%"; Hit description =putative protein, with at least 6 transmembrane domains, of eukaryotic origin (4K108) [Caenorhabditis ele
  Coding regions on vcDNA: vcDNA=SeqID_89433; Strand=+; Position=1-657
HGYTAGLLTLPLPALVFLWGTLASPRPSKLFWIVMIIYTEFEIVAKFAFQFGFWPWNGDTVGNNKVYKTEYVFGVQRIQGFAGKDVALLIALFFHRYMLRKFGLWRDASSDRLINEMPKKRMDNGSSSSSSAEKSPQKSTQSTVVPSSSGENFESVAKAQREQNSDDIEKGIKRQRPSYPRVRLLTAIGRDHQRNSEPRLFAQNLFGHLFGARGGRLFA

SEQ ID NO: 163011 - protein, 210 aa, Heterodera glycines
  Homolog annotation: Hit_ID=AAH47265.1; Match level="QueryCoverage =99%, HitCoverage=14%, E-value=6e-24, Identity=36%"; Hit description =MGC53503 protein [Xenopus laevis]
  Gene Ontology: Cellular component=cytoplasm
  Coding regions on vcDNA: vcDNA=SeqID_89434; Strand=+; Position=1-630
PTLGTSQVKSVRKELKMHLLRMLKHPGTFTLHNLHPRMKQLLIELGASQSEIQRAMPAINEIDEALKKRLAAATAVAAGTARQTTTEPKRHRKEPQQHEQEDLDLRDIKRIKLDEDEYDDGIIDLYKQLDNPDSANAATQKAIDITTNFVLERLSIHVVTKLVMISLYTLPDKMPAAFASSYTPIDEAGSEAQKRHLSRMMAIQMTREGE

SEQ ID NO: 163012 - protein, 280 aa, Heterodera glycines
  Homolog annotation: Hit_ID=CAE62153.1; Match level="QueryCoverage =99%, HitCoverage=52%, E-value=1e-120, Identity=71%"; Hit description= Hypothetical protein CBG06199 [Caenorhabditis briggsae]
  Gene Ontology: Cellular component=mitochondrion; Biological process =glutamate catabolism
  Coding regions on vcDNA: vcDNA=SeqID_89435; Strand=+; Position=2-844
GLAVFINDEKFMTKLGLTTGFKGKTFIVQGFGNVGLHSHRYLHRDGAICIGVQEYDCAIYNPNGIHPKELEDWKIANGSIRGFPGAKAFEPFTDLIFEKCDILVPAACEKAIHLGNAHRIQAKVIAEAANGPTTPAADAVLMNRGDCLIVPDMFINSGGVTVSYFEWLKNLNHVSFGRLTFKYERDSNYHLLASVQKSLERTFDRAVPVDPSEEFQLRIAGASEKDIVHSGLEYTMNRSAKQIIATTNKYNLGLDLRTAAYANAIEKIYQTYETSGFTFA

SEQ ID NO: 163013 - protein, 200 aa, Heterodera glycines
  Homolog annotation: Hit_ID=CAE65966.1; Match level="QueryCoverage =96%, HitCoverage=97%, E-value=1e-69, Identity=64%"; Hit description =Hypothetical protein CBG11149 [Caenorhabditis briggsae]
  Gene Ontology: Mol. function=protein tyrosine phosphatase activity; Cellular component=nucleus; Biological process=cell cycle
  Coding regions on vcDNA: vcDNA=SeqID_89436; Strand=+; Position=46-648
MMNIRSNGKIRFAVSCSSNMNRSMEAHFFLQKRGFNVQSFGSGNYVKLPGPSVDKPNIYEFDSTTYEHILQDLKQKDSKLYTQNGLLNMLDRNRRIKKCPQKFQNYKEKFCVIICLEERVYDQIVDFLQTRESTTGESVHVINFDIQDNHEEATIGALHVVELCKKLEDCEDLDNEIDEALSEFEANNPERNLLHTICFY

SEQ ID NO: 163014 - protein, 281 aa, Heterodera glycines
  Homolog annotation: Hit_ID=CAE69858.1; Match level="QueryCoverage =96%, HitCoverage=57%, E-value=4e-38, Identity=32%"; Hit description =Hypothetical protein CBG16187 [Caenorhabditis briggsae]
  Coding regions on vcDNA: vcDNA=SeqID_89437; Strand=+; Position=3-848
EHICTKTGATQIIWSINWDQSHMRRCLINVQSMMVDQEAKEGVIHALNGRKLIFGRGSHICCDGSLQFGADDAAGAWQKVCIESGVRRFDVRNLETLTERVRELLGGVQLVRRPHENVLNTIQQIQIFIGKICSQPKNEREMLRALLSPEIFVEIVNCYQELMVVEGCLQIPCCVEFPPLRKFVAANAIRSRQLRQENLERKWHLELARDACVSKLALSELSWDASLSFKTVRVCMEKLRRIGPEKSAQFARLSIHLSNSPKLFVMFNGRLSVPIDWVKEL

SEQ ID NO: 163015 - protein, 182 aa, Heterodera glycines
  Coding regions on vcDNA: vcDNA=SeqID_89438; Strand=+; Position=73-621
MSVHSELARSKILTCRNRLAVRRLALLEQYFELNKSVQCLLDDYRLNIMKAKSTSPGFVVGSVTALLSSQRELSPTIWVETAKSDCGSFLALNWPSKYAGEKGNDLRRRGGETFDGKGAEEAEGNGGHSTDFHPFGVLESQSVKAARKNIQKLLLILCDLANIQRQILSLGKEADETKLAEF

SEQ ID NO: 163016 - protein, 206 aa, Heterodera glycines
  Homolog annotation: Hit_ID=CAE70114.1; Match level="QueryCoverage =99%, HitCoverage=42%, E-value=2e-13, Identity=28%"; Hit description =Hypothetical protein CBG16566 [Caenorhabditis briggsae]
  Coding regions on vcDNA: vcDNA=SeqID_89439; Strand=+; Position=6-623
MPNLLQVLFGPVVYRPYQPNLLESGGNKLFSIGAGAYNTCVVLSPILVPYIAFSWTHSHHFSFLRFVLVFYAIAFSFRTIGRLTNVDYVRFIKLLGTVRKSPQNVTLLDTLKDYDFQVYAAPADFKASPGRTAKWHPPRERLPDLNPPLNFLRQAIAWTAANTFGRRMLFPGSMALFNSMLNSQLVDGRRKLLTEMGGKRKVIETE

SEQ ID NO: 163017 - protein, 88 aa, Heterodera glycines
  Coding regions on vcDNA: vcDNA=SeqID_89440; Strand=+; Position=100-366
MSSLEQLASPHNDFYESLFRQLNPSGSAEVDAASIAAFLKTAHGVSVAQLSQIWEIASELSGYKNRSALNKIGVYICLKLVAGIQHGN

SEQ ID NO: 163018 - protein, 222 aa, Heterodera glycines
  Homolog annotation: Hit_ID=AAH57117.1; Match level="QueryCoverage =51%, HitCoverage=63%, E-value=3e-11, Identity=34%"; Hit description =Mak3p homolog [Mus musculus]
  Coding regions on vcDNA: vcDNA=SeqID_89441; Strand=+; Position=32-700
MLVLRPPDGEQSVRQLMLLNISCLPINYGTNPRSTHYKRVTRNRLAEKGPDNGDECDTSFWTMMAYRHHFNDQNGTDCEEDAPMLVGAITVSNRNSNCSCCSSNKTDGVVQPQKQMFSVQIQTLAVLPTFRRHGVATRLLNSLINQCEKWANVENIFLHCQTTNEAALCLYRAHGFEVVQQIHGHYQCRAIDGESADAFLLERRFTNENDEERKVRQNAAFH

SEQ ID NO: 163019 - protein, 188 aa, Heterodera glycines
  Homolog annotation: Hit_ID=NP_493175.1; Match level="QueryCoverage =49%, HitCoverage=24%, E-value=1e-20, Identity=47%"; Hit description =predicted CDS, zinc finger protein EZNF (1N119) [Caenorhabditis elegans] emb|CAB05558.1| Hypothetical pro
  Gene Ontology: Mol. function=transcription factor activity; Cellular component=nucleus; Biological process=regulation of transcription, DNA-dependent
  Coding regions on vcDNA: vcDNA=SeqID_89442; Strand=+; Position=17-583
MAETFSLLSPTHLLNETSLNLRCPYCPKKFLKNTEAISHMDPCLKSRPYPCTNCSRRFKSAQNLSQHERIHTNVRPYNCQYCEKNFTQKSHLQQHERIHTAIVKRLINYCPASTTFWVNRPSHAVTVARRSIFIHPKYSTKKVFVAFTRPWTNRKKIRVKRTVSQRLHHFLNRAKRRRPNNHRHGDQQ

SEQ ID NO: 163020 - protein, 151 aa, Heterodera glycines
  Homolog annotation: Hit_ID=NP_509098.1; Match level="QueryCoverage =100%, HitCoverage=93%, E-value=4e-47, Identity=56%"; Hit description= esophageal gland cell secretory protein 11 like family member (XH131) [Caenorhabditis elegans] gb|AAA831
  Coding regions on vcDNA: vcDNA=SeqID_89443; Strand=+; Position=21-476
MNANLLSSTALLLLFSVPFICASIIPQQHTGIQSYRVKGRLLCGDLAAENVRVKLIDDDFGPDPDDDLDTGYTDTQGNFDLSGDTTELTTIDPHLKIYHDCNDALIPCQRRWKFELPNHYITSGKQPNKALDIGTWNLEAKMPGESHDCIH

SEQ ID NO: 163021 - protein, 211 aa, Heterodera glycines
  Homolog annotation: Hit_ID=NP_492210.1; Match level="QueryCoverage =93%, HitCoverage=47%, E-value=3e-67, Identity=64%"; Hit description =i-67 protein (1I607) [Caenorhabditis elegans] pir||T23321 hypothetical protein K04G2.2 - Caenorhabditis e
  Coding regions on vcDNA: vcDNA=SeqID_89444; Strand=+; Position=31-663
MTATTIAQDPTPSPRRVFLRDLCSLFCCPPLPSAIVAKLAFMPPEPSYRILTNDSGRTTLELIDGRTEWPHGHDELNNVEVFFTRTQRRNKIACMFVRPFELSHFTLLFSHGNAVDIGQMCNFYLGLGCRLRCNVFSYDYSGYGQSTGRPSEKNLYADIAAALKSLESRYQIPPEQVILYGQSIGTVPSIDLASCNPRIAGLVLHSPLLSG

SEQ ID NO: 163022 - protein, 381 aa, Heterodera glycines
  Homolog annotation: Hit_ID=NP_510454.1; Match level="QueryCoverage =82%, HitCoverage=67%, E-value=1e-111, Identity=61%"; Hit description= tyrosine aminotransferase (51.0 kD) (XP411) [Caenorhabditis elegans] emb|CAB03090.1| Hypothetical protei
  Gene Ontology: Mol. function=tyrosine aminotransferase activity; Biological process=phenylalanine catabolism
  Coding regions on vcDNA: vcDNA=SeqID_89445; Strand=+; Position=61-1203
MVSTSPSPPIAMAQHAPLSHRQHRAPLAKVLASEKSLYLSMNAIKTPKKAKMQKVAPIRAQIGDHSEWIPLRASKHSRQTVNPIRRFTDSLSVEPNPNKTPIQLNLGDPTLTGCLPPSESVVAALREAIDSHRFDGYGPAIGTQSAREAIAEHFSCSEAPISANDVVLASGCSHALEMAIVAIADPGHNILVPRPGFPLYSTLCQPNGIKTRQYRLKMEEDGLIDLQHLESLIDDRTRAIVVNNPSNPTGIVFPREHLEQILKLAQKYKLPIIADEIYGDLTYAEGAKFHPLATLSPRVPIITCDGIGKRYLVPGWRLGWLIMHNRFGVLSDVKAGIVSLSQKIVGPCALIQGALPRILRDTPQSFFDNTKALLAKNSEIV

SEQ ID NO: 163023 - protein, 213 aa, Heterodera glycines
  Homolog annotation: Hit_ID=CAE68917.1; Match level="QueryCoverage =87%, HitCoverage=14%, E-value=6e-70, Identity=66%"; Hit description =Hypothetical protein CBG14896 [Caenorhabditis briggsae]
  Gene Ontology: Cellular component=Arp2/3 protein complex; Biological process=actin cytoskeleton organization and biogenesis
  Coding regions on vcDNA: vcDNA=SeqID_89446; Strand=+; Position=3-641
DGKVERDADGKEVRYPVILSAKEKTIARRVVLAFGQSVCGFDLLRANGCSYVCDVNGFSFVKTSTKYYEDTAKILGNTILRRLASSLSIPWHIPFQDDDPPLVSTPSGKIMELRCVLAVIRHGDRTPKQKMKVAVKDERFWNMFKKYDGPRKRELKLKKPTQLMEILEIVRHLLQESLEKRQTLLTISSKNMARFLKDKRDDLAPAEETSVMN

SEQ ID NO: 163024 - protein, 86 aa, Heterodera glycines
  misc_feature (47)..(47): Xaa can be any naturally occurring amino acid
  misc_feature (74)..(74): Xaa can be any naturally occurring amino acid
  Coding regions on vcDNA: vcDNA=SeqID_89447; Strand=+; Position=194-450
SVPDPKIPNSAHRKSTTDSIEIAKRAERERKRKERARERGRKNEREXEETDRQREKTLCHKKYNLNDKWDMWLXKKKKKKKKKKKK

SEQ ID NO: 163025 - protein, 223 aa, Heterodera glycines
  misc_feature (181)..(181): Xaa can be any naturally occurring amino acid
  Homolog annotation: Hit_ID=NP_508615.1; Match level="QueryCoverage =91%, HitCoverage=57%, E-value=1e-31, Identity=38%"; Hit description =choline/ethanolamine kinase (39.7 kD) (XE193) [Caenorhabditis elegans] gb|AAB52502.1| Choline kinase c pr
  Gene Ontology: Mol. function=ethanolamine kinase activity; Cellular component=cytoplasm; Biological process=phosphatidylethanolamine biosynthesis
  Coding regions on vcDNA: vcDNA=SeqID_89448; Strand=+; Position=3-673
LRKICQKMARMHKIPLDPDSANVPMFVAKCEQWLANLPTHFEQVEMQQNFDQNFNGSSLSEQLTELIKALETSESPLVVFAHNDLLLFNILFDEEGTGDVHFIDYEYAGQNYQLFDIANHFCEYAGVDECPDYGMNSASEDERRHFLRRYFVYFGQPIEEECEMDKMLCKIRHFEAAAHFXWTLWAIHQAAKSAIQFDYMRYAITRHRYCTRLMTSSGIAKNN

SEQ ID NO: 163026 - protein, 208 aa, Heterodera glycines
  Coding regions on vcDNA: vcDNA=SeqID_89449; Strand=+; Position=3-626
APQASPHVAFDYGATKLAAAAPSSYGSASEAQPAPAGDENGTKEVSQRKNATPAQTAQHNNAPPQQPARQTTAAQNVLEQRRAKRRCPREAGFVQADAASGGGMHSPAAAARISHRVIGHTAPSTEYASGPRPAGTDAPRVYAAQPYAAPTRSISSVSKSRGSIGPEYEQTAAEQSPPSVKPPSTRTKAQPAGSAPCNTQRCNGRGGP

SEQ ID NO: 163027 - protein, 214 aa, Heterodera glycines
  Homolog annotation: Hit_ID=AAC98796.1; Match level="QueryCoverage =92%, HitCoverage=81%, E-value=1e-82, Identity=74%"; Hit description =dolichol monophosphate mannose synthase [Caenorhabditis briggsae]
  Gene Ontology: Mol. function=dolichyl-phosphate beta-D -mannosyltransferase activity; Cellular component=nuclear envelope -endoplasmic reticulum network; Biological process=protein amino acid glycosylation
  Coding regions on vcDNA: vcDNA=SeqID_89450; Strand=+; Position=34-675
MDDSHQDNGRKQQNTFLTPKFSILLPTYNEAENLPICLWLIIKYLKGLSYEVIIIDDNSPDGTQEVAKSLQKEFGAGRIKLLTREGKLGLGSAYVFGLKQAQGEFVILMDADLSHHPRHIPEMVTLQEKHGYDIVTGTRYAMGGGVSGWDFRRKMISRGANFLAQFLLQPGVSDLTGSFRLYRKSVLSKLVVESVSKGYVFQMEMMFRAKKGGF

SEQ ID NO: 163028 - protein, 100 aa, Heterodera glycines
  Homolog annotation: Hit_ID=NP_496981.1; Match level="QueryCoverage =95%, HitCoverage=46%, E-value=9e-25, Identity=58%"; Hit description =HesB YadR YfhF family protein like precursor (2O630) [Caenorhabditis elegans]
  Gene Ontology: Cellular component=mitochondrion; Biological process =cell ion homeostasis
  Coding regions on vcDNA: vcDNA=SeqID_89451; Strand=+; Position=429-731
LRRIAAPGEHLRICVDSGGCSGFEYKLTLDKRLDEAEDEVIKASEGAIVVVDKLSLQFLRGSKLDFAEDLMRSAFRITDNPLATLGCSCGASFAPKNQIE

SEQ ID NO: 163029 - protein, 217 aa, Heterodera glycines
  Homolog annotation: Hit_ID=NP_499385.2; Match level="QueryCoverage =100%, HitCoverage=20%, E-value=1e-107, Identity=87%"; Hit description=membrane Calcium ATPase, Sarco-Endoplasmic Reticulum Calcium ATPase (115.5 kD) (sca-1) [Caenorhabditis
  Gene Ontology: Mol. function=calcium-transporting ATPase activity; Cellular component=smooth endoplasmic reticulum; Biological process =calcium ion homeostasis
  Coding regions on vcDNA: vcDNA=SeqID_89452; Strand=+; Position=3-653
TAVAKSAAEMVLADDNFSTIVAVEEGRAIYNNMKQFIRYLISSNIGEVVSIFLVAALGIPEALIPVQLLWVNLVTDGLPATALGFNPPDLDIMDRLPRSASESLISKWLFFRYMAIGTYVGVATVAASMWWFLIYEDGPQVSYYQLTHWMRCEIEPENFEDLDCAVFVDNHPNAMALSVLVTIEMLNAINSLSENQSILKMPPWTNIWLCAGIALFM

SEQ ID NO: 163030 - protein, 186 aa, Heterodera glycines
  Homolog annotation: Hit_ID=AAH86735.1; Match level="QueryCoverage =91%, HitCoverage=18%, E-value=9e-25, Identity=37%"; Hit description =Zgc:101763 [Danio rerio] ref|NP_001008625.1| zgc:101763 [Danio rerio]
  Gene Ontology: Mol. function=structural molecule activity; Cellular component=cilium; Biological process=cilium biogenesis
  Coding regions on vcDNA: vcDNA=SeqID_89453; Strand=+; Position=49-606
MRLRLRLSPWSFRGAVPGVVWVGADEVFSVSDDHSLCRWTVSKTEANFLSNALKDSIFPTSLSAAFPFAAGRSPFSGGLSIRSGKKQQRTSAIHSSQSAGNELILMTASDGKIHLITPAGKIERTIEAHQGAAILARWSTSEPGGAGGFVSCGEDGLLKMWSRNGMLRSMLAQLGKPIYAMDWNGN

SEQ ID NO: 163031 - protein, 307 aa, Heterodera glycines
  Homolog annotation: Hit_ID=CAE61649.1; Match level="QueryCoverage =94%, HitCoverage=81%, E-value=2e-77, Identity=52%"; Hit description =Hypothetical protein CBG05583 [Caenorhabditis briggsae]
  Gene Ontology: Mol. function=RNA binding; Cellular component =cytoplasm; Biological process=mRNA splicing
  Coding regions on vcDNA: vcDNA=SeqID_89454; Strand=+; Position=40-960
MSEEKFEDVDGSIIAQKRQNTENGGPASKKANVIESDNLQIKVLIPSAAVGALIGKGGETMRNLKNDSGCRVQMSKNLEVYHGTSERICLVKGKLAATMIVMGAILEKIQEKIDANHASDHFDLKGLDRTKEMKFVVPNTSAGMVIGKNGTSIKEIRDTTTANIQIYPKAGSEEAKISAERVITVGHESNEVLLSAVQRVLEKVVADPMHAQPVPAESQLASGFEFGGSRLSAGSNQFGGISNMGNNSEAMHGKSFGGPSFKFNPLQGTGNNELLAFLDNLQSTLRSSGFNDQSVSEVMQAMQVLAK

SEQ ID NO: 163032 - protein, 55 aa, Heterodera glycines
  Coding regions on vcDNA: vcDNA=SeqID_89455; Strand=-; Position=424-591
RSELKKNYQKNVDGINGMKNMTGKGFGRLYIYSDRLEERRMGIWDGEFTLIPAEH

SEQ ID NO: 163033 - protein, 215 aa, Heterodera glycines
  Homolog annotation: Hit_ID=CAE60878.1; Match level="QueryCoverage =96%, HitCoverage=18%, E-value=7e-26, Identity=30%"; Hit description =Hypothetical protein CBG04590 [Caenorhabditis briggsae]
  Gene Ontology: Mol. function=tRNA (guanine) methyltransferase activity; Cellular component=cytoplasm; Biological process=tRNA methylation
  Coding regions on vcDNA: vcDNA=SeqID_89456; Strand=+; Position=39-683
MSRSHYDKIMFPPISAHGMLTLDRSKFTKSIQIPFVSVPVKCIDRVRLLSAVRAVCLERMPRLKPWHTPPNCDGSVERLLLFDPDKFGEEATNDLAQQLSQTMDSSPEFGKMAYTMEYEDWDLRRCIQSVLPDGFEFSGFEQCGHIIHLNLREHVLPFRFTIGHILLDKIPSARTVLNKVDTLTHEFRVMDAELVAREAEFMTEVVEHGLRYRLD

SEQ ID NO: 163034 - protein, 199 aa, Heterodera glycines
  Coding regions on vcDNA: vcDNA=SeqID_89457; Strand=+; Position=3-602
GVKSSELAAYLFDQLRNLSKLETPITDQTVDVIVKTLKLVGRFLENDRGPQAMAEFLALFDRSIQETTTDQLSEPAREKVRCLFNLRENKWGVVAEPNVGDGPLTTASTSVGIIGPDDVPLTEDECAFMEENLDNFVDNSPGESQCLNAFDEDNVEDDFEKFLQATAIRAAEKALEKVSIDEDDDASSIVSSHKFSTSK

SEQ ID NO: 163035 - protein, 211 aa, Heterodera glycines
  Homolog annotation: Hit_ID=NP_495990.1; Match level="QueryCoverage =97%, HitCoverage=30%, E-value=5e-24, Identity=32%"; Hit description =tubulin-tyrosine ligase (76.8 kD) (2J631) [Caenorhabditis elegans] emb|CAA87783.1| Hypothetical protein D
  Coding regions on vcDNA: vcDNA=SeqID_89458; Strand=+; Position=36-668
MTHHLNFDQFLQVHEPQLLASGLPELFWKSLYKKISNQIFDAGKYFEVIIEESEPNETISSQVKAMSELKMDDPENVFLIDHAWTFRPNTARFALQQVDGLRKRLLDMFNIKAWYANKECLKDPFADDSADQQQKCADAVATHSADCEDSEVASPCGQNVEEIWEKHCEMDDLIIDEMWKYAMTYSIRMLNLEMDEHQIPVWYVMDEFGVR

SEQ ID NO: 163036 - protein, 214 aa, Heterodera glycines
  Coding regions on vcDNA: vcDNA=SeqID_89459; Strand=+; Position=1-642
QLNALVSKLSLTPNKMNERAEFTQQLKTFVQPYFVSPLQIRVFGSSSTGLGFVNSDLDLNLVFDEDLINCGDFARIPSVSSPENGPTLDDIDQQLTPEKLKRSPIDRDTFNRLPKIDRVRLLNRLINEFRKEKGSVTAHVPIPDARTPVVRFLTRLSSARVSCELSVQNLLGECKANLIRDLVRAETTGTLWRLIFFFKLWALCNGLFSPDPQL

SEQ ID NO: 163037 - protein, 259 aa, Heterodera glycines
  Coding regions on vcDNA: vcDNA=SeqID_89460; Strand=+; Position=27-803
MDKENKKPKGTKRSKNPEETSKQREENQNKENDDEFIHPPRRRSARLIAISKPALSSDLSASAEDFVHGKGTKTAKSEVFGTDALFGVSSASFTSPFNSYLTSSVEPIKLSSDEATVSSNRSLTKRLNATNIQNAQSLGEGTSKATLPLSSDDDGEEDEWGAMELLHTDKTEKKVIEVELDEKHSDLFKLQINPLKERDAKEAEERAKWEHEIELEIMRKRREFQEGLHRFHFLTFVAHLRFMAHSLLRNSSTLLTPFT

SEQ ID NO: 163038 - protein, 160 aa, Heterodera glycines
  Coding regions on vcDNA: vcDNA=SeqID_89461; Strand=+; Position=186-665
SMPRRPKTLNRNGGTSPVSCQGMEVELDAWAAIMNGLQGPAREAEEALFTAFIRDDRHLTEWLEDAREMLAHIAAELADEPNQPIAAGGQQPAVAVNPPVPAVPFVNNAAFLGGANVQQPAAVANHANQPPLVPNNAQIVPNPRFGRVSRVPSTVPPLSP

SEQ ID NO: 163039 - protein, 96 aa, Heterodera glycines
  Coding regions on vcDNA: vcDNA=SeqID_89462; Strand=+; Position=36-326
SAHLSLFHANFGSDQLIFRPLISPFSPIRSQFGPDRLLALPYFLCNFTLGSIRFVTFVLIPGLITSFAFFISVPISPFDQSNQPSMPISALIKSFC

SEQ ID NO: 163040 - protein, 215 aa, Heterodera glycines
  Homolog annotation: Hit_ID=NP_505775.2; Match level="QueryCoverage =93%, HitCoverage=37%, E-value=9e-26, Identity=33%"; Hit description =putative protein, with at least 3 transmembrane domains, of eukaryotic origin (5L370) [Caenorhabditis ele
  Gene Ontology: Biological process=regulation of protein activity, epigenetic
  Coding regions on vcDNA: vcDNA=SeqID_89463; Strand=+; Position=4-648
MPTGSRVPLIVERRSDETEEDTWTVYPTAGICIKFKEAHFSAASSVSGPSTSKFFINLAHCTELPPPHRHAELDEDKVAQMVEEDPDAFRIPICVGELDRSAEDRSGEAVAKVDVLVNSEFFHKRISQSEFFRQLTLRIVCQAIEIKHSLRVDIGKQVILRNKKCIGELCAQRIRKRPMTTKEANGEGKVKETTDTKEEEDEEERTEVDQMLDIE

SEQ ID NO: 163041 - protein, 214 aa, Heterodera glycines
  Homolog annotation: Hit_ID=EAL39955.1; Match level="QueryCoverage =87%, HitCoverage=64%, E-value=6e-16, Identity=28%"; Hit description =ENSANGP00000014227 [Anopheles gambiae str. PEST]
  Coding regions on vcDNA: vcDNA=SeqID_89464; Strand=+; Position=3-644
SSLRLGSQRSHAVNAVHPKREKPNYERPKSQQSTKTEQQKCWRCGQTNHHHAACPQKGYKCRKCSQNGHIELRCEAVQEWRKKNAKSWLKKNVGNVHIVTVNIGTTAKPTTKSTLLRVKVSFQGKVIEFVLDSGAEVNVINEMTYKLIGSPKIKACKEQAVLYDGSTRSFIGKGTGTFEFNGVNVEQEFYVAGKDSLNLLSIQTMDAFGLLDEL

SEQ ID NO: 163042 - protein, 83 aa, Heterodera glycines
  Coding regions on vcDNA: vcDNA=SeqID_89465; Strand=-; Position=3-251
SDVIMIFEPISDVSGVSMPGFFQNCQDQEYTYRMNLSINKIKVFSELFGGALTAKFSPAILFFTKKKIYKAQFLKIFFWPILK

SEQ ID NO: 163043 - protein, 311 aa, Heterodera glycines
  Homolog annotation: Hit_ID=NP_494721.1; Match level="QueryCoverage =100%, HitCoverage=61%, E-value=1e-123, Identity=67%"; Hit description=glycerol kinase (55.2 kD) (2E383) [Caenorhabditis elegans] gb|AAA79749.1| Hypothetical protein R11F4.1
  Gene Ontology: Mol. function=glycerol kinase activity; Cellular component=mitochondrial outer membrane; Biological process=glycerol metabolism
  Coding regions on vcDNA: vcDNA=SeqID_89466; Strand=+; Position=58-990
MVLLGAIDQGTSSSRFLVFDSENGNLVAGHQLEVQQQFPNPGFVEMCPEQIFKTTVRCIKSTCEELNRRGIDPKKEIKAIGITNQRETTIVWDRETGCHLSNAIVWLDCRTHELCDEYIQRTSTRDKNHFKAKTGLPIHPYFCALKLRWLLNNVPEVKKSLQNGTLMFGTVDSWLMWKLIGIHATDVTNASRTLLMDLQNRKWSTEMCTFFDIPMEILPEIRSSAEIYGHLQKGPLEGIPLAGCLGDQQSALLGHGCLQAGEAKNTYGTGTFMLCNTGQRAYISKNGLLTTISYQFGQASPVCYALEGSGS

SEQ ID NO: 163044 - protein, 176 aa, Heterodera glycines
  Homolog annotation: Hit_ID=NP_500013.1; Match level="QueryCoverage =85%, HitCoverage=10%, E-value=6e-30, Identity=42%"; Hit description =predicted CDS, polyprotein family member (4B673) [Caenorhabditis elegans] gb|AAC02594.1| Hypothetical pro
  Coding regions on vcDNA: vcDNA=SeqID_89467; Strand=-; Position=9-539
GSSHPEGALKRQWITSKTFKHCYLKFGGCTSLLTDNATAFTSDFFKSFCSLLYINKCYAIPHWSQGNAVVERSFRTFHNILAKYISSEEPDFDEFLECANFCYNTSIHSSTKETPFFLVFGRDPIFCIEQILNPNTEPENTSEVDNVKQKLVKSLRKAWESAAAVIKEAQLRKSTI

SEQ ID NO: 163045 - protein, 63 aa, Heterodera glycines; identical to SEQ ID NO: 157419
  Coding regions on vcDNA: vcDNA=SeqID_89468; Strand=-; Position=379-570

SEQ ID NO: 163046 - protein, 223 aa, Heterodera glycines
  misc_feature (174)..(174): Xaa can be any naturally occurring amino acid
  Homolog annotation: Hit_ID=CAE67927.1; Match level="QueryCoverage =100%, HitCoverage=100%, E-value=3e-54, Identity=50%"; Hit description=Hypothetical protein CBG13527 [Caenorhabditis briggsae]
  Gene Ontology: Mol. function=receptor-associated protein activity; Cellular component=integral to plasma membrane; Biological process =immune response
  Coding regions on vcDNA: vcDNA=SeqID_89469; Strand=+; Position=186-856
MTLQWTVVAFILYAEIATIIVLLLPWVRPTMWKKVFNSRVVHKLKQFSNVYAYAFIFVLILLFVDATREVRKYSHVDTTREMVGRVAEADAVVHMRLFRAQRNLYLSGFSLLMALIISRIVTLLARCAHLELAAEAAMKQAEGAGKAAQTLLGKEGDVNSLSGEEAKKLRNRSXKEMGAKLKKAETDRDAMKAQAENLQEEYERVSQQLRTAEASHNGNKKSD

SEQ ID NO: 163047 - protein, 183 aa, Heterodera glycines
  Coding regions on vcDNA: vcDNA=SeqID_89470; Strand=+; Position=3-551
PILSGKKVSWDMATASCTDTDDQPQRKNSKGSYDYIDADECHDVVTHHSSTPFYSIRNSNSTRPSSSHHAQMSSSSSPQSRYDYLDFAGKPDQPQQHQLRRQQQRAAPQQRVAVPPPALRRAAASADEPLYATASSQIYSLGGSEDPYSSIVSIGGGYGSGSATYDQHGYSRIINSNKNGTTG

SEQ ID NO: 163048 - protein, 175 aa, Heterodera glycines
  Homolog annotation: Hit_ID=NP_490690.1; Match level="QueryCoverage =98%, HitCoverage=99%, E-value=3e-47, Identity=49%"; Hit description =growth factor (1A656) [Caenorhabditis elegans] gb|AAB97554.1| Hypothetical protein F56C11.3 [Caenorhabdit
  Gene Ontology: Mol. function=thiol oxidase activity; Cellular component=mitochondrial intermembrane space; Biological process=iron ion homeostasis
  Coding regions on vcDNA: vcDNA=SeqID_89471; Strand=+; Position=9-536
MDFGPRDDEGKPCKACFSFEDMLRMMGKKKTADRRNGEAQNKTAGDEPSTSSSPSADRRRTDCPLDKDELGRSTWNLMHSMSVYYPKEPTEQQKTAMGQTIDGISKTYPCDHCAADFRADLRAHPPLLNSRDAFARWMCEAHNRVNVKLGKERFDCSRVMERWRDGWRDGSCEKN

SEQ ID NO: 163049 - protein, 188 aa, Heterodera glycines
  Coding regions on vcDNA: vcDNA=SeqID_89472; Strand=+; Position=1-567
QVLPQFVPPFLLLILLSSACPFSLAFSSDILPSVTNSTGIGNGTDATTDPTDTTGNSDLMTSATLPEETTAKEEEGTKPGTDGTARDGQGTGEPQKDGEGMKQDTGVSAADGNGTAEPPKEGDESPQESFACSVLCWTLIIVGGVFICAVGLTAFVLLTVHYQNARADPNNPSAAVQMSAIPRGMTAH

SEQ ID NO: 163050 - protein, 197 aa, Heterodera glycines
  Homolog annotation: Hit_ID=CAB88203.1; Match level="QueryCoverage =100%, HitCoverage=94%, E-value=7e-99, Identity=70%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_89473; Strand=+; Position=8-598
MQETHIVLGIGTVCSLLAIIATVVTLPSLYSEMNEMSTKVHAGVEAFRVNTDSAWTDLMDVQVAVSPPSKPRANPFSSIFRAKRQLPGHCQCGPLQQPSCPPGPPGPAGAPGQPGQPGGAGQPGQPGAPGQPAAPCAPQHIPCPRCPAGPPGRPGGQGPPGQQGAPGQPGSPAPGGGQGPPGAPGPQGPSGQPGRSG

SEQ ID NO: 163051 - protein, 52 aa, Heterodera glycines
  Coding regions on vcDNA: vcDNA=SeqID_89474; Strand=-; Position=144-302
LASPPFTHRPLHPLITPPQLTPQLPSPSMSRPIFGHMSDDAFLFIYLCAPLA

SEQ ID NO: 163052 - protein, 324 aa, Heterodera glycines
  Homolog annotation: Hit_ID=NP_505605.1; Match level="QueryCoverage =99%, HitCoverage=40%, E-value=3e-34, Identity=32%"; Hit description =WD repeat domain 20 (5K612) [Caenorhabditis elegans] emb|CAA96589.1| Hypothetical protein C08B6.7 [Caenor
  Gene Ontology: Biological process=meiosis
  Coding regions on vcDNA: vcDNA=SeqID_89475; Strand=+; Position=1-972
NLYIATGGEDDLLTVYSLAENRVVCRGQAHKSWISEVAFDCYAPEFMLEQTQIFDEKRCCPPLKGEGTCSSFATNEGNAFQNGHHFPSGHEESVSSAPQIGHLPFANCDDLRTTNTNSLQLLPNGKVTHRNGSSDDANDVSHCQPQLLYRVGTVGHDCQLCLWDLSEDILASPPLSQHHFDEITVSPSPSNFANVSPRNTTVIPIGFANALSTTETDVRTADKPSDANSKSSGRFRKFHKRGFSFGSRLTGNERKQHGNSSNGANSNESTLKRGENYAQFLGTVQCPRLEDVPMIEPLMCKKIAHERLGALLLREDCIVTCLSG

SEQ ID NO: 163053 - protein, 195 aa, Heterodera glycines
  Homolog annotation: Hit_ID=CAE65006.1; Match level="QueryCoverage =98%, HitCoverage=71%, E-value=6e-76, Identity=65%"; Hit description =Hypothetical protein CBG09844 [Caenorhabditis briggsae]
  Gene Ontology: Mol. function=phosphatidylinositol transporter activity; Cellular component=membrane fraction; Biological process =nonselective vesicle transport
  Coding regions on vcDNA: vcDNA=SeqID_89476; Strand=+; Position=2-586
EYQIGQLFSVAEASRQETGGGEGVQVLRNEPFEGESLFNGQFSSGQYTHKIYHFDSKVPSLLRAIMPKGSMSVHEHAWNAYPYCKTELTNPDFMKDSFFIRIETIHLNDRGTTENALCLTTDMLSKRQVVRIDIANDKEFINAADIREDTKPSTFHSERTGRGPLLQSWQTNCEPVMCAYKLVTINFQWFGFQNW

SEQ ID NO: 163054 - protein, 292 aa, Heterodera glycines
  Homolog annotation: Hit_ID=NP_998362.1; Match level="QueryCoverage =96%, HitCoverage=78%, E-value=3e-52, Identity=38%"; Hit description =zgc:77832 [Danio rerio] gb|AAH65456.1| Zgc:77832 [Danio rerio]
  Gene Ontology: Mol. function=zinc ion binding; Cellular component =nucleus; Biological process=regulation of transcription, DNA -dependent
  Coding regions on vcDNA: vcDNA=SeqID_89477; Strand=+; Position=24-902
MGRKKKKPQKPWCWYCNREFEDEKILIQHQKAKHFKCHICNKKLFTGPGLAIHCMQVHKESIDKIPGALPGRDNVNIEVYGMEGLPPESTRGHVEDDSDMQPSKIPRPAFPPGMSMSGMVPPIAAYNQYTPRTPFGMPSYGMPRPGTVPLPHHQQQQQQQMAAMMAAAAAAGAGGRMPATSTAASIGAIPTPPAGIVPPPPLPAGIPSPASGGAIPMPPQAAFAAYQDKSISGGKYGTRDEPSTSAASSSTMVKTLGAKTRIVCQDEQTSLEEMMAQRIVPTYTRGLMPFVR

SEQ ID NO: 163055 - protein, 153 aa, Heterodera glycines
  Homolog annotation: Hit_ID=AAH10191.1; Match level="QueryCoverage =94%, HitCoverage=31%, E-value=1e-23, Identity=37%"; Hit description =Protein tyrosine phosphatase, non-receptor type 1 [Mus musculus] gb|AAA98605.1| protein tyrosine phosphata
  Gene Ontology: Mol. function=protein tyrosine phosphatase activity; Cellular component=cytoplasm; Biological process=signal transduction
  Coding regions on vcDNA: vcDNA=SeqID_89478; Strand=+; Position=136-597
MDEAYFLRKFDEYERNDSWDQVFHKINVESENQAKKLSLCCDLSNTFHEKNRYRNVLPYDQNRIMLRCGVSSESDSYINASPLHLPFAHRNYILTQGPLPNTTCDFWQMIFEQEVSICIMLSKVMEKSFVKCHSYFPSKDEKKIAFNNWGMRT

SEQ ID NO: 163056 - protein, 153 aa, Heterodera glycines
  Coding regions on vcDNA: vcDNA=SeqID_89479; Strand=+; Position=4-465
EMASVTDRFLMNWKGIPLGFGLVTSTTCSYLSNKSRWLSKIRSSIAQRLLESKETKIAEQMLQQRRRNELMLHFKMASYGAPVALGTLAAGGILSSLPKILRLPNSIGFTVCGFGLSIGAFIVGALLLDGPMYAYTEWVQQRTDKGTEKQKVE

SEQ ID NO: 163057 - protein, 372 aa, Heterodera glycines
  Homolog annotation: Hit_ID=AAN15386.1; Match level="QueryCoverage =56%, HitCoverage=35%, E-value=6e-18, Identity=27%"; Hit description =unknown protein [Arabidopsis thaliana] gb|AAF79711.1| T1N15.19 [Arabidopsis thaliana] gb|AAL38346.1| unkno
  Coding regions on vcDNA: vcDNA=SeqID_89480; Strand=+; Position=3-1118
MPLPIRFFVLKICQQNGRNGKFVSLLTAALHKELSPPHFRRFFASTTSASSDDGFVVEKVENGNAKNYESIDGAWKCTNCAHLNWPQQRICKHCTIGIPTEAQMAILKQLLWVCPNCTARNTGDHCGNCALARCSVYKGFWVCSRCTWRNIPVNFSCRKCKKGKQTEEQRQLIQQQRWVCGECKHHNFKEECFSCGAPESKRLPDGVGGESLPDGSWYCVGCGFLNFPNYSKCRHCRREEPTDEQLGVIHSSRWQCAECHFDNYESNLTCHHCDAPRPTEGQLPATSDCQYWVCSSCLWRNFPTHLSCQKCIKGRAPEENRQQIQQLRWVCGICRHHNFKEDCFKCGAPKSKGFSCGIGGESLDDGSWYCVS

SEQ ID NO: 163058 - protein, 242 aa, Heterodera glycines
  Homolog annotation: Hit_ID=NP_503119.1; Match level="QueryCoverage =78%, HitCoverage=37%, E-value=5e-37, Identity=45%"; Hit description =glucocerebrosidase (4S421) [Caenorhabditis elegans] emb|CAB02924.1| Hypothetical protein F11E6.1a [Caenor
  Gene Ontology: Cellular component=extracellular space
  Coding regions on vcDNA: vcDNA=SeqID_89481; Strand=+; Position=1-729
GTPGGEQTIDGVAVHWYSPGDYDKLTKVHNLRPNKFIFASEACTGYEVFEHKVLLGDWSRGRAYARDILNDLRNWVVGWTDWNMCLDLEGGPNLARNFVDSPIIVNASAGEFYKQPMFYAMAHFSRFVPRDSSVIGSSLFVANGGVNKLGEKKVDKSVVPNASTAASVDNSTQSTAVEHIAFQTPNGLHVLVLINSDRDAHNVSIFDQTEGRRWTVPLGGDAIVTAIWKPKNDGGKAAKNAQ

SEQ ID NO: 163059 - protein, 288 aa, Heterodera glycines
  Homolog annotation: Hit_ID=AAA80437.6; Match level="QueryCoverage =87%, HitCoverage=83%, E-value=4e-52, Identity=40%"; Hit description =Carbonic anhydrase protein 5 [Caenorhabditis elegans] sp|Q10462|CAH5_ CAEEL Putative carbonic anhydrase 5 p
  Gene Ontology: Mol. function=zinc ion binding; Cellular component =membrane; Biological process=one-carbon compound metabolism
  Coding regions on vcDNA: vcDNA=SeqID_89482; Strand=+; Position=22-888
MVNFFVIFVPFLLLIVSNQLKAEETEENRHKTEETWNYEEPEEWGGKCQKGDRQSPIDIHKQWFIDYKIPAISFANYEKNGTVTMKNNGHTVVVSGFDTWEKQPNIADGGFGSKYMLSQFHFHWSQNENGSEHTVDGEHYDAELHLVHVKEGLSLSEALALSDGVAVLGIFFKRAYVGSALLALQNGLSQVTNKDDSVTIEHYEPNDLLPTASEVFFRYNGSLTTPDCNEAVIWTVFAVPKSISREQIQLLRAINGHDGKPISSNIRPVQKLSRKVQKFRYNKVSILP

SEQ ID NO: 163060 - protein, 263 aa, Heterodera glycines
  Homolog annotation: Hit_ID=XP_394891.1; Match level="QueryCoverage =55%, HitCoverage=19%, E-value=2e-23, Identity=39%"; Hit description =similar to ENSANGP00000024539 [Apis mellifera]
  Gene Ontology: Mol. function=electron transporter activity; Cellular component=nucleus; Biological process=carbohydrate metabolism
  Coding regions on vcDNA: vcDNA=SeqID_89483; Strand=+; Position=94-882
MVRMADVSQDDILVVEGAIDNDQTLKNLVERTYNKFGQIDVLVNNAGSILQHQRSRQNSNSNNSTSSNNYGYDYTNGQNGAEEEDGGRGRYHGFRGFRRTSSSATAMTSRRTCSIFGALDNDFDFLFNINLKSIAKLTRLCAPYLEETKGAVVNISSFGTQRSLSDYTYYSTIKNALDNYCRSIAVKFAKRDIRVNNINPGFIIGETLDEDDNRANKFELNWIKNHVPMGRGGTAEEIGKVVAFLASDDASYITGATITVDGA

SEQ ID NO: 163061 - protein, 263 aa, Heterodera glycines
  Homolog annotation: Hit_ID=NP_508395.1; Match level="QueryCoverage =87%, HitCoverage=63%, E-value=6e-20, Identity=31%"; Hit description =DumPY : shorter than wild-type DPY-3, collagen family member (29.6 kD) (dpy-3) [Caenorhabditis elegans] g
  Gene Ontology: Mol. function=ATP binding; Cellular component =extracellular space; Biological process=cell-matrix adhesion
  Coding regions on vcDNA: vcDNA=SeqID_89484; Strand=+; Position=51-839
MPPTWALVPLLLLFFVHFIDVGFARRYKASTKYNPPAEETTTETTELTTPTECPAPVCPCECPTEETSETPPSTGGGGGTDDIVTSPEGEETTTPVSGCVPGPPGPPGPPGPAGQKGPQGKCGDNASKRKREAAAVPKEFMTNLEPNVPVKRAKEGEAVAKTHFARGHVKGGCPPGPPGEPGTPGPPGPPGDPAPCPKHMKSEAQSVDGKQLANRNKRGETVLNAAKEGTEVRPIVRHGIGPPGPAGPPGKAGEKGEPGPCEW

SEQ ID NO: 163062 - protein, 209 aa, Heterodera glycines
  Coding regions on vcDNA: vcDNA=SeqID_89485; Strand=+; Position=2-628
FFVHFLRFFSVISLYFNVLLVLLVLLVHLFRRYSGRLVAAVLQRLLHARAAHIYGLGWFALRHGELLLANGLHLEVRELRVHSLFNWWWTTTAPTVDSAANDGGGQRMALNVRVSVGTIRVGKQLADEEGSRNATSSICDGQNPLIENCGVLDSVSIHLSRPGPGQLHLQVQLQQPVELVWSPVLHLMVNDVVRASRLPNVPIGQLFRL

SEQ ID NO: 163063 - protein, 207 aa, Heterodera glycines
  Homolog annotation: Hit_ID=NP_506241.1; Match level="QueryCoverage =89%, HitCoverage=77%, E-value=8e-50, Identity=51%"; Hit description =prion-like Q/N-rich domain protein PQN-69, Eukaryotic Initiation Factor, Prion-like Q/N-rich domain prote
  Gene Ontology: Mol. function=translation initiation factor activity; Cellular component=eukaryotic translation initiation factor 3 complex; Biological process=translational initiation
  Coding regions on vcDNA: vcDNA=SeqID_89486; Strand=+; Position=57-677
MSMDELKKRAKAIGTFEELRKIIDIRGVNRYNPNNAPVLERAVDLMIKETKYDKDILMTLLKLYQLNPFLYNEKYVCLVLLKTMTNFPRNDFALAKYLVDAAKVNAPELRRVCQIGSLLESCNFALFWRLVDGRYKPRDSLDEPFKKPDEIRQLVESVTSFKEATRNYACQVINVTFQRIHKQQLVNLLGGIDDAQLTAYTNLPSNK

SEQ ID NO: 163064 - protein, 99 aa, Heterodera glycines
  Coding regions on vcDNA: vcDNA=SeqID_89487; Strand=+; Position=6-305
MDDIKAQLHVALSKNGYGQPEYRYFCETDGRQYFRCECSVKRYEDIYVANEIAQKKRDAQTKAATSMGKWMVKNGFLTDEELPQLMQKSDHASEKDESA

SEQ ID NO: 163065 - protein, 127 aa, Heterodera glycines
  Coding regions on vcDNA: vcDNA=SeqID_89488; Strand=+; Position=81-461
MDNNSVDPITKQLLKICVELLQQVQQQQTVISEQDLQLQHFKQQKMMEEAIQDHERRRSVVVMGLPESQKQKPSERVAEDRTAISGVLDELGIESPITVYRMGSPDQANTGQNRPRLMKVIFGCSKY

SEQ ID NO: 163066 - protein, 214 aa, Heterodera glycines
  Homolog annotation: Hit_ID=CAE62916.1; Match level="QueryCoverage =100%, HitCoverage=37%, E-value=3e-76, Identity=62%"; Hit description= Hypothetical protein CBG07110 [Caenorhabditis briggsae]
  Gene Ontology: Mol. function=electron transporter activity; Cellular component=mitochondrial matrix; Biological process=proline catabolism
  Coding regions on vcDNA: vcDNA=SeqID_89489; Strand=+; Position=3-647
RMFVPKSLWPSIQKGLAELASQTKMGDVRDPSIFMSAVIDAKAFKRINDYIAYAKGAGVKKDGTRLVFGGKCDDSRGWFIEPTCVEVDNISSLLLKQEIFGPFIAVYVYNDVDAGQLVRSLKDQTPFGLTGAVFSQDKDFLYEAKDILRDAVGNLYLNDKCTGSVVGQQPFGGARQSGTNDKAGGPHYVLRWTSAQVIKESFGPLTEWRYPHMD

SEQ ID NO: 163067 - protein, 160 aa, Heterodera glycines
  Coding regions on vcDNA: vcDNA=SeqID_89490; Strand=+; Position=221-700
RKRGIEYRKKRGIEYRNDSFIILWKLLLVRGINSNILKSGSNNNNNNGKRRNFRHYVRALDTDVAFNKKFRLMNAKSTFMIQTLPSNPESLLRVIFGHCIQSSLDEAQRRGIEPSRLTATITSQLLDPDIWIPIRQITPNTVDTILNRFLDVAQSKSREG

SEQ ID NO: 163068 - protein, 88 aa, Heterodera glycines
  Coding regions on vcDNA: vcDNA=SeqID_89491; Strand=-; Position=209-475
LLQLPKKSVRRQLLHFFSLHFTNKIIHRSIFRIYSLNISTKFTHPQNAPQLAPHSCNKFVRNLLIQPAVRSRENYFIEKMLLSFHKKM

SEQ ID NO: 163069 - protein, 233 aa, Heterodera glycines
  Coding regions on vcDNA: vcDNA=SeqID_89492; Strand=+; Position=131-832
LNSFQSQWRQLVAQSSSPLQFQLEMSNLNYSPIKFNARFLVINSSANNKRQTNEKFAFDEEIADGFQIATADDSLLIEVVLYNISNVPLRFEYCSLTLDEILNSSGAKKSKTLSEWSTAGNSSKNSTLVLVPKRPSRVFFIYKTTFATSLKQLMQLPASKAPTSRCQSPLMDEQNAKEILITVRHFSLRTLSGSLSWDIDHRSTSNRHHQNSIEEMDKNNYAVKCDHNGAMCY

SEQ ID NO: 163070 - protein, 288 aa, Heterodera glycines
  Homolog annotation: Hit_ID=NP_741220.1; Match level="QueryCoverage =99%, HitCoverage=43%, E-value=2e-83, Identity=54%"; Hit description =heat shock protein 75 (3I314) [Caenorhabditis elegans] gb|AAK29856.2| Hypothetical protein R151.7a [Caeno
  Gene Ontology: Mol. function=tumor necrosis factor receptor binding; Cellular component=extracellular space
  Coding regions on vcDNA: vcDNA=SeqID_89493; Strand=+; Position=3-866
PSETTPEMHETFFKQLAKTHHPHLADDRPQYTIQYQTDSPINIRALVYVPTKRVSHLEFAADSQRDIAISLYNQRVLIKPNAKELVPHYLRFLIGVVDSEDVPLNLSREMLQTDLILEKIRKTLTERCVRFFLSQLSKDRVKYNDFYMGYSMFFKEGVVTEQSNTTKEEIAQLLLFESSSFRSGTLTTLSEYVERMQSDQKNIYYIYAPSRQLAETSPYFELFKDKYEVLFLSDPADELVFLSMPQFRMKSLQSLEKWTKEEGLSIDSDKESSAELMRDSSKKEFLWL

SEQ ID NO: 163071 - protein, 197 aa, Heterodera glycines
  Coding regions on vcDNA: vcDNA=SeqID_89494; Strand=-; Position=3-593
QVKCPAGTTKFKLKGGLAFIPKQQQFGFSQRDSASGHIEPGSTFTLTMPNWGFDPFPLLRLLSTGQWLLIAVASEIIALAALFVFIKFNPHFRLYRSLAALAFVALIGKGEAVGTGFNSRLITNSDISSIHPTISSLRPTFSPKFSHFFTSLIYSKIVGPKTTGQQQKTAFPFINNSDLDKNLCPSNKRRATGDVYP

SEQ ID NO: 163072 - protein, 374 aa, Heterodera glycines
  Homolog annotation: Hit_ID=NP_499256.1; Match level="QueryCoverage =100%, HitCoverage=25%, E-value=2e-40, Identity=32%"; Hit description= PDZ domain-containing guanine nucleotide eXchange Factor (pxf-2) [Caenorhabditis elegans] emb|CAA83013.2
  Gene Ontology: Mol. function=guanyl-nucleotide exchange factor activity; Cellular component=membrane fraction; Biological process =signal transduction
  Coding regions on vcDNA: vcDNA=SeqID_89495; Strand=+; Position=1-1122
VIFREGDPGQSWFVVLRGTLEVKSSGKRHSFLHEGDDFGKLALLNSCEMNGNSQKQQQNNGNRTQRQSTVITAEDGCQLLRVYATKFSRLLSEMETNTVRLKEYMECDNGTTERPLDVLVLQRDAGGGRHSLIAGLPSQILEYTLETRMDHLVTMVDESFVVLSRLGTRSSSTNALQPAADSLLLDVLFSLPFWMPSNELCNMLKLYYSFGFSNSIEQNVQTIGGDPSEWSRTANTATKRRTVAFVSAWQMAIGHRFFLDSVANAFVEELFSSLLEDVRTAEETTEAMEFEEMMRQMETLMEFREGFMRKLSRHPRVVLDKGKYGDGASAPDPILPRDLCIQPIHLMNASDHSKRSIILQLRMDKSAAEIAQMA

SEQ ID NO: 163073 - protein, 237 aa, Heterodera glycines
  Homolog annotation: Hit_ID=XP_320498.1; Match level="QueryCoverage =90%, HitCoverage=71%, E-value=2e-28, Identity=37%"; Hit description =ENSANGP00000015808 [Anopheles gambiae]
  Gene Ontology: Cellular component=CCR4-NOT core complex; Biological process=regulation of transcription, DNA-dependent
  Coding regions on vcDNA: vcDNA=SeqID_89496; Strand=+; Position=81-791
MLMPQRQLRLVSKSLLFVHGAGAKQFLQGLTTKDMDSLNNVPLVYSFLLNVRGRILADFFIYRGNNGGNAEAFVLETEKSQAELLEKTLKLYRLRKQIGIEPLLDKTVLFRFDAEGETTQKQKATIPENSSNWMVDPRVPGFGFRAIRKIENETAHDDEASSSAYLRHRLAWGLAEGTEMVDQIPLNMNGDITGGISFEKGCYIGQELVARTHFTGIVRRRLMPFRPIDDKNGRDGF

SEQ ID NO: 163074 - protein, 188 aa, Heterodera glycines
  Homolog annotation: Hit_ID=CAE56710.1; Match level="QueryCoverage =94%, HitCoverage=38%, E-value=2e-41, Identity=49%"; Hit description =Hypothetical protein CBG24496 [Caenorhabditis briggsae]
  Gene Ontology: Mol. function=protein binding; Cellular component =synaptic junction; Biological process=muscle contraction
  Coding regions on vcDNA: vcDNA=SeqID_89497; Strand=+; Position=175-738
DFATKGKKRDIILDVNGESLVNARHDEAVRALKQAGKMVNLQVQYRRDLHLRRENMLHRLSWEESRVGASSAGPTVNGQSAGEALRSFGLKLAFVTRNPLEEEDPENRTIEIRSHSARHILTLRCSSATEADAWFEAIHSCADTLLTQALAQVNLILGQSPQVLRMGWMAEQDAAIGWKAVFVALTVN

SEQ ID NO: 163075 - protein, 170 aa, Heterodera glycines
  Coding regions on vcDNA: vcDNA=SeqID_89498; Strand=-; Position=599 -1111
ANGAAAQAQAVAVEQPAATATAQPSQAVTATTTTTTAAEVQQTEQPTAAIQHQQQQHKSVGQMLLKLLPCNCSSIGSGGSVGWGGGRSTVYSRVSTPPLEKGLPLFGVVVQLKGIKIRVGRRAGPMDGEESGIGKEIPRPKFCREWLEKFKNGAPQNVVGRNVVGRLFEP

SEQ ID NO: 163076 - protein, 96 aa, Heterodera glycines; identical to SEQ ID NO: 135751
  Coding regions on vcDNA: vcDNA=SeqID_89499; Strand=+; Position=196-486

SEQ ID NO: 163077 - protein, 130 aa, Heterodera glycines
  Coding regions on vcDNA: vcDNA=SeqID_89500; Strand=-; Position=1-390
TSANYRRARVWRYSEPPGSLVGVGLQVAKVPRCCTGCANPRALGYLPIGQKRLGLLSCGSSISVELDSSSRIWRKITGRYFVKPKNGRAEWHGQTHFGVSSGASVCYPAAPRRSCHNEPEGEWPWRLQPH

SEQ ID NO: 163078 - protein, 323 aa, Heterodera glycines
  Homolog annotation: Hit_ID=CAE56992.1; Match level="QueryCoverage =85%, HitCoverage=71%, E-value=1e-97, Identity=62%"; Hit description =Hypothetical protein CBG24859 [Caenorhabditis briggsae]
  Gene Ontology: Mol. function=transcriptional activator activity; Cellular component=cytoplasm; Biological process=regulation of cholesterol biosynthesis
  Coding regions on vcDNA: vcDNA=SeqID_89501; Strand=+; Position=4-972
MPKSKIQSASILAEQQKSVFSCQPTIPAADESDDLSNSSHLNCCQPISEIEQHQINDLRQILETQLLKQEVDEAYLLRWLRSKEGKFDEAADGIRKDLVFRKAWGLDKIVNWEAPEILEKYCGYGFLSDHDGNPILMSLLGNTDVEGMLRSVQSKDYIKFSLAAIEKGITLCRERALQTGRPFEQMMLVFDLDHISSAHYSSKQVASSFTTLVLLFQEHFPLVLRKILVIRAPEMGRIAFNSMTPFLSNAIKSMIEMPSEEGWQSALSKYVNLDAWPVHWGGRMMDPNGDPKCPSKIRYGLGPVPDSFFVDPSQAMPDYDPLT

SEQ ID NO: 163079 - protein, 192 aa, Heterodera glycines
  Homolog annotation: Hit_ID=CAB59856.1; Match level="QueryCoverage =99%, HitCoverage=53%, E-value=4e-57, Identity=61%"; Hit description =THI2p [Uromyces viciae-fabae] sp|Q9UVF8|THI4_UROFA Thiazole biosynthetic enzyme, mitochondrial precursor
  Gene Ontology: Cellular component=mitochondrion; Biological process =DNA repair
  Coding regions on vcDNA: vcDNA=SeqID_89502; Strand=+; Position=58-633
MFKQLNEAEVARAMISRYWRDLYERAECDVVIVGAGSAGLSCAYCLATRHPHLSIAIIEANVAPGGGAWLGGQLMSAMVVDKEMEPFLDELAVPYEEGGPNFVVVPHAALFTATLLAKVLAQPNVKLFNATAVEDLIIKRQQQSETGEGPGKSVQQQQHVVGVVTNWTLVALNHHSQSCMDPSTVMAKVVIS

SEQ ID NO: 163080 - protein, 161 aa, Heterodera glycines
  Coding regions on vcDNA: vcDNA=SeqID_89503; Strand=+; Position=157-642
NFALTNVKSSNVRPFFDSPLFLLMLLLLCLLLSVFFIAFYRPFPVLSPPPGVPFLPKHHSHTNSFSSNFPKCPKHHSQPIHSLLTFQNVPNTTATPIHSLLTFQNVTACNEFPSLPFPSSFRVRKQSTNCRWRTPKFHNGRTNLTLKWHCTTRRWRTCTTT

SEQ ID NO: 163081 - protein, 184 aa, Heterodera glycines
  Homolog annotation: Hit_ID=AAO85274.1; Match level="QueryCoverage =95%, HitCoverage=23%, E-value=3e-59, Identity=56%"; Hit description =chondroitin disaccharide polymerase [Caenorhabditis elegans]
  Coding regions on vcDNA: vcDNA=SeqID_89504; Strand=+; Position=165-716
SICFSPSPQRFLDTRAFQIWRSWARRVPGRVLFFVADGTVLSARVRAARMPVVVLRGVDDAYPPQKKAFAMLRWMFDNQLSNFHWFLRADDDLYIRTDQLKQFLIGMDPDRAHFIGQAGLGNSLEYGQLSLGAQDNYCMGGPGVLLSRETLRQLGPHLENCLRHLVTSHQDLELGRCVRSDVTW

SEQ ID NO: 163082 - protein, 296 aa, Heterodera glycines
  Homolog annotation: Hit_ID=NP_507133.2; Match level="QueryCoverage =97%, HitCoverage=53%, E-value=1e-127, Identity=78%"; Hit description= protein phosphatase 2A, regulatory B subunit (5Q845) [Caenorhabditis elegans] emb|CAB07297.2| Hypothetic
  Gene Ontology: Mol. function=protein phosphatase type 2A, intrinsic regulator activity; Cellular component=cytoplasm; Biological process= neurogenesis
  Coding regions on vcDNA: vcDNA=SeqID_89505; Strand=+; Position=49-936
MSSVSAGGDGKTPAGHTIPPPKTSGAATGGQQLSASANQFVDKIDPFSKRGNSRRRRRLIGSSRYHADNEPDLTQLPLIKDAGQADQTYLAIQKLQQCQKIFDFYDPVSQLKSKEIKRAALNELIDYITATKGAVCEPLYPEIIKMVSKNIFRVLPPSDNSEFDPEEDEPTLEVSWPHLQLVYELFLRFLESTDFQASIGKKYIDQRFVLQLLELFDSEDPRERDFLKTILHRIYGKFLGLRAFIRKQINYMFLSFVFETESFNGVGELLEILGSIINGFALPLKQEHKVFLVKVL

SEQ ID NO: 163083 - protein, 267 aa, Heterodera glycines
  Homolog annotation: Hit_ID=AAH68705.1; Match level="QueryCoverage =92%, HitCoverage=59%, E-value=1e-80, Identity=61%"; Hit description =LOC414700 protein [Xenopus laevis]
  Gene Ontology: Cellular component=cytoplasm; Biological process =embryogenesis and morphogenesis
  Coding regions on vcDNA: vcDNA=SeqID_89506; Strand=+; Position=1-801
VISASSDTTVKVWHTRRNGACLSTLKTHKDCVRCLAYARWPTELVASAGLDKCIYLWDVNTLTKVTATNNTVTTSSLRGTKNSIYSLAMNECGTVIIAGSTENLLRVWDPRTCQKVAKLRGHNENIRAISVNRDGTLCLSGSSDGTVKLWSIGQQRCIGTIRCHSDSVWALQTDSVFATVFSGGRDHRVFRTPLRNLNDSELLFTEGKPVQKLLMVDTDQPKHLWTATWDSSIRRWPIDGKETERTEEGPRVNMTLQGAPSIRKYAV

SEQ ID NO: 163084 - protein, 268 aa, Heterodera glycines
  Homolog annotation: Hit_ID=CAE56805.1; Match level="QueryCoverage =83%, HitCoverage=45%, E-value=6e-58, Identity=52%"; Hit description =Hypothetical protein CBG24618 [Caenorhabditis briggsae]
  Coding regions on vcDNA: vcDNA=SeqID_89507; Strand=+; Position=3-806
DISSSQLKIFSVFLLFIDFVFPNNHENFVTLAQFRAGGEKFSFAERRFLLYDVNPGEGFNLRRDVYLRVANTVRQLREKGFDFVLVLPPWGNCWHWRTKPRQTKIRWSELFDLDSLSDFVPVIEFDEFLEAQGTSVSTVLYLQHYAEGWAEGGEYTLKYDIRPCIEADKYYAKRGDKWNGHFFDYADHFHAKDLQCLSIQGQSSTLAEAIAQLFPEGRSLMVDRAETILHDQFGDHFFWKARKSMRYAKRLRSIGDTFRADQLANTSD

SEQ ID NO: 163085 - protein, 187 aa, Heterodera glycines
  Homolog annotation: Hit_ID=NP_491655.1; Match level="QueryCoverage =93%, HitCoverage=40%, E-value=6e-19, Identity=29%"; Hit description =WD repeat domain 12 (49.0 kD) (1G224C) [Caenorhabditis elegans] gb|AAB37809.1| Hypothetical protein F55F8
  Gene Ontology: Cellular component=nucleus; Biological process=N signaling pathway
  Coding regions on vcDNA: vcDNA=SeqID_89508; Strand=+; Position=55-615
MVAAPDEAQFHISFYTDEEECKNLLPAESINVPASSHSDQLNVLINQIGSMNDDSWKPVQFDFLLHSVLLRCSLLELVEQQQLSLENVLRIECIRQSPAPRPTAELNEAQWVADLRTLSHNCVLSVNFAGLLNVWELAGEWTRAVVKQLDDEPLKCVDTFTQDDGTTFALSGGQNQTLTLVRLRAQN

SEQ ID NO: 163086 - protein, 184 aa, Heterodera glycines
  Homolog annotation: Hit_ID=CAE72187.1; Match level="QueryCoverage =95%, HitCoverage=59%, E-value=1e-51, Identity=51%"; Hit description =Hypothetical protein CBG19295 [Caenorhabditis briggsae]
  Coding regions on vcDNA: vcDNA=SeqID_89509; Strand=+; Position=97-648
MTLPPTLFAFDQMPTLDPAIPTQSPHLAPSSDSCVGQCALIFTDQMRSQLGSEHSTGLLNLNYNEFLAAFSNSSFFDSFCNIYHQFNFCYTKCPQGFMQELLSRSAEIVDHFCVWNYKEIKTKFGCLVALDREMSKKCLHSCAGHHKAVTSLMQNFKHLAMNSDPTEAEKYLGESCEYVGCTLH

SEQ ID NO: 163087 - protein, 423 aa, Heterodera glycines
  misc_feature (244)..(244): Xaa can be any naturally occurring amino acid
  misc_feature (338)..(338): Xaa can be any naturally occurring amino acid
  misc_feature (368)..(368): Xaa can be any naturally occurring amino acid
  misc_feature (393)..(393): Xaa can be any naturally occurring amino acid
  misc_feature (405)..(405): Xaa can be any naturally occurring amino acid
  Homolog annotation: Hit_ID=CAE75423.1; Match level="QueryCoverage =100%, HitCoverage=51%, E-value=1e-163, Identity=29%"; Hit description=Hypothetical protein CBG23416 [Caenorhabditis briggsae]
  Gene Ontology: Mol. function=structural constituent of muscle; Cellular component=striated muscle thick filament; Biological process=striated muscle contraction
  Coding regions on vcDNA: vcDNA=SeqID_89510; Strand=+; Position=3-1274
RHKLMGDLDDAQVDVERAAAYAGALEKKQKGFDKIIDEWRKKCDDLAAELDASQRDARNLATDLFKAKTVQDELAEALEGTRRENKSLAQEIKDLTDQLSEGGRSVHELQKIVRRLEVEKEEIQHALDEAEAALEAEESKVLRAQVEVSQIRSEIEKRIQEKEEEFENTRKNHQRALESMQATLEAESPGKQEALRIKKKLESDINEVEIALDHANKAYADAQKTIKKHQEQIRELQLQVEDEXRQRDELREQFLNSEKRNQILQSEKEELMHQAEQAERARRAAEADLIELREAVNDLSNQVNSLNGYKRTLEGELRALHAELDETLTELKNADELXQNASADAARLAGGLRQRTAHSQHVDRLRKXLGLPNHEMHSALEPAEGAAIKAGKXIAQLKERIRTLXQGLDGMPSRPPETGQNFR

SEQ ID NO: 163088 - protein, 242 aa, Heterodera glycines
  Coding regions on vcDNA: vcDNA=SeqID_89511; Strand=+; Position=17-742
NAFPFCASIHTAEAFSRPTIFSFSSVIGKMLSTYALFYPTIICYIFCFRIWVATASTASYRTAGPKTKVPDKNEWMKRCAAEYERKYCVETDTKLKQQTTKNKEKKKQQQQQDESPEEYYPTNYEPAFNYDKLHVSDITLPLTIHQKDKYQAQNGPTKYEPKAEGQHVTSSVTTAEAGKYSSSSGHASSSESEEEDRWEEPRKRSRNRERDERNGRHGEGEDKAAKRWYKSDESKEEKRDGK

SEQ ID NO: 163089 - protein, 552 aa, Heterodera glycines
  misc_feature (274)..(274): Xaa can be any naturally occurring amino acid
  Homolog annotation: Hit_ID=NP_740833.1; Match level="QueryCoverage =89%, HitCoverage=88%, E-value=2e-48, Identity=29%"; Hit description =ornithine decarboxylase (52.9 kD) (1E401) [Caenorhabditis elegans] gb|AAB52428.1| Hypothetical protein F5
  Gene Ontology: Mol. function=enzyme inhibitor activity; Biological process=arginine metabolism
  Coding regions on vcDNA: vcDNA=SeqID_89512; Strand=+; Position=695 -2353
MTNFGFPPSPTFHTVRLREGGTITVFRDVANDEFRRRRPSEFAAQIAESKSAKDDCRPFFVMNIDCAVALLELWAQFLPRVQPFYALNCNADPMLLRLMASHQSVGFSCSSGAEMLNALHYVSADRVFGAFPCWTRSALRQAETCGVYTLCFDSERDLDRILANHSNARLLLRICVDPCATDANALFGAPLDEAVELLKLCVQLGLNCIGISLSTGPSTDDNCNLSSSSLFHFSSVYAFAIECSARLFRIAIDLGLRMDVLNIGDAFACPWSSXSTETDESLAHFAEFCTEFNRSFDVHFPSDGIGHGLRIMATPGQFFARSPFSWVTNVIGKRSTDASAVTNNDFDAGKTAFHYQTNESYYGTFGCRMMVNTEPRCAPLFNDFDMDTEQNQCFYYGTVFGQSGFDDGSDTDIVQSVCHFRQLNIGDWLIWSNMGAYSFGNCGSLDDEINDDDDSDGNEFDTLKTPPIFYFASQGNWESVCHKFDFAFLDEHQQQRRAGPLFASSADEYLSDSDSDGSVGEAMVHSDTEETDGGGTEKYEFWPVGWPTKFND

SEQ ID NO: 163090 - protein, 48 aa, Heterodera glycines
  misc_feature (42)..(42): Xaa can be any naturally occurring amino acid
  Homolog annotation: Hit_ID=XP_485323.1; Match level="QueryCoverage =72%, HitCoverage=23%, E-value=1e-09, Identity=82%"; Hit description =similar to putative senescence-associated protein [Mus musculus]
  Coding regions on vcDNA: vcDNA=SeqID_89513; Strand=+; Position=464-607
YLPTPGSKNIAILPRRDSDLEAFSHNPSDGSFAPLVYRPSTXTKCLNL

SEQ ID NO: 163091 - protein, 176 aa, Heterodera glycines
  Homolog annotation: Hit_ID=NP_740982.1; Match level="QueryCoverage =100%, HitCoverage=39%, E-value=1e-59, Identity=61%"; Hit description= k+ channel tetramerisation containing protein (54.1 kD) (2F201) [Caenorhabditis elegans] gb|AAA83172.1|
  Coding regions on vcDNA: vcDNA=SeqID_89514; Strand=+; Position=1-531
EYPPQMGEDVTQVVYSTPLYKFFKYAENRDVAKRVMKDRELKKIRLGIEGYPTHKEKIKRRFNRSEVVYNYVQRPFLHCSWEKEEARSRHVDFACPIVKSKSNPSLASAASDPLPQPAPLQNNINNGWAAENGAGEHSANFQQRPTNDNDGSSGNENERQPLRSPPANVQNSAADD

SEQ ID NO: 163092 - protein, 54 aa, Heterodera glycines
  Coding regions on vcDNA: vcDNA=SeqID_89515; Strand=+; Position=41-205
VSDGWNVIFDGIGWEDGILSQFLILRFFLVGRITFSTPKVCHIFEQGCKLELFF

SEQ ID NO: 163093 - protein, 280 aa, Heterodera glycines
  Coding regions on vcDNA: vcDNA=SeqID_89516; Strand=-; Position=1-840
STASLSVAPCPSNLVFCTPIDGTVMNFLQICTVEFQAVGASFAKHCICSTQSNLRLTNRSNAFDALAVLYPWEYVSEAIRKAAAKSGWSLGMRMVRPELAERKTIFSKALTTRRRRPKKGCWATRFLSLFWSTSTEVLATFVTSAFGTDELPTCSVVRCPHPLSSMSQRFSSVPFPSVAVPSFSSSELSSHGGRNASTRLFELGFFFDGLTPCEGGRGPTKSFRVLAVNPKSGGCPQRKVFESLPDVFDSSCHLCPKFAFFCCLLDILRGFSLDYLKNRN

SEQ ID NO: 163094 - protein, 198 aa, Heterodera glycines
  Homolog annotation: Hit_ID=A48575; Match level="QueryCoverage=96%, HitCoverage=21%, E-value=5e-84, Identity=86%"; Hit description =paramyosin - nematode (Onchocerca volvulus)
  Gene Ontology: Mol. function=structural constituent of muscle; Cellular component=striated muscle thick filament; Biological process=striated muscle contraction
  Coding regions on vcDNA: vcDNA=SeqID_89517; Strand=+; Position=74-667
PPYPSAMSNSLYRSPSTAGGALYKSPSMSAFAGGAPFGAMSVADLGSLTRLEDKIRLLQEDLESERELRNRIERERADLSVQLIALTDRLDDAEGTTDQQIEANRKREAELQKLRKLLEESQLEAEDALNVLRKKHNDACLDYNEQIEGLQKKNAKIDRERQRLQHEVIELTATIDQVQKEKHAAEKAAERFEGQAID

SEQ ID NO: 163095 - protein, 256 aa, Heterodera glycines
  Homolog annotation: Hit_ID=NP_510634.1; Match level="QueryCoverage =76%, HitCoverage=58%, E-value=6e-42, Identity=44%"; Hit description =misexpression suppressor of KSR (35.6 kD) (XQ738) [Caenorhabditis elegans] emb|CAA92227.1| Hypothetical p
  Gene Ontology: Cellular component=cytoplasm; Biological process=cell differentiation
  Coding regions on vcDNA: vcDNA=SeqID_89518; Strand=+; Position=143-910
RIQRDAQVHFGCVRSGKLRAFGRQSCELWQFSWHFSCHQFICLENHSIETHCFHLVPHPKVFLTVHDVGKTYLSCVDLANSPTLSPLVGQRAVFLHVSVPGQAPGAENFVGDFPSMEQLGDGLSQVMEQFNLSKCIAIGEGAGADIVCRFAMSFPQLVVGAVLVHCISTTHGIIASIKELFTNLLLNDGEMTHSAWNWLLVHKFGNHEMDKEKRNYVDAIKAGGMNEYNLSRYLYAFSHRDELTDRLKDQLGKVDV

SEQ ID NO: 163096 - protein, 275 aa, Heterodera glycines
  Homolog annotation: Hit_ID=NP_508183.1; Match level="QueryCoverage =98%, HitCoverage=63%, E-value=1e-115, Identity=74%"; Hit description= ARRestin, beta 1, Drosophila kurtz homolog (48.5 kD) (arr-1) [Caenorhabditis elegans] gb|AAA82342.2| Arr
  Gene Ontology: Mol. function=enzyme inhibitor activity; Cellular component=heterotrimeric G-protein complex; Biological process =signal transduction
  Coding regions on vcDNA: vcDNA=SeqID_89519; Strand=+; Position=91-915
MTENEDKKAGTRVFKKTSPNGKITTYLGKRDFLDRGETVDLIDGMVLIDDDYIKSSKKVTVQLLAAFRYGREDLDVLGLTFRKDLISQLYQVYPATQNESLRPMTRLQERLKKKLGENAFPFWFEIPPNSASSVTLQPAQGDTGKPCGVDYEIKTMVGGDSTQEKPKKHNSVRLAIRKLTYCPQLERIQPMVDVTKNFIISPGGLHLEASLDKEMYYHGESIAVNVHIQNNSNKTVKKIKVTVQQMADICIFTTARYTCDVDKIDSCEGFPVGPG

SEQ ID NO: 163097 - protein, 330 aa, Heterodera glycines
  misc_feature (320)..(320): Xaa can be any naturally occurring amino acid
  Homolog annotation: Hit_ID=AAK26375.1; Match level="QueryCoverage =100%, HitCoverage=75%, E-value=1e-179, Identity=94%"; Hit description=class V aminotransferase [Heterodera glycines]
  Gene Ontology: Mol. function=alanine-glyoxylate aminotransferase activity; Cellular component=peroxisome; Biological process =glyoxylate cycle
  Coding regions on vcDNA: vcDNA=SeqID_89520; Strand=+; Position=46-1035
MLSRMLSSAVAVPRMCESNKKLLRKGATFVGLLCGRMANSTFTATVTPPHRLLRPLHINEKKLFGPGPSNMPPLVQEGLVQPLLGHMHPEFFEIMDDVKAGIKYIFQTENALTFAVSGTGHAGMECAILNLLEPGQTILVVQNGVWGLRAANLAERLGIKVHRLVVPEGEVINLDDFAEAVDNYRPQVAFVCHGESSTGVVHPLERFGDICNAYDVLFLVDTVASICGAPFHADALKVDCVYAATQKVLNCPPGLAPISFSEKALEKITKRKTRVPSFYFDALELGNYRGCFDEARRYHAAAAISGVCARREGLTVGAQXGIGHIGEAHR

SEQ ID NO: 163098 - protein, 194 aa, Heterodera glycines
  Homolog annotation: Hit_ID=NP_740945.1; Match level="QueryCoverage =93%, HitCoverage=32%, E-value=4e-20, Identity=36%"; Hit description =DNA methyltransferase protein 1 (55.8 kD) (1P67) [Caenorhabditis elegans] emb|CAD21666.1| Hypothetical pr
  Coding regions on vcDNA: vcDNA=SeqID_89521; Strand=+; Position=59-640
MGHLLSMDSHIRWPECKTPGPHLRSQEMKLPSNIGQKKLSNIGLVVTTRKIASIGLEYPHAYEEIVKQYNDFRSHIVLLQDLKTALHNTELELDQLAAQMPADKECPIIEPRFRVSSTFYEELERSPVRVLNTPMTEGGKGKGKGKQQLKPAPVTGRAITKMIEVNTAPTTVTRKRRMHYPEGTPPTRSQTAIH

SEQ ID NO: 163099 - protein, 158 aa, Heterodera glycines
  Coding regions on vcDNA: vcDNA=SeqID_89522; Strand=+; Position=148-621
GIPGNFSVLENRICLQLIPCRKCHYQKTGHCTIGERRLSICQFNAGGRARSRAGAGTTVEEQPKCSNGGRQVPIVAKFDREKDAQIHTLGRQIRAEHLSGFVDQRLLLWLRLWDECVFEKRGGKKWEGNHRRISQRNNANATSLWDNLEERDRTLRNV

SEQ ID NO: 163100 - protein, 232 aa, Heterodera glycines
  misc_feature (221)..(221): Xaa can be any naturally occurring amino acid
  Homolog annotation: Hit_ID=CAE61329.1; Match level="QueryCoverage =92%, HitCoverage=36%, E-value=6e-48, Identity=43%"; Hit description =Hypothetical protein CBG05167 [Caenorhabditis briggsae]
  Gene Ontology: Cellular component=membrane; Biological process=lipid metabolism
  Coding regions on vcDNA: vcDNA=SeqID_89523; Strand=+; Position=6-703
MPSNAQKADKTMANGKQQTIGEKQPEHKRRVMRHRHIRLKPNILNSSAAANASMKRHPQPNFDTIEVLEEEHEFEVPINEEEMMRFPGMEEGSQKSDKISVHRRFWQLNWKGVHFSGLPTWLQDNEFLHFGHRPPLPSFGSCFNSIFSLHTETGNILTHMYGAIAFIGIFIWFLVQAEDVVSWPDKLIFSSFFVGAILCMGMSFAFHTVQYHFEDINKLVXKLDYSTCAYYH

SEQ ID NO: 163101 - protein, 140 aa, Heterodera glycines
  Coding regions on vcDNA: vcDNA=SeqID_89524; Strand=-; Position=1-420
KSTFFYFWVGAQTTPGPKNHNDGFLNNDLAPFQFPMDFFKIFRPTAGPRWSRSTRDSSPRWSPPCPRSSRASVSVVLLALALVVSLLRPAPNRRLLLLLRIISNFRLLTVVVVNTQLLLFPVVFSTHFCCPFSTRFSFCF

SEQ ID NO: 163102 - protein, 579 aa, Heterodera glycines
  misc_feature (560)..(560): Xaa can be any naturally occurring amino acid
  Homolog annotation: Hit_ID=NP_492457.1; Match level="QueryCoverage =99%, HitCoverage=67%, E-value=0.0, Identity=85%"; Hit description =translation Elongation FacTor (94.8 kD) (eft-2) [Caenorhabditis elegans] emb|CAB02985.1| Hypothetical prote
  Gene Ontology: Mol. function=translation elongation factor activity; Biological process=protein biosynthesis
  Coding regions on vcDNA: vcDNA=SeqID_89525; Strand=+; Position=3-1742
NQEPVTKRGFCQFVLDPIFKVFDAVMNIKKDEVAKLVEKLNIKLTLEEKEQEGKPLLKTMMRKWLPAGDTMLQMIVMHLPSPVTAQRYRMEMLYEGPHDDEAAVAMKNCDPNGPLMMYISKMVPTSDKGRFYAFGRVFAGRVATGMKARIQGPNYVVGKKEDLYEKTIQRTILMMGRYIEPIEDIPAGNIAGLVGVDQYLVKGGTITTYKDAHNMRVMKFSVSPVVRVAVEPKNAGDLPKLVEGLKRLAKSDPMVQCIFEESGEHIIAGAGELHLEICLKDLEEDHACIPLKKSDPVVSYRETVTEESEIVCLSKSPNKHNRLFCKARPLPDGLPEAIERGDVNPTDDPKNRAKILTEKFEMDATDSRKIWCFGPEGTGANLLIDVTKGVQYLNEIKDSVVAGFQWATKEGVLCDENMRGVRFDIHDVTLHADAIHRGGGQIIPTARRVFYASVLTAKPRLLEPVYLVEIQCPEAAVGGIYGVLNRRRGVVFEESQIAGTPMFIVKAHLPVNESFGFTADLRSNTGGQAFPQCVFDHWQVLPGDPFDGTSRPGQVVTETXKRKGLKEGIPSLDNFYDKL

SEQ ID NO: 163103 - protein, 215 aa, Heterodera glycines
  Coding regions on vcDNA: vcDNA=SeqID_89526; Strand=+; Position=1-645
GGDAVPLPSAVADSPFLEVDLNRTLTPQSQWTNESTGTMHPIVDTEPNPIRDAHEPNHIFHYSPSSHSPDDDESSQNGQSSSSQSAPISSALDASLTNLYKEKENDECDDERSMPRRASERTLDRFEDVRTIASSDIEVIRQMDDWSVTSSYPNSSHQQSNTQKIGQIRSIGELQQSQTPPELTTKLDTSEQSQREMDEKIAVLMAKLAHRDQKI

SEQ ID NO: 163104 - protein, 183 aa, Heterodera glycines
  Homolog annotation: Hit_ID=AAG00554.1; Match level="QueryCoverage =98%, HitCoverage=39%, E-value=2e-14, Identity=27%"; Hit description =retinitis pigmentosa GTPase regulator-like protein [Takifugu rubripes]
  Coding regions on vcDNA: vcDNA=SeqID_89527; Strand=-; Position=2-550
MKIRQMSSSSDDENELQLSDTDCEAGPSSRKKSKAPKSQTHHRKWGPKASSLEEEDDEDEETLVEREVERTETGRPLRKAAVNMRKKLKEELQYEEEEDEGEETEQRDEEEEGTAAGAQIGRLADRAVSALARPQRTVGNRSEEGDADEFKPDEEDEAEADEEEEEAEKEEEVEESDEEGEEE

SEQ ID NO: 163105 - protein, 227 aa, Heterodera glycines
  Coding regions on vcDNA: vcDNA=SeqID_89528; Strand=+; Position=1-681
ERLFLKMGRRRKTAPALLRNKRTRIDEDEMDEEEEGAWNGHGHQNMGLRPRKQIQRTISAQWAPRLRERHQNGQNTTEDQLADMELEDVDMDEDEIVKTLNMVFTNLDLSQLPALSPGAGLYAMANYAIEEKSIPKRKAAEKKVPEDVLEPTFLSLEQAMQRDQNFKGKLLDAFLEDFREYFQTYFSRPNSQTFDKDLCVRFLLQHFPFCRVPLIERLADEFAGRYA

SEQ ID NO: 163106 - protein, 185 aa, Heterodera glycines
  Homolog annotation: Hit_ID=AAO23078.1; Match level="QueryCoverage =94%, HitCoverage=11%, E-value=4e-44, Identity=49%"; Hit description =polyprotein [Glycine max]
  Coding regions on vcDNA: vcDNA=SeqID_89529; Strand=-; Position=6-563
MHHVETGTAPPVKMRVRPVPYAFREKVATMLQDYLDRGLIRPSWSPYASPIVLVPKKDGTIRFCVDYRGLNAITVKDAFPLPNIDNTLMMLGNKKVFSTMDFMSGYWQIKMHPDSVSKSAFTTEFGLYEYLVMPFGMSNAVATFQRFMTRLFDGILNDFVFIYIDDILVASESFEKHLEHLQAVF

SEQ ID NO: 163107 - protein, 192 aa, Heterodera glycines
  misc_feature (97)..(97): Xaa can be any naturally occurring amino acid
  Homolog annotation: Hit_ID=NP_493378.1; Match level="QueryCoverage =99%, HitCoverage=30%, E-value=1e-41, Identity=40%"; Hit description =CYcloPhilin (70.8 kD) (cyp-15) [Caenorhabditis elegans] emb|CAB60429.1| Hypothetical protein Y87G2A.6 [Ca
  Gene Ontology: Biological process=protein folding
  Coding regions on vcDNA: vcDNA=SeqID_89530; Strand=+; Position=3-579
IYILDANGDKQPIHVFESLHQHPVILMQYTAAFDVAISFDEIGMVEYWSGSRNEFSFPKTVNFEFKTDTDLYEFCKIKQMPKALAISPDGRTFAVWXSNSYIYIFDLRSGKIIKKLDETLQRYIEMGKETKGNGLPAIEWNRRVALEKEMSRDPNALRFISITYDASSNFLIFPTPLGITVYNLVSDQVARR

SEQ ID NO: 163108 - protein, 216 aa, Heterodera glycines
  Homolog annotation: Hit_ID=CAI25442.1; Match level="QueryCoverage =78%, HitCoverage=34%, E-value=5e-14, Identity=30%"; Hit description =polymerase (DNA directed), delta 2, regulatory subunit [Mus musculus] gb|AAH03342.1| Polymerase (DNA direc
  Coding regions on vcDNA: vcDNA=SeqID_89531; Strand=+; Position=1-648
VKQQERISFPFSVDSKRFLLLPTDFVDEKSKFFNRQFLTIYRARINCLKDLIKKNARNILASTSNNSVQIDDLSNFSAGNDILLIGVVFKKMKFRQSILYEFSDDSNVPIKMGRKAGDNLCDDEDILQLEDDQQTVKLLGNIDKHCFVTGDVIGVIGCQEDVSDNFEVRRIIYPEMSPQLEWPLVEHDCYIVFMSGISLVGNFDNDVQTFSALMQF

SEQ ID NO: 163109 - protein, 213 aa, Heterodera glycines
  Homolog annotation: Hit_ID=CAE56258.1; Match level="QueryCoverage =86%, HitCoverage=78%, E-value=9e-26, Identity=37%"; Hit description =Hypothetical protein CBG23899 [Caenorhabditis briggsae]
  Gene Ontology: Mol. function=chaperone activity; Cellular component =cytoplasm; Biological process=muscle contraction
  Coding regions on vcDNA: vcDNA=SeqID_89532; Strand=+; Position=2-640
LNESTSPIGGSTSSKMSSSFNQSSSYNRTFERKVIEESTPTMTTRMFTSSPLNTIKTTLGSGFPSDLGGLGTGTGTTFVQPHNYQFGTATSGSFHSSDDSLSVSMDCAMFAPEELKVSVVGNQIVVEGKHGEKQDSLGSIERQFVRKFAMPRNATADSVNSNLTSDGMLTVTASAPKAKDNSPIRTIPVKIVTTSAGGQTPQEWGRPISTKWQ

SEQ ID NO: 163110 - protein, 47 aa, Heterodera glycines; identical to SEQ ID NO: 127360
  Coding regions on vcDNA: vcDNA=SeqID_89533; Strand=-; Position=544-687

SEQ ID NO: 163111 - protein, 150 aa, Heterodera glycines
  Coding regions on vcDNA: vcDNA=SeqID_89534; Strand=+; Position=11-463
GRHNKHTLIKIVPNLVYLPGRKPARLIALRSVPTPYIPPNGYSARLAHFIPFPSPSPRRVRRKFLVATTFFAYQIFAINAHLFKKYSILLKCSVFCYILRIAVHLKESVIEQISQISRKVQAVAVKIVYIKTMAIRISALGPFSKLMCFY

SEQ ID NO: 163112 - protein, 289 aa, Heterodera glycines
  Coding regions on vcDNA: vcDNA=SeqID_89535; Strand=+; Position=3-869
SLSSDIMPFLFPSIVTTNNTAFNRINDKSANVRQKLDMMETALVHLTTNKCQLNFSAEKTRSDIRRATDKHISMLRERELKLFEEVDHIHQREQQLIEEQMEQLNQAIGTSKFVVEKMAAFADEKNLEELISVELDQKINLLDKLANSSKGTNIVFSAAFQQNIPLGQIYVGFAGGSASPQANANDGVSSVASDQRLHFENGSEISFDQFVNSALRGETSVKGGTDQANNHLANCAANGVKREMLVPDATFMDKLRVAIRNIIQESPPNSKWNTFSRIRQNLYFDIICQ

SEQ ID NO: 163113 - protein, 289 aa, Heterodera glycines
  Coding regions on vcDNA: vcDNA=SeqID_89536; Strand=+; Position=239 -1105
MPRRRTMEGLDMKWQFRSVTSSRKGTQWKVRWERKRRKKRRDKTTAQCDRLPTKLGELSLDEDKTANTDAVVEPPMATEEKAADVGNDKPSGENLNEENNESKGYQSPVSEEEHPIQHVDAKQPTVDEGQTHAAAADSLPPSEPTTDSSAENDGNNEIVSPTALEPQLVPTSDEEEQKPKNAVEAGDDGAAKDNTLSSGGATASDETAAVAAFSAGTPPPVPAVGQQPQQQTEHQLSQHQQQAELCGAKTAVAAESTARDSAEDETDASSSARQSVPAKGGTDGKAHGG

SEQ ID NO: 163114 - protein, 199 aa, Heterodera glycines
  Coding regions on vcDNA: vcDNA=SeqID_89537; Strand=+; Position=59-655
MHTTAAPPPHQPSVVMSAIDDNNSVRFPIIQVEVKIRVPDHLVGRLIGKSGICVKKIMEDTQSHISISESRSQQEVNQYQTPELLDRIITIRGTAFGSVMAAEKQVQQKLRHIQEQDMNISGGGGGVSAASGRQFCPTPVPAPPGGILQSMDGGGGAAIGSYIAPSAVTVTGAPMLSRGPPDNAFHHHPPTAAAMYSAQ

SEQ ID NO: 163115 - protein, 211 aa, Heterodera glycines
  Coding regions on vcDNA: vcDNA=SeqID_89538; Strand=+; Position=1-633
LLKTFDPLQISAKMLHSFRGVRLSSHTNNTFEFSSSFSSSTSTTTKRTKSSNSNEDGRTPTNGKNLSPKKRNHSQQRQQQNDSKKSALSTDLGLKSVVVQRKLNIQTNYSLRAVRKKITASNELVVEQDEGVAKAKPPNEHRYKRAAKDENENDAFGEDDGDENDYDGGEDEHGIWLNWRAKKRDNQSNKLGGGQNSQIGTERGSAQARLM

SEQ ID NO: 163116 - protein, 83 aa, Heterodera glycines
  Coding regions on vcDNA: vcDNA=SeqID_89539; Strand=+; Position=20-271
MFKNIFFFFLIVAPFIAAYKPSCKCPENEQPGQLSCNGCEPSCDNRKPEVCTKMACECSCDCVPGLLRDKKTKKCVPKEKCPY

SEQ ID NO: 163117 - protein, 166 aa, Heterodera glycines
  Coding regions on vcDNA: vcDNA=SeqID_89540; Strand=+; Position=123-623
MATKNGRIPYELLFELISALPFHIRWAVTRVSKAFDGFVWQKQFSWVRAELIRKEAQRQKEGGAFLQMVDSLSTAVNSLSEASHSLSQASHSLSNSAAQEMHKKNKSWFNFFTKQVYSMRDEINTMTAEAQNADKEDGGNAGEGGDAAGGNGADKKGARKRHHGER

SEQ ID NO: 163118 - protein, 144 aa, Heterodera glycines
  Homolog annotation: Hit_ID=NP_494930.3; Match level="QueryCoverage =68%, HitCoverage=13%, E-value=3e-26, Identity=58%"; Hit description =putative protein of eukaryotic origin (84.8 kD) (2F343) [Caenorhabditis elegans] gb|AAK31510.3| Hypotheti
  Coding regions on vcDNA: vcDNA=SeqID_89541; Strand=+; Position=2-654
RHELMLLRMSDVISNGLGNHRPDNAFCSIDAATLCRNLIRFAYQLSAAKRRTLEDPELYRMRTHSKTEERLRRKVVRDMIMEMPGKLDHASVVAYKVGKWPRHAESHSLRRRVTEWEGGMELDGVFMERHGYREPNDEDDGGAR

SEQ ID NO: 163119 - protein, 412 aa, Heterodera glycines
  Homolog annotation: Hit_ID=CAE64356.1; Match level="QueryCoverage =95%, HitCoverage=98%, E-value=5e-72, Identity=38%"; Hit description =Hypothetical protein CBG09043 [Caenorhabditis briggsae]
  Gene Ontology: Mol. function=DNA binding; Cellular component=nucleus; Biological process=induction of apoptosis by extracellular signals
  Coding regions on vcDNA: vcDNA=SeqID_89542; Strand=+; Position=13-1251
MIPDSAYIEIMKNCSKWNSRTMGGRTRSQTAVFDQQTGIVHRPTEHLFRHPSERCRAQNPMQVFTYPPVRWVKPKNNPSAGIEMNYFMRANPSLKSAISSSVEQPQNASSGEQQIAEAQQQIGTNVPSVRSATGGSGTKSYIENELDLAEYDLDELETNDQSDEEDWGASRKKRKKTGPGFGGNVPGRTARKVPSNISSATAKKEQPTDNGSNGGTPTAANVIGGGAGVATTATETRPYVCQLCGAKYKSRPGLAYHKLHVHQSDSNNETPKSPIISPKVQVSEYCDFCLGTNLQNAEGEAEPLISCHDCGRSGHPTCLKFTKNMLVSTKRYGWQCIECKSCAICGTSENDDQLLFCDDCDRGFHLYCLKPPLKEAPETDWSCHLCVKEFGAEASIAKATKSTEDGTSSPAK

SEQ ID NO: 163120 - protein, 191 aa, Heterodera glycines
  Homolog annotation: Hit_ID=CAE72576.1; Match level="QueryCoverage =60%, HitCoverage=26%, E-value=8e-38, Identity=66%"; Hit description =Hypothetical protein CBG19763 [Caenorhabditis briggsae]
  Coding regions on vcDNA: vcDNA=SeqID_89543; Strand=+; Position=3-575
FNEVGSRDALFLLSVLQLHLTISVNIATIITPKFMISSDSHRRALGDIAGMGVSGRAHPSLAKMRENLINGTIDFQEVPIIDMNPEDIRAELKRVYTQLRMYKLKNAYQDNPHISKRKGGGAVKKSAAGDATVSGRLSSGAGLSGAGLPKGVRGTEGYCAVKRNSIPREATPNAVTSPKQLHGADRPPPLV

SEQ ID NO: 163121 - protein, 44 aa, Heterodera glycines
  Coding regions on vcDNA: vcDNA=SeqID_89544; Strand=+; Position=1-132
YTHIRLPLMSLTNCKMGLSACCLLLGNLNFCIHSNSNATRKWVI

SEQ ID NO: 163122 - protein, 195 aa, Heterodera glycines
  Coding regions on vcDNA: vcDNA=SeqID_89545; Strand=+; Position=28-612
MLKSAVLFLLNLFYPFANFCLDLLPNSSPMGSKSTPATADVAYANYRLFDELNRKVRESLRKAIEADETRIAKSRVIGLYENVLKQINKALEIRHTSCPSHKQTEMQEQQKKLKAFVGQTKDRLEKLASIEPMALRATPLPLATVETGNNRARRMPCTSTDQRLVSNRQNLSKMSLLKSVDSKLGDEILATIVET

SEQ ID NO: 163123 - protein, 346 aa, Heterodera glycines
  Homolog annotation: Hit_ID=CAE59922.1; Match level="QueryCoverage =99%, HitCoverage=37%, E-value=2e-69, Identity=40%"; Hit description =Hypothetical protein CBG03408 [Caenorhabditis briggsae]
  Gene Ontology: Cellular component=membrane; Biological process =intracellular protein transport
  Coding regions on vcDNA: vcDNA=SeqID_89546; Strand=+; Position=1-1041
LKVSVVGLERALEQYTSAAHFDAPFDLKQVPLSTEPLTASTDEVKKKAAMVDDASAAMKKQKEEKKSGTSRQEQFALQFASMPEFAACGALFKSCAAVELTETITEYNVSCVKHIFNDDFVLLQFDCRNTLNDQLLEEVFVEIEPQDEGEDCPWHVQSVHPLAQLPFGQPCTTYVLLKMPEDGRIAGTFGAKLKFKICDVDPATGEPESNDLYDEVYTLEPIEVGLADFLLATAPKGASFTTAWDALKEEGHETEESYALSNVHTLEDAVSKLLKCTALFPCEHSNRVPEGKSSHQLLLCGIFRGGIDVLCRVRLVMDPSDQTVSMNMVVRSMDETVSQMIANIVS

SEQ ID NO: 163124 - protein, 180 aa, Heterodera glycines
  Coding regions on vcDNA: vcDNA=SeqID_89547; Strand=+; Position=3-545
RPRVHHRTVLSSLSLLLNINNNNSSSSRRCRRRRTVLLRLLFLVRVPPLPSLRLPLFLRQHLQQFHQQQLNNSNNNHRHQRSRIITVTISPSSSSSRNQPLRSLSLHSCDTLVNVPVKMGMPWCKSLSNSLLFLSNSVHWLLNSLIILWQLRARMCKFGERERPTEKECLADLFLRYFIH

SEQ ID NO: 163125 - protein, 174 aa, Heterodera glycines
  Homolog annotation: Hit_ID=NP_495527.2; Match level="QueryCoverage =97%, HitCoverage=100%, E-value=7e-42, Identity=49%"; Hit description= ribosomal protein L14b/L23e (19.9 kD) (2H598C) [Caenorhabditis elegans] gb|AAA68795.2| Hypothetical prot
  Coding regions on vcDNA: vcDNA=SeqID_89548; Strand=+; Position=3-527
MNQFLLNLSSSYSQWISKAFASTGKGRWYAQPLDEMSRHRSRPPCYGMARRSKVLCVDNSEIAKEANMSGKLAYVIWVYKDGYRKRHMPKAELGDRVLLSIRGEMKRAVVVGCKQHLAIRKHGLPSTDTNNVVLLNNDGNPLGNRILAPVPAYFMRYRKWLHASKVSALVKKFV

SEQ ID NO: 163126 - protein, 212 aa, Heterodera glycines
  Coding regions on vcDNA: vcDNA=SeqID_89549; Strand=+; Position=19-657
KHVSLNIKSPIMSNSGELTFSDKDDVKGKTEDDKSRGTKRKKRKDSPSSSSSTSSSSSSSSSFSSSSESDDTSLSESEGPPAPSKVKKSKLTHVINPRKIFIHEYLMSKLHVSDVKRLPAEISQKYQMVQKELIGKFASGDYAKKPISFRIDEITLAGAAAQKAFNHGPTVAEYFLKKNGITLKHPQLPCLVQSGGGKHKSFYPMELLFFAQ

SEQ ID NO: 163127 - protein, 210 aa, Heterodera glycines
  Homolog annotation: Hit_ID=NP_502164.1; Match level="QueryCoverage =92%, HitCoverage=31%, E-value=1e-63, Identity=56%"; Hit description =white family member (67.1 kD) (4M237) [Caenorhabditis elegans] emb|CAB05682.3| Hypothetical protein C10C6
  Gene Ontology: Mol. function=xenobiotic-transporting ATPase activity; Cellular component=mitochondrion; Biological process=ommochrome biosynthesis
  Coding regions on vcDNA: vcDNA=SeqID_89550; Strand=+; Position=1-630
AFFHAEVEKRRQCVRERPTPRKTASSWVQTQSLLKRSLIDNWRNPGLTRAKLFQKLIMGVFIGLLYMNTQLNGVGVGNLNGAMFYIIAELTYSTLFGVLTFFPADFPLLAREYHDGLYCSGAYFVARSASYLPLFTIDGILMVTIAYWLIGLVPTVGRFLITLGISFLVEQSAVAFGVMLSAVCPSYPVAVSVAGPILTILSLTGGLYAN

SEQ ID NO: 163128 - protein, 283 aa, Heterodera glycines
  Homolog annotation: Hit_ID=EAL22522.1; Match level="QueryCoverage =99%, HitCoverage=26%, E-value=1e-112, Identity=69%"; Hit description= hypothetical protein CNBB4000 [Cryptococcus neoformans var. neoformans B-3501A]
  Gene Ontology: Mol. function=oxoglutarate dehydrogenase (lipoamide) activity; Cellular component=mitochondrion; Biological process=2 -oxoglutarate metabolism
  Coding regions on vcDNA: vcDNA=SeqID_89551; Strand=+; Position=1-849
EFHVHSLLNRILKNRLKTVQDGEGLDWSTAEALAFGSLLTERHHVRLSGQDVERGTFSQRHAVLHDQKNETTYTALNNLSPDQAAFTVTNSHLSEYGVLGFELGYSLVNPNSLVIWEAQFGDFANTAEVIIDQFIASGEKKWLQRTGLVLNLPHGYDGQGPEHSSSRIERFLQLSDEDPYRMPTADELARQHQDCNLQLVYPSTPANYFHVLRRQIHRDFRKPLFLPFSEALLRHPLARSSLADMAPGTRFQRFLPEATPDALVAPDQITRVIFGFCPVYYSL

SEQ ID NO: 163129 - protein, 121 aa, Heterodera glycines
  Homolog annotation: Hit_ID=NP_498143.1; Match level="QueryCoverage =91%, HitCoverage=93%, E-value=5e-22, Identity=42%"; Hit description =glutaredoxin, possibly N-myristoylated (13.1 kD) (3G434) [Caenorhabditis elegans] gb|AAF39994.2| Hypothet
  Coding regions on vcDNA: vcDNA=SeqID_89552; Strand=+; Position=91-456
MGGNSSVPESMAKKVDENQIRKEISECPVVVYTKSGCGYCKLAKELLEQERIRFCEHDLETKEQQEPDKAQSYVNGLVYVSRHRLVPQVFICGKFIGGYTELTMLKESNLLREEISRCSDE

SEQ ID NO: 163130 - protein, 276 aa, Heterodera glycines
  Homolog annotation: Hit_ID=NP_035286.1; Match level="QueryCoverage =99%, HitCoverage=37%, E-value=3e-82, Identity=54%"; Hit description =prolyl endopeptidase [Mus musculus] gb|AAH12869.1| Prolyl endopeptidase [Mus musculus] gb|AAH50830.2| Pro
  Gene Ontology: Mol. function=prolyl oligopeptidase activity; Cellular component=cytoplasm; Biological process=protein metabolism
  Coding regions on vcDNA: vcDNA=SeqID_89553; Strand=+; Position=1-828
DKLLVCYLEDVKNALYVHSLDDGRELYKLPLPIGSVGGVFAEKSKSKIFVGFESFLVPFILFHGDFSKCPSRESPLQLTETRRVNVPGLDCDAFDSKQVFYPRDDGTKIPMFIVHRKGVKLDGSNPAILNGYGGFNIAQTPYFSVTRLMLAKHFGIVSVIANIRGGSEYGEKWHEAGMLGRKQNVFDDFIAAAEFLISEKYTNNKKLAIHGGSNGGLLNAGCSQQRPDLFGAVVTRVGVLDMFRFNKFTVGAAWTTEYGDPDKPDDFSFIRMYSPL

SEQ ID NO: 163131 - protein, 245 aa, Heterodera glycines
  Homolog annotation: Hit_ID=AAF21097.1; Match level="QueryCoverage =95%, HitCoverage=97%, E-value=7e-71, Identity=57%"; Hit description =thioredoxin peroxidase [Dirofilaria immitis]
  Gene Ontology: Mol. function=thioredoxin peroxidase activity; Cellular component=mitochondrion; Biological process=phospholipid catabolism
  Coding regions on vcDNA: vcDNA=SeqID_89554; Strand=+; Position=10-747
MLLLGEQFPDFGADTSHGKIDSFYEWMGEESWAILFSHPADFTPVCTTELARAAQLTAEFARRHVKVIALSCDSSESHRNWTEDIAAYGNSKGNGSEKISSAADFPFPIIADQQRLLAIKFGMIDPLNSDLSGVPLTVRAVFIVDTKKRLRLSLLYPASTGRNFDEILRVLDSLQLSDKFMVATPEGWKPGSACMVEPRVTDAKAKEMFAGVGGGVRPVELPSGKRYLREVNDPSAGQSEVPRSD

SEQ ID NO: 163132 - protein, 105 aa, Heterodera glycines
  Coding regions on vcDNA: vcDNA=SeqID_89555; Strand=-; Position=70-387
FGVPFAFDEASTVIFRLLSRSDSSLIKSWLWNLDETDPLPLEEPTLFDGETVRFWTPFPAEHFRSLTSRSLSAKVACCCLPANKFLKSGGGGGGGGALLSGIFCC

SEQ ID NO: 163133 - protein, 208 aa, Heterodera glycines
  Homolog annotation: Hit_ID=CAE73951.1; Match level="QueryCoverage =96%, HitCoverage=75%, E-value=2e-11, Identity=28%"; Hit description =Hypothetical protein CBG21575 [Caenorhabditis briggsae]
  Coding regions on vcDNA: vcDNA=SeqID_89556; Strand=+; Position=13-636
MFYRRIFALFLCIFVILFTLQFLPVIDGMQFDVVQCGHSKRCEFGGCAPGKAQNAASCAYLFSMEPEGPDSVRMEMYTRRNVPDVKYVAVAFSDDTQMGDDAVTYCVLTGNGRVEARLSVNPANTKNNVPAPAGAENGFLELLEGKADDNGIYCKFRQHSNNGPGKDLARPNLHKAYYLFLAKGPAEEPHTIGIHSLDSDDHAVFPHI

SEQ ID NO: 163134 - protein, 490 aa, Heterodera glycines
  misc_feature (67)..(67): Xaa can be any naturally occurring amino acid
  Homolog annotation: Hit_ID=NP_506513.1; Match level="QueryCoverage =97%, HitCoverage=85%, E-value=1e-112, Identity=48%"; Hit description= TRNA Methylase (58.3 kD) (trm-1) [Caenorhabditis elegans] emb|CAB00881.1| Hypothetical protein ZC376.5 [
  Gene Ontology: Mol. function=tRNA (guanine-N2-)-methyltransferase activity; Cellular component=mitochondrion; Biological process=tRNA modification
  Coding regions on vcDNA: vcDNA=SeqID_89557; Strand=+; Position=39-1507
MDGAESVILQCATEKGNGVGPSVAADCEANKLAEVTEGLARITATAEGGETFYNRVQEFNRDLTSLXVVVLRAFAAEIPNEKEPKTEEEGPKAKQRKMDEGKAPEANAAQSQPRAFSVLDALSASGLRAIRFALEVPNVTRVVANDFSEKAFEAIRRNVQLNGVQHKVEAVFSDAIDLMMAHRKFGKRFHAVDLDPYGSASAFLDAAVQAVMDGGLLMVTCTDTAILCGNTPEACFNKYGSVPLRHKSCHELALRILLRAIDAHANRHKRYIVPLLSVSVDFYVRCFVRIRSGAAMAKDSVTKLANVNCCATCQSLDFQPLLKKSVSGPSVRFSTAHFQSELVRLFLGQSDASMDGRMVAKCAHCGGTAIHTGGPIWVAPTWDTEFVGKLLAILKGPNAGQLRLGTRERLEGLLTVLSEELPDVPLFYEHDQLMVVMKCPSPKMNVFRSALLNAGFRCSISHCNPRAVKTDAPTSFLWDVCREWAKRNGI

SEQ ID NO: 163135 - protein, 303 aa, Heterodera glycines
  Homolog annotation: Hit_ID=NP_504650.1; Match level="QueryCoverage =99%, HitCoverage=65%, E-value=4e-79, Identity=49%"; Hit description =epoxide hydrolase (51.5 kD) (5G981) [Caenorhabditis elegans] gb|AAB04970.1| Hypothetical protein W01A11.1
  Gene Ontology: Mol. function=epoxide hydrolase activity
  Coding regions on vcDNA: vcDNA=SeqID_89558; Strand=+; Position=2-910
FSVNVSNKELAGLKDRLTKCRIGHEQLEDVHDFEYGFPIGELMEWRDRWLNEYDWREAEKKLNAMGDHFRAQIEGLQIHFIRSRPADPSVYKRRVPILLCHGWPGNVFEFHKLVPLLTNPRSNYIRNISSSEIAFEVIVPSIPGYGWSEQPHKGGFNQMATARIFHKLMVERLGFRRYIAQGGDWGSVVTSNMARMFPESVAGLHLNVVFPDFKSPSQLLISLFGSLVPRWIFSGPEGPTFSLAGIFSFIFRESGYMHIQATKPDTVGVALNDSPLGLLAYILEKFVCWTNPSFLKLADGGLE

SEQ ID NO: 163136 - protein, 315 aa, Heterodera glycines
  Homolog annotation: Hit_ID=AAH74536.1; Match level="QueryCoverage =98%, HitCoverage=92%, E-value=1e-39, Identity=33%"; Hit description =MGC69286 protein [Xenopus tropicalis] ref|NP_001004796.1| MGC69286 protein [Xenopus tropicalis]
  Coding regions on vcDNA: vcDNA=SeqID_89559; Strand=+; Position=2-949
HSIQTLSAWLLHHAKKHADCILDCWLKEVRNNSENERLISLINLANDVIQNSRKKVPSFMAAFFEVLQPAFVHASECLDESHRKMVARIVAVWRERQIYSAKNLDDLSKCLTADEPSTFSVSPNLNSETESPSKSSPVDGGQSPVASEEDTKKIKEEFHAFSTLSSNMIALLRKLEDPASTDVKIRQLIAAYPESIANPTLLKQFKSADEFGELSKKIAEAMPVVDVYCGRLREELKDRQNFQFLLEDYIKALNEANERNKQLVVSVKRRIGRLDEEKQELARHIESLPDLTEMFGSEPATTNLPSLGELFTPTS

SEQ ID NO: 163137 - protein, 220 aa, Heterodera glycines
  misc_feature (195)..(195): Xaa can be any naturally occurring amino acid
  Homolog annotation: Hit_ID=NP_499340.1; Match level="QueryCoverage =93%, HitCoverage=77%, E-value=2e-60, Identity=52%"; Hit description =mitochondrial ribosomal protein L22 like (30.5 kD) (3L707) [Caenorhabditis elegans] emb|CAA21022.1| Hypot
  Coding regions on vcDNA: vcDNA=SeqID_89560; Strand=+; Position=2-662
RRLPLVPRIAPFSPIQRFEKQFPKIYYAPEWRLDESGKRMTRGVEEKYSPMNNYGVTPDKWEYMNKVVWPPNYVVPETGKPKPREVFHCIENIHTAPKKMHTVHQFALNMVVDEAIQQLRNHQKKPTFLLADLIEEAKERARKEFFIENPGKMFVAETFHIQSKIVKGARRHAHEKWHPMRYRYINLFVRLQEGXPPKSKKREPDAHGWDKMENYYAFLQ

SEQ ID NO: 163138 - protein, 103 aa, Heterodera glycines
  Homolog annotation: Hit_ID=NP_509429.1; Match level="QueryCoverage =100%, HitCoverage=15%, E-value=5e-49, Identity=84%"; Hit description= transmembrane 9 superfamily member 2 (75.3 kD) (XJ38) [Caenorhabditis elegans] gb|AAB71307.1| Temporaril
  Gene Ontology: Cellular component=membrane; Biological process =transport
  Coding regions on vcDNA: vcDNA=SeqID_89561; Strand=+; Position=1-312
VFLILIVTCSEATILLAYFHLCAEDYHWWFRSFMTSGFTAVYLFIYCIHYFNSKLTITGVVSTILYFSYTSIFVFLFFLMTGTMGFFATYWFIYKIYSSVKVD

SEQ ID NO: 163139 - protein, 150 aa, Heterodera glycines
  Homolog annotation: Hit_ID=NP_498082.1; Match level="QueryCoverage =68%, HitCoverage=80%, E-value=9e-20, Identity=44%"; Hit description =cytochrome c oxidase polypeptide via-liver mitochondrial like (14.7 kD) (3G171) [Caenorhabditis elegans]
  Gene Ontology: Cellular component=integral to membrane; Biological process=energy pathways
  Coding regions on vcDNA: vcDNA=SeqID_89562; Strand=+; Position=43-495
MLIKLVKATVGVPSPVALRAVSARGVGSGTHWIGNDFEDFDKHYKTGLRDAVPIAAFWKKFSAFVMMPLLVFAGYCGWKDHQNVHHSPRPEYVAYEYLATRRKPFPWGDGNHSLLHNPATNWVPGVGYEAPWPGDAHKKEGDSGGEGKKH

SEQ ID NO: 163140 - protein, 277 aa, Heterodera glycines
  Homolog annotation: Hit_ID=NP_727425.2; Match level="QueryCoverage =84%, HitCoverage=8%, E-value=6e-11, Identity=31%"; Hit description =CG17255-PB, isoform B [Drosophila melanogaster] ref|NP_572631.2| CG17255-PA, isoform A [Drosophila melanog
  Coding regions on vcDNA: vcDNA=SeqID_89563; Strand=+; Position=2-832
SSGQPGGGGPVVVHGGNAVNFAAAAAHQQQQQQAAGDPSQHVAAVHHHHQQQQQLPPQQNKTLFTPAANPAMVSATPAMQQHLQQQAQTIFHQTSATAVPQFPSYNMPYMYSPVATAQTLQGPNAEIDRFLIQQYGTPYSQLDLQMGAMSIGPPTSLAPNHHRATLESYMENKFGQQQQNVNQAANNGHYQQTQQSQQQQRGLAQSEQATLLGGPPSHVGPPPGFGMPTAPTQPSYVQPANIHSLFQMPTYPHPYQHPQYMMSNANRFQAAQRPAQT

SEQ ID NO: 163141 - protein, 201 aa, Heterodera glycines
  Coding regions on vcDNA: vcDNA=SeqID_89564; Strand=+; Position=27-629
MFRFLFASGQIRASARSVASYDRMGQNNFAAHISKPFSVWAARENADNLGVVDAGKTLQVTLSTDLNTAEPGKSVRFRLSAVPDSFVGLLAVDQMPLSVGMARENADNPGVVDAGKTLFSTAEPGESVRFRLSAAPNSFVGLLAGDHGMRRGMIGGGRESFVPPRVMQSRAVSTEARDQIRAEVCEKYSEMLEKFMSKDTA

SEQ ID NO: 163142 - protein, 261 aa, Heterodera glycines
  Coding regions on vcDNA: vcDNA=SeqID_89565; Strand=+; Position=2-784
VVFLKLSPPLPSDSRRFLHLMDVFNRLLPRPGNGNVQFKKLRHTSNSASIFASDEATGDKQHNDETTNNGMMPATNSPRVELGLMLSNISAEMRHGQNSATEGNGKANGTGKQNKSFVEEKANGNGPSSEVTALSKGKSNGTAKGGGKRFLSALLPGKRKGRLGLSVSEPRLNFDIEPSKNDFEPTEIEGGENAKGGQIADHQQNFGERNRLCDGISDGSRKSRPNFAGALQKVREKLNVRPSSNSHRSSAFSPPMNRSNT

SEQ ID NO: 163143 - protein, 191 aa, Heterodera glycines
  Homolog annotation: Hit_ID=CAE60209.1; Match level="QueryCoverage =91%, HitCoverage=64%, E-value=7e-63, Identity=65%"; Hit description =Hypothetical protein CBG03773 [Caenorhabditis briggsae]
  Gene Ontology: Mol. function=phosphoric monoester hydrolase activity; Cellular component=cytoplasm; Biological process=JNK cascade
  Coding regions on vcDNA: vcDNA=SeqID_89566; Strand=+; Position=94-666
MSRVGLFGQISEINDHLFLSGAGVLRPEKLKQKGITCVVNATVEEPTANLPGIDSVRIRIEDSPFARLDHYFDQTADKIKSVKERGGNTLVHCVAGVSRSATLCIAYLMKHERMSLRQAYHYVKSARPIIRPNLGFWQQLVEYERKLRGHNTVTMVPAEGSALPFPDVYSSDLRGHILSNPGPPQHDPQIV

SEQ ID NO: 163144 - protein, 165 aa, Heterodera glycines; identical to SEQ ID NO: 128277
  Homolog annotation: Hit_ID=NP_495416.1; Match level="QueryCoverage =96%, HitCoverage=98%, E-value=7e-62, Identity=68%"; Hit description =CYcloPhilin (18.0 kD) (cyp-10) [Caenorhabditis elegans] gb|AAK68671.1| Cyclophylin protein 10, isoform b
  Gene Ontology: Mol. function=neurotransmitter:sodium symporter activity; Cellular component=ubiquitin ligase complex; Biological process=protein folding
  Coding regions on vcDNA: vcDNA=SeqID_89567; Strand=+; Position=10-507

SEQ ID NO: 163145 - protein, 115 aa, Heterodera glycines
  Homolog annotation: Hit_ID=XP_239780.2; Match level="QueryCoverage =72%, HitCoverage=12%, E-value=3e-18, Identity=53%"; Hit description =similar to RNA helicase A [Rattus norvegicus]
  Gene Ontology: Mol. function=structural constituent of epidermis; Cellular component=intermediate filament; Biological process =epidermal differentiation
  Coding regions on vcDNA: vcDNA=SeqID_89568; Strand=+; Position=39-386
MNSSMTVSLLLMLIIGTALLALTNAMPNADASLTREKRGSYGSGSYGGSSYGGGPSGGGDAFGSGGAAGFGSGIGNGFGSGGGSGFGSGGGNGFGTGGGSYGGGSYGGGSYGKRR

SEQ ID NO: 163146 - protein, 139 aa, Heterodera glycines
  Homolog annotation: Hit_ID=NP_508777.1; Match level="QueryCoverage =83%, HitCoverage=26%, E-value=1e-41, Identity=69%"; Hit description =target of (48.5 kD) (XF138) [Caenorhabditis elegans] gb|AAK39154.1| Hypothetical protein C07A12.7a [Caeno
  Gene Ontology: Cellular component=endosome; Biological process =endosome transport
  Coding regions on vcDNA: vcDNA=SeqID_89569; Strand=+; Position=65-481
MTHRQQNEGGGGAVTPNATTTGHLQEQMANAMERVGEAAHNVGQRVTDFFQGDPFGTLIGRKIELATDATKMATENWGLNMEICDFINGTNDGPRDAVRAIKKRLQTQMGKNNAIVMYTLTVLETCVKNCDHRFAVLVT

SEQ ID NO: 163147 - protein, 208 aa, Heterodera glycines
  Coding regions on vcDNA: vcDNA=SeqID_89570; Strand=+; Position=1-624
GKESCQMTMSNHNRMMNFNNVNIRKYDNKNERNGAGFGANSDTAAFESWACESFNLFEFLGEDTSPLDEVVPEKMDEDEIEKQKEDAMYSQFQYSDMLIGGQHPTNSHHDFGVNDFANVPSDGRSDFDVPTAFHEGVPFPMPPATHQIYSQNLDAIPHVPSTSKSSMPLMKQEPISEQEQINLQLGLDAPKSSRESSVASGSIHFKYH

SEQ ID NO: 163148 - protein, 319 aa, Heterodera glycines
  Homolog annotation: Hit_ID=NP_495708.1; Match level="QueryCoverage =93%, HitCoverage=83%, E-value=2e-71, Identity=43%"; Hit description =protein c20orf4 homolog (2I437) [Caenorhabditis elegans] emb|CAA88309.1| Hypothetical protein F10B5.2 [Ca
  Coding regions on vcDNA: vcDNA=SeqID_89571; Strand=+; Position=25-981
MFLLPGKCRKNWRWNCSKTAIFKDFPKGCEFGMDYRSWIVGPNFLGMKMIPPGIHFIYFSVPGAPRIAFFHNFRQKEVILRRWDTKKEDLVTDEKSDEVELDRLRENLRNIDRFLGVYPFADYRNWLSLSSYITPNSVRRLSPSNSLGRISSQNEMVTQEAKLEKKLGDPFGLSIVDREHRGRIRFTDESGLPLMSEREEAKLNFTRISQITLADTNLRRAGIDSSDRLFQCFEAMGGDYREVLAEFQFAFVVFLVGQVYEGFDQWKRLVHLFCSCTSALQSHPQFFNELFAVFHFQMKMVPDDFFEDVLASSNFLAST

SEQ ID NO: 163149 - protein, 120 aa, Heterodera glycines
  Coding regions on vcDNA: vcDNA=SeqID_89572; Strand=-; Position=5-367
FLTLSAIFLKNPDNNKKINYHIQQKLLVINQFVCSVVVAPHLSVKKFSGMTGREAESGSAKMSGIFLNNEVPFPVNIRLLMTLFILISVQREFCHVTFSYAKFSNSVDKDGNKRKCGIMP

SEQ ID NO: 163150 - protein, 46 aa, Heterodera glycines
  Coding regions on vcDNA: vcDNA=SeqID_89573; Strand=+; Position=1-141
AKHILLPFKRNYHCNHMIYFHSLCATLSYKSRGQFLLKLFAMKLAI

SEQ ID NO: 163151 - protein, 153 aa, Heterodera glycines
  Homolog annotation: Hit_ID=CAE74043.1; Match level="QueryCoverage =59%, HitCoverage=61%, E-value=2e-09, Identity=37%"; Hit description =Hypothetical protein CBG21694 [Caenorhabditis briggsae]
  Coding regions on vcDNA: vcDNA=SeqID_89574; Strand=+; Position=53-514
MAADGKKIEDSERPFVVWQRLDPSDKLGAPKPAPVPSKVKPSSGQSPSPSGIERRVWRGVAPPIPDDILALADSSFEDITPAQMAVRRMAHSPIAPIGMVATVSALVMMIVSMRRRDSLAFQRYARYRIAAQGLTICSLVGGAWYYLKKDGFM

SEQ ID NO: 163152 - protein, 196 aa, Heterodera glycines
  Homolog annotation: Hit_ID=CAE67374.1; Match level="QueryCoverage =58%, HitCoverage=7%, E-value=1e-10, Identity=31%"; Hit description =Hypothetical protein CBG12850 [Caenorhabditis briggsae]
  Coding regions on vcDNA: vcDNA=SeqID_89575; Strand=+; Position=37-624
MNAHFNGAFGFNFGFMHGALSCARTISACLGSHVHLILPPILSVLDDRKTEEKVRTSALDTLLELARRHSIEDYALPVMQTWLRCIGIKSQQPRLMELLGIIVRKWTQFSVYKENVNAALVRCRVEPMLCHEYQEQLALLQAPSYARQQQQQQQNAVGSGGGVYQQQQGTFSASTSSPLFARQVSFLPPTQNGGAT

SEQ ID NO: 163153 - protein, 78 aa, Heterodera glycines
  Coding regions on vcDNA: vcDNA=SeqID_89576; Strand=-; Position=0-233
AIKNFFTKINLKNIKFASFISCAIRINCVRSLTFLVFVTFARARLSVFARFSRRSGGAGRSNAMAHNLAFHFGPLLCR

SEQ ID NO: 163154 - protein, 197 aa, Heterodera glycines
  Coding regions on vcDNA: vcDNA=SeqID_89577; Strand=+; Position=29-619
AQAQAQAQAPQPTMSSTLPTSSSTGTTTSAAPLPAALLADLTSAIPHSPPPPVTPATLLATRISQPFYASVSTTRRSGTTAAHALALSHVSETAQFVVGYTSRNAPILNDLKGSNAAEVLLSSPPPGTSLARGQVPKVIRIEAKCYLACSPQLLMRFPPPRVAGDEEPRLTWERARLSVFARLTPAQRATLLIGEPN

SEQ ID NO: 163155 - protein, 214 aa, Heterodera glycines
  Homolog annotation: Hit_ID=NP_497456.1; Match level="QueryCoverage =90%, HitCoverage=48%, E-value=3e-12, Identity=27%"; Hit description =putative protein of bilaterial origin (3C862) [Caenorhabditis elegans]
  Coding regions on vcDNA: vcDNA=SeqID_89578; Strand=+; Position=25-666
CIYFSLFPFHVNFLMGNQQSQHNNSGHAHHGKKQLDPRIVSAFNSLSNGKDTIGLEQIKPSIGAKLALSIWPSLQDTQQRITLEQFVERAETILNFTPDIAVRMLMPAQKLVTACLEADGIEVQTEEEKAFLNSLVEHMESNAKTADALVDWKNTNCARMCHPLVERVQSLLTAIPFKQGPKIHSAILNDVQMFILRHALPTTVFFPDPSRHLS

SEQ ID NO: 163156 - protein, 213 aa, Heterodera glycines
  Homolog annotation: Hit_ID=CAE64717.1; Match level="QueryCoverage =97%, HitCoverage=78%, E-value=1e-64, Identity=59%"; Hit description =Hypothetical protein CBG09503 [Caenorhabditis briggsae]
  Gene Ontology: Mol. function=electron transporter activity; Cellular component=mitochondrion; Biological process=carbohydrate metabolism
  Coding regions on vcDNA: vcDNA=SeqID_89579; Strand=+; Position=12-650
MFPAKYKAFRLENKVAVITAATNGIGLAIAERLGHEGARLVVSSRDEDNVKRAIDRLVSSGLKRSDLAGCTCHVSNSEDRSRLLKLTIQRFGSVHILVNNAGINPIFGDLLDVDESAWDKLFDVNVKAGFMMAKLFAPEIEQSGGGSIVFNSSIGAYRSPQGIAAYGITKTALLGLTRALAESLAPKGIRVNAIAPGIIKTKMSKALWEGIDE

SEQ ID NO: 163157 - protein, 141 aa, Heterodera glycines
  Homolog annotation: Hit_ID=NP_490905.1; Match level="QueryCoverage =96%, HitCoverage=100%, E-value=1e-45, Identity=64%"; Hit description= ribosomal Protein, Large subunit (15.7 kD) (rpl-27) [Caenorhabditis elegans] gb|AAK68266.1| Ribosomal pr
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_89580; Strand=+; Position=7-432
GAFAKMVKIMKPGRVVIVLSGRYAGRKAVVVKSYDEGSSERPYGHALIAGIDKYPLKVTKKMGKKQVEKRIRIKPFLKVTSLQHLLPTRCIFEADLDKSLVNKEWIKEPRKKKNAIISVKKEFETSYKAGKSKWLFTKLRF

SEQ ID NO: 163158 - protein, 167 aa, Heterodera glycines
  Coding regions on vcDNA: vcDNA=SeqID_89581; Strand=-; Position=2-502
MYKCRLVSSPAVPRCNHRMALSAQIRRIEEKTKGRTLAQNAIRRRLQHPRLHRTPPPPPPPPVAVPTARPAPSPVRKATEGRRKVERHKLVGCYGMKTSEKQPNRRRKSEDWTKEKGEGRDTAEEKGKNGEEKANGRGKHPSDGEKAAYQRELLRERNRGNEKLGNC

SEQ ID NO: 163159 - protein, 118 aa, Heterodera glycines
  Coding regions on vcDNA: vcDNA=SeqID_89582; Strand=+; Position=38-394
LIRMSTIPMPPPPTQDEKDQQKKSQWKPLEIGNRMRTTSEDSAESFDAYGPDSPNMTSSGRRMSITERLFGRPVPQERRNSLGEEQMGQEKPKSIAENKDFKELMKRQRKILGDDEWQ

SEQ ID NO: 163160 - protein, 192 aa, Heterodera glycines
  Homolog annotation: Hit_ID=NP_501127.2; Match level="QueryCoverage =79%, HitCoverage=10%, E-value=3e-49, Identity=66%"; Hit description =RNA Polymerase, Class III (C), rna polymerase (rpc-1) [Caenorhabditis elegans] gb|AAA83341.2| Rna polymer
  Gene Ontology: Mol. function=DNA-directed RNA polymerase activity; Cellular component=DNA-directed RNA polymerase III complex; Biological process=growth
  Coding regions on vcDNA: vcDNA=SeqID_89583; Strand=+; Position=1-576
VGAIAATSIGEPSTQMTLKTFHFAGVASMNITQGVPRIKEIINAVRSISTPIITVALADERDEKLARRVKARTEKTTLGDIIDYVEQVFLPDGLYVLVKLNTRRIREMELEVTMDTIIDSICASKLPVSRILCDQIRSVGKSMLLVRPVESSKSRTKFNNSLVIAEVLGIEAARGSIISEILAIMGKHGIEL

SEQ ID NO: 163161 - protein, 285 aa, Heterodera glycines
  Homolog annotation: Hit_ID=NP_491515.2; Match level="QueryCoverage =100%, HitCoverage=81%, E-value=1e-143, Identity=85%"; Hit description=atpase (39.9 kD) (1F648) [Caenorhabditis elegans] gb|AAK85455.2| Vacuolar h atpase protein 16 [Caenorha
  Gene Ontology: Mol. function=hydrogen-transporting ATPase activity, rotational mechanism; Cellular component=hydrogen-transporting ATPase V0 domain; Biological process=hydrogen transport
  Coding regions on vcDNA: vcDNA=SeqID_89584; Strand=+; Position=16-870
MGEFFFNLDHGYLEALIRGFKSGLLTSTDYSNLVQCETLEDLKLHIQSTDYGNFLANEPGNITVQVIDERLKEKLVTEFTHLRNNSLEPLATFLDYITYSYMIDNIILLITGTLHQRPINELISKCHPLGSFEQMEAIHIASNPAELYNAVLVDTPLAPYFVDCISEQDLDELNVEIIRNTLYKAYIEDFYNLCKKMGGKTAEVMCEILAFEADRRAFIITINSFDTELNKEDRANLYPRCGKLFPEGLAGLAKADDYEQVKQVCEYYSDYKQLFENSGLNPGEK

SEQ ID NO: 163162 - protein, 94 aa, Heterodera glycines
  Homolog annotation: Hit_ID=NP_501094.1; Match level="QueryCoverage =85%, HitCoverage=88%, E-value=3e-22, Identity=57%"; Hit description =transport to INner mitochondrial membrane (yeast TIM) TIN-9, TIMeless related (10.2 kD) (tin-9) [Caenorha
  Coding regions on vcDNA: vcDNA=SeqID_89585; Strand=+; Position=2-286
MTQQQGATDTDLRTFRDFLFQYNAVTEQCFDACIRDFTSRDISEKEERCSKNCMDKFLKAGQRLSMRFQEHQLLNMEAQGAPVMATNTKVQIGK

SEQ ID NO: 163163 - protein, 343 aa, Heterodera glycines
  Homolog annotation: Hit_ID=NP_502196.1; Match level="QueryCoverage =100%, HitCoverage=37%, E-value=5e-77, Identity=47%"; Hit description= methionyl tRNA Synthetase (101.7 kD) (mrs-1) [Caenorhabditis elegans] emb|CAA97803.1| Hypothetical prote
  Gene Ontology: Mol. function=interleukin-8 receptor binding; Cellular component=cytoplasm; Biological process=apoptosis
  Coding regions on vcDNA: vcDNA=SeqID_89586; Strand=+; Position=3-1034
LFTKIEPAKVAEWKELFGSGKQQQNQPKNNGPTAMSSSSSKKAPNSTEKQQQKQKKKKENMAEERGEVGQIYAEVMAKFEKAKALFVTNESEKLDTEIAALKEQITEQKARLGFTGALFSPPMPKATPAIVVPPAVSSPQTPPKLTAASNASKEQTQQKQQPKQKKPQQQQATAPADDTVDVGCLDLRVGRIIEAQKHPDADALYVEQIDLGEEKPRTVVSGLVRFVPLEQLKNRLVVCLCNLKPAKMRGVESQAMVMCASTPEKVEVLEVSPESVPGDLVVCEPFVRRPPQQLNPKKKIWETVAPDLSVSETGECIYKGQILRVERLNSSLSASTLRNVPVK

SEQ ID NO: 163164 - protein, 380 aa, Heterodera glycines
  Homolog annotation: Hit_ID=NP_500379.1; Match level="QueryCoverage =91%, HitCoverage=65%, E-value=6e-85, Identity=46%"; Hit description =protein from EUROIMAGE 1967720 (62.7 kD) (4E360) [Caenorhabditis elegans] gb|AAD12825.1| Hypothetical pro
  Gene Ontology: Mol. function=tRNA dihydrouridine synthase activity; Cellular component=mitochondrion; Biological process=tRNA modification
  Coding regions on vcDNA: vcDNA=SeqID_89587; Strand=+; Position=10-1149
MVDAHFAGCAHIKSEYVVLRSETQQQEGGNKPPNESNPLEGNSHEGILPRNVRARGMDRQREQKMAKARAENRQKIVRICPSVLFESEGRKCKYGEKCDAEHSLTKYWAKKPPDIGPSCFLFDQMGKCSFSLSCCFARAHTNESDLSQKSKAGHSEWQSVLNTHTLPIQQQLRKRTYDFSRSERALHESPSGCMEREAPKWDMRTLRGKKYLAPLTTVGNLPFRRLCVELGAEVTCGEMAIATHLLQGLPSELSLMKRHPSEKIFGVQLAGGYPDSLGKAVQLITDNFNVDFIDLNLGCPLDSVNEKGAGCSLANKSNKLVSVLQCMQKSATGVPVSVKMRYGVKEGERTAHYTMGTIAERSPPQLLTLHPRSRGQRYTR

SEQ ID NO: 163165 - protein, 107 aa, Heterodera glycines
  Homolog annotation: Hit_ID=AAO85453.1; Match level="QueryCoverage =85%, HitCoverage=70%, E-value=9e-33, Identity=67%"; Hit description =putative gland protein G16A01 [Heterodera glycines]
  Coding regions on vcDNA: vcDNA=SeqID_89588; Strand=+; Position=23-346
MAEEYFLIAAAAFGAGIYCWKTYLGPLLEQPKSDDEEKPKPEGGEEATTAGDKEEKKAGSKGDKHKKSGSKGDKHKKDKKSGSKSDKDNGPADENKQPQTSAYATPT

SEQ ID NO: 163166 - protein, 196 aa, Heterodera glycines
  Homolog annotation: Hit_ID=AAP06491.1; Match level="QueryCoverage =100%, HitCoverage=70%, E-value=2e-44, Identity=47%"; Hit description= similar to probable hydroxyacylglutathione hydrolase (Glyoxalase II GLO2_SCHMA [Schistosoma japonicum]
  Gene Ontology: Mol. function=hydroxyacylglutathione hydrolase activity; Cellular component=mitochondrial matrix; Biological process=sulfur metabolism
  Coding regions on vcDNA: vcDNA=SeqID_89589; Strand=+; Position=70-657
MRVVPIPANTDNYMYLIIDDDDKYQKGHRPAALVDPVNVEKCFEVVKTEGTLLEAALVTHHHWDHAGGTYQLAIKSRSGFSDLLMKQPLCIISGDAERVERTEKVIADGESVQLGTNLSVTAMYTPCHTSTHVCYYVVDQRTNERAVFTGDTLFIGGCGRFFEGTAEQMHHALNERLAALPDETLVYCGHEYTVAN

SEQ ID NO: 163167 - protein, 237 aa, Heterodera glycines
  Homolog annotation: Hit_ID=EAL18352.1; Match level="QueryCoverage =71%, HitCoverage=38%, E-value=6e-22, Identity=35%"; Hit description =hypothetical protein CNBJ2750 [Cryptococcus neoformans var. neoformans B-3501A]
  Gene Ontology: Mol. function=caspase activity; Cellular component =nucleus; Biological process=proteolysis and peptidolysis
  Coding regions on vcDNA: vcDNA=SeqID_89590; Strand=+; Position=54-764
MSSSAPTQALCIGMTYPGSDSPLPGCEVDAYKMTQLAANMGIPEESISAMSDVAGTEVTKADVLASLREMVDNAKPGDNLMFTWSGHGGQRPSTELGETDGQDELIFASDGPISDNEIYDILRDLPEGCNMNMVFDSCRSGTMVDLDFADLDANIVCVSAALEDQNSLGNSDGGVFTNQLCEVLQENPGIALADAIETVNTLNAANDVPHVAMVTTTTGAEHLLQEPAFGLTDPVEF

SEQ ID NO: 163168 - protein, 99 aa, Heterodera glycines
  Coding regions on vcDNA: vcDNA=SeqID_89591; Strand=+; Position=52-351
HLQLGSIEMDCFDNDDAFGELVYEEEEFEQELEDKRKQGQKCTSTQREEEEELRETENEILPELRSERVFINIPAIKFSLVVQLRGFTWSKVKLRPTVT

SEQ ID NO: 163169 - protein, 123 aa, Heterodera glycines
  Homolog annotation: Hit_ID=XP_478998.1; Match level="QueryCoverage =92%, HitCoverage=15%, E-value=4e-12, Identity=40%"; Hit description =putative diaphanous homologue [Oryza sativa (japonica cultivar -group)] dbj|BAC55695.1| putative diaphanou
  Gene Ontology: Mol. function=SH3-domain binding; Cellular component =lamellipodium; Biological process=actin filament organization
  Coding regions on vcDNA: vcDNA=SeqID_89592; Strand=-; Position=11-481
IKPSFPVGHFSAKFPPPRPPRAPPPCEGTPAERPPPNMARRNPLGATPPPAPPPPPQAMPGPSAPPPPPAVAPEAGEYCFARVGCGAPAILRAAAQMRAHSSSTSSSSPGTGGAAPEAAGAGV

SEQ ID NO: 163170 - protein, 84 aa, Heterodera glycines
  Coding regions on vcDNA: vcDNA=SeqID_89593; Strand=+; Position=2-256
TSKNEDYDPDIWHSKEQQRQLMHNAKQSRILKELGCPAMGDGCCSNALLEASVKARVRDVARYQLRRALASNLLFKSRGRNDQL

SEQ ID NO: 163171 - protein, 98 aa, Heterodera glycines
  Coding regions on vcDNA: vcDNA=SeqID_89594; Strand=+; Position=2-298
SFLKMEFVLIVRLPNDLKYITVRPSSTIAFVRGMTASLMGTATENVRLLLDGMPMHDGRTVEHYGLTSDSRVFAELINKGTDGAGSSAGKTGKPPAGR

SEQ ID NO: 163172 - protein, 298 aa, Heterodera glycines
  Homolog annotation: Hit_ID=CAE70749.1; Match level="QueryCoverage =85%, HitCoverage=35%, E-value=6e-91, Identity=66%"; Hit description =Hypothetical protein CBG17495 [Caenorhabditis briggsae]
  Coding regions on vcDNA: vcDNA=SeqID_89595; Strand=+; Position=2-895
ENKDGSFLNKRDISDPYCEIQVGSQVFHTRVINNNLNPVFNECFEAVVDQASGQKLRIELFDKDTAGADEELGRLSIPLESVRQAGEMERWHHLEGCKHGELRLKVCWMDLSTESTGVGRDEWEQEWLGADKPMHPALLMVFIDSVANLPYPKSNLEPSPFVEVSLGRITQRTPVKPKTVNPLFQSKFNFFVKQPEGQELKIRAVDEGTKRDIGELSIPLAAVMREPMMEMSQQSFYLTHGVHSSPIVLTARLRFFTPPRKVLEARDLSSTYGNAVHIERGDRTNSSLSEEDGQSNHN

SEQ ID NO: 163173 - protein, 202 aa, Heterodera glycines
  Homolog annotation: Hit_ID=NP_504477.1; Match level="QueryCoverage =91%, HitCoverage=67%, E-value=2e-36, Identity=41%"; Hit description =predicted CDS, cyclin G1 interacting protein like (5G74) [Caenorhabditis elegans] pir||T32530 hypothetica
  Coding regions on vcDNA: vcDNA=SeqID_89596; Strand=+; Position=17-625
MATQSNFGKFQQRSSRQSSRIISQQPTKCFDEAAKRRRIQQQLESLEKDNFQEDPHANITWHKAAPKFDDEMVFGDKEKKRRKRKIASPSKVSGAEQATKKGKKIVAALTKTRFRKTFAQLLEEAQRKREEETQQRRKEASPELLLPTYYEVASSPSKVPSRKFCAVCGLFAGYTCVRCSARFCSIPCKDMHLDTRCLKWTV

SEQ ID NO: 163174 - protein, 93 aa, Heterodera glycines
  Coding regions on vcDNA: vcDNA=SeqID_89597; Strand=+; Position=1-282
TLFTVGPLLGSSKWEHAREQPSGLVQIDLGLNICGRSVPGNLVICFAVQRGTVEYFGDQQHKPCKNLKKNKKLLSEKMEAVRPPRRKIQEKIL

SEQ ID NO: 163175 - protein, 194 aa, Heterodera glycines
  Coding regions on vcDNA: vcDNA=SeqID_89598; Strand=+; Position=33-614
MSDFFLDNSDMDDNELELKLNNLQMLKNRRANKSLKMPPTDIGTTKLPVNGKGIGYRPLPENAQLKRDIETKMGTTDSEEKEKEPKEENRVPPNENGNGNRPLSDNAKEKNAQLKREIKEILGIIDSEEKETEPKETKFCEMFSWVQLFFGLAFLLLSFAVFCWCASNKTQTSNTPTHSNSSSVPSNVPVPPFL

SEQ ID NO: 163176 - protein, 241 aa, Heterodera glycines
  Homolog annotation: Hit_ID=CAE74548.1; Match level="QueryCoverage =96%, HitCoverage=42%, E-value=2e-10, Identity=29%"; Hit description =Hypothetical protein CBG22305 [Caenorhabditis briggsae]
  Coding regions on vcDNA: vcDNA=SeqID_89599; Strand=+; Position=3-725
MSRPLPNVTQTANILRSNAPSPHNQQQALYQQQQMLPHQQQQLHPPPRLNSQPPYTIVYQNQQRTPQPTVLVGTANSPLQSQSISSSCASSPQLSMTSSSGGGAGDGGTAAPVASANPHDPKRLLLKCAHFFKSLSRFKPNSSQEQHQQVLQLLREGVTSEMSAEEFSAKLREVTGSQDKGTLLPFLKLSLPLLRVSLRKGEQNELQQMLRLDGAGSASPEETALLSPQQQQLSDNGVDEA

SEQ ID NO: 163177 - protein, 147 aa, Heterodera glycines
  misc_feature (26)..(26): Xaa can be any naturally occurring amino acid
  Homolog annotation: Hit_ID=CAE73097.1; Match level="QueryCoverage =97%, HitCoverage=18%, E-value=9e-49, Identity=63%"; Hit description =Hypothetical protein CBG20476 [Caenorhabditis briggsae]
  Gene Ontology: Mol. function=protein tyrosine kinase activity; Cellular component=nucleoplasm; Biological process=signal transduction
  Coding regions on vcDNA: vcDNA=SeqID_89600; Strand=+; Position=3-447
IMLGLPYDFGIDLWSVAVTLYEVYTXKIMFPGKSNNQMLKFMMDLRGKFPNKVIRKAVFKDQHFDYNCNFLYHETDKVTGKDKVTVLTNIKLLRNLPAELSGDQELDRDGFAKVDHFRSLLEQMTALDPSKRISCSDALKHPFIVEK

SEQ ID NO: 163178 - protein, 79 aa, Heterodera glycines
  Coding regions on vcDNA: vcDNA=SeqID_89601; Strand=-; Position=1-237
NDQNKTMLNKEKMAKYNDKQIKIELTVTAQPKPNENRKSSKVEIEKSAFRHFLAELVRLAQESIEIEITLTVPRAVRLL

SEQ ID NO: 163179 - protein, 90 aa, Heterodera glycines
  Homolog annotation: Hit_ID=NP_501616.1; Match level="QueryCoverage =73%, HitCoverage=94%, E-value=2e-10, Identity=42%"; Hit description =putative protein (8.1 kD) (4K24) [Caenorhabditis elegans] emb|CAB63344.1| Hypothetical protein Y11D7A.10
  Coding regions on vcDNA: vcDNA=SeqID_89602; Strand=+; Position=6-278
MGTKIKIFNKVIWIPKRIWGESLAFAGILIGLHFVYYSMQNNPNLIPLNDRRELIYVKWIKEKFPSLGWVGIDDSEAMKRRERIMGQKEQ

SEQ ID NO: 163180 - protein, 198 aa, Heterodera glycines
  Homolog annotation: Hit_ID=NP_505666.1; Match level="QueryCoverage =87%, HitCoverage=72%, E-value=1e-26, Identity=35%"; Hit description =udp-glucuronosyltransferase family member (5K853) [Caenorhabditis elegans] emb|CAA94866.1| Hypothetical p
  Coding regions on vcDNA: vcDNA=SeqID_89603; Strand=+; Position=112-705
DFGGKSLFKVLADSAFEKPSLVDIFFSSKLFQASLNDACEALIRTQSQQFKLLKKRNFDVIISEQLNFCGAGIGHLLDISVNIVLSSCSLQEHLASLIGLPFPSSFVPSLMDSNWSDKMSLLQRFQNLLHKFAGYNYLSCGIDPLTQIFRKHFGNAFPDLRSIVSKSPLIFVASDEFVDFPRPLFSNVIYIGGLGMEK

SEQ ID NO: 163181 - protein, 161 aa, Heterodera glycines
  Homolog annotation: Hit_ID=CAE74105.1; Match level="QueryCoverage =66%, HitCoverage=89%, E-value=3e-10, Identity=35%"; Hit description =Hypothetical protein CBG21765 [Caenorhabditis briggsae]
  Coding regions on vcDNA: vcDNA=SeqID_89604; Strand=+; Position=1-486
TSSFCRHLTKVAHRFFSSSVRQTELSLERHEWQTVMCSNGVIACWHPPKQFPFEHSRTFNMEKAMSEKEKFLNRKPDQTLFTTAPDDNALCEIFHTEKQEWRPIYREKRLYNAKVEDQLKPILSNPLETPTAPVITKNVENEAHRIEQGVNEGNNPNILSE

SEQ ID NO: 163182 - protein, 286 aa, Heterodera glycines
  misc_feature (18)..(18): Xaa can be any naturally occurring amino acid
  misc_feature (278)..(278): Xaa can be any naturally occurring amino acid
  Homolog annotation: Hit_ID=AAL78215.1; Match level="QueryCoverage =97%, HitCoverage=96%, E-value=1e-160, Identity=96%"; Hit description= probable polyprotein allergen Hgg-14 [Heterodera glycines]
  Coding regions on vcDNA: vcDNA=SeqID_89605; Strand=+; Position=4-862
ECHLFGFAPSISPPIPFXISVLLLLFCLQFFPLNALHHSVFVRRDLSRPAPDDGVASASINTEEDLGGLNTEWLTDDQLSELASAGSNEERMIKMRTFYDNLEGEAKKGATKKIVEECYGWVDEVATEDERNALKQMHHQSHDECKAKVRELMGRLSEERSEQVENRMGFCEHVYYGKMDGEGDGGAGTAGDEHHHHHHHHTKRRAHRQRRDHHHHHHGEHGLEDYFKTHLAWLTDEQKAEISRMKESGKSRQEIKQKVIELYDATTGEAREKATELXEGRVPRAD

SEQ ID NO: 163183 - protein, 222 aa, Heterodera glycines
  Homolog annotation: Hit_ID=CAE56448.1; Match level="QueryCoverage =87%, HitCoverage=32%, E-value=4e-81, Identity=72%"; Hit description =Hypothetical protein CBG24153 [Caenorhabditis briggsae]
  Gene Ontology: Mol. function=proline-tRNA ligase activity; Cellular component=cytoplasm; Biological process=reproduction
  Coding regions on vcDNA: vcDNA=SeqID_89606; Strand=+; Position=3-668
LRHLFRASLNAYSNGPVIAENIINSLKRNREMGKEQQKQQNKEKKVAAQQQQNTGDEAGTKKQTRLGLDVTKTENYSEWYSQVIVKAELIEYYDVSGCYVIRPWAYSVWEHIQAFFDAEIKKLGVKNCYFPMFVSAAALEREKTHVADFAPEVAWVTKAGNNDLAVPIAIRPTSETVMYPTFAKWCKSHRDLPIKINQWCNVVRWEFKHPTPFLRTREFLWQ

SEQ ID NO: 163184 - protein, 199 aa, Heterodera glycines
  Homolog annotation: Hit_ID=NP_491747.1; Match level="QueryCoverage =96%, HitCoverage=37%, E-value=4e-22, Identity=30%"; Hit description =zn-finger, cysteine-rich C6HC family member (57.0 kD) (1G630) [Caenorhabditis elegans] gb|AAB93643.1| Hyp
  Gene Ontology: Mol. function=zinc ion binding; Cellular component =nucleus; Biological process=ubiquitin-dependent protein catabolism
  Coding regions on vcDNA: vcDNA=SeqID_89607; Strand=+; Position=18-614
MSNSNDSDDLIIYDDNEDIKDVSSDSGDEVAMEEVTNAGTSTAGALSNEEIRDYQVLSQTELVDELNKLSSETSAVLRFNGSICKVLLHHFKWNKVTLIERFFEFPETSNTDSFFRNANLLDPTKHNKIEGKGDYCKNCYHLRQLTGMLCNHLFCRQCWSNYLSCKFLGEGRPYVTCPELRCTIVADDEFVLKNVDNKQ

SEQ ID NO: 163185 - protein, 262 aa, Heterodera glycines
  Homolog annotation: Hit_ID=CAE68613.1; Match level="QueryCoverage =90%, HitCoverage=40%, E-value=4e-67, Identity=54%"; Hit description =Hypothetical protein CBG14494 [Caenorhabditis briggsae] emb|CAE68611.1| Hypothetical protein CBG14492 [Cae
  Gene Ontology: Mol. function=ammonium transporter activity; Cellular component=plasma membrane; Biological process=ammonium transport
  Coding regions on vcDNA: vcDNA=SeqID_89608; Strand=+; Position=44-829
MVTQNDHLMANLSDQLTNLQKELDTLKKDMTANNDAFFNCAMALIIFLMQCGFAFLEAGAVRSKNCTNIIIKNVLDSLLGIIAYAAVGWALAFGSNPLPVLEPYFGFSQFGMVGTTEFSKFFFQFVFCATASTIISGAVAERAEIACFITYSLAITAFVYPVLTHWGWTKQGWMAASGFVVDDAHQITYVDFAGSGMVHVCGGTISLIAAALMGPPIGRFPERTVSVPVGGPRRKQNEPKSVEIKRHSVPLASMWGFILIAG

SEQ ID NO: 163186 - protein, 149 aa, Heterodera glycines
  Homolog annotation: Hit_ID=CAE71256.1; Match level="QueryCoverage =91%, HitCoverage=59%, E-value=3e-25, Identity=46%"; Hit description =Hypothetical protein CBG18136 [Caenorhabditis briggsae]
  Coding regions on vcDNA: vcDNA=SeqID_89609; Strand=+; Position=21-470
MKFSHVLAKGKVNLNAHTWFRRVWEKGYSGPPLPKIKRTGKPPVPVTNEAVNEVRTALMREWNVMQWLANPYLNAEKEAPYLERFGDINDEWTQRTVEAKHRKMPNKPKIRQIASGEVEKRRANVGNLLHAHRTVEDELKNLERRNRWD

SEQ ID NO: 163187 - protein, 214 aa, Heterodera glycines
  Homolog annotation: Hit_ID=CAE56800.1; Match level="QueryCoverage =99%, HitCoverage=60%, E-value=1e-80, Identity=66%"; Hit description =Hypothetical protein CBG24612 [Caenorhabditis briggsae]
  Gene Ontology: Cellular component=membrane; Biological process =intracellular protein transport
  Coding regions on vcDNA: vcDNA=SeqID_89610; Strand=+; Position=1-689
RFSSSNVGCFSAVKMTAAAKLSRFFRRLVHVRQMDFEFAAWQMLYLLVNPQKVYRNFMYRKKAKDQWARDDPAFLLLLALSLLGSSVLFALALNLSFSSFCAFFLWVVFIDCIGIGIAIATALWFISNRFLRRTRDCDVVEWAYCFDVHLNAFFPLLILLHVILPLLFYGLVDYQNFLARFFGNSIWCIATIYYNYITFLGYTALPTLENTQFF

SEQ ID NO: 163188 - protein, 150 aa, Heterodera glycines
  Homolog annotation: Hit_ID=AAF76925.1; Match level="QueryCoverage =100%, HitCoverage=100%, E-value=2e-83, Identity=98%"; Hit description=hypothetical esophageal gland cell secretory protein 11 [Heterodera glycines]
  Coding regions on vcDNA: vcDNA=SeqID_89611; Strand=+; Position=20-472
MFRFSLLLLLVPLVRCVPNPKPLFGIGIGRKQSAGAEGKLTCAGEPLADVKVKLYDDDRGVDTDDLMGETRTDSEGRFRLEEYTNEITTIDPKINIYHDCNDGLKPCQRKISIMIPDKYIASGEHPNTYYDAGTIELEGKFSGETRDCLH

SEQ ID NO: 163189 - protein, 209 aa, Heterodera glycines
  Homolog annotation: Hit_ID=NP_500306.1; Match level="QueryCoverage =87%, HitCoverage=28%, E-value=4e-70, Identity=71%"; Hit description =acetolactate synthase homolog (69.3 kD) (4E27) [Caenorhabditis elegans] gb|AAC17553.2| Hypothetical prote
  Gene Ontology: Biological process=embryogenesis and morphogenesis
  Coding regions on vcDNA: vcDNA=SeqID_89612; Strand=+; Position=3-629
IVSLCLLISVKILRLTNLDILFRIRDGLRSGKPFITALFRVDIESQRHGGELVAEVLKAHGVRELFTLCGGHISPILVACEQIGIRVLDTRHEATAVFAADAAARLRQDIGVAAVTAGPGITNTVTALKNAQMAESPVLLLGGASPSLLKGRGALQDIDQQTLVRSLCKFSARVTCVRNIVPTIRNAIATAESGTPGPVFVELPIDVLY

SEQ ID NO: 163190 - protein, 193 aa, Heterodera glycines
  Homolog annotation: Hit_ID=YP_062940.1; Match level="QueryCoverage =83%, HitCoverage=47%, E-value=6e-33, Identity=46%"; Hit description =pantoate--beta-alanine ligase [Leifsonia xyli subsp. xyli str. CTCB07] gb|AAT89835.1| pantoate--beta-alan
  Gene Ontology: Biological process=coenzymes and prosthetic group metabolism
  Coding regions on vcDNA: vcDNA=SeqID_89613; Strand=+; Position=39-617
MSTSSKLTVINTIATMRQFVRKHRKQNANLCVALVPTMGALHQGHLRLAHQARQWHNDKKEQNGTTDQCASPPLVIVSIFVNPLQFGPNEDFERYPRTLEADLAKLEGVVDCAFVPNAVEMFGEEKQPLNHKDEEDGIGIKSGRIGRILEGVTRPQYHDGMLLHVAKLFNIVQPNLAFFGKKDAQQLFAIHQL

SEQ ID NO: 163191 - protein, 204 aa, Heterodera glycines
  Homolog annotation: Hit_ID=CAE65987.1; Match level="QueryCoverage =86%, HitCoverage=22%, E-value=6e-36, Identity=40%"; Hit description =Hypothetical protein CBG11178 [Caenorhabditis briggsae]
  Coding regions on vcDNA: vcDNA=SeqID_89614; Strand=+; Position=15-626
MMRPFLGVRRIISVYRTISGLRPFDCVQRTLTVPIEGKAPKRCTAEEAVRDIESDEHIYLHHAMSCPTDLLRAFGKHIEKNDLRGIRASHALTCGEVPWTDEKLHDRVRSTTIFICSNFRKLVNQGKADYLPVFLSQSARLYDEKVLRVDTALLNVSPPDKHGYCSLGVSVDMSSAAARNAKRVIASINKTQPRTFGDAEIHIS

SEQ ID NO: 163192 - protein, 68 aa, Heterodera glycines
  Coding regions on vcDNA: vcDNA=SeqID_89615; Strand=+; Position=3-209
LSHNRFTMLIFPHIKFSTLLKRATVNSSYYVSYAAYGASAFLVLVYVTEWKRFARYIPGLRSQIKSDE

SEQ ID NO: 163193 - protein, 81 aa, Heterodera glycines
  Coding regions on vcDNA: vcDNA=SeqID_89616; Strand=-; Position=2-247
LNVTMFFLITLLVKRQRMVRIRRLPVVVRPLIDNFVLRKFISFVRCGCCGSCAKIPNTKSDKSSRPKTTIPAPIEHRHNQE

SEQ ID NO: 163194 - protein, 202 aa, Heterodera glycines
  Homolog annotation: Hit_ID=NP_788728.1; Match level="QueryCoverage =69%, HitCoverage=50%, E-value=3e-14, Identity=36%"; Hit description =CG33108-PA [Drosophila melanogaster] gb|AAF56219.2| CG33108-PA [Drosophila melanogaster]
  Coding regions on vcDNA: vcDNA=SeqID_89617; Strand=+; Position=15-620
MFAGIDGQQNLLLSAQLQRLLCHHGETANAFVFCHQMQPELQKGPTCGFAVLLMALRCSVGDGTLDRLVEMGKHFGITYNGELFSADWMCEFVQKHWPNACELRVAQFPSPNSIVRHLISGKKAHHQCTTTVLVPYDCDKNFEPCNRQGVAAHWAIIIGFVIFDVTAQNGPENHAKVIAFDENDFRCDGFDNEHLLYLIALQ

SEQ ID NO: 163195 - protein, 160 aa, Heterodera glycines
  Coding regions on vcDNA: vcDNA=SeqID_89618; Strand=+; Position=65-547
MGNCKPADATESENASSVETVEVEVPPDPLVNPFWKMQKAFEKKLRNLLKREKKLLQLKEERDSDKPITTDQHEALSKLDEVKTLIGFVDEMMKLNQQQFSQYKKAIKNRERQLKMQKARSQIGTPQLSDELKKSTEVQTNGVAEEVQAAVGVVGPSSEV

SEQ ID NO: 163196 - protein, 339 aa, Heterodera glycines
  Coding regions on vcDNA: vcDNA=SeqID_89619; Strand=+; Position=53-1069
MTTEPNGAVDQQQQLLFASTACACRPNTMEWCKTTSFIAFASQRTICIVSDQLPYHRIIETVERAHGAGEITSLTLLRGGTVGNCKIRSLFCTAASSGELAIWKMFKTPTTTTIADGDRRHVMCIKRLSKKASIELSKMAAYAGDTDDVLLAILQFDHIDVQFLNLDGDDDQIGAAVSSLKFGSAIPSTFELSHICGAVVMAVGLSYGLIDIFVSETNSYSIQKKLSLDLCGSNKSWTRALAFNVSEDGQCHNLSLAAATDGLIKIWQFVGDGDKITVTPLANDDDEDQQLKMNQQTFCIQNGVAHPISVTLESVLHAQTGPIYALAWHPKRLELLSSG

SEQ ID NO: 163197 - protein, 162 aa, Heterodera glycines
  Coding regions on vcDNA: vcDNA=SeqID_89620; Strand=+; Position=17-505
RKQRFLFFSRFKMSLFLLRALPLFFLFSLCFAASPFNFRANHSLGAETTQQIVPTVATETTDGPKPTENVPLMLENDNVTEVAKVEGRNANDSEIETREDQAFANITAHSSDNASLTESCGFFCRNVPLFVGFILTLVCVSLLLILSILLYRYFTRRTYADE

SEQ ID NO: 163198 - protein, 198 aa, Heterodera glycines
  Homolog annotation: Hit_ID=CAE73664.1; Match level="QueryCoverage =98%, HitCoverage=36%, E-value=2e-63, Identity=67%"; Hit description =Hypothetical protein CBG21173 [Caenorhabditis briggsae]
  Gene Ontology: Mol. function=hydrogen-transporting ATP synthase activity, rotational mechanism; Cellular component=soluble fraction; Biological process=energy pathways
  Coding regions on vcDNA: vcDNA=SeqID_89621; Strand=+; Position=33-626
MASRTFSRFASNFRLFGSVMATNLSGRSHCFVAKKSLSTSPLVYATAAAASQPTTPKATVKGKKGRVVAVIGAVVDVQFDEGLPPILNALEVQNRASRLILEVAQHLGDNVVRTIAMDGTEGLIRGQEVVDTGDPIKIPVGPETLGRIINVIGEPIDERGPIGAKNYAPIHADAPEFVEMNVEQEILVTGIKVVDLLA

SEQ ID NO: 163199 - protein, 201 aa, Heterodera glycines
  Homolog annotation: Hit_ID=EAK94850.1; Match level="QueryCoverage =86%, HitCoverage=45%, E-value=4e-09, Identity=30%"; Hit description =hypothetical protein CaO19.2344 [Candida albicans SC5314]
  Coding regions on vcDNA: vcDNA=SeqID_89622; Strand=+; Position=42-644
MSKHQKSAVTPPTTTTTAAESGGERDGRTETTSGQRKRHSANQTDSANGAAGGQGSNNAVVLSSSESAAKEAKVRKMSTTSQNKGHKSNTMAEDSGGGTGTSAASSGNGAEQNDNSRATRRPAELQHLIDYFPDQQSTDGNRMTRSKARAMQDKSSNSASGSSGVQQQGSSGNGSGGNGPGGSSSAKSVGNGVAATPNTHH

SEQ ID NO: 163200 - protein, 207 aa, Heterodera glycines
  Homolog annotation: Hit_ID=AAH77124.1; Match level="QueryCoverage =95%, HitCoverage=99%, E-value=3e-76, Identity=69%"; Hit description =Zgc:100812 protein [Danio rerio]
  Gene Ontology: Mol. function=RAB small monomeric GTPase activity; Cellular component=Golgi apparatus; Biological process=signal transduction
  Coding regions on vcDNA: vcDNA=SeqID_89623; Strand=+; Position=59-682
MRHAAAPIRDYDHLFKLLIIGDSGVGKSSLLLRFSDNTFSTSYITTIGVDFKIRTITVMGKKIKLQIWDTAGQKRFRTITSTYYRGTHGVIVVFDVTSIESFNNVKRWLHEIDTNCENVQKILVGNKVDEPSRRAIPEAEARRFAESMRINYFETSAKENLNVEQMFQCITEIVLESCVDREKNNPRQATDVLKLRQRPEKKRKCCG

SEQ ID NO: 163201 - protein, 111 aa, Heterodera glycines; identical to SEQ ID NO: 138785
  Coding regions on vcDNA: vcDNA=SeqID_89624; Strand=+; Position=84-419

SEQ ID NO: 163202 - protein, 132 aa, Heterodera glycines
  misc_feature (74)..(74): Xaa can be any naturally occurring amino acid
  Coding regions on vcDNA: vcDNA=SeqID_89625; Strand=+; Position=61-459
LHHQIFPTCLASATPLAPPTTPTSLSLKATLGPASTLPGRSCATTAAATTRPPHPRQPANPASPRRTTAMSTRXLSMCATPTRTLPRNCTSSEPSCVNTTPTTWTRTRSKSTCCATTWTAWPLFPCTTRLAT

SEQ ID NO: 163203 - protein, 118 aa, Heterodera glycines
  Homolog annotation: Hit_ID=AAR30497.1; Match level="QueryCoverage =99%, HitCoverage=9%, E-value=2e-30, Identity=48%"; Hit description =RhoGEF [Caenorhabditis elegans]
  Gene Ontology: Mol. function=Rho guanyl-nucleotide exchange factor activity; Cellular component=plasma membrane; Biological process=Rho protein signal transduction
  Coding regions on vcDNA: vcDNA=SeqID_89626; Strand=+; Position=274-627
MDWGSDLEVDTEIPSLESLVSWEILKHLKPKEKKRQEVVNELYQTERTHVLRLKVLYKVFYRPMVLQRVASPHLVKLLFGNLDELLKVHAEMCQKMKRLRLQNGLYGELGSVMEELFC

SEQ ID NO: 163204 - protein, 329 aa, Heterodera glycines
  misc_feature (162)..(162): Xaa can be any naturally occurring amino acid
  Homolog annotation: Hit_ID=XP_415852.1; Match level="QueryCoverage =93%, HitCoverage=73%, E-value=5e-28, Identity=30%"; Hit description =PREDICTED: similar to Carbohydrate kinase-like protein [Gallus gallus]
  Gene Ontology: Biological process=carbohydrate metabolism
  Coding regions on vcDNA: vcDNA=SeqID_89627; Strand=+; Position=26-1013
MPLFLGIDLGTTSVKIALIDGDKKTFLEWDRKHNALIEREEKDKHEQSPKKILDTVQKLMGEMETDKLAQVKGIGISGQMHGVMLWEADSIGLGVDRCHCSPLITWMDSRCDEQFLRKLPNIPLDSVQKCVYFLTKCRVVGFRLRLHLDRPTDKLIDALPLXPFHFAFPHAHFPTHLLPSIVSPGTFIGRTSLPFAHLPKGVPVTVPLGDLQASLLPFLSAGVAALHIGTASQIAFVSQRLAEEMSPKVVLPNSIRRDPFFDDDFLLVAPSLNGGNVFTGLFQQIASWSADLFGFPSDFSPLSFSAAFSLLDRIFNSPNSQPNDGEVPP

SEQ ID NO: 163205 - protein, 206 aa, Heterodera glycines
  Homolog annotation: Hit_ID=S42136; Match level="QueryCoverage=60%, HitCoverage=8%, E-value=8e-10, Identity=32%"; Hit description=cnjB protein - Tetrahymena thermophila gb|AAC37171.1| cnjB [Tetrahymena thermophila] prf||1922371A cnjB gene
  Coding regions on vcDNA: vcDNA=SeqID_89628; Strand=+; Position=12-629
MTSNSTDGWGCNNSGWGQSQAKMTSNSAADGWGCNNSALRPNQAKMTSNSAADGWGCNNSALRPNQAKMTSNSAADGWGCNNSALRPNQAKMTSNSTDGWGCNNNGWAPSQAKMTNSTDGSGCNNSVRGPREFSRSFSGRPGFNRQPVPLMNKLPPIPPSTILFVDGIENKNKKLPLLSVEEITKIFWDIANISVLDVTRPKQHMR

SEQ ID NO: 163206 - protein, 145 aa, Heterodera glycines
  Coding regions on vcDNA: vcDNA=SeqID_89629; Strand=+; Position=1-438
KKTTSKTKPKVTIPSTLSSPSPYAKKIKKLPKQNKNTIDARGLYHTGKHNKKPSRAILELPGWQWDRVPIPKDPTEECGKIVFEIKVDANGEVVAVRTIEKTITPLVEKIYADELRSLTFSKTNHNNASYRNLSTGKVIFILVAK

SEQ ID NO: 163207 - protein, 297 aa, Heterodera glycines
  Coding regions on vcDNA: vcDNA=SeqID_89630; Strand=+; Position=3-893
KFENLMPTAGEIVHEERQQEKMKKTNFEEAKEEKGRKGTIKGGGRRSKRKRCQRNRTASCSSEKEKQTQQFDGIGGATPPRQKRHFPQAAVVDNGARRVTKVWHDEKQRVKMARVETAVEGGGGDSDGTMAGGRTLSSSSVISARHHQTQSRNALKPRAPNNTTSFLMSDLEKRQQHEEDDPQQHTDALGQVAGTQRGQKVLGSKEVGGATNGGHQLTTPMMAGESALLAEGGDGTDIEEQRDADFEECLFSTSIERIERLSREEVNRELLLADRDNRMLKQRVTLLRDSYQQVQEE

SEQ ID NO: 163208 - protein, 143 aa, Heterodera glycines
  Homolog annotation: Hit_ID=XP_311320.1; Match level="QueryCoverage =76%, HitCoverage=91%, E-value=1e-35, Identity=62%"; Hit description =ENSANGP00000017573 [Anopheles gambiae]
  Gene Ontology: Mol. function=metal ion binding
  Coding regions on vcDNA: vcDNA=SeqID_89631; Strand=+; Position=45-476
MGRPFLEHMGGRKYYSCRRCKTYLTNRRELISHTFRGATGQAYLFRNVVNIVMAKVESRFMITGQHMVRDVFCKICNGKLGWMYEFAHEPQQQYKEGRVILERELLTEHEETDPGLAERNRPLTRTSSSSSVSSSGISSVTIT

SEQ ID NO: 163209 - protein, 167 aa, Heterodera glycines
  Homolog annotation: Hit_ID=CAE60152.1; Match level="QueryCoverage =83%, HitCoverage=85%, E-value=2e-50, Identity=66%"; Hit description =Hypothetical protein CBG03702 [Caenorhabditis briggsae]
  Gene Ontology: Cellular component=nucleolus; Biological process =ribosomal large subunit biogenesis
  Coding regions on vcDNA: vcDNA=SeqID_89632; Strand=+; Position=12-515
MRLEKCWFCSSTIYPGHGIQFVRNDATVFKFCRSKCNKLFKKKKNPRKLKWTKASRRIRGKELVNDVTQAMEIRRNEPTKYDRNLWETAVEAVKEIHSIRHRRYGEHIKSTLKPGKQAVKRAMVEKARKKVHLIRAPVAMGEDDEKLEVVEDGEQKTEEGELQMEVN

SEQ ID NO: 163210 - protein, 146 aa, Heterodera glycines
  Homolog annotation: Hit_ID=CAE74779.1; Match level="QueryCoverage =96%, HitCoverage=23%, E-value=7e-39, Identity=51%"; Hit description =Hypothetical protein CBG22609 [Caenorhabditis briggsae]
  Gene Ontology: Mol. function=actin binding; Cellular component=actin filament; Biological process=cell organization and biogenesis
  Coding regions on vcDNA: vcDNA=SeqID_89633; Strand=+; Position=2-442
NDRRVHLYDLPANGGAFVEKKVLQHAGAITSVNFSPNGKYLVATDIARKVVPYRVDDGFKVASEKEWSFHTARINCCAWSSNSRYIATSSLDTNVMVWDLQQSGEHPLVIRGAHSMSAINGVAWLSDNRLLTVGQDSNVKQWTLKL

SEQ ID NO: 163211 - protein, 230 aa, Heterodera glycines
  Coding regions on vcDNA: vcDNA=SeqID_89634; Strand=+; Position=30-719
FWQTMLTLLLAICLSLGPILAYLSIALFSHRFLIVDRSRNRPICTSPGCVRCNRNANELASAMDRFQKARFAARAQFARVRSALERARCASVDDAHELFFRMKFEGVQRPVWTRSQLPPAFVAKMELFERQHAAIAKECERALDQCPYLWARNEERAPALHTDNGAAFSAWFVFPLINQGDWQEKQCRECPRITALLHQLATDDGVVGTTDGVSAVSDCSSASLLTDCLF

SEQ ID NO: 163212 - protein, 195 aa, Heterodera glycines
  Coding regions on vcDNA: vcDNA=SeqID_89635; Strand=+; Position=42-626
MFELADQSDGTSGIKQLWALIDPIWKFDRAELVDCMAKRVIYETDDLIALDKPFQMAFSSGPDDQPQLDRILQDLKKHIAPKIDRLFLVRSLDKNCSGVIVFAKSHVKQLEMKAQLQNDALLFRYRAICKGVPKMAKARISIPLIKVLRGSNLKFCPLVGEADERQQLYHLNTDVRMVNGNPKVQCALLDAFERR

SEQ ID NO: 163213 - protein, 208 aa, Heterodera glycines
  Homolog annotation: Hit_ID=P36335; Match level="QueryCoverage=86%, HitCoverage=17%, E-value=2e-09, Identity=29%"; Hit description =Neural cell adhesion molecule 2, 180 kDa isoform precursor (N-CAM 180) pir||JN0635 neural cell adhesion molecu
  Coding regions on vcDNA: vcDNA=SeqID_89636; Strand=+; Position=375-998
MVNGGSGKLHQIVVESEPKKASVVVDHSPQKEPEKKPDAPSDAAPTVVDSLPSPTSTPNKKDEVMAISAVAPPSSIVDVPKTDDTAPPPSLSQPVAATAAAAPPPTSEQQPNPAVVTTAAANNTNNSLAQRPKSVVAGSYAAIAAAARGNGPNNVDNIVTVHVPAATNGPTAPTPSKEIPQHNNNIAKHNPEHQIAVKQQQQTPPSLP

SEQ ID NO: 163214 - protein, 185 aa, Heterodera glycines
  Homolog annotation: Hit_ID=NP_506709.1; Match level="QueryCoverage =90%, HitCoverage=58%, E-value=2e-21, Identity=36%"; Hit description =ubiquitin-specific protease otubain (32.3 kD) (5P547C) [Caenorhabditis elegans] emb|CAB02772.1| Hypotheti
  Coding regions on vcDNA: vcDNA=SeqID_89637; Strand=+; Position=61-615
MDPSAVSSSSSTDQQQNAEEAQKGDLTLAQQIAEDKQKMFERSQQYQQEIEDEIRKTQPLVSSKQNIVHLVGEFDEKTSSQYFKKATELAGVYSDIRRIRGDGNCFYRAVLTAQLERCFEDAEELKRFNELVKGWRARLMAVGCFPELTTGDYCDSMEQLMTSLLNGTMLPQILLDDLNQDGIAN

SEQ ID NO: 163215 - protein, 274 aa, Heterodera glycines
  Homolog annotation: Hit_ID=CAE67645.1; Match level="QueryCoverage =99%, HitCoverage=77%, E-value=6e-50, Identity=42%"; Hit description =Hypothetical protein CBG13204 [Caenorhabditis briggsae]
  Gene Ontology: Cellular component=cytoplasm; Biological process =antimicrobial humoral response (sensu Invertebrata)
  Coding regions on vcDNA: vcDNA=SeqID_89638; Strand=+; Position=30-854
MSSKRVRFTEERNATERVKRSRTEAAEEEKRERLDDEEDGGPAETAEGMKTKRTKKHTLDSDEEDETEGYQRLDMDKVEGQEESTLEYEGHVKIMPFNMKDDLEEGHFDANGTFIFDKKQSVIKDAWLDNIEWDNVKNAAGKHWGKLDDEDDKKADDEKEVEPKEVYRRLVELLNEKETIGAALKRLNNEKKSNAAEERKRRWAAKKAGANVQEDEKTKQIAELTSLADSLISLGNMEAYQLDQTSINALLDDLQAKNKIPGAKEATLDMFSEG

SEQ ID NO: 163216 - protein, 321 aa, Heterodera glycines
  Homolog annotation: Hit_ID=NP_508505.1; Match level="QueryCoverage =100%, HitCoverage=59%, E-value=5e-84, Identity=45%"; Hit description= male sterility protein (61.2 kD) (XD555) [Caenorhabditis elegans] gb|AAC67415.1| Hypothetical protein Y7
  Coding regions on vcDNA: vcDNA=SeqID_89639; Strand=+; Position=2-964
AMAENQLSKSAKDLPVIIARPSIIGAIWQEPLPGWIDNLNGATGIFASVGKGLLTDMCGDVKSVADIIPVDIVANMLIVAAACRSQMGQCKEIPVFHCTSGQLNPLTWERIVVYCEQFFIAFPFDECYRIPSTQFHANHNLFLANFYAKHLSVAYALDGAYRLLGKKAKFVRIYSKIWRIMEVLHYFTSRGWVFESQNALKMWERLSEEDKKLYCFDVRKVDWDKYLFDYLMGIKIYLLRESLDDVPRAQANLLWQKQLNLYSNGLFFALLVRLFAWRRSKRQRWAFWLSGFLLSFAYQNANHWLRPAVRLRNLEEYKRTA

SEQ ID NO: 163217 - protein, 172 aa, Heterodera glycines
  Homolog annotation: Hit_ID=AAG21338.1; Match level="QueryCoverage =48%, HitCoverage=100%, E-value=7e-45, Identity=100%"; Hit description=hypothetical esophageal gland cell secretory protein 9 [Heterodera glycines]
  Coding regions on vcDNA: vcDNA=SeqID_89640; Strand=+; Position=63-581
MNCSSAAMLMLLMTIFTVLSNVNEVAAEEHELVSRIKRNGYGYSSGYGGGCSACQSSCTTCGYTSYHTVPAAPAPPPPPPPPPPPAPVYSQSSYSCSTWGGSSYSSYPSSYSSYPAFFLFLLLLPRFFLLLLVLVLLLLFLLLHVQLERVQEQLELRWAAPPNTWNSRRARP

SEQ ID NO: 163218 - protein, 131 aa, Heterodera glycines
  Coding regions on vcDNA: vcDNA=SeqID_89641; Strand=+; Position=150-545
RPPTNSSPPPTNSSPPPTNSSRQQTNNSRTQSTTSSKTSNNSKTYWPVSNRLFQRLPPGFLVNNSSIIMRQRTFSATSMRSAARIHTRHLLAPTFSVVSPKILVFSSSTCRSSRVPLLRRHRSKTLQVEVE

SEQ ID NO: 163219 - protein, 186 aa, Heterodera glycines
  Homolog annotation: Hit_ID=NP_495470.1; Match level="QueryCoverage =97%, HitCoverage=80%, E-value=1e-45, Identity=48%"; Hit description =ribosomal protein L10 (25.3 kD) (2H403) [Caenorhabditis elegans] gb|AAA82424.1| Hypothetical protein F10E
  Gene Ontology: Biological process=protein biosynthesis
  Coding regions on vcDNA: vcDNA=SeqID_89642; Strand=+; Position=3-563
VFSTDNLRSARLAEVRQHFKQNSRIFFAKNNLMAVALGKSAQDEQANELHKVSALLRGQSGLMFTNAKANEVQRFFAEHTEAEFAQAGAVASADISLPAGPMPAELHLHGAMEPQLRKLGMPTRLENGAIELLEEFTVCKTGDQLSADQARILKQFGHRLAKFRVRLLARWSKKKGFEQIDGGAEE

SEQ ID NO: 163220 - protein, 145 aa, Heterodera glycines
  Coding regions on vcDNA: vcDNA=SeqID_89643; Strand=+; Position=58-492
IRRYSMCHRSQAATDYGISSCCCSYCSTCNCCSITAVPLPTTAQPVVAAVTVTVSSHHRVLPYHRPSMIRMLLLALLMVYCCYCHTVQCSPSTVWNTVSGAEDNIDTVVAAANNGGGATFLVPQQQLLVPLVRQEVRTMPEVAAS

SEQ ID NO: 163221 - protein, 247 aa, Heterodera glycines
  Coding regions on vcDNA: vcDNA=SeqID_89644; Strand=+; Position=3-746
LTPVGPSVAPLAFSSSSTDASAVELPYAVPNFGTPTEKLLLGGELIAVPSALLADEKIFRSVLCPKSFWSLSQASRDHLEHFLPLPSISSAIKSSSVSVARRNCGAPLDELLSCAFTSDPNFCFGNPLAKFFARIRNGYFSSPEQVQLRDHRRVLYDHYIRHYQMNLLKTLLINSHVLLEQSTMLNSFDEHVRLNPRTFCSLRKLAKHKEVRARAQLRILTHDKRLSCPRGTGRSGRLFIGRLSPGG

SEQ ID NO: 163222 - protein, 212 aa, Heterodera glycines
  Homolog annotation: Hit_ID=NP_502196.1; Match level="QueryCoverage =77%, HitCoverage=17%, E-value=6e-40, Identity=48%"; Hit description =methionyl tRNA Synthetase (101.7 kD) (mrs-1) [Caenorhabditis elegans] emb|CAA97803.1| Hypothetical protei
  Gene Ontology: Mol. function=tRNA binding; Cellular component =methionyl glutamyl tRNA synthetase complex; Biological process =apoptosis
  Coding regions on vcDNA: vcDNA=SeqID_89645; Strand=+; Position=12-647
MFWSSNFALLSRRLANPSCSNFSTNLRFFNVGASLFGRKRADAIEESEKSVDFGRLDVRVGRVVAVRKHPNANSLYVAHVELGELQPRTVIAGLVKFVGLEELQNRLVVCLCNLRPSKKRGIDSHAMILCASTEQKVEPLELSDQSSPPGSLIICPNFARQPDKVLKKSVWEEIALDMLVSGTGECVFKGTPLRVDAEDGASSLVTAPTLRN

SEQ ID NO: 163223 - protein, 153 aa, Heterodera glycines
  Coding regions on vcDNA: vcDNA=SeqID_89646; Strand=+; Position=3-464
PIKPFNSKMGTNYSTSNSAPFDYGMTSRKKGKNRTYESNHFDKNYLIEGTEFWAENEYRKDSYLFERRKGSDRANFAEIYVKTPAEYGSPRVSCWAFSCSPCASSKESAVAIPSHSLPPSSAPWSSPIQPNGAKSAHGSRPVGVRSKYLPTFG

SEQ ID NO: 163224 - protein, 290 aa, Heterodera glycines
  Homolog annotation: Hit_ID=NP_740993.1; Match level="QueryCoverage =96%, HitCoverage=67%, E-value=1e-114, Identity=70%"; Hit description= DeHydrogenase, Short chain (dhs-6C) [Caenorhabditis elegans] gb|AAK68187.1| Dehydrogenases, short chain
  Gene Ontology: Cellular component=mitochondrion
  Coding regions on vcDNA: vcDNA=SeqID_89647; Strand=+; Position=95-964
MLNTGKFLGKTFVITGASRGIGKEIALKLAKDGANIVICAKTTQDNPKLPGTIYSAAEEIEKLGGKALPLQVDVRDEQQVEEAVEKAVKKFGAIDSLVNNASAISLTNTLDTPMKRYDLMHSVNVRGTFLMSQKCVPYLRQTSNPHILNLSPPLLMDKQWFAPHVAYTMSKYGMSMCVLGMHEEFRKDGIAVNALWPRTTIWTAATQMLTSGRGQRNSRKPEIIADAAYVILSKNSRDYTGNFAIDEEVLKEVGVKDFSQYANDPTAELFPDFFVPGVNYEKAIEAAFAA

SEQ ID NO: 163225 - protein, 180 aa, Heterodera glycines
  Homolog annotation: Hit_ID=AAM64597.1; Match level="QueryCoverage =100%, HitCoverage=33%, E-value=1e-102, Identity=100%"; Hit description=beta-amylase-like proten [Arabidopsis thaliana] gb|AAM98271.1| At5g18670/T1A4_50 [Arabidopsis thaliana]
  Coding regions on vcDNA: vcDNA=SeqID_89648; Strand=-; Position=1-635
KAITAGLKALKLLGVEGIELPIFWGVVEKEAAGKYEWSGYLAVAEIVKKVGLKLHASLSFHGSKQTEIGLPDWVAKIGDAEPGIYFTDRYGQQYKDCLSFAVDDVPVLDGKTPMEVYRGFCESFKSAFADYMGNTITGITLGLGPDGELKYPSHQHNAKLSGAGEFQCYDKHMLSALKGY

SEQ ID NO: 163226 - protein, 200 aa, Heterodera glycines
  Homolog annotation: Hit_ID=AAA59949.1; Match level="QueryCoverage =97%, HitCoverage=69%, E-value=2e-15, Identity=31%"; Hit description =DNA-binding protein
  Gene Ontology: Mol. function=transcription factor activity; Cellular component=nucleus; Biological process=transcription from Pol II promoter
  Coding regions on vcDNA: vcDNA=SeqID_89649; Strand=+; Position=47-646
MQAVTRPPIVLERGVSGRVKWFDFSKGYGFITRDDGGQDVFLHASSIVRKVNMYFVLIEGQRVEFDVIDGEKGREAAAVSGPGGIRVGTAIQYNNTARSQPLPVNANNSAGRMFIAGRFRRPVGKPNNKAKSAVASVPAVVNGGDDSAKCPPLSLSGVTRKGRRMFKANDGEKGKNSDKKESASDGVGKEKDNGGREGEN

SEQ ID NO: 163227 - protein, 166 aa, Heterodera glycines
  Homolog annotation: Hit_ID=AAS78778.1; Match level="QueryCoverage =82%, HitCoverage=89%, E-value=7e-25, Identity=44%"; Hit description =thioredoxin [Ascaris suum]
  Gene Ontology: Mol. function=thioredoxin reductase (NADPH) activity; Cellular component=nucleus
  Coding regions on vcDNA: vcDNA=SeqID_89650; Strand=+; Position=1-501
GIHPFCNIGVLRKTDDKSLMNGQLALKGCEIMALYFGAHMSQRCREFIPVLKQFYDQLKKSPETMPFEIVFVPFDRSEDEFRNSLRDLHDDWLYIPYGSVHINSLAARFNIINWGVIPTLVVLKEDGTLITMAGQANVQHLSASEAMVRWRSIPNPESGFKDFSKF

SEQ ID NO: 163228 - protein, 107 aa, Heterodera glycines
  misc_feature (62)..(62): Xaa can be any naturally occurring amino acid
  Homolog annotation: Hit_ID=CAE66666.1; Match level="QueryCoverage =87%, HitCoverage=9%, E-value=1e-19, Identity=55%"; Hit description =Hypothetical protein CBG12004 [Caenorhabditis briggsae]
  Gene Ontology: Biological process=positive regulation of growth rate
  Coding regions on vcDNA: vcDNA=SeqID_89651; Strand=+; Position=657-978
GEGDRLAVQHRQEKEFERTIRTYKSPYISFTYFHSQTLAEEAKRNAHTLVLHFVFAFFILFXLSRRCTTCPICRAHNCYIDWTLSKPFLAILGVVNAGMGIVTAIGY

SEQ ID NO: 163229 - protein, 211 aa, Heterodera glycines
  Coding regions on vcDNA: vcDNA=SeqID_89652; Strand=+; Position=12-647
MCPSKTQHLEQFHSLNIPMIFILSALFSLSATFAQFVPAKNRCYSCASDNMKENFLTRSRGPPGRVREPRLFDSMCDSDTWVIREKSAIECQGACFKWQQTLNNSGVLSYATIRGCYEWMFDSSVGGPTPSSDSSSSVAFNTECKHTQRALVCLDEFSSVEESTCWCFGDFCNAATAKGDGIRNAIRATASALFASSLFMSFWKLQQINCK

SEQ ID NO: 163230 - protein, 116 aa, Heterodera glycines
  Coding regions on vcDNA: vcDNA=SeqID_89653; Strand=+; Position=1-351
HSLASITSTPTQSTSQNGLPFLLLPDLPPIPRDSPSRRCRLRCHLIRDLLIHGQDLGRSRLAHPSKPRPHHLRRAPQAVGGGQEALSCSAVSSSRPQPDPLHTKSTHHPTFFRLPT

SEQ ID NO: 163231 - protein, 274 aa, Heterodera glycines
  Homolog annotation: Hit_ID=NP_503064.2; Match level="QueryCoverage =87%, HitCoverage=45%, E-value=7e-38, Identity=35%"; Hit description =alpha amylase, catalytic domain containing protein family member (69.3 kD) (4S215) [Caenorhabditis elegan
  Gene Ontology: Mol. function=cystine transporter activity; Cellular component=integral to plasma membrane; Biological process=basic amino acid transport
  Coding regions on vcDNA: vcDNA=SeqID_89654; Strand=+; Position=22-843
MATTDGMVEDGKVGNDLQSAKFTKDKEVVDIVQPTAKLIGLTKEQLEQYRNDPFWKAIRYSLFVAFWLIWLAMFVGAVLIVVLSPKCQQVNWTEKMVAYKIFTLAYKDSESKNGFGDFEVIEKKLDQMKGIGVNAIWPTPVLKYYKNALGPEAIEKLEVSDQLGGAEGFKKLIKRAHDNQIKVIVDLPLTVNAKGNWANKTSDTKNGIALIDLDNAANREGLKEAAVRFLDFGVDGLAITDYGLFANSVHLGSLVDLIRTIPKAEKIPIYARGS

SEQ ID NO: 163232 - protein, 63 aa, Heterodera glycines
  Coding regions on vcDNA: vcDNA=SeqID_89655; Strand=-; Position=2-190
YKIIWFFNHSEIIFQIAMRDRAFFCPCPTLPLTSSLSNCALAACCCLVLMKRKSRAKNLNIFK

SEQ ID NO: 163233 - protein, 194 aa, Heterodera glycines
  Homolog annotation: Hit_ID=CAE59899.1; Match level="QueryCoverage =94%, HitCoverage=30%, E-value=4e-39, Identity=48%"; Hit description =Hypothetical protein CBG03383 [Caenorhabditis briggsae]
  Gene Ontology: Cellular component=membrane
  Coding regions on vcDNA: vcDNA=SeqID_89656; Strand=+; Position=27-608
MAATSATGFPVCILTPCSNSHPFEERRILVTRTEEDAVKIGRSVVRLQPSSNNAIFDCKVLSRNHAVLWANGAGHFMIKDTRSSNGTFINNERLSASGEENEPRELFSGDILQLGVEIIDTAKKVASGCVTCIVRLLNERGEECAGRPKPDHGTFPTLLQQIPPNYTLVKNDQLFILDQYIKEAQHRENQLGLK

SEQ ID NO: 163234 - protein, 133 aa, Heterodera glycines
  Homolog annotation: Hit_ID=CAA33608.1; Match level="QueryCoverage =90%, HitCoverage=81%, E-value=1e-42, Identity=67%"; Hit description =ribosomal protein [Mucor racemosus] pir||R3UD24 ribosomal protein S24 - Rhizomucor racemosus sp|P14249|RS2
  Gene Ontology: Cellular component=eukaryotic 48S initiation complex; Biological process=protein biosynthesis
  Coding regions on vcDNA: vcDNA=SeqID_89657; Strand=+; Position=7-408
MAVDASSATIRTRKYLTNRLLQRKQMVVDVLHANIANVPKDTIRAKLAKMYKVEKDLVVAFGFRTAFGGGKSTGFALIYDSIDSLKKFEPKYRLVRLGLAEEAKTGRKQRKERKNRAKKARGKAKAIVLGHRK

SEQ ID NO: 163235 - protein, 187 aa, Heterodera glycines
  Homolog annotation: Hit_ID=CAE63854.1; Match level="QueryCoverage =89%, HitCoverage=98%, E-value=2e-55, Identity=58%"; Hit description =Hypothetical protein CBG08414 [Caenorhabditis briggsae]
  Gene Ontology: Mol. function=structural constituent of ribosome; Cellular component=mitochondrial small ribosomal subunit; Biological process=protein biosynthesis
  Coding regions on vcDNA: vcDNA=SeqID_89658; Strand=+; Position=67-630
MRGPFMRGTMPLRRTFYYLGQGKIHLREEVKVFAIAFHNFPNVAQEGAKEFVFWHWAQLQFKNPHVQFVKLADVCVTPFVQAFLGDGREVVFDLECRTREQISEALIGTLGMTETVRKRMKMDSYKRENPAEFGCDCERQCICEMQGQHPCTAILYAPKHLRGSWRWNHSTYNPEKPVPFPPVEGYD

SEQ ID NO: 163236 - protein, 201 aa, Heterodera glycines
  Coding regions on vcDNA: vcDNA=SeqID_89659; Strand=+; Position=66-668
MQSVQSSATAAVTAASTVPLSIQNEILWIKQDALQVRNAVILLEQEKDSLRKAIRKLKLENGRLKTKVKTLNEKVAKISNEEMDDEEGKLAPESELDYDELNRGDFYLIGGVHDPISLRFEAAIRDQNAVEHKSAERYYWYKMAEFFGDEEAMKSILHAQNVQQAEEAMKNIKGFDVAEWDKVKLKHWEDGQRLKLEQVRW

SEQ ID NO: 163237 - protein, 234 aa, Heterodera glycines
  Homolog annotation: Hit_ID=NP_497892.1; Match level="QueryCoverage =82%, HitCoverage=86%, E-value=1e-81, Identity=72%"; Hit description =peroxiredoxin, thioredoxin-dependent peroxide reductase, mitochondrial (24.9 kD) (3F499) [Caenorhabditis
  Gene Ontology: Mol. function=thioredoxin peroxidase activity; Cellular component=extracellular space; Biological process=response to oxidative stress
  Coding regions on vcDNA: vcDNA=SeqID_89660; Strand=+; Position=67-768
MLTNKLAKCAAMTMTRCQPLNALAMLGGARLCHHTPPNCMDAIRPLGPKSSVPSFKGQAIVNAEMKTISYDDYKGKWLIFFFYPLDFTFVCPTEIIAFSDRVAEFKQLGCEVIACSCDSQFSHLAWVNTPRNDGGLGKMEIPVLSDFSKKIAADFGVLDKETGLSYRGLFLIDPNGTVRHCLVNDLPVGRSVDEALRILKAFQFFEKHGEVCPADWEEGGETIDVKSPKEYFKK

SEQ ID NO: 163238 - protein, 216 aa, Heterodera glycines
  Coding regions on vcDNA: vcDNA=SeqID_89661; Strand=+; Position=3-650
SCRIRHEVEMQPSAESVPPIDPIWRIGLYERHVFRSNGRVGALCLECGEMFWENGTDEKKRMGRALKRHLLTTHRQYGLKLLEQMLEEEEREKAEGRAEGGQIAKDANSTVCGTVHSQFVEAFHQTIVATETMPTELIEEKSQLKRKDVPNPEDLSYQIDARDEELSKSLPAAQTDGTLTSTECDANTSITTPSISADLWAAAQQLSTSLHNNNKT

SEQ ID NO: 163239 - protein, 142 aa, Heterodera glycines
  Coding regions on vcDNA: vcDNA=SeqID_89662; Strand=+; Position=118-543
TLSARVVSSSVKCAKRWGKRRALSRGRELQKACGSLTTADSTKRQLVANGEWGGRRTNVALVQKQSFGMGSSRLGLKGFSGIPWHSVVPSSVHIFFPFFLPFHLHLFVHFLYIFHPFVLFSYILFIHSFICLQIVLIKSFFV

SEQ ID NO: 163240 - protein, 211 aa, Heterodera glycines
  misc_feature (157)..(157): Xaa can be any naturally occurring amino acid
  misc_feature (168)..(168): Xaa can be any naturally occurring amino acid
  Homolog annotation: Hit_ID=EAK85491.1; Match level="QueryCoverage =99%, HitCoverage=68%, E-value=4e-76, Identity=71%"; Hit description =hypothetical protein UM04634.1 [Ustilago maydis 521] ref|XP _402249.1| hypothetical protein UM04634.1 [Usti
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_89663; Strand=+; Position=19-648
MVFVKAVKNKAYFKRYQVKYRRRREGKTDYYARKRLVTQAKNKYNSPKYRLVVRITNADVICQIVYSKIQGDFVLTAAYAHELPRYGVKVGLTNWAAAYATGLLVARRALKKLSLDDKYEGFVNPDGTIAEVEPLEDGPRPFKAFLNVGLARTTTGXPRSFAAMKGAXSDGGIFRPHSEQRFPGYDRESKELDTGCGPRRTSSGGHVGEYM

SEQ ID NO: 163241 - protein, 196 aa, Heterodera glycines
  Homolog annotation: Hit_ID=P00443; Match level="QueryCoverage=64%, HitCoverage=82%, E-value=3e-45, Identity=64%"; Hit description =Superoxide dismutase [Cu-Zn] pir||DSHOCZ superoxide dismutase (EC 1.15.1.1) (Cu-Zn) 1 [validated] - horse gb|A
  Gene Ontology: Mol. function=copper, zinc superoxide dismutase activity; Cellular component=cytoplasm; Biological process =neurogenesis
  Coding regions on vcDNA: vcDNA=SeqID_89664; Strand=+; Position=3-590
SLLSVVLFPSFCLCSLLLFLLPSALFADGFSSSGQRVVLARVIIFKASEKQGTIASQPLGTVDISETVPGKTTLNGTIEGLSPGDHGFHFHQFGDISQACKAAGAHFNPHGKRHGSKESEERHVGDLGNVKAAENGVAVVDIKDYLVALNGVNSVVGRALVVHEKADDMGKGGNEESGKTGNAGKRIACGVVGVIP

SEQ ID NO: 163242 - protein, 193 aa, Heterodera glycines
  Coding regions on vcDNA: vcDNA=SeqID_89665; Strand=+; Position=151-729
MAANWTYRIKKEGRNPAARLYPKQTNKEQQQQGGGPSNGFHDITSIGGGGGGGSALFHSSNGTAAAGLSSSSGSSPTILQQQQHRQFSSAISQQKSLTPPPLSVGSSTFNPTLEQLLQATQNISYSLSPLNSNGGMNGSGGEQHDGTNFNSNGTNNTNSNGGGGSSPFSGTTASDMLAVGGHRSVGGNAKTLL

SEQ ID NO: 163243 - protein, 100 aa, Heterodera glycines
  Coding regions on vcDNA: vcDNA=SeqID_89666; Strand=-; Position=1-300
LSIIFPYFSNFLHIHSNSSTQNAVVPKASFLAHFLNPFGHILNRPFITTLPFSSVRLPTPTLQLLLDFFIAIETGSIKILMNKKKKIKANIDICSNKIIF

SEQ ID NO: 163244 - protein, 75 aa, Heterodera glycines
  misc_feature (29)..(29): Xaa can be any naturally occurring amino acid
  Coding regions on vcDNA: vcDNA=SeqID_89667; Strand=-; Position=274-594
SFFFYFFLIFLFFFNLLRKKKFFYYYFFXFFLSLHPFLLIFFFLKFFFRIIVFLMDSRMNVFFYFFFFLFFLIIY

SEQ ID NO: 163245 - protein, 216 aa, Heterodera glycines
  Homolog annotation: Hit_ID=NP_496330.1; Match level="QueryCoverage =87%, HitCoverage=51%, E-value=7e-42, Identity=47%"; Hit description =peroxisomal isomerase (42.1 kD) (2L111) [Caenorhabditis elegans] emb|CAA86779.1| Hypothetical protein R06
  Coding regions on vcDNA: vcDNA=SeqID_89668; Strand=+; Position=2-649
FNNLSSKFLKNGPFTKVALPFFSRFCFSTEAFEKAQKDMKQLKDEPDNDTKLELYALFKQANEGDVRGDRPKMLEFVARAKFDAWEKVKGMPKADAQHKYAEIVNSLLKNAGINNANTSETESDGIRRTKEGKVYKIELNRSDKYNAITWEMYEGLISALGDASADRETSVTVITGVGSYFWAGNDWANLTRGGKTSDDLRAMADRGERVLERYVR

SEQ ID NO: 163246 - protein, 212 aa, Heterodera glycines
  Homolog annotation: Hit_ID=CAE61308.1; Match level="QueryCoverage =95%, HitCoverage=46%, E-value=1e-63, Identity=53%"; Hit description =Hypothetical protein CBG05143 [Caenorhabditis briggsae]
  Gene Ontology: Mol. function=peroxidase activity; Cellular component =extracellular space; Biological process=embryogenesis and morphogenesis
  Coding regions on vcDNA: vcDNA=SeqID_89669; Strand=+; Position=1-636
IRQSTFNHQKALKNLTAIKEYVAHLEHFFDSPQMKEHLKTLESFPEAQLPRNFDARDKWPMCPSIHAVPNQGGCGSCYAVSAMGVAADRTCIHTNGTDGTQLSALDVIECCEVCGNCFGGDPLKAMVYWALEGVVSGGPDGCRPYAVSSACGTPCTPNLYAEEQTKRKCRKDKCQTAYYKNSAGGEYAADKRKGSFAYTLFPRKMSVDQAGN

SEQ ID NO: 163247 - protein, 208 aa, Heterodera glycines
  misc_feature (35)..(35): Xaa can be any naturally occurring amino acid
  Homolog annotation: Hit_ID=NP_493049.1; Match level="QueryCoverage =100%, HitCoverage=31%, E-value=1e-22, Identity=37%"; Hit description= heterogeneous nuclear RibonucleoProtein A1 (hrp-2) [Caenorhabditis elegans]
  Gene Ontology: Mol. function=RNA binding; Cellular component=nucleus; Biological process=RNA splicing
  Coding regions on vcDNA: vcDNA=SeqID_89670; Strand=+; Position=1-625
EKHGKVDKVKRIKDYAFVHFEERSATVQAMEALKXRQVDGAPMEVSLAKPQGDQNQKKKLAIKSRFNPQQYGAGVTPGIGPRGRKGYEYMGAFRGGRGGAGPSMHMGYHQPYPGYPPAGYGPPPYDPYYSGYRAYGGGGYDMYGGYPADPAAAYYGQHPAHASGSYGAGPGGPPGGPAAMRGGAAGYGAFGGTVQRGRGGKSAGAGQG

SEQ ID NO: 163248 - protein, 102 aa, Heterodera glycines
  Coding regions on vcDNA: vcDNA=SeqID_89671; Strand=-; Position=121-429
MAVRSSETTNEGSTILWSGMTAPKPLPSCLVGKASKGNGNFCCCCCCISANGFTLPGNGKSGERPSNSLYFPLTSNCCSPLKSTMTTSTFCRASVGPLAKKR

SEQ ID NO: 163249 - protein, 197 aa, Heterodera glycines
  Homolog annotation: Hit_ID=CAE63047.1; Match level="QueryCoverage =87%, HitCoverage=29%, E-value=2e-33, Identity=43%"; Hit description =Hypothetical protein CBG07318 [Caenorhabditis briggsae]
  Coding regions on vcDNA: vcDNA=SeqID_89672; Strand=+; Position=37-627
MVHKQNQLETTAVPIAVAHNDNGTADIFEQFEIMFNGDKSVFFGNETVTGSLKIKLKQETVLNAIHLHFIGVAKWIGTGRKEDKEGQTEKIYFDKNFVLLERPPGHPGPGHFKFVAHFAYSLPFECPLPSGCETSYESGSAHIRYFARAILETEQRDKFIAKKAFTIGSSPGLDQLVPPQPQPITCKETVRYGGCCC

SEQ ID NO: 163250 - protein, 214 aa, Heterodera glycines
  Coding regions on vcDNA: vcDNA=SeqID_89673; Strand=+; Position=10-651
GIFMSDHFWDENVFDLIVELEKEGRHVRLDWLSSNSALVDRFQTDIARLSEEEYSLYAASSSKLQRIAAAECAYKYNRTEELDKLFEKDRDSEALRETNVRHFLINRILDEFRPNIRRLSALPIERTIDAFCLNQPKDIEQHVLDVYDFLMDCPEAPAAAEAAAPSYQGGQESSGTAEQPQEAAAPEAPAAAEAAAPSYQGGQESSGTAEQPQE

SEQ ID NO: 163251 - protein, 293 aa, Heterodera glycines
  Homolog annotation: Hit_ID=CAE62813.1; Match level="QueryCoverage =97%, HitCoverage=33%, E-value=3e-91, Identity=57%"; Hit description =Hypothetical protein CBG06989 [Caenorhabditis briggsae]
  Coding regions on vcDNA: vcDNA=SeqID_89674; Strand=+; Position=52-930
MFPFNTPYNHLLNWSLVCFLIPWFYSYYNEQHRLSSMPVEQAMLKSWDTVISQPSIKFRKIMVGINCNVDVIVSGVSMVNKLNISSPNPIADKEVLNGFEDLYEAFVHFFTRGAPAERCMVNDAAFDRMVHTVEDKHLRAQHYIGGNAALMAQKIASSFPAATAYLVGPIGPRSHALLHPAIVRNNSTRIAEDELHLILEYKQGEILGEYVSPASSRFIVSHDQFSGSAMIIEMFFKAIMQFRPDLIILSGIHGLEAQNQDVRLEKLRLIKRSLMQVNPLIPIHLQLGSMADD

SEQ ID NO: 163252 - protein, 216 aa, Heterodera glycines
  Homolog annotation: Hit_ID=CAI11846.1; Match level="QueryCoverage =91%, HitCoverage=95%, E-value=5e-16, Identity=26%"; Hit description =novel protein (zgc:55718) [Danio rerio]
  Coding regions on vcDNA: vcDNA=SeqID_89675; Strand=+; Position=69-719
MSSHCKTLEEDEEWMANLHFVRSDIDPATVKPIDSRQLASLVNEFLLRSADILNRFCAQFENRMMELDFRLDTFERMLALMERKLENVNVDEVKKQSAEEKETAEKAEGMTRKEKGEETPEGTGEEKRTDKRQGKETAAEGTTKANEHPKLAKYFKMLKMGVPEAAVRQKMRSEGMDDALPNDPEKELPLESPQNKAQMVHDALAEDDESSSNSDE

SEQ ID NO: 163253 - protein, 86 aa, Heterodera glycines
  Coding regions on vcDNA: vcDNA=SeqID_89676; Strand=+; Position=46-306
MKPSFNFNLFASVFLVLCVASLVLCEHKRAAAAEACNPPKDVGTGNLALKRWWWDGHSCKQFIYKGQGGNTNNFPSKKHCVQVCKP

SEQ ID NO: 163254 - protein, 56 aa, Heterodera glycines
  Coding regions on vcDNA: vcDNA=SeqID_89677; Strand=-; Position=91-261
VANGILVGLCLTDVLAIGFSLVPSLFFFLLFIICHFLLPLTFVCLFLPHYFFFRLN

SEQ ID NO: 163255 - protein, 208 aa, Heterodera glycines
  Coding regions on vcDNA: vcDNA=SeqID_89678; Strand=+; Position=2-625
TQIKMFFLCPPIVLLPLTLFCVASHGLTNHSKAFGNESESNRTDFFGTEPMEIPRHKSADGFDPMVDDVFALLSAGEEGEEEGNGTKVGITVEEEEEEEEQQLLLRCADQLSPFVPLLLVPPHYHRWDFSCHFQGNQSEKPADLSPNNANENADLFLKMSKPCRSSQSFRDAITSEPNCHLFVGFVDHFHSFPTNTLVTKLNGKTMNG

SEQ ID NO: 163256 - protein, 194 aa, Heterodera glycines
  Homolog annotation: Hit_ID=CAA60012.1; Match level="QueryCoverage =96%, HitCoverage=82%, E-value=8e-78, Identity=80%"; Hit description =H+ ATP synthase; subunit beta [Drosophila virilis] sp|Q24751|ATPB _DROVI ATP synthase beta chain, mitochond
  Gene Ontology: Mol. function=hydrogen-transporting ATP synthase activity, rotational mechanism; Cellular component=soluble fraction; Biological process=energy pathways
  Coding regions on vcDNA: vcDNA=SeqID_89679; Strand=+; Position=43-624
MPLARTMASAAPAGAVAAGQIKSVIGTVVDVQFDGPLPPILNALEVQDHNIRLVLEVAQHLGENTVRTIAMDGTEGLVRGQKVLDTGAPIMIPVGRECLGRIMNVIGEPIDERGPINAKNKLPIHADPPEFVDMTTTPEILETGIKVIDLLAPYAKGGKIGLFGGAGVGKTVLIQELINNVAKAHGGFSVFTGV

SEQ ID NO: 163257 - protein, 205 aa, Heterodera glycines
  Homolog annotation: Hit_ID=AAR35032.1; Match level="QueryCoverage =77%, HitCoverage=83%, E-value=6e-35, Identity=50%"; Hit description =SXP/RAL-2 protein [Meloidogyne incognita]
  Coding regions on vcDNA: vcDNA=SeqID_89680; Strand=+; Position=3-617
AFSSFALSSLLPLFLLSLSSFVFCHFRPHFPPFLQKASVEQRRQYNRIVTSQNDTKAQINSNVQNWASNAGVASDYNNFTSEQQQRSQQFHDAVSGNLTGQALQLFNNLWSIRQNDQITRLAECQQIRAALNATGRDHVLHLLVPIPPPSIVGPPPSGCFPRPPYSKPFGGGFGPKSGGAAIPGRGGPQTPERRNNIGTEEGEEK

SEQ ID NO: 163258 - protein, 185 aa, Heterodera glycines
  Coding regions on vcDNA: vcDNA=SeqID_89681; Strand=+; Position=1-558
HNSTNLMELLSQQSAKSAAPVDGPQKLWHQINDENGTEACDRHNNGRRCCFCLDCRRRHCSFTISPIDGMEWLQQCHPSYGVDADLSAKRFLEEKKLNLSRRFQLIERGYVLKLKNDDGEGPGGGKAQRRRCSKCGCKGSLFDQLTVRLIAGSEIENEGKTTDEEEREGEQQKRSGGEEAENGAQ

SEQ ID NO: 163259 - protein, 162 aa, Heterodera glycines
  misc_feature (118)..(118): Xaa can be any naturally occurring amino acid
  Coding regions on vcDNA: vcDNA=SeqID_89682; Strand=+; Position=36-524
MSDCMTDDDAEEALRQFAEITNTDEAFAHFILQDVNFDLDRALARYYTADDPEASYKKFQTEGLDSAQNTGSEVDDEEGSGGTPNDKSKGKQPPHKRSRHEDESKESSKFPAELTLIXLECGRDGRTQFEQTILCGALHNCKNEPRSDFPARDDSTSDAPTQ

SEQ ID NO: 163260 - protein, 84 aa, Heterodera glycines
  misc_feature (60)..(61): Xaa can be any naturally occurring amino acid
  Coding regions on vcDNA: vcDNA=SeqID_89683; Strand=-; Position=9-263
ICASVINHWQTINQSLSSHLSSMAAASYFVKTSFISLRKWNASLSDIFPRNVSTISAQYXXEHGACPHGHLAHAGTLGQFQNIL

SEQ ID NO: 163261 - protein, 155 aa, Heterodera glycines
  Coding regions on vcDNA: vcDNA=SeqID_89684; Strand=+; Position=93-557
NLFETFMQAMAQFNAMFPNLNSSVVESVLRNCDGDVSRTIDELLRRSGQEEGNNSETDERRKSVSTPPRDQCANDEKIALLVQNREFLRYLRRDPNFQREMLGRSNSSDYRHRHHSSTHRRRNLPVLLTSSRTSQSPNSIRFFRTSADVMTNPAE

SEQ ID NO: 163262 - protein, 213 aa, Heterodera glycines
  Coding regions on vcDNA: vcDNA=SeqID_89685; Strand=+; Position=8-646
AFLTQITCRAKSQAHSMPAFWCHKCRSRCIALERYEDGVRCGRCHEGFIEEIDDIQEDHSQRSASDSPQQTPPPLVLQGHENPFGAFPGSPFARLFQLIHNNIFPTTTAAAGNDGRPTVLIHRRSASEGPSTATHQPQHRQAAATPPPVPMDQQPHTQRSHAQQQASDRPQPQQHEQINHNDLLTLFMDQFLGPIMNNAQMDNTGGRTQVIIQ

SEQ ID NO: 163263 - protein, 71 aa, Heterodera glycines
  Coding regions on vcDNA: vcDNA=SeqID_89686; Strand=-; Position=3-215
DCPVQSPTTNQQSTSTKLSTSPPPPPSPPSSASGRYPFGYLGQYAPLAALLNQFVQRSFHLFPARNLTEPQ

SEQ ID NO: 163264 - protein, 237 aa, Heterodera glycines
  Homolog annotation: Hit_ID=NP_496366.1; Match level="QueryCoverage =73%, HitCoverage=90%, E-value=2e-38, Identity=51%"; Hit description =C.Elegans Y-box (21.3 kD) (cey-1) [Caenorhabditis elegans] emb|CAB04257.1| Hypothetical protein F33A8.3 [
  Gene Ontology: Mol. function=transcription factor activity; Cellular component=nucleus; Biological process=transcription from Pol II promoter
  Coding regions on vcDNA: vcDNA=SeqID_89687; Strand=+; Position=38-751
MESSDANNNINNSEGEAENTTKNGGEEGVEKKILSKGVSGVVKWFNVMNGYGFICRDDTNDDIFVHNSAITANNPSKIQRSLGDGEKVMFDIVDGAKGPEAANVTGPDGVPVQGSKYAADLSQRRRFAGPRRNYFFRGNRNRRPRHSEEAAGGEVPVGEKKEGAENNGKEAKKEEVAKDANGGRGGGQRRGRGVRFRGRRNNRRNVAGSTSGGTENEGEQKKEQTQPEEETKVNGGE

SEQ ID NO: 163265 - protein, 166 aa, Heterodera glycines
  Coding regions on vcDNA: vcDNA=SeqID_89688; Strand=+; Position=188-688
MSEFTSSDGSGKSVSSKVSESESYDATTLGKLMNLDAKVVEWLEKEPYTDDDPLLVLDFLGPFNNLHGDYNQNKAFLVQKLVAAGGARIAANVDNVIKFATWDMFFEARRILQADMEVRHFFYNPNPAMALQNNINQFPIVSTTVVTFWSDDSQKLKTQPCQFFEF

SEQ ID NO: 163266 - protein, 213 aa, Heterodera glycines
  Homolog annotation: Hit_ID=CAE59942.1; Match level="QueryCoverage =92%, HitCoverage=96%, E-value=9e-31, Identity=43%"; Hit description =Hypothetical protein CBG03429 [Caenorhabditis briggsae]
  Coding regions on vcDNA: vcDNA=SeqID_89689; Strand=+; Position=66-704
MMPSSPSSAPLGANVLVTGANRGIGLGIVKEILKTDGIVHLLAGCRNPSQAEELKELSKCHKKLKLIKIDVSCDESIANAVAEVRKMLGSEEEKGLHTLINNAGILEKEGGTLLAPDRAAYLRHFNVNVVGTVATTAAFLPLLRKAAATNSEGQTEEQQAAPVVRVVNIGGALGCIGKVFLKPSECPYQNMAYGMSKAAVHHFNKMFSIDQPD

SEQ ID NO: 163267 - protein, 156 aa, Heterodera glycines
  Homolog annotation: Hit_ID=CAA92962.1; Match level="QueryCoverage =71%, HitCoverage=14%, E-value=5e-21, Identity=48%"; Hit description =Hypothetical protein F56H11.1c [Caenorhabditis elegans] emb|CAA92483.1| Hypothetical protein F56H11.1c [Ca
  Coding regions on vcDNA: vcDNA=SeqID_89690; Strand=+; Position=1-471
KQLNISLHRTSVTLFSMKGPNDANSSMQFELRLVSGRTEFPSVFLATRANFLLQKGENRNSAIISLRDPLDGPHEVHLELVLRLSVRGIFAGKYMANLTVFVSQQKAQPHHPPQLQQKNSAKRHRRRRRTHRNREERGASGHRNGIRTVTEKIGGW

SEQ ID NO: 163268 - protein, 142 aa, Heterodera glycines
  Homolog annotation: Hit_ID=NP_493578.1; Match level="QueryCoverage =97%, HitCoverage=99%, E-value=8e-56, Identity=73%"; Hit description =ubiquitin E2 conjugating enzyme Variant UEV-1, yeast MMS related, Ubiquitin E2 conjugating enzyme Variant
  Gene Ontology: Mol. function=transcriptional activator activity; Cellular component=nucleus; Biological process=regulation of transcription, DNA-dependent
  Coding regions on vcDNA: vcDNA=SeqID_89691; Strand=+; Position=89-517
MSSGVEVPRNFRLLEELEDGQKGKGDGTISWGLEDDDDMTLSRWTGMIIGPSRTPFEGRIYNLRIECGPNYPREAPIVRFTTKINMNGVNQQNGVVDKRVVPSLRQWNPSYHIKTVLEDIRRHLMTAKENSKLSQPAEGSSY

SEQ ID NO: 163269 - protein, 283 aa, Heterodera glycines
  Homolog annotation: Hit_ID=AAK82924.1; Match level="QueryCoverage =72%, HitCoverage=37%, E-value=2e-54, Identity=48%"; Hit description =Abnormal cell lineage protein 17, isoform b [Caenorhabditis elegans]
  Gene Ontology: Mol. function=frizzled receptor activity; Cellular component=integral to plasma membrane; Biological process=frizzled signaling pathway
  Coding regions on vcDNA: vcDNA=SeqID_89692; Strand=+; Position=1-849
PSWIFFRCFSAPPLLSPTFPNWAIRPRVSRPSLTGSRSAETHGKGKLRRRRLPKSDGAKLKRIISKLGYQRFSPQAPLCHPIDISLCRDIPYNRTILPNPFIDGLDPQSLQAQTEHFKPLIRTKCSPHILFFVCSVFVPMCPAQLPQAVTSCRSVCEEVRHDCIKIFHEFDFPWPAVLNCSRFPASPELCMRPEPTTPEQKPFHSLAPANRKARVPECPQDLVDLDPADPAAKCAFRCEKSTMFRKDLKEKARVWLMMCAFLNVCIGSFAVFSFCIHRRRFAF

SEQ ID NO: 163270 - protein, 156 aa, Heterodera glycines
  Coding regions on vcDNA: vcDNA=SeqID_89693; Strand=+; Position=9-479
VKPKLNLFMFFVNLAAILIFLQFYLDLTEAGIECQPNGVCRDVSGSTPASTVCSKKCYSCTYKNCCNKVYTSQYAKCSIKGWRKKGYIGNVPVEIGATKKRDVYCSKSNPCAKEGYKCVAYKKGDDRGFCWREKVEKAPPSSFALAIAIAGLVILL

SEQ ID NO: 163271 - protein, 278 aa, Heterodera glycines
  Homolog annotation: Hit_ID=NP_496416.1; Match level="QueryCoverage =62%, HitCoverage=29%, E-value=5e-10, Identity=28%"; Hit description =putative protein, with at least 5 transmembrane domains, of bilaterial origin (66.3 kD) (2L595) [Caenorha
  Coding regions on vcDNA: vcDNA=SeqID_89694; Strand=+; Position=29-865
MTLDDKLTFPPLEEQTARKRRERKHQKVISSGWKTNTLNSICFSTALLLCFAHFEHLQTDADYKFFEIQNISIRLQKDFLAGIVRNGHSISAVMFLLHIVATKLSETRFTFLGLLAVLSWPALFFVHYEQIHNRDYLISRLALSAFTLLISTALLFLPKKPKRKKRPNTFYSAFSVASTPLSQRSRFTRDSSVTDFVLDNSKRMMDFEDDDQSLSSKYSTKIVLQIESEIGRFWTSRIYCPSPLPKSLPRLPFVLFPFVLLPFLRILLAGVKKERKLR

SEQ ID NO: 163272 - protein, 95 aa, Heterodera glycines
  Homolog annotation: Hit_ID=NP_500197.1; Match level="QueryCoverage =98%, HitCoverage=97%, E-value=3e-23, Identity=61%"; Hit description =protein translocation complex beta (8.6 kD) (4D152) [Caenorhabditis elegans] gb|AAK68450.1| Hypothetical
  Coding regions on vcDNA: vcDNA=SeqID_89695; Strand=+; Position=44-331
MADSSKVPGGGKVVPRSAAGGGLRQRRAGGAANTGRTRTAGGGGGGGMNSGGLWRFYTEDSTGLKIGPVPVLVMSLVFIASVFVLHIWGKYSRTH

SEQ ID NO: 163273 - protein, 122 aa, Heterodera glycines
  Coding regions on vcDNA: vcDNA=SeqID_89696; Strand=+; Position=1-369
ICSNFNMNFPSRTRTQLVTDCIDYSNEIEGIIRAVPLIWQRFEEASKFFRVINKFVGYFPPLRDSFPTPGNETLDEILRCAGVGVRLLVEAESVSDYSLSNLRGALFAIYYSAVYYMPTTDD

SEQ ID NO: 163274 - protein, 234 aa, Heterodera glycines
  Coding regions on vcDNA: vcDNA=SeqID_89697; Strand=+; Position=37-738
MNKKFINALFHQQMFKNAVLLPFRHFAALTATQTHIDPVPLSFLRQSEDESEQKTTIMPKWKEEGLKIERNCSNRIFQTIAKDIVDECGLDNSAQDYALWVKAFGSNFSMFFALDQNRHPMGSVSIALYPQVAQWSMFFVKDRFRGHRLGSTLTRRSMELPGIRPVFCYGAADMWFKYAEDYGLNHLLDWRLWSMHANCADVRPERLDYDSSVELKEWREVSFDQLLSFDRLQT

SEQ ID NO: 163275 - protein, 443 aa, Heterodera glycines
  Homolog annotation: Hit_ID=EAL44122.1; Match level="QueryCoverage =61%, HitCoverage=49%, E-value=1e-13, Identity=22%"; Hit description =conserved hypothetical protein [Entamoeba histolytica HM-1:IMSS]
  Gene Ontology: Mol. function=microtubule binding; Cellular component =microtubule cytoskeleton; Biological process=nonselective vesicle transport
  Coding regions on vcDNA: vcDNA=SeqID_89698; Strand=+; Position=15-1346
MAGPDSRFILEFFNREAKELGVTQELLNNSQQSDQLIQAYYFLCDLIFENVGTTKENECEVATDLTRARPKMIIRTQQHSNLVFNKLFDGSNEFLYSDLLQPDPRRTKMHIAQLIRLYTTKCDIAKELSAVDNHIDEQMKAHDFEKNCERSTHAQLKDREEALNRMEKRNDEMGSKVRRLKDKLNDRQALAEDEKRNVERIDKILLGAQCENDECKELFAQEEENRKRLDNKILSSPERIIEELSNMEVEVEDIRRKNDQAVQNDRKLEREYGEQRVTSQCVESLINSMQQLEMMQEQMVEMRAKEEERRKQMDDLEMTRKNLVAEIEVLERQSTTDLESLGGEVNHRAKSLAMLNQQKAQLESDEKELAKQLKKKKDDIRQHQQEIKRKDRSFIILTDTYDDSVAKLFKNLSLVEQKVQVSRSNLLSLFDEKKSEIFGPFNQ

SEQ ID NO: 163276 - protein, 237 aa, Heterodera glycines
  Homolog annotation: Hit_ID=CAE56451.1; Match level="QueryCoverage =99%, HitCoverage=98%, E-value=4e-51, Identity=43%"; Hit description =Hypothetical protein CBG24156 [Caenorhabditis briggsae]
  Coding regions on vcDNA: vcDNA=SeqID_89699; Strand=+; Position=10-720
MASTITHVVFDLDGVLIDTERHYTTANERTLEKFGAKFTREMKLKMMGRKKTEAVTVLLKDAGIADRVTMDQYIAEYDKHVLQIMRALTEELPGATKLIDHLYAHNIPMAICTGSDNEEFASKMLKFDEWLKKIPLRVLCGSDPEVRIGKPNPDAYEVTIGRFAAKPTSPKNVLVFEDSINGVESALGAGCTVVMVPQREFLPNDWPEKELRSRPNFAALLDSLDNFCPKQFGLPDY

SEQ ID NO: 163277 - protein, 123 aa, Heterodera glycines
  Coding regions on vcDNA: vcDNA=SeqID_89700; Strand=+; Position=27-398
MHNFYFPLLSFVIFVYLAHFSDATKQKFLGGAHGNDVDNLDAPKQHILGGVGGEKQLKPDDAQPRRMRGAWPWIPPRNDTNGQEQRKFLGGAKVETVMIKPPEADDQKQQQTILGGVHGNDAN

SEQ ID NO: 163278 - protein, 84 aa, Heterodera glycines
  misc_feature (27)..(27): Xaa can be any naturally occurring amino acid
  Coding regions on vcDNA: vcDNA=SeqID_89701; Strand=+; Position=6-260
IFPGSRSRSRPFLGNLDLSWTWIFQRXVQEIKVQVKCEKKSRSRSRQNRKKPGFSWTKFLNLFFQVTDVCQVFKNNLYKFKNTL

SEQ ID NO: 163279 - protein, 213 aa, Heterodera glycines
  Coding regions on vcDNA: vcDNA=SeqID_89702; Strand=+; Position=1-639
IRTVKQKTRFAFPFFSSPIPMASAPSSDRFSSDHFFSDRSLRPQCLPNCASLSFGFVVDKLAQHCHCFSHLFECGQRIFEVSATELSPTNGFTSRVFRCEFEFGTFVGEKRMPTPKKRTMSAIAKVISLERMDTLWENFVGKKQMEKMRNSREQTEMIKSTLLQLHRNECNLYKFIGSSAPLPLPKVFYTQTAEEGEGVGLILMEDLSKSTHL

SEQ ID NO: 163280 - protein, 87 aa, Heterodera glycines
  Homolog annotation: Hit_ID=CAE75166.1; Match level="QueryCoverage =90%, HitCoverage=79%, E-value=1e-25, Identity=63%"; Hit description =Hypothetical protein CBG23103 [Caenorhabditis briggsae]
  Coding regions on vcDNA: vcDNA=SeqID_89703; Strand=+; Position=71-334
MSIVGGHSLRAEVIQLYKTLYHLGKDYPQGSRWFHERLKNAFARNANVQEEAKVRELIKRGEYVVKELEALYRLRKYRAMKNRYYND

SEQ ID NO: 163281 - protein, 156 aa, Heterodera glycines
  Coding regions on vcDNA: vcDNA=SeqID_89704; Strand=+; Position=1-471
QLSPRSGPNSARSPSSAHGVLHQYADQPQHQLDSARSLSIELASATHSLSNAVQMASTGSTKKMALHASECIEEMTRACDKLIGTRQLINNDPDISTDERRLLLEGVNRAISAFRQRLHSVLGNGDEGGAGMDDGQTSATAHVGKWDGEESGGLRV

SEQ ID NO: 163282 - protein, 373 aa, Heterodera glycines
  misc_feature (7)..(7): Xaa can be any naturally occurring amino acid
  Homolog annotation: Hit_ID=ZP_00195010.1; Match level="QueryCoverage =95%, HitCoverage=98%, E-value=1e-117, Identity=60%"; Hit description= COG2008: Threonine aldolase [Mesorhizobium sp. BNC1]
  Coding regions on vcDNA: vcDNA=SeqID_89705; Strand=+; Position=1-1121
FNLTSDXWSGAHPKISEALLRHCDGGATAYGASVLDRKIERTFNEVFERDVAVFFVGTGTAANALSMAYVNRAGGIIFAHRHAHLIEDECGAPEYFTGGARLVGVSGAEGRIEPEALEEAIQRYPPNPVSVHAGRPMAVSITQSTESGTLYSLAQIRRIANIAHSHGIPLHMDGARFANAMAALGCTAAEMSWKSGVDILSFGASKNGCWCAEAILVFNDLQQAHKDFPFLRKRAAHLFSKTRFIAAQFEAYFHDSLWLRNARHANKMASHLTSAIRSLDPSVIRLAWTPQANEVFVVMRRSVAETLRKSGEISHFYEWNVPDGERRELKLYTEEGLFRLVTTFATKEAEVDEFASLLKAHYLGKSEQMRSIA

SEQ ID NO: 163283 - protein, 241 aa, Heterodera glycines
  Homolog annotation: Hit_ID=AAB61596.1; Match level="QueryCoverage =98%, HitCoverage=99%, E-value=1e-94, Identity=70%"; Hit description =galectin [Globodera rostochiensis]
  Gene Ontology: Mol. function=protein binding; Cellular component =cytoplasm; Biological process=cell adhesion
  Coding regions on vcDNA: vcDNA=SeqID_89706; Strand=+; Position=66-791
MSAVHTVENPPMPFRWPIEYGMQTGAEVIMTGATYNGQQKQFVVNLNGRGDDVVLHVNPRFKFLEDTIVLNNRSYAGWQKEERHRNKFAVGDTFRLRIVCHHSHFVIIVNDKEIAQFEHRMSPDSVRSLEVNGDVVLHRVNLVNMAQPASAPAPTVQPMAPAPQFGQPMYPPPPSQPFGYAAPPPDVGFSPSIGGGHYPSMPPYPSASVPQPNAPADASQWHQPDYGTPKPNAPYPPYGHH

SEQ ID NO: 163284 - protein, 73 aa, Heterodera glycines
  Coding regions on vcDNA: vcDNA=SeqID_89707; Strand=-; Position=2-220
LIFETTRNARNVSAVPIFAVFRSHHQFFPICRMPSVRSALCVKRWNGARDERHYSGKARKQKAVFSLRRSSDG

SEQ ID NO: 163285 - protein, 160 aa, Heterodera glycines
  Coding regions on vcDNA: vcDNA=SeqID_89708; Strand=+; Position=56-538
MSLSSIHHMSRLKLWMTPVRDNHFGLDDLKIFNSDGYSENAPFSRESSRNSSADGSIACNADAADAVINMKIGVWKPLPQKTCGFCYIQYKRHCQRLGVAFPRVTDKGFWVGHTTKDEHGDVICPELRKLKCPLCYASGKKAHTLKFCPLNSIKGRRDEA

SEQ ID NO: 163286 - protein, 248 aa, Heterodera glycines
  Homolog annotation: Hit_ID=NP_082497.2; Match level="QueryCoverage =87%, HitCoverage=86%, E-value=4e-22, Identity=36%"; Hit description =RIKEN cDNA 2310065K24 [Mus musculus] gb|AAH25472.1| RIKEN cDNA 2310065K24 [Mus musculus] gb|AAH23158.1| R
  Coding regions on vcDNA: vcDNA=SeqID_89709; Strand=+; Position=1-747
PRAEFGTRNFVSEEELQKQREAGEEKPESSEPVDKRTLYERLKEQKDIKQLEYDETHALKNQFRGIDEAESDFLTQVERAKEEQEARKRKEEQELVRLSRQLTQQHATGATAEQQQHALLEKPQKASTAASSGISRQAALITSLVRRKRPLSTDSEPKSARGEVPSPPSSSDSDKRKTNEPSKASGGPPPKQRHESHCQIIGVLPGLPNYSDSSDEAESSNNSESLESGLPCVAIYAGKGAPKPHGEC

SEQ ID NO: 163287 - protein, 207 aa, Heterodera glycines
  Homolog annotation: Hit_ID=CAE65840.1; Match level="QueryCoverage =94%, HitCoverage=30%, E-value=1e-36, Identity=45%"; Hit description =Hypothetical protein CBG10971 [Caenorhabditis briggsae]
  Gene Ontology: Cellular component=integral to plasma membrane; Biological process=development
  Coding regions on vcDNA: vcDNA=SeqID_89710; Strand=+; Position=33-653
MSNQQNGDVAVPAAVAPNEQPNQNNQFQLWPFLKSILTRLVMFWLISSLIRNFFGPKQERDADQNTSLTGGGKTYPPSFNMFMANEHFDLFVYLSAKSERFHDFDNVESLFWHEHDLVYGDWTSGAIGDGSRQKAVTMMPTPEVLQRNGSLYLHVFLVKQGQSHHPRAKNYGGREIVYSSHQLNKFKKKYYQKTANLLTGKTGQSEL

SEQ ID NO: 163288 - protein, 188 aa, Heterodera glycines
  Homolog annotation: Hit_ID=T37314; Match level="QueryCoverage=81%, HitCoverage=23%, E-value=1e-14, Identity=31%"; Hit description =probable kexin (EC 3.4.21.61) - Caenorhabditis elegans  (fragment) gb|AAA98752.1| endoprotease
  Gene Ontology: Mol. function=proprotein convertase activity; Cellular component=integral to membrane; Biological process=embryonic development
  Coding regions on vcDNA: vcDNA=SeqID_89711; Strand=+; Position=2-568
YFESAQSVCLECDKSCATCHGPGPLQCDECAQGFANHTMGYCRQCCSPDQLTQKDLHCEDCSKSYPEFRTKSHLSMLSLLANFFTIIGLVLLGTVLFYLCRQLICCCFEIGRNGNRSDLEYTPLTTIGDDLDGRKKDQKQNMGFALEDDESESDSDNAESLMEGEKSSPEAEKEQKQQRKVPTEEAES

SEQ ID NO: 163289 - protein, 67 aa, Heterodera glycines
  Homolog annotation: Hit_ID=AAL78217.1; Match level="QueryCoverage =100%, HitCoverage=23%, E-value=7e-33, Identity=98%"; Hit description= probable protein kinase C subtrate Hgg-23 [Heterodera glycines]
  Coding regions on vcDNA: vcDNA=SeqID_89712; Strand=+; Position=3-206
GPGRKTATNSRLNAMNMAKRVGMDRRGPLWCSSSAVNSSNLWKPANRPSANITFWQNLRPLVLTRKS

SEQ ID NO: 163290 - protein, 286 aa, Heterodera glycines
  misc_feature (275)..(275): Xaa can be any naturally occurring amino acid
  Homolog annotation: Hit_ID=CAE68346.1; Match level="QueryCoverage =44%, HitCoverage=48%, E-value=4e-34, Identity=64%"; Hit description =Hypothetical protein CBG14076 [Caenorhabditis briggsae]
  Gene Ontology: Mol. function=protein binding; Cellular component =transcription factor complex; Biological process=histogenesis and organogenesis
  Coding regions on vcDNA: vcDNA=SeqID_89713; Strand=+; Position=89-944
MFLTPLGNVKNELVVCPTDFGGDFVFGMELEPSNSDFCASTAAFAPSISMNGPFPPMQTQMIRMPMPSLSASITEDQQMAYLLSSAGQSPSGSSQHSSLEGSPLQPNCHQTMLLSIGKYELNDRKMLTELSGEVKTDGAKKMAATDAAMTAPNSPGGRSSGTNQLGRTYSPGLPLSMVERQKIVQLFHEGWKICDISKYLCVTHSCVSKILQRFRATGSVRPKDAKEGRQESPLVAAIRDYRQRLGIMRQSEIREQLIRDGLCRRENAPSRSSIXNHILRTKLSGL

SEQ ID NO: 163291 - protein, 160 aa, Heterodera glycines
  Coding regions on vcDNA: vcDNA=SeqID_89714; Strand=-; Position=164-646
FFFFFFLTKKKTLLVSKQQMMDQFSLSNNTTFRSICPSIFAGISLFVVVLSFRLFLRTRFLLIRFFDFRRLVLCCCLTAINRHLTNQLMKHFRVLQQIAELDSATSRPFSIVTASSSLLHFHRSWSRCTHCARRRASVLLIVLSILSTLRRLVSCHGKTG

SEQ ID NO: 163292 - protein, 167 aa, Heterodera glycines
  Homolog annotation: Hit_ID=XP_319088.1; Match level="QueryCoverage =87%, HitCoverage=31%, E-value=2e-32, Identity=47%"; Hit description =ENSANGP00000006001 [Anopheles gambiae]
  Coding regions on vcDNA: vcDNA=SeqID_89715; Strand=+; Position=132-632
MSSQNGTDSSLLDDGQWLDGHFPLHHAVFDNDVPRLGQLLKEAAAAAAESSVIDREDTHGNTAVHIGCMLGHRECVKLLLEHGASVQSGNNLGWCSFHEAISYGDRKTIRMMLIALKKQSSGQLKSRLPLLGEHFSKLADFYMETKWEFSSWIPLLSRILPSDTFKI

SEQ ID NO: 163293 - protein, 210 aa, Heterodera glycines
  Coding regions on vcDNA: vcDNA=SeqID_89716; Strand=+; Position=1-633
ALKFVVLALAISAAAGKSSLSSANIQELQYRVEGCAADFPGRWAGSFNSSPQEQCVTNAKYNARNGSSPQNQIIKELPKCMLSAGAAESHITKLSKCLNKNILLPWTFVERDTGYTQLETFTHMFAIQDCLESSADVKNVDSLVGKTCAYQLYLQYGYGASEDAAKKWLEACLHTANVGKATDALKCYSSALTDPAVIQRAADYIAKMRG

SEQ ID NO: 163294 - protein, 209 aa, Heterodera glycines
  Coding regions on vcDNA: vcDNA=SeqID_89717; Strand=+; Position=2-628
MSLNHTLSSSSTILSAAAAGANETTERFRLALDDFVTVHPHLTCALIAVSVSLATHLALFVFARLFDFALAKFRPFVRRCRLRRGGGRSFRVHISDAPLLSSNGPFIHSQFTQHQQRASGKSQLLHKVPTIEADGGDDDGGIANAEKAKRTTTPVATSRQRHQQRGLRLSSSGSGGRIGTRRTTTTVDTTGAAAKAVPETAAGSKAAPN

SEQ ID NO: 163295 - protein, 225 aa, Heterodera glycines
  Homolog annotation: Hit_ID=NP_496800.1; Match level="QueryCoverage =90%, HitCoverage=58%, E-value=4e-55, Identity=52%"; Hit description =nuclear receptor-binding factor 1 like (38.2 kD) (2N476) [Caenorhabditis elegans] emb|CAB04958.1| Hypothe
  Gene Ontology: Mol. function=enoyl-[acyl-carrier protein] reductase activity; Cellular component=mitochondrion; Biological process =aerobic respiration
  Coding regions on vcDNA: vcDNA=SeqID_89718; Strand=+; Position=19-693
MVFAGVNCSTNIRWVHRWAWTSRRLCSSTKIIYEQNGNPAEVLKLSNEKIDQNAIGANEVFVRWMASPINPSDINQIQGVYPIKPPLPAVAGNEGCARVEKIGSNVRELKVGDIVLPTNAGLGTWRTHGIYQSTQLFPIDSSLQLDSIATAMLQVNPSTAYRMLHDYAKLVPGDIVVQNGGNSAVGRFIIQMCRNLGFKSISVVRDRPQINEMKDELKQLGATEV

SEQ ID NO: 163296 - protein, 218 aa, Heterodera glycines
  Homolog annotation: Hit_ID=CAE66990.1; Match level="QueryCoverage =94%, HitCoverage=97%, E-value=9e-37, Identity=35%"; Hit description =Hypothetical protein CBG12388 [Caenorhabditis briggsae]
  Coding regions on vcDNA: vcDNA=SeqID_89719; Strand=+; Position=10-666
MLSSSACCTLLAALISAAFFAMANAQTVKQCLCSEIQPCSEKYMNTWKTCMQQCKGHFSSVGGDVEKLGHCLDSNQALLQSTIRCTQSHGDESCAKSPAAVKQVPKRYPETLEIATISEINRMINGMGLEGAMKGLMDAGKKAFGCTRKCMNTKAGNCEKTLKCGLDFPPDNVAVQEVKKCALNSGLNTANAQALCKCASAAGVKNLTPAICAKVKVT

SEQ ID NO: 163297 - protein, 111 aa, Heterodera glycines
  Homolog annotation: Hit_ID=NP_075965.1; Match level="QueryCoverage =90%, HitCoverage=23%, E-value=2e-15, Identity=40%"; Hit description =lipocalin 7 [Mus musculus] dbj|BAB20596.1| ARG1 [Mus musculus]
  Gene Ontology: Cellular component=lysosome; Biological process =proteolysis and peptidolysis
  Coding regions on vcDNA: vcDNA=SeqID_89720; Strand=+; Position=3-338
KMMREIMTNGPIQVQVKWYVDAYLYGQNSTQVNVYMHTIVNQTDKGDYQEGSLKLIGWGEESTDKGELVKYWFGVNSFGTDWGLNGLFKWRRGTDECRIESKGISFGTPDV

SEQ ID NO: 163298 - protein, 227 aa, Heterodera glycines
  Homolog annotation: Hit_ID=AAH75367.1; Match level="QueryCoverage =68%, HitCoverage=33%, E-value=1e-12, Identity=31%"; Hit description =UBX domain containing 1 [Xenopus tropicalis] ref|NP_001005818.1| UBX domain containing 1 [Xenopus tropical
  Coding regions on vcDNA: vcDNA=SeqID_89721; Strand=+; Position=49-729
MDQTDHSAVGPSSSSPSLPVSSTVPRNALLFDPAAPAEVQQQQNAAEEEDDQFYELTAEDLRKMLKALQDESKRQNSLLPTKLMKERDQQLKHKAYKHSIVRFRLNNGQILQAQFLSTEPVSALFIFLRQIISPTIRFELHQIPTTSGKLKSDDSTTSLLDAGITPKSVLILKIVAADNSPESPEQMNADQIFVADSFQSCTQTEAKAEAQKWLSSNTEFRPYLDTI

SEQ ID NO: 163299 - protein, 57 aa, Heterodera glycines
  Homolog annotation: Hit_ID=CAE68482.1; Match level="QueryCoverage =96%, HitCoverage=93%, E-value=2e-13, Identity=58%"; Hit description =Hypothetical protein CBG14284 [Caenorhabditis briggsae]
  Coding regions on vcDNA: vcDNA=SeqID_89722; Strand=+; Position=91-264
MVEVQQLIELIFCILLPPVAILLHGGLDILHLILNIVLCILGYVPGIIHALWYCFFS

SEQ ID NO: 163300 - protein, 173 aa, Heterodera glycines
  Homolog annotation: Hit_ID=NP_501962.1; Match level="QueryCoverage =63%, HitCoverage=89%, E-value=9e-18, Identity=37%"; Hit description =transthyretin (4L369) [Caenorhabditis elegans] pir||T24096 hypothetical protein R09H10.3 - Caenorhabditis
  Coding regions on vcDNA: vcDNA=SeqID_89723; Strand=+; Position=30-551
MMERRNRTKNGGLSPTPQETTINLPVSSNRRASSASILFAQASFDTGLDVSRASQLSSQRNVLSTHVMDLGSGRPCSGIQCKAFKWDKSHSEWIQIGDTVTNAQGRIPLVHPGTSLSKGLYKLRFATKEYYARHQLKSLFPQVDVVIEVDDASEHCHVPVLLNHFGYSVYKGH

SEQ ID NO: 163301 - protein, 214 aa, Heterodera glycines
  misc_feature (83)..(83): Xaa can be any naturally occurring amino acid
  Homolog annotation: Hit_ID=EAL18380.1; Match level="QueryCoverage =72%, HitCoverage=16%, E-value=3e-22, Identity=35%"; Hit description =hypothetical protein CNBJ3030 [Cryptococcus neoformans var. neoformans B-3501A]
  Gene Ontology: Mol. function=translation initiation factor activity; Cellular component=eukaryotic 48S initiation complex; Biological process=establishment and/or maintenance of chromatin architecture
  Coding regions on vcDNA: vcDNA=SeqID_89724; Strand=+; Position=3-648
PEYIFIFRDGLSEGQFAMACKEELRALKQGCVEYDSRYQPKFVMIVGTKRHFKKFFLEEEGRKGRPFNQNLTPGSIIQDKVTXADITEFFLQPHAPIHGTGKPVEYTMLEDEIGISMDELQGVIMALSYSHQIVNVEVSMPDPVYQAHELAKRGKNNFVTLKRFKPERVPKIDKQIVAKGGKRQIISIVDYKAVTRLLSYWGDGTFKLSHRFTA

SEQ ID NO: 163302 - protein, 289 aa, Heterodera glycines
  Homolog annotation: Hit_ID=AAP05997.1; Match level="QueryCoverage =93%, HitCoverage=98%, E-value=4e-93, Identity=50%"; Hit description =galectin [Haemonchus contortus] gb|AAF63406.1| galectin [Haemonchus contortus]
  Gene Ontology: Mol. function=protein binding; Cellular component =cytoplasm; Biological process=cell adhesion
  Coding regions on vcDNA: vcDNA=SeqID_89725; Strand=+; Position=2-871
IIDESPVAIGNGGTETQLSTPFRGVLDVRFEPGQTLTVKGIVREKARQFSVNLHSRTADFSGSDVPLRVAARVDRAKIGLNSMVNKMWGKEQRKGHSLKPGKPIDLRIRAHDKEFQIIIDGKAFKRYAYQSPLQSITHLSIDGDLAIQHIHWGGKVYPVPYETGLPHGFPIGKCLKMSGTPSLRKGGRFEVNLLRKNGHIALHLNARFDEKAVVRNSLEANEWGNEEREGKMPFERGHCFDLAITNEANHFGIFVNGQHFANFVHRSKPEDIFGLLIQGDIELTGLEME

SEQ ID NO: 163303 - protein, 135 aa, Heterodera glycines
  Homolog annotation: Hit_ID=CAE70802.1; Match level="QueryCoverage =91%, HitCoverage=95%, E-value=4e-18, Identity=38%"; Hit description =Hypothetical protein CBG17563 [Caenorhabditis briggsae]
  Coding regions on vcDNA: vcDNA=SeqID_89726; Strand=+; Position=28-533
MGNIVYSDKLSCYESADYCARSCSASSQCVYPDNCGDSANAHYACLPFDTRLLTWILVVSFLVIVLCCSALVVFYALRVIRRSFRNPVQTDGDIVFYNARNVHNFPHPAAMKQPTVEDDGRQEYYYNNSRRNDYY

SEQ ID NO: 163304 - protein, 156 aa, Heterodera glycines
  Homolog annotation: Hit_ID=CAE59600.1; Match level="QueryCoverage =94%, HitCoverage=69%, E-value=3e-40, Identity=57%"; Hit description =Hypothetical protein CBG03007 [Caenorhabditis briggsae]
  Coding regions on vcDNA: vcDNA=SeqID_89727; Strand=+; Position=140-607
MSNGTIFIDRDGELFAYVLDYLRTGKLLLPENFRELARLREEVQFYQIDQLMQQLIPFYNLKFPPKTPTGQNNGSVALTAAVAAAVAKTNALYETGGFITLGYRGTFAFGRDRQADVKFRKLHRILVCGKAQLCREVFGDTLNESTDPDREGAERY

SEQ ID NO: 163305 - protein, 211 aa, Heterodera glycines
  misc_feature (41)..(41): Xaa can be any naturally occurring amino acid
  misc_feature (84)..(84): Xaa can be any naturally occurring amino acid
  misc_feature (87)..(87): Xaa can be any naturally occurring amino acid
  Coding regions on vcDNA: vcDNA=SeqID_89728; Strand=+; Position=33-665
TAKRFPIFKWRINHNFHKDFSRLFWMKKCRPTFSRFCKCLXDSYHWLIVGDGRLSATGAANAGSSQRQFVLVQRLRHSTDGDAXGSXDDGLSTHNGIIQVTSWKRVDGGKLCFFQVLDYTLYSLDFPVIGNPQPHSGNPAEFRRVVQPQKDPDTQQTAAESVALWRGTQVKDEPENAWGGGGSAKRGRGSSPSDQRQPLRKRQPDAGAQMA

SEQ ID NO: 163306 - protein, 85 aa, Heterodera glycines
  Coding regions on vcDNA: vcDNA=SeqID_89729; Strand=+; Position=45-302
LLKMCPHLPKRAVVQGLLATLKRVKLVHFPFATHNPSSISKSHCAFTTANRNLLRRNWLPLRPFRPMQTKQQPNRGQQNTHKLLF

SEQ ID NO: 163307 - protein, 129 aa, Heterodera glycines
  Homolog annotation: Hit_ID=NP_497804.2; Match level="QueryCoverage =82%, HitCoverage=20%, E-value=1e-18, Identity=45%"; Hit description =tumor endothelial marker like (56.8 kD) (3F99) [Caenorhabditis elegans] emb|CAA84646.2| Hypothetical prot
  Coding regions on vcDNA: vcDNA=SeqID_89730; Strand=+; Position=3-392
SASSPTTGSSAAGTSHLGAAVAPPKAAVASDSGALPTGTPTTTETPPSTTASSTTTKATANEKRIAEEGSGGGLAFVTMFMLLGISVSVWLLYAYFNPHTRSGQLLIKYRPSKWQIPSSHVRYSASVHM

SEQ ID NO: 163308 - protein, 165 aa, Heterodera glycines
  Coding regions on vcDNA: vcDNA=SeqID_89731; Strand=+; Position=192-686
MEAPAEIDEIYRPHEARIHEAFFNTLSKPIHSKNERRNRAEGIFTTSESQQDRERIHVTWRHFGQKTKFFLDRNEHDLFEALHRKIRSELPNFRGNLAFRDDNSREVILKCDRQIREAAARRDNRLHIFTTLSESPSLFLAASEIGTLSASRPSSRAPLGSPISA

SEQ ID NO: 163309 - protein, 97 aa, Heterodera glycines
  Homolog annotation: Hit_ID=NP_996661.1; Match level="QueryCoverage =89%, HitCoverage=42%, E-value=9e-30, Identity=72%"; Hit description =Unknown (protein for MGC:77145) [Danio rerio] gb|AAH65318.1| Unknown (protein for MGC:77145) [Danio rerio
  Gene Ontology: Mol. function=ATP binding; Cellular component=Golgi apparatus; Biological process=negative regulation of FGF receptor signaling pathway
  Coding regions on vcDNA: vcDNA=SeqID_89732; Strand=+; Position=2-295
GQGVILVYDVSNRPSFENLDHLLLEVDTYCTKSDTVKMLVGNKIDAERRMVSREEGLQFAKKHRMLFIEASAKTREGVQCAFEELVEKQFRHGQSVL

SEQ ID NO: 163310 - protein, 155 aa, Heterodera glycines
  Coding regions on vcDNA: vcDNA=SeqID_89733; Strand=+; Position=27-494
MFSQLFLFLIFLAFSAESAPRGEKKKDTPKDRYSLCRKGGVPIAKLNDQINGKDFDKLFAPLFPHPLLISNLLSLEGLKCPDKIAPFMKKCDAKKDGEINLREFKCFVKSLLASYLVDEDRNKCITEEELESFYKECGLKEMEEEMMGDGSVRKE

SEQ ID NO: 163311 - protein, 198 aa, Heterodera glycines
  Homolog annotation: Hit_ID=EAL23807.1; Match level="QueryCoverage =93%, HitCoverage=68%, E-value=6e-18, Identity=28%"; Hit description =HUS1 checkpoint homolog (S. pombe) [Homo sapiens] gb|AAV38289.1| HUS1 checkpoint homolog (S. pombe) [Homo
  Gene Ontology: Biological process=DNA damage response, signal transduction resulting in cell cycle arrest
  Coding regions on vcDNA: vcDNA=SeqID_89734; Strand=+; Position=30-623
MRFVAVIGDGKAVDIFVKVAAVVSKLCRKRAVVRITPNEFSFVNVYNVREGMHVDFRIHKDNLFNSWSFDGLSLDNNAIFFELSTDDFVRSLHSRATQIKLKMTKKDGVPHLRVELSANSLVNEIPIVLVVLRQWPDFNPPNMGISQLAVALPNVKTLTKIVSGVKDIGGRHLIFRANNRGEFNIIGYADQAKVAVYA

SEQ ID NO: 163312 - protein, 130 aa, Heterodera glycines
  Coding regions on vcDNA: vcDNA=SeqID_89735; Strand=-; Position=35-427
VLSIYSKWIIIIAIFRLFSYFSSNSITLYFSFSCGPSTETVVVFSWTHSFTSSNFCLIVGSTDSISHARASDSSNACFAFSYPCCIDLSPSLNLSLIPSSKSSNIPPAFERSTAQRKKRQNAKMTKGRNI

SEQ ID NO: 163313 - protein, 68 aa, Heterodera glycines
  Homolog annotation: Hit_ID=NP_496970.1; Match level="QueryCoverage =80%, HitCoverage=55%, E-value=1e-09, Identity=52%"; Hit description =high Mobility Group protein (10.6 kD) (hmg-1.1) [Caenorhabditis elegans] emb|CAB54448.2| Hypothetical pro
  Coding regions on vcDNA: vcDNA=SeqID_89736; Strand=+; Position=50-256
MPAQSPFFLWMNENRERFYEPGMTQADVAKAAGEEWRRLPESEKAKWGQRSAEERGRQGGQDVEEEEQ

SEQ ID NO: 163314 - protein, 95 aa, Heterodera glycines
  Coding regions on vcDNA: vcDNA=SeqID_89737; Strand=+; Position=130-417
ALNPSTAKAKKRKTHSLGKKRTERRNRKRRTSRSRTAGRTSTKNAWTNLTTTKSAAKCRAEATNVCWRTQRRKRAKRRRRNRNIRTKRSKSVWRS

SEQ ID NO: 163315 - protein, 200 aa, Heterodera glycines
  Homolog annotation: Hit_ID=CAE60549.1; Match level="QueryCoverage =79%, HitCoverage=33%, E-value=1e-09, Identity=32%"; Hit description =Hypothetical protein CBG04176 [Caenorhabditis briggsae]
  Coding regions on vcDNA: vcDNA=SeqID_89738; Strand=+; Position=8-610
MDSPKCQTLNFARPFFPNNFVLLEVEKSVADAFSSSNMITDQFNHESLSLTIRGHCSDPLVVCTSSRTFGAKDVEVSNTLLLLDGTPNGAGANQQHIVSITNRFVELSEAFLPDQTFRLKALLEQNLLDFYNENAPAAEESKGIKLNELLDHVQISEQQLREELAKFAVVEPAEGVATFTRLILNLEIYLLCICSLIIVR

SEQ ID NO: 163316 - protein, 222 aa, Heterodera glycines
  Homolog annotation: Hit_ID=CAE56190.1; Match level="QueryCoverage =92%, HitCoverage=57%, E-value=4e-42, Identity=45%"; Hit description =Hypothetical protein CBG23813 [Caenorhabditis briggsae]
  Coding regions on vcDNA: vcDNA=SeqID_89739; Strand=+; Position=42-707
MATPPKANALIEAAGKFNKLFIMPPNRPTRIKKAMNILFGRTEEEKRVTGNFVSRIAERNPRREDMSTTQDWPSVWPTAQSFRSSVVPLPVRMGFRRRPERFAPKGPYGNLELMKIPNFLHLTPAHVQRHGQAIKKFCTKFPEELKQADVKEQYTPLRLVYSDYVHQGNNIRDKRAREVTAKIQLNSFGLKDTHAHNKCRQLVGDRYDEETDTVTFKADNCP

SEQ ID NO: 163317 - protein, 264 aa, Heterodera glycines
  Coding regions on vcDNA: vcDNA=SeqID_89740; Strand=+; Position=3-797
VGCASFGAGNKYRDCDFPRLIYPSVGSVFTDSYCWYVNVTCEEANYGLPAYIEFNENPSTIVAAPEPTLGRRITVTLQCVGNSYGQRVWTKFGVDGDPSAVVQVKTVRCGTKCATNVSTTPATLTSPNSEGLPYCRDSCAARIGHGTRGQDCDQTLLNNALIVYPSYPYILYGCWYVSVTCEAKANGNPIYIKLNDEEKTIVTSTQPPFNKITVNLQCAWNSYGQRVWSKTGVDGYPNRVIQVEKVSCGRNCGTTETSTIPTTE

SEQ ID NO: 163318 - protein, 183 aa, Heterodera glycines
  Homolog annotation: Hit_ID=NP_495786.1; Match level="QueryCoverage =97%, HitCoverage=89%, E-value=3e-64, Identity=69%"; Hit description =TU37B2 (21.3 kD) (2I757) [Caenorhabditis elegans] emb|CAA90361.1| Hypothetical protein F22B5.10 [Caenorha
  Coding regions on vcDNA: vcDNA=SeqID_89741; Strand=+; Position=2-550
YSDALLIIFIAFFTALLGEGLTWVLVYRSDEYKRLKFSMERKSKKLERKKDAIGAGGDAAGGAGAANAASKTTKRKIEREEERLKSTNRDLSMFRMKSMLAIGFVFAALLSTFSSIFEGRVVAKLPFEPITWVQGLSHRNLVGDDFTDCSFIFLYILCTMSLRQNLQKLLGFAPSRSFNRQTQ

SEQ ID NO: 163319 - protein, 80 aa, Heterodera glycines
  Coding regions on vcDNA: vcDNA=SeqID_89742; Strand=-; Position=397-639
MTTIIFNKGTVLAFFGFIFGFINFHVKVLNQIIHLSIQKFTMPLFDQFPPSVIENNFIGWNLNIQLSETLEKLLMVQVYI

SEQ ID NO: 163320 - protein, 209 aa, Heterodera glycines
  Homolog annotation: Hit_ID=NP_496492.1; Match level="QueryCoverage =99%, HitCoverage=25%, E-value=3e-38, Identity=47%"; Hit description =Dyggve-Melchior-Clausen syndrome protein like, possibly N -myristoylated (78.2 kD) (2L967) [Caenorhabditis
  Coding regions on vcDNA: vcDNA=SeqID_89743; Strand=+; Position=3-629
FPPQSLSTLSLALLLSLVYYPSFEGRTNAYKQMLSIFQNAQEVSSLANLEASFKLDFTHLYNRLCATLHSERMPLLLLYLLLHNNVGFRNFVLSRINLEQLVLPVVRVLYDGMCSVPGHGFQRPSPTSSPKMRRQSQFSHNNSTVHTHQTYLALIVLLILSEDDFFKKVIHEMTIKNIDWYTLDRTTHLAETTLGGLIVLVFSKTIQIN

SEQ ID NO: 163321 - protein, 210 aa, Heterodera glycines
  Homolog annotation: Hit_ID=AAK94489.1; Match level="QueryCoverage =100%, HitCoverage=99%, E-value=1e-108, Identity=93%"; Hit description=putative S-adenosylmethionine synthetase [Heterodera glycines]
  Gene Ontology: Mol. function=methionine adenosyltransferase activity; Cellular component=cytoplasm; Biological process=amino acid metabolism
  Coding regions on vcDNA: vcDNA=SeqID_89744; Strand=+; Position=27-656
MDAVKAPTLASIHHKNRLQSPLNAHGHPLIIENGTVAETLVDKEEEELTEQVGTFLFTSESVGEGHPDKMCDQISDAILDAHLALDPTTKVACEVVTKTGMVLVCGEITSSATVDYQSVVRETIKKIGYDDSSKGFDYKTCNVLVALEKQSPEIAARVHEDNEPEDVGAGDQGIMFGYASDESPEAMPLTLVLSHKLNPKYHQLRKAAAL

SEQ ID NO: 163322 - protein, 148 aa, Heterodera glycines
  Coding regions on vcDNA: vcDNA=SeqID_89745; Strand=-; Position=190-636
MVQFDQSFQVSLRLWASSEFGSQGSHKTRQPFALPYAVTHFHALAVPKTTGVQCSKNGTDEQKLIAINSLQKVLAATAVGKCEHQMFQRRETLASKFEDYLARVILNNCYAKFGHNAINTHRKQQFGSIGILNKEVSVMFKEFGGFTQ

SEQ ID NO: 163323 - protein, 140 aa, Heterodera glycines
  Coding regions on vcDNA: vcDNA=SeqID_89746; Strand=+; Position=3-425
VIKMLFYPISVSLILFTFFAGSAEAQNDAGVLGPVEETAGQIGRNLSCSAIHAAVRAIITAHPDWHQWFYEARQNQSDHIETCANTESGDVHDYLSEQVDMLRCPESRSRLMTVSIVFIIAFLITLAVAITLGILLYRKK

SEQ ID NO: 163324 - protein, 100 aa, Heterodera glycines
  Coding regions on vcDNA: vcDNA=SeqID_89747; Strand=+; Position=73-375
QRFGESCSDIGCLLSGASNPWPEMQCCLFVVYEHAEQQKKLHVQRQFDGLVTIARQQEVDEQTAGTFSAVTSIGRPPTFTSTSRYTPAASAPSGSRTQMW

SEQ ID NO: 163325 - protein, 145 aa, Heterodera glycines
  Coding regions on vcDNA: vcDNA=SeqID_89748; Strand=+; Position=2-439
LSYHSNMISNYLKSQLELVEEHSTRLNERTQNWRQRKQTLSAREKEIVSADMSIVVPSDIKPRLRGSKFAHATEEERKAIAAQMEQGRDANRTATTEAKRNAARLGQAEAKLDQQIEAEKAYFDAQLEKLETELQFVASLLPKSQ

SEQ ID NO: 163326 - protein, 211 aa, Heterodera glycines
  Homolog annotation: Hit_ID=CAE71248.1; Match level="QueryCoverage =64%, HitCoverage=64%, E-value=9e-50, Identity=68%"; Hit description =Hypothetical protein CBG18124 [Caenorhabditis briggsae]
  Gene Ontology: Mol. function=SH3/SH2 adaptor protein activity
  Coding regions on vcDNA: vcDNA=SeqID_89749; Strand=+; Position=49-681
MASAKCAREDCGKTVYPLEELKCLDKVWHKTCFKCTDCGMILSMKSYKGYDKKPYCQAHYPKTVPSAVAATPEMEQAKRNTAYQSQVKYHEAYEKQMKGTKMEVADDPETMRHKANMVNQSLAHYHGELQKKEKQDSQRDTTAGSAPSVGFAVHSSPSLDSLGSAISTASSVVRPSNGSSSGNIGHVQQNIRRNSPQQHHQQQTYSYGQLF

SEQ ID NO: 163327 - protein, 254 aa, Heterodera glycines
  Homolog annotation: Hit_ID=NP_871644.1; Match level="QueryCoverage =97%, HitCoverage=27%, E-value=4e-37, Identity=35%"; Hit description =putative cytoplasmic protein of ancient origin (3H529) [Caenorhabditis elegans]
  Coding regions on vcDNA: vcDNA=SeqID_89750; Strand=+; Position=8-769
MESGRSDEVLARLEAVRRRVLAAPMNVHFGGDPSQIRLGTCSSSASSPPITDIASQWAFLEQPIHQLLQCPADYGASEAQFGQSRAIVVGGADSAFLLQKTRFDDDWNGPSTMSTLLLAQYLQQSEGPLWNAVRGTGLAYGVSLYVMPDRKALSLDLYRCSELTKAYEQTRDTTLAVLNLDRLDTNLLESAKRSLICELISGQNTVKLTVTSAILATIRSLGTDFTLKLCSPIWYAKAEDVLAIGGPPIRRLFD

SEQ ID NO: 163328 - protein, 193 aa, Heterodera glycines
  Coding regions on vcDNA: vcDNA=SeqID_89751; Strand=+; Position=63-641
MARKNLCRKTFATFKQEERYPIVQRAIGARWGRKTIQTPNIEEEALQSVELRPSTSAEDFVESPPLTPSIATTSEVDVLSAETVEFGGSFSATAAQMDIFESTPSTSAVQMDIEETTPSPFTVNDRSQRIEQLENQLNDRDDKNLWEDAIAYDCEFEEQSQKSPERSNYILPALPNDCLPLSVPSASRLVDVK

SEQ ID NO: 163329 - protein, 172 aa, Heterodera glycines
  Homolog annotation: Hit_ID=NP_502269.1; Match level="QueryCoverage =94%, HitCoverage=43%, E-value=8e-69, Identity=80%"; Hit description =zinc-containing alcohol dehydrogenase superfamily (40.2 kD) (4M724) [Caenorhabditis elegans] emb|CAA98080
  Coding regions on vcDNA: vcDNA=SeqID_89752; Strand=+; Position=2-520
ENRIKLIVADSKEERLCLAERNGADFVVHWDDSQFEEYLIMRTKDVATNGLHIVCDFVTSPRTGARSLKCLSEGGVLFIGGISGLDVQLPIKLVAKNRLAIMGVTRGSIEQLKNLVTLLSEGQLNAPNYRVYPVDQASQVLKQLSMSEVEGRAILEVFNPDTEVKKAEEEQK

SEQ ID NO: 163330 - protein, 295 aa, Heterodera glycines
  Homolog annotation: Hit_ID=NP_493077.1; Match level="QueryCoverage =90%, HitCoverage=88%, E-value=7e-56, Identity=43%"; Hit description =esterase lipase YbfF (1M774) [Caenorhabditis elegans] emb|CAB03219.1| Hypothetical protein R05D7.4 [Caeno
  Gene Ontology: Biological process=lipid metabolism
  Coding regions on vcDNA: vcDNA=SeqID_89753; Strand=+; Position=209 -1093
MLFSSLNSSLFIRQLFPHRRFFCFSAFPQPIPLAFDAYPSTAEPEKTNPLVIVHGLFGHKQNWRGVAKALQKELGNRVFVLDLRNHGESPHLPQCTYSSMASDLRQFLEKEVFTVSVYKTAFLLGHSMGGKVVSEFAFTKVNESLIEKLIVEDIAPQRNSHSSLAQFRAYIQALRSVDLRLSRSEISRSLESKIPEETIRAFLLTNLYKPRGGPFKWRCNLDALSDNLEHIFDPLISRERVTMPTLFLHGANSTYFLEDDKIALRKIFSHANFEEIPEAGHWLHAEQPKMFIDSV

SEQ ID NO: 163331 - protein, 79 aa, Heterodera glycines
  Homolog annotation: Hit_ID=NP_502317.1; Match level="QueryCoverage =100%, HitCoverage=14%, E-value=5e-28, Identity=68%"; Hit description= proline HYdroxylase (61.5 kD) (phy-2) [Caenorhabditis elegans] emb|CAA93469.1| Hypothetical protein F35G
  Gene Ontology: Mol. function=protein binding; Cellular component =extracellular space; Biological process=embryonic development
  Coding regions on vcDNA: vcDNA=SeqID_89754; Strand=+; Position=1-240
VYTDLKMGVAPSLHDALFWYNLHRDGNGDLRTRHAACPVLTGVKWVSNKWIHERGQEFIRPCPLKKEYNEKYVGDVRPF

SEQ ID NO: 163332 - protein, 200 aa, Heterodera glycines
  Coding regions on vcDNA: vcDNA=SeqID_89755; Strand=+; Position=3-605
FILLQHLNPQKMLSLIVIVCFFGIVPNLSKPIKLRNHSPMNVLFMAWPEARYPLELPFHRVDCFSEMERRHIVPQVITYRLENIKKLRNGICLVRIPTRSRVTVTQMNTNNVKSYVKFIAGSTQLSMPLHTDHIHSGQHEKFGPWHMPCRYAYIVFRSRSDQLEWVEFRLEPELKVDSADDQRNDCASEEHNFAESLLKH

SEQ ID NO: 163333 - protein, 234 aa, Heterodera glycines
  Homolog annotation: Hit_ID=NP_491242.2; Match level="QueryCoverage =95%, HitCoverage=61%, E-value=1e-62, Identity=52%"; Hit description =transcription factor B1 mitochondrial (1E420) [Caenorhabditis elegans] gb|AAB42235.2| Hypothetical protei
  Gene Ontology: Mol. function=rRNA (adenine-N6N6-)-dimethyltransferase activity; Biological process=rRNA modification
  Coding regions on vcDNA: vcDNA=SeqID_89756; Strand=+; Position=25-726
MLKMRSVVPHFPPLPALRDFIYMYRMDADKTLSQNYLMDMNLTRKMVRRAGDLTNAFVVEVGPGPGGITRAILEQPCKRLDVVEIDKQFLMPLQHLSNHSMERMNVHRADVLKFDFEQVWTDAGAAKCSWVEEHPNFHIIGNLPFHISTPLVIKMMRQMSIRRGPFVFGRVPLTFTFQSEVARRVVGEPGTDCRSRIGVTGQNLTEPRILFNVPGKCFTPPPDHDVCVVQFLPR

SEQ ID NO: 163334 - protein, 100 aa, Heterodera glycines
  Coding regions on vcDNA: vcDNA=SeqID_89757; Strand=+; Position=43-345
MCCINSKMLLLVAAFVVLLCLLNQNVGAEKIIVLYNGKKYDLTEFHKSHPGGEEVLKKVNGKDVKEYLEGKKGVKTDHLVQHKHSKHTINEFLPTFEIKH

SEQ ID NO: 163335 - protein, 67 aa, Heterodera glycines
  Coding regions on vcDNA: vcDNA=SeqID_89758; Strand=-; Position=1-201
PFCLGRCGGRWACECAWGKRCWGPWPTAAARPLSIFPPPPPPPRFVLFALCGKIVAFFGSTVPFCLI

SEQ ID NO: 163336 - protein, 125 aa, Heterodera glycines
  Coding regions on vcDNA: vcDNA=SeqID_89759; Strand=-; Position=75-452
ELIIDVRCALKFCFLFRGSPRLLILSLPLILCPLPLLLPTLLPLLSQCKKRIFLALCRNPNCKSRAMVPLPVGILHSKTDRTLHWRTFLADPRFWPFLLRDGHLEECRCFAQSIAVVFWGENAAF

SEQ ID NO: 163337 - protein, 101 aa, Heterodera glycines
  Homolog annotation: Hit_ID=NP_872192.1; Match level="QueryCoverage =99%, HitCoverage=69%, E-value=3e-32, Identity=62%"; Hit description =transthyretin-like family member (15.7 kD) (5I318) [Caenorhabditis elegans] gb|AAN84848.1| Hypothetical p
  Coding regions on vcDNA: vcDNA=SeqID_89760; Strand=+; Position=445-750
MKVKLYDHDKGPDADDLMGTTTTDEQGRFQVSGKTTELTTIDVQLRIYHDCDDGMMPCQRKVTFNIPDSYVTSGAVPAKFFDIGTVNMQIIFDHEERSCIH

SEQ ID NO: 163338 - protein, 246 aa, Heterodera glycines
  Homolog annotation: Hit_ID=EAA10559.3; Match level="QueryCoverage =84%, HitCoverage=52%, E-value=9e-18, Identity=37%"; Hit description =ENSANGP00000021579 [Anopheles gambiae str. PEST]
  Gene Ontology: Mol. function=chaperone activity; Cellular component =nucleolus; Biological process=nucleocytoplasmic transport
  Coding regions on vcDNA: vcDNA=SeqID_89761; Strand=+; Position=69-806
MVVPPAPQIPKKIAEEHKKNGTQPQKEESKKDIGKKKQPQMAERRESSGESGKRGRGSGMSRESSKRAQGNSRKRGRERSRESSGDKGRKTMRRSSRSRSVKRRRRDSSSSSYSSTSRSRSRSRSYRRSPKRSPARDRRRDRTRRSTSNSSRSSSSSSASSSSQYSSSERSHSQSRSFTSDRDEEEERIRDRIIARTLSTSVTAAPAKQPQSKDDGVAMDEAMEYGPKPPESLEVSILNSDMEMSE

SEQ ID NO: 163339 - protein, 114 aa, Heterodera glycines
  Coding regions on vcDNA: vcDNA=SeqID_89762; Strand=-; Position=115-459
SIQFTKSQSFPFFLSFALPITSSPMFFVLSLPLSLLSEAESNSQTNVHVSVHHKARSSTQGTVAVGSVIAEALSAAQVAKVAKTDKKRAASARVSCQCLLGGKPSLVGSSHLAI

SEQ ID NO: 163340 - protein, 122 aa, Heterodera glycines
  Coding regions on vcDNA: vcDNA=SeqID_89763; Strand=+; Position=512-880
GGGGRKRGRNGTGGGAGGGDILSTLFNAVKGGDIGSLLGALAGGADVNAKDTSSGNTLLQMAIMTGITEIVKLLLNRGANVNATNAEGKDAVRIAQEQAEQAPDEDSKEKYEQMVQLLQEKQ

SEQ ID NO: 163341 - protein, 203 aa, Heterodera glycines
  Coding regions on vcDNA: vcDNA=SeqID_89764; Strand=+; Position=51-659
MVQRLHCTNPESVQSAQKALINAIGRQLITDFHPAVKNVASASQNLLRSFQSLSHHFYEYTAALYALGFSGINSDEFEVREQSKTLQTVTEVLKKVHSEQIDWMDYFTAMALTINQNSKTEKERLKALISGFSERERQLSKAIHRGKQMPDTRSNFYETELEAMRDQQSQRYRFFADKHLELLRRYHEWMKDSLLLLEKELNL

SEQ ID NO: 163342 - protein, 284 aa, Heterodera glycines
  Homolog annotation: Hit_ID=AAH87434.1; Match level="QueryCoverage =97%, HitCoverage=98%, E-value=4e-46, Identity=38%"; Hit description =Unknown (protein for MGC:99245) [Xenopus laevis]
  Gene Ontology: Mol. function=carbonyl reductase (NADPH) activity; Cellular component=cytosol
  Coding regions on vcDNA: vcDNA=SeqID_89765; Strand=+; Position=28-882
MAGKIFVVTGANKGIGYGIARGLAQQVNGATIYMTARTPSLGEKALDDLEKELGIKRISKLAFHQLDITDEKSCADFAAFLKKTHGGLDVLINNAGFAYKHNATESAAIQADVTIGVNYYGTKLISDQLGPLIRDGGRIVNVCSQMGVMGSQIGVMGNLYKQALIDQFKRADVTSDDINTFVEEYKKLAHADKRKEGGYPESAYCVSKAAEIALSVLQARELAKRNIVVNACCPGYVDTDMTSHKGHLTIDQGADTPIFLAIDQSVQKGGLFYYQRKPITWLQE

SEQ ID NO: 163343 - protein, 125 aa, Heterodera glycines
  Coding regions on vcDNA: vcDNA=SeqID_89766; Strand=+; Position=24-401
MPPPVSQKNPITVQLKLTNSTDTCSDYSLEFTNTCFKLVDQVKFHVKVPKTSKLANHWGIVPLATDNGTADQQQLFTLPNNVHLYPGKSFASAGISVNGADRPEIVILDVQSVLCTEKHDDAATN

SEQ ID NO: 163344 - protein, 130 aa, Heterodera glycines
  Coding regions on vcDNA: vcDNA=SeqID_89767; Strand=-; Position=2-391
LSDFLLEIHRQKHWTKHLASSVRFFSLFEPPPKMPLILCQMLLFAPWANFSRHSEKHGPSKSATSLLCPSIVTSSIWSLMSTHFPSSPLFVRSSPNTSICFSSVSVKINCINAKIIEQNKIKSFILLLKL

SEQ ID NO: 163345 - protein, 48 aa, Heterodera glycines
  Coding regions on vcDNA: vcDNA=SeqID_89768; Strand=+; Position=37-180
INLKRKPPKRDNNTAALSLIISNNNKMKLLIVLLCVSAIYARSLQKRG

SEQ ID NO: 163346 - protein, 59 aa, Heterodera glycines
  Coding regions on vcDNA: vcDNA=SeqID_89769; Strand=+; Position=3-182
EKTEFSMYLTSSSSPPWHGIIFNTNFAHLVFFLLGRVHQAYTVVGHYGKRICIIFEGAI

SEQ ID NO: 163347 - protein, 212 aa, Heterodera glycines
  Coding regions on vcDNA: vcDNA=SeqID_89770; Strand=+; Position=1-636
EDLSSKELAKCELYLDFVKIHDNTTVYRHINRILNLNAKDVLLEISTELRDIVTTVTEYHFPVIADRTSKLVFAYTIDVINPERDCAFHFPTNEFVALLCYIAACCPNLDTFSLSFLLQGEFSDEDFKQLSSWLYRTIQSVLSLRCSILCIDCNLTIEFRAFFPEATLMEANKTGHGLATMGEQRRTDDSETTEMDDTPDTYSISRKIQMRD

SEQ ID NO: 163348 - protein, 242 aa, Heterodera glycines
  Coding regions on vcDNA: vcDNA=SeqID_89771; Strand=+; Position=2-730
EDSMAMIPFNLFLLSALFFTANAYDLILKNISVPDELKDKFECTFEVKKGNGENECGLGELETDGRRNGELKWAEDKLCIKVKCEEKGNDTKFAFRLQQCELVDLKKSDKPMKRPIHLIDSNGCLASNAKGQWPKLNPPLNYSFEERTVEMRGWTFGNETDIGQFPDEATLSCAVEICADPCEQSCLDKISLDKCSLNDFIGDKNATDICHEGNAAAVQGTISFCLMTLLMFLCSSTVLMFQ

SEQ ID NO: 163349 - protein, 324 aa, Heterodera glycines
  Homolog annotation: Hit_ID=NP_501359.1; Match level="QueryCoverage =97%, HitCoverage=77%, E-value=1e-90, Identity=50%"; Hit description =molybdenum cofactor synthesis 3 (44.5 kD) (4I895) [Caenorhabditis elegans] gb|AAB92067.2| Hypothetical pr
  Gene Ontology: Mol. function=URM1 activating enzyme activity; Biological process=protein modification
  Coding regions on vcDNA: vcDNA=SeqID_89772; Strand=+; Position=55-1026
MSATTHSLSKQEIARFSRQLMLKGIGPSGQERIRETKVLIIGAGGLGCPVSMYLVAAGIGRLGIVDHDVVSIDNLHRQTMHDQKRVGQSKADSLKESLSRINNEANVVAYNVLLTSKNVLQLFRDYDIVADCSDNVATRYLINDACVLSGKPLVYGSALGWEGQFTVYNNGTNCPCFRCIFPDPPSPEHVMSCSEAGVLGPVVGVIGSLQALEIIKIAVSGKSSFAGNLWMFDGFEGISKRISLREKMSNCAICSENPRITELQDYQKFCRSDPSNKVRSLCLLSAEQPVSPTDIQICRTKKSRASFILLDVRPPTSFEICHFA

SEQ ID NO: 163350 - protein, 246 aa, Heterodera glycines
  Coding regions on vcDNA: vcDNA=SeqID_89773; Strand=+; Position=1-738
GAFSASHFSYSTSVTAASSANSKTPTNCSTISDPKTQRPQSSPAGTMAEGWQNRLENLEFIDDDIISGEECPLIRPNSSGKVPTANVPSNFLSNTTMPHKLQTTSTRKDSNCSVTSLLPNAEKESDKSFAGVALSCGGGKKAHQLNDIKAVVEKLSRLAFELSATRHHSSTIHSTLSHVRLKPSAKFELLDIDLEKFQTLQNSRSSASPSSAGTPSDQLPSKTRLQNVAALRAKVRGIARQVAQFE

SEQ ID NO: 163351 - protein, 206 aa, Heterodera glycines
  Homolog annotation: Hit_ID=NP_492692.1; Match level="QueryCoverage =87%, HitCoverage=86%, E-value=5e-36, Identity=43%"; Hit description =5-formyltetrahydrofolate cyclo-ligase (1K796) [Caenorhabditis elegans] emb|CAA21728.1| Hypothetical prote
  Gene Ontology: Mol. function=5-formyltetrahydrofolate cyclo-ligase activity; Cellular component=cytosol; Biological process=formate metabolism
  Coding regions on vcDNA: vcDNA=SeqID_89774; Strand=+; Position=18-635
MMSNAATPKLAKKVLRKKIGEIIAQQMAGENGRNIRERETATVAQKLLVNEWFPNSTRLSIYLSNEQEICTDDIVRTALREGKEVFIPRFKKGAERMEMLRLESENEFDSLEGTLWGIRQHSASLSPPSFEETSAKAPLDLVVMPGVAFNTSGKRPGHGREFYDRFLNEYAQKYRTVPRTIALALKVQLVDDLPIESKDRMLDEVI

SEQ ID NO: 163352 - protein, 195 aa, Heterodera glycines
  Homolog annotation: Hit_ID=XP_395597.1; Match level="QueryCoverage =94%, HitCoverage=11%, E-value=1e-17, Identity=32%"; Hit description =similar to CG14814-PB [Apis mellifera]
  Gene Ontology: Biological process=regulation of protein activity, epigenetic
  Coding regions on vcDNA: vcDNA=SeqID_89775; Strand=+; Position=22-609
MLPSMSKKQRKPEQNNRQLRIIEVQLFTPTARRYPHFDYEEMCKELGLEISKQKKTAESNSFHDQDAEEIVRRLEAKYGSQTVVSLPSTWKKPRKKTKKAIKFAPEDVMDKGLGYDLEDDFIDDEQAYDEWVPTTMDTAKRGHYVNKGPLEFRQIDFDQTTSEEDEEKDGEEESNGTRRETSILEADEEEAMNME

SEQ ID NO: 163353 - protein, 148 aa, Heterodera glycines
  Coding regions on vcDNA: vcDNA=SeqID_89776; Strand=+; Position=21-467
MSSFGTSSGGRIRQRGTVGGRGQFNLSGMVEPQQAFQPPTTHPADFSVSRGRGHRYLQNPLESLTHPCKLEVAMATPAEVDLSPAIREIKKDTFSVGVTPTTLTSVGKGPCVSCQQSEEVNRQLMAALLKDLGTSLVNFAAKLEQPSK

SEQ ID NO: 163354 - protein, 69 aa, Heterodera glycines
  Homolog annotation: Hit_ID=Q8I7D9; Match level="QueryCoverage=97%, HitCoverage=98%, E-value=2e-26, Identity=86%"; Hit description =Protein transport protein SEC61 gamma subunit emb|CAC82549.1| putative transport protein sec61 gamma subunit [
  Coding regions on vcDNA: vcDNA=SeqID_89777; Strand=+; Position=25-234
MEHVQAVVDPGKKFAKDSIRLVKKCTKPDRKEYQKIAFATAIGFAIMGFIGFFVKLIHIPINNIIVGGG

SEQ ID NO: 163355 - protein, 186 aa, Heterodera glycines
  Homolog annotation: Hit_ID=XP_421796.1; Match level="QueryCoverage =50%, HitCoverage=15%, E-value=8e-26, Identity=56%"; Hit description =PREDICTED: similar to arginine-tRNA-protein transferase 1-2p; ATE1 -2p [Gallus gallus]
  Gene Ontology: Biological process=RNA processing
  Coding regions on vcDNA: vcDNA=SeqID_89778; Strand=+; Position=3-560
AKYFFYDPDFAFLSLGTYSALREIAFTQQLAQHRPDLHFYYMGFYLFDCPKMRYKNRFRPSELLCDHCFNWVPETECDRILEANGGRFSTFHPSAEPTRAELDSAQMDQILCLHGDPPRPLTFASLCNSLETAAAHPSSSTDSQRQNGRGEGPEMGQHDAFLTVDGIGPGALLRQLTDKVRTYVRH

SEQ ID NO: 163356 - protein, 112 aa, Heterodera glycines
  Coding regions on vcDNA: vcDNA=SeqID_89779; Strand=-; Position=141-479
RAQLENEVLVVKAYALWDNNRKTEEHRISIYSAKRLARPPSTATPSKLLGDSAAVKRRAANTIKRIRMQTHRPMHTFETPPPSIELSAPNPEAAGVVPLRRVILFVNLSRKP

SEQ ID NO: 163357 - protein, 116 aa, Heterodera glycines
  Coding regions on vcDNA: vcDNA=SeqID_89780; Strand=-; Position=2-349
IFSFVILNANNFIQRKNIFYDLEIFSILRNNFHRFRRFVCRSFVRPPISFLLSAYFPYHFGKSLVSLTTTWRFEIRSKSARGKASTEAKIKKSSERTENRREKRILAERKWEIVLK

SEQ ID NO: 163358 - protein, 186 aa, Heterodera glycines
  Homolog annotation: Hit_ID=CAE70331.1; Match level="QueryCoverage =60%, HitCoverage=38%, E-value=1e-19, Identity=40%"; Hit description =Hypothetical protein CBG16864 [Caenorhabditis briggsae]
  Coding regions on vcDNA: vcDNA=SeqID_89781; Strand=+; Position=74-631
MAGKFIGGRMPFRQSLLAPSFLTVSPLWPFPFRPNSASSHARVFDSEFPSSHSPKLRCVLSANNKTNSRARRYHHPRPQLVIFDKDGTLICFHSLWVPWVRSFAEKVEEAGIDGIAPKVFHALGFCPVLKKVKRGLLAEGTMRQIRDRVVHLLVQNGLERRESLNVVEKAIHGTSEGPFAERTVRQ

SEQ ID NO: 163359 - protein, 71 aa, Heterodera glycines; identical to SEQ ID NO: 162404
  Coding regions on vcDNA: vcDNA=SeqID_89782; Strand=+; Position=47-262

SEQ ID NO: 163360 - protein, 121 aa, Heterodera glycines; identical to SEQ ID NO: 133600
  Homolog annotation: Hit_ID=NP_506003.1; Match level="QueryCoverage =95%, HitCoverage=95%, E-value=5e-13, Identity=37%"; Hit description =macrophage Migration Inhibitory Factor related (12.8 kD) (mif-2) [Caenorhabditis elegans] emb|CAB01412.1|
  Coding regions on vcDNA: vcDNA=SeqID_89783; Strand=+; Position=34-399

SEQ ID NO: 163361 - protein, 104 aa, Heterodera glycines
  Coding regions on vcDNA: vcDNA=SeqID_89784; Strand=+; Position=1-315
VPSADFFGGIGHRLSGDENVAMVFMLLMITILATNTAILIMQIVMFWTVISRPRAAAGEQQTEKKKTDNYKKMMSNTNGKVHLVSSPRNSAELLLFDRKGNAVV

SEQ ID NO: 163362 - protein, 77 aa, Heterodera glycines
  Coding regions on vcDNA: vcDNA=SeqID_89785; Strand=+; Position=357-590
LRHVAKSVWAQQFRHVLRPGRRPIADGVHKHGGVPKNCTLEHVLREGTLPGTPIGPCAHSTSHGNGWGQTHFRLRSC

SEQ ID NO: 163363 - protein, 234 aa, Heterodera glycines
  Homolog annotation: Hit_ID=NP_509281.1; Match level="QueryCoverage =92%, HitCoverage=66%, E-value=5e-62, Identity=54%"; Hit description =stomatin (sto-1) [Caenorhabditis elegans] gb|AAA68723.2| Stomatin protein 1 [Caenorhabditis elegans] sp|Q
  Gene Ontology: Mol. function=protein binding; Cellular component =integral to membrane; Biological process=signal transduction
  Coding regions on vcDNA: vcDNA=SeqID_89786; Strand=+; Position=32-733
MSSENPPSPMQRQQSSVQLQQSSVSDMGDPDDCFSMFLVFMSYVLLFFTFPCTIFSCIKIVQQYERAVIFRLGRIRRKAQGPGLFFILPCVDEYRCVDLRTVTCDVPPQQVLSKDSVTVTVDAVVFYRVFNATQAVMMGNISSSTTLLAQTTLRHVFGTKTLSEILGNFNKINREMKLSMDKPSDVWGVEVELVELKNVRLPHDMQRSMAAEAEAGREARAKMVAAEGDHKRPR

SEQ ID NO: 163364 - protein, 198 aa, Heterodera glycines
  Homolog annotation: Hit_ID=NP_082438.2; Match level="QueryCoverage =59%, HitCoverage=14%, E-value=4e-11, Identity=34%"; Hit description =TBC1 domain family, member 5 [Mus musculus] gb|AAH43113.1| TBC1 domain family, member 5 [Mus musculus]
  Coding regions on vcDNA: vcDNA=SeqID_89787; Strand=+; Position=36-629
MEEQGPFLIDWRTLFGKAPFELRKQCIRGHLRNSHLRSIVWRLLLGVLPMEDRTQWVEVIGQERRNYTELRHRIESNPRINNSPEGKNFDGNNPISLNAESPWCRHFENQSTRKNIEKDVDRTCLKSSKQCLRQLHITVQSAEEAKASAPSTPSNVANSYAVQIRWLSSEFLTGLAYTLTVLCNIQYSNFERAHRYFG

SEQ ID NO: 163365 - protein, 151 aa, Heterodera glycines
  Homolog annotation: Hit_ID=CAE68398.1; Match level="QueryCoverage =96%, HitCoverage=86%, E-value=3e-34, Identity=46%"; Hit description =Hypothetical protein CBG14167 [Caenorhabditis briggsae]
  Coding regions on vcDNA: vcDNA=SeqID_89788; Strand=+; Position=23-478
MASENEIPDKFLGKFKLEKNEKFDEYLASKGVSWILRKMICFTTVTKIFEKSEAEKSKYNAYNQSSKHNTNWEGWKIGETFEGIGLDGKQHKITFDLSDNGDTLTEKHLRMDNPSDVGEVYRYSVDTDSGHLILTLSNESLTARRFFKRIQ

SEQ ID NO: 163366 - protein, 209 aa, Heterodera glycines
  Homolog annotation: Hit_ID=NP_499994.1; Match level="QueryCoverage =63%, HitCoverage=24%, E-value=2e-21, Identity=39%"; Hit description =predicted CDS, mitochondrial ribosomal protein L46 like (4B557) [Caenorhabditis elegans]
  Coding regions on vcDNA: vcDNA=SeqID_89789; Strand=+; Position=4-630
MFVKTFSRSVRNSTRFFYSTNTKLDPSKWRIEVALLIYRPPVVAPPMTEVEEQFYRMSEFANQKSSYKCDFELQLEKDEKLLEKRRQLENEGRDLSALDEEINVSSTQLRDDWFEKSEQLTKQYKLDSPQTTTDEDKNLKTFGRMQQKKLALLVKQRFPDALNSDYVSPWILPQLIRTGDDTLRQTAEKCIAHMFPNFDQMPIGFQILG

SEQ ID NO: 163367 - protein, 168 aa, Heterodera glycines
  Coding regions on vcDNA: vcDNA=SeqID_89790; Strand=-; Position=80-586
QKSNISDIRQSATARTQRGNPSHTIFFSVKCFISQPKNGETRAEVGCHNWSWSGKRLYWIFGSFPWRALCWIYSLKCRAVVAHWWRMFPAYYQSMLVVGRTNCSMKRKAKVAIGRNDSQHWHPSSSFVVWSFANPEVVSDFFHFDQSRGLTRSFLCFSINPCEKCAKE

SEQ ID NO: 163368 - protein, 211 aa, Heterodera glycines
  Homolog annotation: Hit_ID=NP_878822.1; Match level="QueryCoverage =50%, HitCoverage=47%, E-value=2e-28, Identity=53%"; Hit description =uracil-DNA glycosylase [Candidatus Blochmannia floridanus] sp|Q7VRQ7|UNG_CANBF Uracil-DNA glycosylase (UD
  Gene Ontology: Mol. function=uracil DNA N-glycosylase activity; Cellular component=mitochondrion; Biological process=DNA repair
  Coding regions on vcDNA: vcDNA=SeqID_89791; Strand=+; Position=13-645
MSPKQFKLTHSLFSFQRISQADGVKRKQMKADESICPPQRKKPSTSLKEADGSDGAVENVQTKENMRPILEAERHQQNDDGTGEIRSPPSSSPTPWHPSHALAEPTWQKLLRKEFQMKYMTNICCFLEEQAKQGVSVFPPRHLIFNAFNLTPFNTIRVVVIGQDPYHNLGQAHGLCFSVPNGQPIPPSLKNIFKELSSEFPDFVLPKHGTL

SEQ ID NO: 163369 - protein, 199 aa, Heterodera glycines
  Coding regions on vcDNA: vcDNA=SeqID_89792; Strand=+; Position=21-617
MANFPPNSDEEFDRGNFSSLSGMVGMNQRHLDWLMKNISREDMAELQQRTGQCARKCAVTYGGPIVVVTIGFLEFLRRKQNLPITAPRFLIGYPIMCLTSVALGSSIGFKRSGCGAEMRLFLDKLYAKYDSQMNAASAQMAPGVGGGTSPTKTYAQLREANRAGRPIELGQLKQQQTRQQQKKMDGSKATTEGTEGSGG

SEQ ID NO: 163370 - protein, 82 aa, Heterodera glycines
  Coding regions on vcDNA: vcDNA=SeqID_89793; Strand=+; Position=3-251
KFEALIPLLQMWYERLPMIIAAVSIPAFCTSDYYPLHWYGTNGCKHHRVLKGHEQSALLIRDRELTGYEYNLMGIDSIPEED

SEQ ID NO: 163371 - protein, 195 aa, Heterodera glycines
  Homolog annotation: Hit_ID=NP_498174.1; Match level="QueryCoverage =72%, HitCoverage=83%, E-value=4e-21, Identity=38%"; Hit description =immature colon carcinoma transcript 1 like (3G589) [Caenorhabditis elegans] gb|AAL06045.1| Hypothetical p
  Coding regions on vcDNA: vcDNA=SeqID_89794; Strand=+; Position=90-674
MLPSPSFSIQLVSRLFSQFFNRPLCSSAHLLSKDPSNSRNSGRDHNFFEGLYFEGEIPRDRIKQKYTLSSGPGGSNVNSHPTKAEIRFTVDEADWIPRRVRERLVERYPRYMNNRGEFAFTSQKTRYQIQNMNDCFDRLHNMLLNCSEELVKEEHRTHVSPQHISIMEERKKRSEEFRLASKNSHSRKKQNRRSG

SEQ ID NO: 163372 - protein, 112 aa, Heterodera glycines
  Homolog annotation: Hit_ID=NP_741567.1; Match level="QueryCoverage =98%, HitCoverage=10%, E-value=3e-32, Identity=54%"; Hit description =IMportin Beta (123.9 kD) (imb-4) [Caenorhabditis elegans] gb|AAB04981.2| Importin beta family protein 4,
  Gene Ontology: Cellular component=cytoplasm
  Coding regions on vcDNA: vcDNA=SeqID_89795; Strand=+; Position=3-341
IIEVPLNPTNPSQPNMEFVYEAIATLFTTHFKNLTEPQIRVTVKGFFSFNRTVTKMREHIRDFLVQIREEAGDDTADLFLEEKEAEIQRIQSLKQAIPGVRNPNELLEEDMV

SEQ ID NO: 163373 - protein, 379 aa, Heterodera glycines
  Homolog annotation: Hit_ID=XP_391857.1; Match level="QueryCoverage =59%, HitCoverage=29%, E-value=2e-45, Identity=40%"; Hit description =similar to Na+/H+ antiporter [Apis mellifera]
  Gene Ontology: Mol. function=sodium:hydrogen antiporter activity; Cellular component=integral to membrane; Biological process=sodium ion transport
  Coding regions on vcDNA: vcDNA=SeqID_89796; Strand=+; Position=3-1142
QSLVTINYFMKTLSSSCEAVIFVFLGLSAVSKNHDLDFIFILVTLASCLVYRFIGVGVLTYLVNKRRVERIGLVDQFIMGYGGIRGAVCYGLVMSLDPELVECRNMLATTTIIVILFTVFVQGGSIEKLVTYLKVKQFEAHKKTVFEMIADNVSSHMVGGMESIAGLRGDYWFRMKLERYNKKYIKPFIMLNPNDKDMKIVRHNEEIQVKEAVIYLKKHGSFAGMPTVQSSRDLYSQQQPSNGIGAPRMSFSRLTVPQRTPQESIPRNESVGTFVRNKFAELQSSGHRYSRHYNDQDLRPVQHSFSMGDDEEPLDDDQHYKTFPYNKATQREAVRLINEARRKSSSQVRKSSKPTANKMDTLLESNKFIVDEENEEKEE

SEQ ID NO: 163374 - protein, 266 aa, Heterodera glycines
  Homolog annotation: Hit_ID=NP_491127.1; Match level="QueryCoverage =98%, HitCoverage=93%, E-value=8e-66, Identity=47%"; Hit description =thioredoxin-like protein (31.1 kD) (1D801) [Caenorhabditis elegans] gb|AAF60759.1| Hypothetical protein Y
  Gene Ontology: Mol. function=thiol-disulfide exchange intermediate activity; Cellular component=mitochondrion; Biological process =signal transduction
  Coding regions on vcDNA: vcDNA=SeqID_89797; Strand=+; Position=8-805
MPVVKPQTDSEFTKFLLNVGTAPCIVDFFATWCQPCSAIAPVFDELSNNYLNLKFVKVDVDKCKETKNTYGVSAMPTFIVLLNGQRVDLLRGADKTALQNLAHKWSKNCPTQMVSPIPGQCELSPLFNKIQCECLNEDDSNNLNNLLNGVGPLISDCDEQLLISVSFIQPVKVHSVLFNGPKEKAPKTVKIFANITNTLGFDQAQSTEPIQCIDLSEEKLVALKYVKFQNVFNLQFFVEDNVGGGDKTVVDEFRIYGTPIAKTTNM

SEQ ID NO: 163375 - protein, 115 aa, Heterodera glycines
  Coding regions on vcDNA: vcDNA=SeqID_89798; Strand=-; Position=44-391
FRIFNWSSEIKRFITITLKNNRIDLTKEFGYVPAVGFTDSLALISFSFCSLPSTKSIGVLFWRFFFSMLAPERAKSNATSICWSSHAKCSAVSPSLFGKSICKFFRQPNSKLTMR

SEQ ID NO: 163376 - protein, 176 aa, Heterodera glycines
  Homolog annotation: Hit_ID=NP_500802.1; Match level="QueryCoverage =100%, HitCoverage=97%, E-value=1e-48, Identity=52%"; Hit description= putative protein of eukaryotic origin (4G158) [Caenorhabditis elegans] gb|AAF60946.1| Hypothetical prote
  Coding regions on vcDNA: vcDNA=SeqID_89799; Strand=+; Position=43-573
MNKWRLDLCGSAGSRTLMLRSAAADQSLNPPGYNPGLSTTQQNESANRAEQQQQHLLSKRAWDLALQPVKSLPMNMFMMYMAGNTISIFPIMMVVMMAWRPMKTLMSVNAAFKPLEQEHVGSLWIHKIVFALGNLCAIALAVYKCHTMGLLPNHASDWLDFVPPLERAQYALFNDI

SEQ ID NO: 163377 - protein, 136 aa, Heterodera glycines
  Homolog annotation: Hit_ID=P48817; Match level="QueryCoverage=94%, HitCoverage=90%, E-value=7e-25, Identity=42%"; Hit description =Nucleoside diphosphate kinase (NDK) (NDP kinase) gb|AAA90988.1| nucleoside diphosphate kinase pir||JC4359 nucl
  Gene Ontology: Mol. function=ATP binding; Cellular component=nucleus; Biological process=negative regulation of cell proliferation
  Coding regions on vcDNA: vcDNA=SeqID_89800; Strand=+; Position=26-436
NNMERTFICLRPTNPSPVGRVIARFESNGLKLIAMKMINATRNQATEHYKEYRDRPFFNKLINYITSGPVVAMVWEGIDSVKKSLHLLESACFYNLRNMDECRDIVRHGSCNVQDAQRKINIWFSPNELRINSTSR

SEQ ID NO: 163378 - protein, 94 aa, Heterodera glycines
  Coding regions on vcDNA: vcDNA=SeqID_89801; Strand=-; Position=34-318
SNNQTWAHQFIHTMKLHESPAHLLSNDAAPGESQATTPCRQSRLDSDRSEAVAQQPGCSEAVAQQPRCSEPVAQQPRCSEPVAQPGCSCFRYRG

SEQ ID NO: 163379 - protein, 188 aa, Heterodera glycines
  Homolog annotation: Hit_ID=NP_491690.2; Match level="QueryCoverage =92%, HitCoverage=34%, E-value=7e-47, Identity=56%"; Hit description =aminotransferase, class I and II family member (55.8 kD) (1G400) [Caenorhabditis elegans] gb|AAC24265.2|
  Gene Ontology: Mol. function=transaminase activity; Biological process=nitrogen metabolism
  Coding regions on vcDNA: vcDNA=SeqID_89802; Strand=+; Position=56-619
MFPRPSTSFPKILNRTKLCQASVVGSNRTMSSSDKLQQQKVLTVDTINPNVITMEYAVRGPIVIRAVELEKQLAKESLPFPSVIRANIGDAHAMGQTPITFIRQVIAGITEPALIKQQPNLFPEDVQRKVASLLRACGGGSAGAYTQSTGIDLIRQHVAQFVERRDGFPCDPESVCISGGASESIRNV

SEQ ID NO: 163380 - protein, 212 aa, Heterodera glycines
  Coding regions on vcDNA: vcDNA=SeqID_89803; Strand=+; Position=1-636
IKHILRKHCIELLAYKSKMTSRSAKRSLKKSDGLSGKVSVSKAQQIEQFFGIDEAKCETAERTSKSPSAKRSRNSTNTAVQLLKKMAKHKKELNSSKETRREEDEREMENIPDTLDELNSRGTEDERGKGTESVQTVNELDELLDSETAKRIQSESEVTIRFCCPLLANVGSVGQLFSIDDFSPLKTLSSSSNLSVPPFLCPFVFLFLSRPH

SEQ ID NO: 163381 - protein, 198 aa, Heterodera glycines
  Homolog annotation: Hit_ID=CAH92373.1; Match level="QueryCoverage =95%, HitCoverage=36%, E-value=1e-52, Identity=51%"; Hit description =hypothetical protein [Pongo pygmaeus]
  Gene Ontology: Mol. function=protein transporter activity; Cellular component=cytosol; Biological process=intracellular protein transport
  Coding regions on vcDNA: vcDNA=SeqID_89804; Strand=+; Position=33-626
MANELISPTPPDIENIFKRLRANPSNKVCFDCGARNPTWSSVTYGVFICIDCSSVHRNLGVHLSFVRSTNLDTNWSWIQLRAMQIGGNANAVAFFKQHGCESNDAQVKYHSKAAAMYKGRIIDLATKAQQQAGSNIFFDALKEQQSPQSKGPNESEFFGSHETEEHTKEMKEASLSEIPHAPIQKTKKITLGQKKGGS

SEQ ID NO: 163382 - protein, 279 aa, Heterodera glycines
  Homolog annotation: Hit_ID=XP_315055.1; Match level="QueryCoverage =51%, HitCoverage=20%, E-value=3e-13, Identity=34%"; Hit description =ENSANGP00000011420 [Anopheles gambiae]
  Gene Ontology: Mol. function=DNA binding; Cellular component=nuclear origin of replication recognition complex; Biological process=DNA replication initiation
  Coding regions on vcDNA: vcDNA=SeqID_89805; Strand=+; Position=45-881
MTFDFEKRGDNADDEDSSADECSSSTGSSTPNSEYSVDEIIGHRIENGTDKWRVRWKGWAPKYDTWEPRENFSNSMHLLDKFDAKRLAGQCKENEAVATHPMSNNNNQSDYVKKLRPHRSLCLPPTSAAVPSAGRKGPKKKGSAKRTTAAKTPVSIPLLEAKAMLHTSRMPKDMSERAKECKEIRKFLLNCVKRTNASATAAAPRVLYISGVPGTGKTAAVLKVQKELCSEKKTPKFDFLNINALELSDPRQLFTKVYGQVQNNCTGTRKKISARNAQQ

SEQ ID NO: 163383 - protein, 107 aa, Heterodera glycines
  Coding regions on vcDNA: vcDNA=SeqID_89806; Strand=-; Position=6-329
LNTLFIRLHFNHPLFFFSTFFTNSSRHLIMHTNRRVPGCLSAHPQLSPASGGPMFLLLSTNNKFNSLEPKRNKTKRKGAKIIENYQNDNINKFCSNYPNSKKAQIYV

SEQ ID NO: 163384 - protein, 134 aa, Heterodera glycines
  Homolog annotation: Hit_ID=NP_495934.1; Match level="QueryCoverage =100%, HitCoverage=100%, E-value=1e-49, Identity=71%"; Hit description=ribosomal Protein, Large subunit (15.5 kD) (rpl-32) [Caenorhabditis elegans] emb|CAA92757.1| Hypothetic
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_89807; Strand=+; Position=58-462
MVSVNGRKVKIVKKRTNRFTRHESDRYLRVKPNWRKPKGIDNRVRRRFKGQRRMPKIGYGNARQTRHMLPNGLRKVLVHNVKDLDVLLMQNKRYCGEIGHAVSSKKRKQIVERAQQLRIVLTNGNARLRTEENE

SEQ ID NO: 163385 - protein, 207 aa, Heterodera glycines
  Homolog annotation: Hit_ID=AAH76973.1; Match level="QueryCoverage =99%, HitCoverage=34%, E-value=6e-27, Identity=35%"; Hit description =MGC89486 protein [Xenopus tropicalis] ref|NP_001005068.1| MGC89486 protein [Xenopus tropicalis]
  Gene Ontology: Biological process=growth
  Coding regions on vcDNA: vcDNA=SeqID_89808; Strand=+; Position=1-624
QPTNFAFQKSELLRMKEQAEQSGDVARVRDLQQQVNELEEKAKKIEHQRTKNLSAISAINQRNRDHMKQTFLGAGMVREEQEKDDDPFTRKSARMKVVSGSVKSKTAGEGSGANAELSVMDTMVSSLGSLSSSSESSPNKKVQLPSTHDLFNAHGIDINIDIKMPAVVGGSLRAPPITDSQAPRTQQKTSSSRTLTLEEYKKKRGLV

SEQ ID NO: 163386 - protein, 158 aa, Heterodera glycines
  misc_feature (2)..(2): Xaa can be any naturally occurring amino acid
  misc_feature (4)..(4): Xaa can be any naturally occurring amino acid
  misc_feature (14)..(14): Xaa can be any naturally occurring amino acid
  misc_feature (18)..(21): Xaa can be any naturally occurring amino acid
  Coding regions on vcDNA: vcDNA=SeqID_89809; Strand=-; Position=0-473
GXSXPGERAPARGXVSPXXXXTACPGPRPSLSCANNNFRLNICCRRCCNCCCSSPATSSSSPPFPSRRCSSMPSSPPPVESSQRCCAVAAGAPGISAAAASSSASTSLSSTTALLLLMSCCCWCWFCWEMLSAAGSRENEVCCLINRWKRSGALCPQT

SEQ ID NO: 163387 - protein, 201 aa, Heterodera glycines
  Homolog annotation: Hit_ID=AAT07319.1; Match level="QueryCoverage =82%, HitCoverage=60%, E-value=2e-15, Identity=34%"; Hit description =Sloan-Kettering Institute proto-oncogene product [Anopheles stephensi]
  Gene Ontology: Mol. function=protein binding; Cellular component =transcriptional repressor complex; Biological process=limb morphogenesis
  Coding regions on vcDNA: vcDNA=SeqID_89810; Strand=+; Position=33-635
MLDQTPSTSSTAVTYANLSIDDRDTLMKNLQKLFKTHHQEQNVTNDQQPGSSTSKGTDSRTMKTAARGQTEFPFFTPRDSRYSTLKSTVVDGKALGCFIIGGECRLSFPQMRALCLGEIPTQKIDESMKLLAIVNALATEDQLTVLKRAGLAQPSLSKCELITKTNAERLISLLNSTGTSPIDEVQRSQLHSFRVVHDCFG

SEQ ID NO: 163388 - protein, 79 aa, Heterodera glycines
  Coding regions on vcDNA: vcDNA=SeqID_89811; Strand=+; Position=1-240
ERDMPEPNLPLPRKRVGFKEPHTGLVKNDFFGYWYLQYCLVTGLYMLEPWERKMFNVFVTGFIAVLCSAFYALWNALIN

SEQ ID NO: 163389 - protein, 265 aa, Heterodera glycines
  Coding regions on vcDNA: vcDNA=SeqID_89812; Strand=+; Position=3-797
SLFSMLPPLHAFLCLIFFVSSSISPHSSASSVHSSEDELSQMLSSLWHIDSEHRKLFHNEFRISSTDDRGRLVAVLPRPSVLSRPIVTAFGQLCNVLQSVNPNQSNNNSLRQKVDLFLAEMDKSPIFKKASEFYSAHRLSNSKSFKQKFHSLWFFPSSSIPFGSLMCRFSAFSGNWLSFISAQKRMNVKRLVVERESEDMALVEFGGSDAGGANVADMRGNAQPQKRHFALGDSVEFELSALTLCALLRRERHQQKKRCSFKTDE

SEQ ID NO: 163390 - protein, 156 aa, Heterodera glycines
  Coding regions on vcDNA: vcDNA=SeqID_89813; Strand=-; Position=214-684
KLTPFFYRSLLLSSSSAACVANVKKGSQIVSESDVSPFGAAAPWVDAHVETRAGQKGLLLLQIGRIVIIGHGFNAIGEEQIQKKPKENETHRPDLGVEFEVERCTKNAMPSHFFVGVKRRLEFFFFFFFFFFRRSTIFIKNKNPDYLRNPETQGCY

SEQ ID NO: 163391 - protein, 203 aa, Heterodera glycines
  Homolog annotation: Hit_ID=NP_491320.1; Match level="QueryCoverage =93%, HitCoverage=92%, E-value=1e-56, Identity=57%"; Hit description =stromal cell-derived factor 2 precursor (22.8 kD) (1E746) [Caenorhabditis elegans] gb|AAC17034.1| Hypothe
  Gene Ontology: Mol. function=dolichyl-phosphate-mannose-protein mannosyltransferase activity; Cellular component=endoplasmic reticulum; Biological process=protein amino acid glycosylation
  Coding regions on vcDNA: vcDNA=SeqID_89814; Strand=+; Position=18-626
MPFLGPFFVFVVSPFFVFGSAYSEDEPVTCGSVLKLQSVADNVRLHSHEVKYGSGSGQQSVTGNSNSDDVNSHWQIIGPNSEPCQRGQPVKCDSSIRFMHLQTRCFLHSHEFSAPLSRGMQEVSCFGKEGQQSDSGDHYKVVCSGDVWTQDEQIKLKHENTGNYLSISGQQFGRPISGQREVIAAPSDGHKSLWIAAEGIFIK

SEQ ID NO: 163392 - protein, 111 aa, Heterodera glycines
  Homolog annotation: Hit_ID=NP_506146.1; Match level="QueryCoverage =63%, HitCoverage=16%, E-value=1e-11, Identity=53%"; Hit description =putative protein, with 2 coiled coil-4 domains (5N52) [Caenorhabditis elegans] emb|CAB02877.1| Hypothetic
  Coding regions on vcDNA: vcDNA=SeqID_89815; Strand=+; Position=16-351
MRTSLLIPLSLFSLITLLFIVSFSEADIEMDSLMPRTKRQCCGGCGYSGGYGGYGNDGGGQCCDACGQCGSGGYGSGAIIITTGGGGYGYGGYGDGYCYSCGGGGCYGCCG

SEQ ID NO: 163393 - protein, 189 aa, Heterodera glycines
  Coding regions on vcDNA: vcDNA=SeqID_89816; Strand=+; Position=64-633
MSHHTQIQQYFCPPSAPAVTYYNYGNITNIDLSPQQAVPQGFQQQVQLTAPAYTVAQYWHNVPSQNGGYQMPQNNGHHAAAYSSGDHPKMGKHKGIGKRFHPQKHQQRASAPHGIRRNGKYSAGATTKQQQANADDTDHQPSAAQAAQIIDLLSELLAEFTNFSAEFAQFASLMQENWAQTQRPIKRTN

SEQ ID NO: 163394 - protein, 309 aa, Heterodera glycines
  Homolog annotation: Hit_ID=BAC87096.1; Match level="QueryCoverage =100%, HitCoverage=52%, E-value=1e-61, Identity=43%"; Hit description= unnamed protein product [Homo sapiens]
  Coding regions on vcDNA: vcDNA=SeqID_89817; Strand=+; Position=3-929
HIETHSNGGASVLRCDWRRLKHDLSSQELNEFAEEFIDLGLSELSKVPLFVMCVVEHGIEYLEDLLEYLGTKHSNMPVKMGSLHNKQLVETIQIGHYYEKVISSYKQGTYRCGPLKEITLVGKKQEECGAYFEHLIERLEECPFLRILLPWSERTICSDKRPSESDDGPIYWCRPGEQLIRTDESKFDEIKSKQHRRGSAGTKQTKSAGIPLKALERREILFEDRTPCHADHVTDENKAHTTAAVGLLQAVRSPTEKGKIGDRLVKDVICFHAADFKRVTDILKLDLYEPPMSQCTQWVEEAKLNTLRR

SEQ ID NO: 163395 - protein, 195 aa, Heterodera glycines
  Homolog annotation: Hit_ID=CAE65688.1; Match level="QueryCoverage =67%, HitCoverage=30%, E-value=3e-15, Identity=32%"; Hit description =Hypothetical protein CBG10763 [Caenorhabditis briggsae]
  Coding regions on vcDNA: vcDNA=SeqID_89818; Strand=+; Position=3-590
LSKCIVLVDYARQRQEWTFNKVSQLSTSVVELRNKIETEATRTRKNPGEVLLKIIRFYSSKLNVLMSKLRDRSSEVLLSSSMQKQILTLTAYVQQLDDNFVKAKDIDEVKQEVLEEAKQKLFDIARWSASLSLRGPPKTSTADDGENENLSSNIETEPKQEETKGEEEETLQQSMKEDEEEKGEEEEDEEEEEED

SEQ ID NO: 163396 - protein, 224 aa, Heterodera glycines
  Coding regions on vcDNA: vcDNA=SeqID_89819; Strand=-; Position=293-967
CVYCIMLYCNEPFTVMWLITVIIDWSLLSLLDENRPFSLGWPQSIGQLAVGVLTGATAAATEAGKRPRNASAKALRAETPAGGHETDNWPTDGLSDGQSADGGQSEGRKSAKDEDVSLASVGVSKFVVVWACLFAPSSVCGIFPILASTRSPMARAWEGLHAGGKADIGGRGEAAEEKRLLFSICAGGSVGSARAPFTGFSRRTNSEFPTHKRRNKSPTEKSNR

SEQ ID NO: 163397 - protein, 219 aa, Heterodera glycines
  Homolog annotation: Hit_ID=NP_570962.2; Match level="QueryCoverage =92%, HitCoverage=45%, E-value=4e-26, Identity=38%"; Hit description =reticulon 4 interacting protein 1 [Mus musculus] gb|AAH24116.1| Reticulon 4 interacting protein 1 [Mus mu
  Coding regions on vcDNA: vcDNA=SeqID_89820; Strand=+; Position=4-660
MFSARSSFTFLRIFQCFARRCRPSLAGNATAAAQAQPSNANQMRAWAVNAFNAPLVHSNVPMPTIQNDNQVIIRVKAASVNPIDVRMSEGYGNEVLSKIKCLTEFVDRGLPKRMDFLQTQQTIGETFSRMGEADQFPLILGRDCSGEVVEKGRAVKDLDVGDQVIAVVPPHCQGCHSEFALSFTNAVAPKPASLSHTESAALPYVACTAWAALVTTGRI

SEQ ID NO: 163398 - protein, 134 aa, Heterodera glycines
  Coding regions on vcDNA: vcDNA=SeqID_89821; Strand=+; Position=18-422
IHFFIWFRPTTRNGKAHKKGRHCREVRHSVRRLVAEDSQKDGGVSTCQIHMCILRQGGHEASVCRDLELFQVSQESGRRRLRVRHHHRGNSAKHHPPSARDQRVICRIPTAENNGGDDDFCTPLPLFFVVMCCF

SEQ ID NO: 163399 - protein, 157 aa, Heterodera glycines
  misc_feature (134)..(134): Xaa can be any naturally occurring amino acid
  Homolog annotation: Hit_ID=NP_741625.1; Match level="QueryCoverage =97%, HitCoverage=18%, E-value=3e-45, Identity=58%"; Hit description =ligase (lig-1) [Caenorhabditis elegans] pir||T19544 hypothetical protein C29A12.3 - Caenorhabditis elegan
  Gene Ontology: Mol. function=DNA ligase activity; Cellular component =nucleus; Biological process=DNA replication
  Coding regions on vcDNA: vcDNA=SeqID_89822; Strand=+; Position=1-471
GGYLLACYNNDSEQYESIAKIGTGFKDEDLKSQFKEFQELRIDKPRSYFAFDPSLAPDHWFEPSVVWEVKAADMSISPRHLAARGLVDAEKGISLRFPRFIRNRADKKPENATSSEQIAEMYRNQDHIKNQKDXKVDFDEEEEGEEKKEEADDEKEE

SEQ ID NO: 163400 - protein, 279 aa, Heterodera glycines
  Homolog annotation: Hit_ID=NP_741809.1; Match level="QueryCoverage =89%, HitCoverage=92%, E-value=1e-69, Identity=51%"; Hit description =beta Carbonic Anhydrase (30.7 kD) (bca-1) [Caenorhabditis elegans] gb|AAK39291.1| Beta carbonic anhydrase
  Coding regions on vcDNA: vcDNA=SeqID_89823; Strand=+; Position=67-906
MPGIKRLFDGILRFRKTLRPSMVKEFEKVRDHPDPSAMLFTCMDSRLQPSKFMGAQIGELFVVRNSANMVPVAKSFGDSGGEVSVTTEPAALELAIRRGNVRRVVICGHSDCKAINTLYDLYHGRPFDAESPMDHWLRRNGHQSVHKLTQLLMAGPGTELEFASENGLMAFCAHIDRTDQLNAVDKLSQINTLQQLTNIASHEFLREYIVTKKVGLDAMWLDIFNGKIYIFSRMQKLFLPIDEKTSADLLREAIGQIEEENENGGEKRRECRKERHGRT

SEQ ID NO: 163401 - protein, 147 aa, Heterodera glycines
  Homolog annotation: Hit_ID=NP_500326.2; Match level="QueryCoverage =95%, HitCoverage=53%, E-value=9e-44, Identity=47%"; Hit description =heterogeneous nuclear RibonucleoProtein A1, RNA binding protein (36.3 kD) (hrp-1) [Caenorhabditis elegans
  Gene Ontology: Mol. function=heterogeneous nuclear ribonucleoprotein; Cellular component=cytoplasm; Biological process=RNA processing
  Coding regions on vcDNA: vcDNA=SeqID_89824; Strand=+; Position=203-643
LKENGIDRSHQRSGKSGSLEPEQFRKLFIGGLSLNTTDESLHAFYSQFGMLVDCIVMRDAQTKRSRGFGFVSFQTADEVDAAMSARPHTIDGKVVDPKRAVPREQSAKAESNVSTKRLYVSGVRDEHDEESFMHYFTEFGPVAKVEI

SEQ ID NO: 163402 - protein, 219 aa, Heterodera glycines
  Homolog annotation: Hit_ID=NP_494763.1; Match level="QueryCoverage =98%, HitCoverage=86%, E-value=6e-57, Identity=50%"; Hit description =u2 snrnp-specific A' protein (28.9 kD) (2E615) [Caenorhabditis elegans] gb|AAK31542.1| Hypothetical prote
  Gene Ontology: Mol. function=pre-mRNA splicing factor activity; Cellular component=cytoplasm; Biological process=mRNA splicing
  Coding regions on vcDNA: vcDNA=SeqID_89825; Strand=+; Position=3-659
MVRISVDVVNDAYQFINPCKQREISLRNLQIPTIENLGVTRDQFDVIDLTDNNIRKLDNLPRLKRLETLLLHNNRVDFISKEIGDQLTKLSTLVLTNNNLAQLGDIDVLASCPRLEYLSLQGNPLTHLPKYRQYVIYKLKNVRVLDYKRIRLAERQAAKKLFKGESGARLKSELVKRSQQISEGGEETEQPPKKRATEEQKKIRELISGAKTLVDVERV

SEQ ID NO: 163403 - protein, 208 aa, Heterodera glycines
  Coding regions on vcDNA: vcDNA=SeqID_89826; Strand=+; Position=197-823
KMRKKKCGYKVHEYQGFGIPGILVKNPGIRSRFPSFLTGKKAGNPSRFFFVFPSGKFFPALSKYCLLHFKMLPLFVTNKLLTTQIVRTNLSLRLPSRQKNFGPNYYTEKQWWITRKIKKLFMRFPILERTLILGILFSTLAIPFITQRKKLLNMRNNLSDDEWADFTQKHKATILARLKFGQNLHLPFYNKDKALEQDEQTQKTFMDS

SEQ ID NO: 163404 - protein, 113 aa, Heterodera glycines
  Coding regions on vcDNA: vcDNA=SeqID_89827; Strand=+; Position=1-342
TSRNYASNTELSDDASAGEMERENRRVRSNRLSQQRYREKGNEARNLLPQLYSRIAELERENNLLKDLLWRERDPNSFAVAQQQKMEWNRANGQTMDMENAFPQRAMSETSVN

SEQ ID NO: 163405 - protein, 213 aa, Heterodera glycines
  Homolog annotation: Hit_ID=EAA59951.1; Match level="QueryCoverage =83%, HitCoverage=19%, E-value=7e-10, Identity=25%"; Hit description =hypothetical protein AN3743.2 [Aspergillus nidulans FGSC A4] ref|XP _407880.1| hypothetical protein AN3743.
  Coding regions on vcDNA: vcDNA=SeqID_89828; Strand=-; Position=3-641
MDMNLTNGGDVVSVQQRQNGGVGPTSLSSFNSFRQPVPPPPPPQNRLSLNVDFADRTSASSPTPLPPTSPIPKIQPQMLQQQSSNNFHHHHHHNLHHQQQLSSSSTFSTSPSAKVPMPPPPLPPPPPFIRRPVVMPTENLSPSNNAPLTNGRGVTSPKKSSSSALRLSFFNGSPLNFFNNSKVVAEKSVPAPPISPPPKAMPSAAETNGLSNG

SEQ ID NO: 163406 - protein, 208 aa, Heterodera glycines
  Coding regions on vcDNA: vcDNA=SeqID_89829; Strand=+; Position=2-628
LTDAGQLVALTGASGVDRTTLFNTLLNRNLKSLSVEGQLLINAHSLGQFINYASGVFGSSFVVSNILRVLSGFPIVFRIQKADRRRYTPTERMRDMQQNINELIRINRVNAETIQSQAETIRILMGLPGVRQMYDEHQANANQNANQNANQNAPIQNIQYAQPLQIAQAGNFQNLNQLPNLQQNQQQYGQYPFVPTPLGYPPAPQGNP

SEQ ID NO: 163407 - protein, 202 aa, Heterodera glycines
  Homolog annotation: Hit_ID=CAE57069.1; Match level="QueryCoverage =97%, HitCoverage=94%, E-value=2e-17, Identity=32%"; Hit description =Hypothetical protein CBG24963 [Caenorhabditis briggsae]
  Coding regions on vcDNA: vcDNA=SeqID_89830; Strand=+; Position=26-634
MRSVKHGGKKGMRFRYKLSAVKRQNKKQKKKQRNIAGCSLIKKAWQTQLSSRQNLSAMGLVYDPNEALKKNPEFAMEMDQSEIEVIGLPEAKALGSVKEQKKATKSKKACPKLNKSEAESSKVVLELQQIALEGAQQMAEQKQRKRERAKLQQSDIEFCQKMLQRHGENYEGMSRDPLNIWQNTPRQIERKIGVYKRSIASD

SEQ ID NO: 163408 - protein, 281 aa, Heterodera glycines
  Homolog annotation: Hit_ID=NP_510674.1; Match level="QueryCoverage =77%, HitCoverage=76%, E-value=2e-44, Identity=47%"; Hit description =carbonic anhydrase (28.1 kD) (cah-3) [Caenorhabditis elegans] gb|AAB52498.1| Carbonic anhydrase protein 3
  Gene Ontology: Mol. function=zinc ion binding; Cellular component =mitochondrial matrix; Biological process=one-carbon compound metabolism
  Coding regions on vcDNA: vcDNA=SeqID_89831; Strand=+; Position=43-885
MAATIASHAPQMKQQNVQVAEEETFGKTNGGMPNGAQKQQNGQAKEKQKVGQTAPVARPLTVKDWDYDERGQCGPKHWLRIAKCEHLGDHQSPIDFQLSKMRVHPLNIHPLCLVNFKKPLAGQLINTGCGIQFQPDPQIEPPEIYGGLLDQNYRFVQYHFHWAQNDNEGSEHTIGGLRYPAELHLVHQGVKNPSKLAVLGIFLKLDNESENGEKKKFVFSAEEMEALKKVIEFEQNAAIDTEHSLSSKLPPNCCQEMASSAEHFVSSFVRYEGSLTTPPCS

SEQ ID NO: 163409 - protein, 229 aa, Heterodera glycines
  Homolog annotation: Hit_ID=NP_957282.1; Match level="QueryCoverage =100%, HitCoverage=45%, E-value=1e-96, Identity=75%"; Hit description= similar to signal recognition particle 54 kDa [Danio rerio] gb|AAH67588.1| Similar to signal recognition
  Gene Ontology: Mol. function=ATP binding; Cellular component=signal recognition particle; Biological process=signal transduction
  Coding regions on vcDNA: vcDNA=SeqID_89832; Strand=+; Position=1-687
KDSVDVGSVIITKLDGHAKGGGALSAVAATRSPIIFIGTGEHIDDFEQFRVKPFLQKLLGMGDIEGLVEKVTEMGLEDNEELIKRLKQGQFTLRDMYEQFQNILKMGPFGQIMSMIPGFGTDFLSKGNEQESMSRLKKLMTIMDSMADNELDHPKANDLFNKEPTRLVRVAKGSGTAPQDVKELLSQYKKFADMVKKMGSIKGLFKGNEVNPRNINQNQMARLNQQMAK

SEQ ID NO: 163410 - protein, 74 aa, Heterodera glycines
  Homolog annotation: Hit_ID=NP_497276.2; Match level="QueryCoverage =95%, HitCoverage=23%, E-value=3e-09, Identity=53%"; Hit description =RNA-binding protein S1 serine-rich domain like (rnp-4) [Caenorhabditis elegans] gb|AAK21429.2| Rnp (rrm r
  Coding regions on vcDNA: vcDNA=SeqID_89833; Strand=+; Position=28-252
MVERRKESPKRRRRSSSSSSSGSSSSTGSSSSGSSSSSSTTASRSPSPKKQRAAARPSARDDRTTRRSPRRLTC

SEQ ID NO: 163411 - protein, 111 aa, Heterodera glycines
  Homolog annotation: Hit_ID=NP_491381.1; Match level="QueryCoverage =82%, HitCoverage=30%, E-value=2e-15, Identity=48%"; Hit description =ribosomal protein L19 (33.7 kD) (1F78) [Caenorhabditis elegans] gb|AAK39323.1| Hypothetical protein Y119C
  Coding regions on vcDNA: vcDNA=SeqID_89834; Strand=+; Position=230-565
VKLKPPPWTLQWFKYDVKGIEDTWTLATPWFKRKFIASKDLLELRKYDVIRHYREAGQELEHDLKVQKRMLEFIEEYRRKRGEPKRKLLKSAGGKLREISLFVTSEDVKSK

SEQ ID NO: 163412 - protein, 231 aa, Heterodera glycines
  misc_feature (63)..(63): Xaa can be any naturally occurring amino acid
  Homolog annotation: Hit_ID=NP_502029.1; Match level="QueryCoverage =98%, HitCoverage=43%, E-value=9e-81, Identity=63%"; Hit description =pyruvate kinase (56.2 kD) (4L677) [Caenorhabditis elegans] emb|CAA93424.2| Hypothetical protein ZK593.1 [
  Gene Ontology: Mol. function=pyruvate kinase activity; Biological process=glycolysis
  Coding regions on vcDNA: vcDNA=SeqID_89835; Strand=+; Position=3-698
PAQKVFLAQKMMIAKCNMAGKPVITATQMLESMVNKPRPTRAEVSDVANAVLDGSDCVMLSFXSAKGDYPVESLKTMHDICLEAETAFFHSRYFEELLQNTPSPTGPGETIASAAANAARRCRASAIIVLTTTGKSAQECSRFRVPIPVLAITRYEQVARQLQLCRGLFPLYYPHMERDTEWTEDVNKRIAYGIGVGKERGFIHNGDFVVIVTGWQAGAGSTNTIRLQKVE

SEQ ID NO: 163413 - protein, 108 aa, Heterodera glycines; identical to SEQ ID NO: 147910
  Homolog annotation: Hit_ID=NP_497406.1; Match level="QueryCoverage =96%, HitCoverage=91%, E-value=5e-36, Identity=76%"; Hit description =ATP synthase (12.1 kD) (3C509) [Caenorhabditis elegans] gb|AAK26152.1| Hypothetical protein Y82E9BR.3 [Ca
  Gene Ontology: Mol. function=transporter activity; Cellular component= proton-transporting ATP synthase complex (sensu Eukarya); Biological process=energy pathways
  Coding regions on vcDNA: vcDNA=SeqID_89836; Strand=+; Position=44-370

SEQ ID NO: 163414 - protein, 107 aa, Heterodera glycines
  Coding regions on vcDNA: vcDNA=SeqID_89837; Strand=+; Position=3-326
LSFVERTVQSLLDKKMIVRQEIDMFEATQIGSATFNANFNPQMALDMCNDLGANLGKGIVLISHFHLLYNCVPLDVAVQVDWNLFYNEVIFGAEQRGAAANSFDGFA

SEQ ID NO: 163415 - protein, 243 aa, Heterodera glycines
  Homolog annotation: Hit_ID=CAB88203.1; Match level="QueryCoverage =100%, HitCoverage=80%, E-value=1e-100, Identity=67%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_89838; Strand=+; Position=79-807
MHEAKIIVGIASLCSLAAILATLVVIPQLYTQINEMNNRVMDGVQAFRVNTDSAWTELMEVQISVTPPTRPRENPFNSIFLRQKRQGLPPQCVCQLQQPSCPPGPPGPPGPPGTPGEPGGAGQPGSPGQPGQQAPPCPPPVSTCQKCPAGPSGQPGSQGPPGPPGNDGQPGQPGQGGGQGPPGPPGPQGQPGQPGQPGGPGQPGQPGQPGIKSTTIPGPPGPPGNPGAPGQPGSPGQPGNPGG

SEQ ID NO: 163416 - protein, 196 aa, Heterodera glycines
  Homolog annotation: Hit_ID=NP_501358.1; Match level="QueryCoverage =91%, HitCoverage=94%, E-value=4e-54, Identity=56%"; Hit description =putative protein of bilaterial origin (21.3 kD) (4I894) [Caenorhabditis elegans] gb|AAB92069.1| Hypotheti
  Coding regions on vcDNA: vcDNA=SeqID_89839; Strand=+; Position=32-619
MNICASKCCLASPIAHRSHSVAFPPFVRRFASHGHDDNKPHPIDDPDIPRQPDMYRPGSDSFAYENPWPMLNKGRLDWLFNDGWRRPLAADQGAHMRRQWIYFKCIPRDEHKDWKKWHGTMPIFGTGCFVMLTFVWQYCNSDWPSAKEWALREAHFELVRRERAGLPLISPDLIERSRVEAALPAEEELRDFEILI

SEQ ID NO: 163417 - protein, 81 aa, Heterodera glycines
  misc_feature (52)..(52): Xaa can be any naturally occurring amino acid
  Coding regions on vcDNA: vcDNA=SeqID_89840; Strand=+; Position=3-248
LKPEQVTVQNLLIENGQLIETVAEYQRMGKIVEATKYQERLHRNLIYLAKLXIRHVLLTFYWKSVERYPQRMSRHRQPNLC

SEQ ID NO: 163418 - protein, 195 aa, Heterodera glycines
  misc_feature (134)..(134): Xaa can be any naturally occurring amino acid
  Homolog annotation: Hit_ID=NP_596868.1; Match level="QueryCoverage =89%, HitCoverage=63%, E-value=3e-21, Identity=31%"; Hit description =RAD1 homolog isoform 1 [Homo sapiens] ref|NP_002844.1| RAD1 homolog isoform 1 [Homo sapiens] gb|AAP35554.
  Gene Ontology: Mol. function=damaged DNA binding; Cellular component =nucleus; Biological process=DNA damage response, signal transduction resulting in induction of apoptosis
  Coding regions on vcDNA: vcDNA=SeqID_89841; Strand=+; Position=88-670
DRAHRQEQQQEKFYSQQQMSEESEEALFCISKHDVKEISQVVKAMAFRDHCTLNVSNEGIRLAVDDQHNQQGSAYFRSEHFQDFNFRTQTCSIKIPMRPLMEALNMFSGTMTMVQISWNGEGFPLLVILEDEGXGVVVHTEIRTLIAPEILEFDFDNENVTAKAILNSLPIREIMRDLDDSAETVVLTFTPGYLQ

SEQ ID NO: 163419 - protein, 223 aa, Heterodera glycines
  Coding regions on vcDNA: vcDNA=SeqID_89842; Strand=+; Position=1-669
KNQNADIEHLSTHYELDQNLFKNKTLREFCAAIHSFYGKCSTNILDHFKKRFNILQFARHLPHFFVGLNSTWIYEFVVLLETTGLNGHILDNDFEMDDNDRFIVNTQLQLLLQEAFRVSWLQNSPFHDKICVSLMRLSPTSDDRLAEHEKRLEHRLKNPPKLELNIVVPKDNASNKNKDLALSLAFPPVVVWSYRQMFYHLLLLNRAKHWMYRKYFALKGTNC

SEQ ID NO: 163420 - protein, 124 aa, Heterodera glycines
  Coding regions on vcDNA: vcDNA=SeqID_89843; Strand=+; Position=13-387
FSVLSFLFVVNLISFFFLTNNLCCVIEQMSTVSNGKAESSMRRYIYILPYLPTGIASYYFYKAAQLARKWATVHKFGPFKVSAAHGFALLIPMPHLVILAFQIAYTRMTRRTDEKIKMKQNVSK

SEQ ID NO: 163421 - protein, 200 aa, Heterodera glycines
  misc_feature (122)..(122): Xaa can be any naturally occurring amino acid
  Homolog annotation: Hit_ID=CAE68867.1; Match level="QueryCoverage =100%, HitCoverage=32%, E-value=2e-64, Identity=56%"; Hit description= Hypothetical protein CBG14830 [Caenorhabditis briggsae]
  Coding regions on vcDNA: vcDNA=SeqID_89844; Strand=+; Position=1-601
VAVDLAAIIVEKNVNSFLSVVDIPKPSLYDYFAFLFALATILWANLLCKSDSNNIFKVHRLMLVLVFLKSLTLLFHGVNFYFVSVYGHERELWAIIYYVTHLLKGALLFGTIILIGSGYTFXKQFLSDRDRRLFIFVLPLQILANIAMIILEKSEFSDQRYLFWLEMFTFLDIVCCMSILLPILWSIAFLTECAAKTTDG

SEQ ID NO: 163422 - protein, 204 aa, Heterodera glycines
  Coding regions on vcDNA: vcDNA=SeqID_89845; Strand=-; Position=3-614
PPPHPPPPPKRGHRRPPSPPGRAPSPPGSPPPRPQRPPRSTRASRRDGRLEQWEKRRNDIQRRQPVVRDLLAEAAAAPLPESDTDDDYMLESGLALPAPTQYYGDLPVLPYNAQREIEQMDTDQQRIAIRRKLKKDEAYDDDSEHKKYRVYYPPSPPRLPLPPRAKAKIEPPPSRPTAKREPQKPTKLELKPSKFEPDSRPKVA

SEQ ID NO: 163423 - protein, 184 aa, Heterodera glycines
  Coding regions on vcDNA: vcDNA=SeqID_89846; Strand=+; Position=42-593
MFMHHIWAHVAQQKHTDSEEQFINMQAEQHNANSIITNGTNNGTDTATGDEHLSDVSRLHMCPECLLEQPTPHRAHLHYHRVHKRGKRHLLDKKPGLLHVCNICEQVFDAKAIASHCAVHHLPDKGAQLALPYGCRFSAGVKCQFRASNRSALLRHFYVRHVGTHVVLCPFCLLTFPVPPANKR

SEQ ID NO: 163424 - protein, 212 aa, Heterodera glycines
  Homolog annotation: Hit_ID=NP_492693.1; Match level="QueryCoverage =77%, HitCoverage=22%, E-value=6e-09, Identity=26%"; Hit description =CEll Death abnormality CED-12, abnormal cell MIGration MIG-16, ELMO, cell-corpse engulfment and cell migr
  Coding regions on vcDNA: vcDNA=SeqID_89847; Strand=+; Position=1-636
MSNFHLSSKVLNYIDTRPKENEVKGAIKLDVNLRIFIKNERSVEKEKSRKEMATNIYATLDKKEPLAAFIARIGDTLALTEEPENYALMFEEKRRFVTEYNKPSVAQGFFLLLTASPSNFAKHFLAQLGQGSCSAWPHLPLFVSLCADPAFAEAFTALNGVHCLAEVIEGFSDEWHPFEPNAPPLFSLMRSLLTFMQQFPVLCPWADFSPQF

SEQ ID NO: 163425 - protein, 108 aa, Heterodera glycines
  Coding regions on vcDNA: vcDNA=SeqID_89848; Strand=+; Position=43-369
IFFLVHCHSQRFISQIPSAVPFSVRLPPPPPVLLFLCSSADLTPSPPFGPQLFLISAILCLFLLLSASSSAVILQLLLSVFCLRFRPFYNCIILSIEQLWHYFLLLVC

SEQ ID NO: 163426 - protein, 164 aa, Heterodera glycines
  Homolog annotation: Hit_ID=NP_492549.2; Match level="QueryCoverage =91%, HitCoverage=26%, E-value=2e-21, Identity=36%"; Hit description =Arginine-tRNA-protein transferase, N-terminal and Arginine-tRNA -protein transferase, C-terminal family me
  Coding regions on vcDNA: vcDNA=SeqID_89849; Strand=+; Position=51-542
MARQQLNIRRRSVVSYVGISEHGQCGYCKFTKRAHDKAKFAASTSECNASVDASTVASSTNNDGQQQANPPNAHDENANDDTNGGGDSAVFGLWAHRLTVHHYQWLANRGWRRSGRFLYKPLMGRTCCPQYTITLDVHKFRLSHTQKRVLRTMRDFLRTDQRPK

SEQ ID NO: 163427 - protein, 216 aa, Heterodera glycines
  Homolog annotation: Hit_ID=NP_510634.1; Match level="QueryCoverage =77%, HitCoverage=51%, E-value=7e-42, Identity=49%"; Hit description =misexpression suppressor of KSR (35.6 kD) (XQ738) [Caenorhabditis elegans] emb|CAA92227.1| Hypothetical p
  Gene Ontology: Cellular component=cytoplasm; Biological process=cell differentiation
  Coding regions on vcDNA: vcDNA=SeqID_89850; Strand=+; Position=8-655
MDKQTFGGDSSANSAAEDKMSGCCSEHIVEIEWKHFDYLSALSGLYTASVERRKCNLLVLVQGNLDNLEGKMVILTIHDVGKNHLSFVDFVNSLSMAPLRGRSLFLHICVPGQEPEAPIFAGSSFPSMDQLGHAMVQVLRHFKISHCFAMGEGAGADICCRFALDFPSMVRGLVLIHCTSTTHGIVENIKEIFAGLRLEDGEMTHSAWNYLLTHRF

SEQ ID NO: 163428 - protein, 212 aa, Heterodera glycines
  Homolog annotation: Hit_ID=CAE75513.1; Match level="QueryCoverage =91%, HitCoverage=42%, E-value=3e-41, Identity=44%"; Hit description =Hypothetical protein CBG23528 [Caenorhabditis briggsae]
  Coding regions on vcDNA: vcDNA=SeqID_89851; Strand=+; Position=16-651
MLERLPSQLVSRSASFVQTRMTANTVNFFMRRTGDTLWKTVTNVSMGGMKRGRARTRQPIRPLPQFYRVGMLKSSPMRIRYPGLNAPIVPQSVAELASRPFFVEEQSEQEREEVLHFVRTQVANKSSQKRHLCKERLTPLERGFSGSTFMGQRMGPPPDMDGANMDDFECICLFTDRITEMHSIRGRVFSTRALVFVGNGNKVGGFALARAS

SEQ ID NO: 163429 - protein, 246 aa, Heterodera glycines
  Homolog annotation: Hit_ID=P21250; Match level="QueryCoverage=97%, HitCoverage=98%, E-value=4e-44, Identity=43%"; Hit description =Immunodominant antigen Ov33-3 precursor
  Coding regions on vcDNA: vcDNA=SeqID_89852; Strand=+; Position=43-783
MHFVLIAFCIVWQLVVANNVEQPANRAKRFTSFGSLSTIGGRVGCVVSKNKLFVNGHFTKDLSEDEQEELKQYQEQLDQFKSEVKTYLEERQKQFRNQVARQGGAEAKEGGTQLKKPEPPKKPSFCSDKATTQYVFDGCSVQGDNVYIGDTFVRKLSPDEQKELAQFDQKFTAYQKAVTAGFRKQVEEMFGQHFGALFGASNLSPSTAEDKQQAVPSSGAELAPAGAENGTAPEAPKTPSFCTLLV

SEQ ID NO: 163430 - protein, 319 aa, Heterodera glycines
  Homolog annotation: Hit_ID=XP_320889.1; Match level="QueryCoverage =97%, HitCoverage=36%, E-value=1e-43, Identity=32%"; Hit description =ENSANGP00000012033 [Anopheles gambiae] ref|XP_313651.1| ENSANGP00000013044 [Anopheles gambiae] ref|XP_314
  Coding regions on vcDNA: vcDNA=SeqID_89853; Strand=-; Position=1-957
AQRQSGTNQRQHKNANSSGKPTRGRPTLPCGSCGKIDHWRSDCSFKDATCFKCNKKGHISTICRSKKKMAPPNSHRSFHSVKVDANCLHVGTTQGRWWKLCILINGRQTSMNGDTGAQATIISLQTWRELGEPELTPSDIDAKNCNDQPFALLGKFQCTVQFADKPPQILIAYVSGEVGHNLLGLPWIEALEIIPRQILFPSSKSADQATMIENFSAVKPPNKSINNVSTLKAVLQKDFPEVFEEGLGHCSKAKAHLILRSDAKRVFCRARPIPHGAMEAVNAELDRLLQIGAIKPIDFSHWAAPILAVKKKNGKTRVC

SEQ ID NO: 163431 - protein, 244 aa, Heterodera glycines
  misc_feature (182)..(182): Xaa can be any naturally occurring amino acid
  Homolog annotation: Hit_ID=CAE71346.1; Match level="QueryCoverage =90%, HitCoverage=56%, E-value=1e-52, Identity=46%"; Hit description =Hypothetical protein CBG18249 [Caenorhabditis briggsae]
  Coding regions on vcDNA: vcDNA=SeqID_89854; Strand=+; Position=97-830
MSARIQHEAFFEHFGIVLDNAEGVYFSGQEIAGKVVIECREPRRISELLLEVKGRARTHWTKSRKMCSENETYFCEQFNTEYTRKLPKTEAENDAGGETPREGGRTVAERRRESIKMMGRLLHVGTHEIPFSYALPKSLPSSFEGEFGFVRYTCRAICESPWDFDTVCFLPFTVIGIEDLNXRGRGSVSAEFRLAKGGLTPGENVPMNAKVRNQSGRTLRGLELRLSKDVVYKWAIHSFLCPKS

SEQ ID NO: 163432 - protein, 241 aa, Heterodera glycines
  Coding regions on vcDNA: vcDNA=SeqID_89855; Strand=+; Position=3-725
EAHLQTLNRNTVVRHCLSMDLSRLLVFLSLVDAKINEHLMSRFNLVLSHRHNLQSSSYSARLMNCFSSAVSRIQHARAHIYHSISDIGVHVDDNGFNRLFPQLLHYERATEPPQADITLTFIRPGATPSHSQIPSVVSQPPSRDSPPHSDSTPNPPSHSQQNNPTALNSLLSGFMSFAHQLLGGVPDQNHPRHPTISPRMSSRSVSFAPRSSASSRSTNSTGLTGQFPRPFRHVQGSQRRF

SEQ ID NO: 163433 - protein, 125 aa, Heterodera glycines
  Coding regions on vcDNA: vcDNA=SeqID_89856; Strand=+; Position=263-637
FFQNCSFQILKMVLLTEKIAKILNCRVSELRDRLNHPSDCETVVKALTGHRVKTTYKDRNGYTKSFAFGGITAQGAAITMAYGRLGRPFNVNVAAHFYVRHRIKLRHPFLHCAVESFPEGQEDRF

SEQ ID NO: 163434 - protein, 338 aa, Heterodera glycines
  misc_feature (257)..(257): Xaa can be any naturally occurring amino acid
  Homolog annotation: Hit_ID=NP_504656.1; Match level="QueryCoverage =99%, HitCoverage=98%, E-value=1e-132, Identity=72%"; Hit description= malate dehydrogenase (35.8 kD) (5G996) [Caenorhabditis elegans] gb|AAD14720.1| Hypothetical protein F46E
  Gene Ontology: Mol. function=malic enzyme activity; Cellular component=mitochondrion
  Coding regions on vcDNA: vcDNA=SeqID_89857; Strand=+; Position=45-1059
MTSQPIRVLVTGAAGQIGYSLVLQIAKGDVFGKDQPIVLVLLDIPPLTEVLTGVHYELVDCALPNLFGVEAVTTEEAAFKDIDYAFLVGAMPRKEGMERKDLLAANVRIFKSQGEALAKFSKPTVKVLVVGNPANTNALICAKYAASKIPAKNFSAMTRLDHNRAMAQVAQKCADGTTVGMVKNVIIWGNHSSTQFPDIRHAKIAKGGSETLAYDAVKDTAWIQDQFIKTVQKRGAVIIEKRKLSSAMSASKAACDXHMRDWFFGTPSDGRWVSMAVPSDGSYGIPEGLVFSFPVTIDAQKEWKIVQGLDLDDFAKQKIDITKKELLAERDEALAACK

SEQ ID NO: 163435 - protein, 317 aa, Heterodera glycines
  Homolog annotation: Hit_ID=NP_500341.1; Match level="QueryCoverage =76%, HitCoverage=51%, E-value=6e-96, Identity=67%"; Hit description =nicotinic receptor family member (53.3 kD) (4E181) [Caenorhabditis elegans] gb|AAB92023.2| Hypothetical p
  Gene Ontology: Mol. function=serotonin-activated cation-selective channel activity; Cellular component=integral to plasma membrane; Biological process=synaptic transmission
  Coding regions on vcDNA: vcDNA=SeqID_89858; Strand=+; Position=127 -1077
MRDRASDSYEDAKQGAQDRYERAVSSLPPSYSLPMNSLSPFSSSVPHLPMPFSSSSSPSSASSSSSSSSAAPSDSLLLDYLFSGYDKRIRPFSDGHVPVLVELTIVLAILTELRENQQAASFVISHVQKWTDPRLSWDPAAFSGLRQIVLPRADVWLPKLFIYNSMDTKEMLADNYFDVRLTHQGKLKINIPHYVTCICRLDIALFPFDTQFCAIAQASPLLGVEEMDVNVTMPPKDSYFSGNAEWELFNVSVRDTKFWEDGERRVEVHYVMHMRRRPVYYLTVIVAPTFLISFLSILGIFAPGTNEGPRSEKVSLG

SEQ ID NO: 163436 - protein, 224 aa, Heterodera glycines
  misc_feature (142)..(142): Xaa can be any naturally occurring amino acid
  Homolog annotation: Hit_ID=CAH91449.1; Match level="QueryCoverage =92%, HitCoverage=19%, E-value=8e-22, Identity=33%"; Hit description =hypothetical protein [Pongo pygmaeus]
  Coding regions on vcDNA: vcDNA=SeqID_89859; Strand=+; Position=68-740
SHVTLTFRFCLVTIGRFLLSTLALTNQPIHDLYTIAVGLYACWICVRLGLLSREWARRGWTYVKKVGTGLLPFECPVGSFSAVQCHGVSAGSCLCRRFSFVGRSFPLCLSLYFQMLVISPLRVAIFQSPLFFPWKEWAMGVXHFKIVCASGLMGPDCGLKTAFEQVQTTTCDGLSLFVFKMYADVIWDIRLRDLYTNLVFPIENTLTFMIAFPYVLSNFLLFFV

SEQ ID NO: 163437 - protein, 326 aa, Heterodera glycines
  Homolog annotation: Hit_ID=AAM61698.1; Match level="QueryCoverage =54%, HitCoverage=47%, E-value=5e-16, Identity=29%"; Hit description =UVB-resistance protein-like [Arabidopsis thaliana]
  Gene Ontology: Mol. function=Rab guanyl-nucleotide exchange factor activity; Cellular component=vesicular fraction; Biological process =endosome organization and biogenesis
  Coding regions on vcDNA: vcDNA=SeqID_89860; Strand=+; Position=2-979
VQLVHSEFPPPSVALSHQFDHWDALRGRKGIDKFEHFSAASSTKSNRFLVCTAFGAFLATNFENCAVLERICDSRLGKNPKEVKRFELPFRIGKISAGRDHLIILDSLNGEIWSFGTGTRGELGTGRVEADNWAEGPRRIPSFSEADIRCVDIESGAWHSLALTAEGDVYGWGWNGHGQIGHPSTEFSIQPTPFPFDLGDGRATMIRCAGNNSFLLLSDGSEMEFGEICTEKPMDEQMAEKMPENGSKNGTEKDEKKGQSQEKDGKEKRQSPSAKRQRHQRTLKVAVVGCSHGQLEAIYERMVQMESQQNAKFDLLICCGDFQSLK

SEQ ID NO: 163438 - protein, 126 aa, Heterodera glycines
  Coding regions on vcDNA: vcDNA=SeqID_89861; Strand=+; Position=580-960
SAPPPPFLWSNCAFPFDQFPHFFDLSANISFGQCHSPFYCLIKIARNPSNYLHPFPNLFLISPTLRGSQMAPFSQSVPSLFLIKCAHSLLISAISPFFSSSNCPNLFWSIVFWLFLLISVTPLHLY

SEQ ID NO: 163439 - protein, 207 aa, Heterodera glycines
  Coding regions on vcDNA: vcDNA=SeqID_89862; Strand=+; Position=11-631
FHRRHPPQFPSHSIDGTQMARTALSGSATRQRSITDNSNSNWFAGDAAILRTEQQCSARQRMNASAMAKISLQKQCSPPECCYTQCSTDAPQKCHDDNDAQKAFDAVHLRSLNCFFSSFCPPFRHFLPPKVLLRLCLLFLFAVGGCPIVPGGVSATARSRRTLVPLGMDKQMFPPQIFDENAPICTAEREPCGFYSFSLDGKAPLKW

SEQ ID NO: 163440 - protein, 117 aa, Heterodera glycines
  Coding regions on vcDNA: vcDNA=SeqID_89863; Strand=-; Position=2-352
MVWLFCWCILCSLPVFDNFRLAPPVPDIYGCCCCCLNGEIPRRCGRFAAVAAPSATENGAFCWLDKANPLELFDVAEFSDEARKTVLPRNLLFWSFSLSLFDEYTAVEEGKSPKLIK

SEQ ID NO: 163441 - protein, 57 aa, Heterodera glycines
  Coding regions on vcDNA: vcDNA=SeqID_89864; Strand=+; Position=842 -1012
QKLIVFGNFPSQVHFFVEDWFISGMLGFITAALSISVDVGYEYLNHCMPFAPSLCSL

SEQ ID NO: 163442 - protein, 170 aa, Heterodera glycines
  misc_feature (125)..(126): Xaa can be any naturally occurring amino acid
  misc_feature (166)..(166): Xaa can be any naturally occurring amino acid
  Coding regions on vcDNA: vcDNA=SeqID_89865; Strand=-; Position=30-542
YSLKFALFSVHIPRTRGSAEANTDEAVVGRYDTRKRPKWRRRTDSEDASPLFVCSAVRQRILWCPMLAIVRQIHTRRDAHSAENSHKKMSNRRNRFDCCAAFGVVWRAKTCAALCRGSNATALSXXMAVTLQHFFSVPSSRMFRIQIICSGRMHRQITKVEKNCLXKLFL

SEQ ID NO: 163443 - protein, 222 aa, Heterodera glycines
  Homolog annotation: Hit_ID=XP_308965.1; Match level="QueryCoverage =87%, HitCoverage=45%, E-value=2e-75, Identity=73%"; Hit description =ENSANGP00000020214 [Anopheles gambiae]
  Gene Ontology: Mol. function=short branched-chain acyl-CoA dehydrogenase activity; Cellular component=mitochondrion; Biological process=electron transport
  Coding regions on vcDNA: vcDNA=SeqID_89866; Strand=+; Position=45-710
MRCFFPRVVRSVFPSPLSFVRSSLSTFYPIDDQLFGLDEEQRQLRQLVFRLAQKELAPFADEIDRQNEFTKLRDFWRLLGQQGLLGVTVPAEYGGSDRTYLDHCIVMEELSRASGSIALSYGAHSNLCVNQIRRHGTPVQKAKYLPKLCSGEAIGALAMSETNAGSDVVSMKLSARKTGDRRSFVLNGSKFWITNGPDADILVVYAKTSPAKHQHGITAFIV

SEQ ID NO: 163444 - protein, 145 aa, Heterodera glycines
  Coding regions on vcDNA: vcDNA=SeqID_89867; Strand=+; Position=5-442
GINITFVAMLPSNLFFLLMTMLSSSLLHQTLANKFSAETDAVNPTRLIQRRHLIRSRATHKEKMHSNVNEGYLQWEKDKFHEALGEKILPKSSRSLMDPKFLGSVEPRLLKTSADGTRTKSDSEEEKWRNWLRRHFPAARTISDQ

SEQ ID NO: 163445 - protein, 45 aa, Heterodera glycines
  Coding regions on vcDNA: vcDNA=SeqID_89868; Strand=-; Position=3-137
VCVLSKKKNREDTTKQIQKMVINFVFLSSVGVIKCPDALCQASRK

SEQ ID NO: 163446 - protein, 195 aa, Heterodera glycines
  Homolog annotation: Hit_ID=NP_496366.1; Match level="QueryCoverage =67%, HitCoverage=64%, E-value=2e-12, Identity=34%"; Hit description =C.Elegans Y-box (21.3 kD) (cey-1) [Caenorhabditis elegans] emb|CAB04257.1| Hypothetical protein F33A8.3 [
  Gene Ontology: Mol. function=transcription factor activity; Cellular component=mitochondrion; Biological process=transcription from Pol II promoter
  Coding regions on vcDNA: vcDNA=SeqID_89869; Strand=+; Position=36-620
MTTSDEKQLQVVVAANEKKQIKKSEVDFPVVLKRGVQGRVKWYSPEDAYGFIHRYDVDEDIFVHGSSIVRFNIRNKNQHPVLSIQQEVEFDVIKVRKGLEARCVSGPGGRLVGRFFNIPRRSVSGAKNQKHAVNGGLRSIRRRSDGEAIRRRRRDAWTPTKRQRLRRTLKTQRQTWPICALVRTKMTVAPWRTRR

SEQ ID NO: 163447 - protein, 225 aa, Heterodera glycines
  Coding regions on vcDNA: vcDNA=SeqID_89870; Strand=+; Position=3-677
SLSKMRLASLFSVLLFLLFIHRTIPSPSPKFDEAIKDNGIFAFDSSEDSAEEVPPSPAFADSLRSPHSSEAEEDGPSAEEEEQFVDNVAGWRPRPSFLPPFAVQNRCLKAKFFDSKSDECRPCSICGPDLYEREKCRTDSDTVCEWCLTNLRVIVRNSDFRVKCEQLIALRDQFRAALVQHSVVEGKAKPTIYSVSMFENASKLWKIELFVEMAFYITLIALVLA

SEQ ID NO: 163448 - protein, 92 aa, Heterodera glycines
  Coding regions on vcDNA: vcDNA=SeqID_89871; Strand=+; Position=1-276
ADGSIMSFKEARDAGILQLQFDGLETRLNEASALGEINPGLAEILVAPCGLSDNGLPLSLVRAFLKYQSVKGRVDDVNGEVIDPATGLGKSI

SEQ ID NO: 163449 - protein, 182 aa, Heterodera glycines
  Coding regions on vcDNA: vcDNA=SeqID_89872; Strand=+; Position=3-548
NPSVNKIHFSKDELDKILRDADEQRDFPALLRSLGQLAFRPTDGFSLPSSALSQMASHFASLSPFSAFHWANGLFALLPSAENHANSEVLIVSLLRSLVDNVPLLNANKLRAFVKTEISRQCVSFWQIGKAHLASALTLCVLRILLMELSYLEAIQNGVCRADLIAEAQNIWSQMLSADELL

SEQ ID NO: 163450 - protein, 257 aa, Heterodera glycines
  Homolog annotation: Hit_ID=NP_501120.1; Match level="QueryCoverage =99%, HitCoverage=9%, E-value=4e-78, Identity=55%"; Hit description =hect domain containing protein 1 (4H900) [Caenorhabditis elegans] gb|AAB00699.1| Hypothetical protein C34D
  Gene Ontology: Mol. function=ligand-dependent thyroid hormone receptor interactor activity; Biological process=embryogenesis and morphogenesis
  Coding regions on vcDNA: vcDNA=SeqID_89873; Strand=+; Position=3-776
LIHPEKMRLVTALLKFIEQRKSIQSDEHFDSAEREKQFDELRVEMGEAKITVEDLSLTFAVNAPARCFPYECVELIPNGASVEVNGSNVELYVKRLVDFHLNEGIREQLFMFRFGFDLVFPLSSLTCYSTSELQTLISGEQSPRWTREDLLRYSEPKLGYTRDSVGFLNFVEVLMGFNSAERKAFLQFTTGCSSLPPGGLANLHPRLTVVRKVGSGDGSYPSVNTCVHYLKLPEYSSAGILRDRLLAATAEKGFHLN

SEQ ID NO: 163451 - protein, 195 aa, Heterodera glycines
  Coding regions on vcDNA: vcDNA=SeqID_89874; Strand=+; Position=1-588
LDSLLKRAPRHRRSKKHRRSRGHHHAEHQHQRGDVFGGEADQNGQFASSGPHAKSFLTRLDSAHSPGSPNSRNSFMQMMVLDRSRQPSADVIETVCLQNGVCTCAETTCTLRCSSCARLTFREICLNIYSPHGQMQKFALTFRLNPNSVPQTVKISQSSAEYTVLENVRVVEWQSSSLDRPELLTVGSESAISPV

SEQ ID NO: 163452 - protein, 275 aa, Heterodera glycines
  misc_feature (242)..(242): Xaa can be any naturally occurring amino acid
  Homolog annotation: Hit_ID=CAE68280.1; Match level="QueryCoverage =99%, HitCoverage=87%, E-value=1e-78, Identity=52%"; Hit description =Hypothetical protein CBG13964 [Caenorhabditis briggsae]
  Gene Ontology: Biological process=autophagy
  Coding regions on vcDNA: vcDNA=SeqID_89875; Strand=+; Position=37-861
MNVNDLVNQFKSAALSVGEYLTPVLRESKFRETGVLTPEEFIAAGDHFVHLCPTWLWSKASDSSRARDYLPIDKQFLISKKVPCHHRCSEMNYNDSLEKIIKEEGDEWVDTHHFDTQTNLAPKELDDLDTINTEENEKATTGESEESGEEGEAFDLDEYIGRGGLEDEDPNRYIANTVAKVPKEAAQNESDDIGILRTRTYDLHITYDKYYQVPRSWLIGYDENGTPLTVAQMKEDFSPDHXDRTITLESHPHVGDLCLATIHPCHHASVMKHLI

SEQ ID NO: 163453 - protein, 181 aa, Heterodera glycines
  Coding regions on vcDNA: vcDNA=SeqID_89876; Strand=+; Position=6-551
MQQKCTFSLITQDKTEVVVPSDFVDQSDMLSDYAKMQRQNNGDAEELQAKFEMTNEMPLISKFHLEMIFEFLGTYREEKQKENEGAADEKQTTKSGERAAEATAEESAELSTMPKWAFDLFDKLPKNDLFLAMNAANYFGIAPFVSLSAAFVCFQILQKKGKREVAEYLNMDENDNNNNGK

SEQ ID NO: 163454 - protein, 202 aa, Heterodera glycines
  Coding regions on vcDNA: vcDNA=SeqID_89877; Strand=+; Position=3-608
NTNMKPAIITALLIAFILHQITAVIENECGQCKHCLDKNDCFLNMITAWAQNGEIEWPRVLGENPNLWGKEQKVLADAKATEDKQFQDPKFEQNFKAMNAIGMAHRGAYHYFRGEPGSAGALEQVRHFLNTSIRAGFNVHKDFAVVNVEIYKNEGADKDQFTGKLLNFVKLLKSKVPNLFIHTSVDHWSALINNDHDEFFAL

SEQ ID NO: 163455 - protein, 281 aa, Heterodera glycines
  Homolog annotation: Hit_ID=XP_319666.1; Match level="QueryCoverage =100%, HitCoverage=85%, E-value=2e-88, Identity=57%"; Hit description= ENSANGP00000021376 [Anopheles gambiae]
  Gene Ontology: Mol. function=chaperone activity; Cellular component =cytoplasm; Biological process=protein folding
  Coding regions on vcDNA: vcDNA=SeqID_89878; Strand=+; Position=32-874
MSSVPQLSASEHKERGNRYYQAGKYEEALSHYTRAIIKNPNDPTYFTNRALCNLNLKKWDSAADDCRKALDMDRKNVKANYYLGKVYVHQGQFDEAIKVLSRAHEGVLNLKQTYGDEITQLLRLARREKFRQEEDKRITQEIELQSYLNQLIDDDIAKKVNQLEDKKENDVEEKAEELKTQGDTFKKQLNNLFAQVDDRRRKRDLPDYLCGKISFELLKDPVITPSGITYDRQDILTHLHRVGHFDPVTRVPLTADQLIPNFSMKEVVDHFVQENEWAIDF

SEQ ID NO: 163456 - protein, 238 aa, Heterodera glycines
  Coding regions on vcDNA: vcDNA=SeqID_89879; Strand=+; Position=27-743
MCRFQCDQQCCPSKQTYTAKDKLKTEEQQFSRNKNVKFFSPDSSDESEDDEHHNHHHDNHHLLRTKTNLSNYNFLQSCEDNFFRSFDATKIADNFCHDSDSSLSLSSAATEEEDSEEYNSQQSDSEEDSSKTTSSSIDGSTTTFKLKSILSTSAKRSPTAEKHAYERRVSFADRWGMQLTSFRTIPNRFADRFYDELELDFNEVNFSDNTSYFWCQSLQQQRNNLQNWSLDEQGEVAC

SEQ ID NO: 163457 - protein, 134 aa, Heterodera glycines
  Coding regions on vcDNA: vcDNA=SeqID_89880; Strand=+; Position=34-438
MSPVIAPFVLAIIGIIALPTIEGAVGRQQVKLGEQYKYENVPGKLMVKRQTAASKEPQYLFAGQTAWTTDGKDRFGHAELDFATGTMTIPNFSENDLGSYTFPLEQPNFSAVNGPNGCELQGVGGTMLDLIKKE

SEQ ID NO: 163458 - protein, 86 aa, Heterodera glycines
  Coding regions on vcDNA: vcDNA=SeqID_89881; Strand=-; Position=12-272
FYYAAHSLLSPVKCQSCLLSIESVKPFKGDRSLVAIVHSIRTGGSRLVYLRITRRVSLYLDNREEPVLGGRFCETYFDAEQPGLSQ

SEQ ID NO: 163459 - protein, 185 aa, Heterodera glycines
  Homolog annotation: Hit_ID=NP_502791.1; Match level="QueryCoverage =100%, HitCoverage=100%, E-value=1e-91, Identity=88%"; Hit description=ADP-ribosylation factor-like protein (21.3 kD) (4P563) [Caenorhabditis elegans] emb|CAB16514.1| Hypothe
  Gene Ontology: Mol. function=ARF small monomeric GTPase activity; Cellular component=cytoplasmic vesicle; Biological process=G-protein coupled receptor protein signaling pathway
  Coding regions on vcDNA: vcDNA=SeqID_89882; Strand=+; Position=54-611
MISMINKLLDWIRSLFWKEEMELTLVGLQSSGKTTFVNVIASGQFTEDMIPTVGFNMRKITKGNVTIKLWDIGGQPRFRSMWERYCRGVNAIVFMVDAADKSKLEPAKSELMQLLSKPQLEAIPVLVLGNKKDLPDALDEGQLIDAMNLESIQNREICCYSISCKEKSNIDITLQWLIQHSKTAR

SEQ ID NO: 163460 - protein, 195 aa, Heterodera glycines
  Homolog annotation: Hit_ID=NP_505451.1; Match level="QueryCoverage =74%, HitCoverage=26%, E-value=5e-17, Identity=31%"; Hit description =ligase family member (60.3 kD) (5J989) [Caenorhabditis elegans] emb|CAA94751.1| Hypothetical protein F11A
  Coding regions on vcDNA: vcDNA=SeqID_89883; Strand=+; Position=44-628
MFCQWRIKVKSNNFLNSFSFYCQKQCLFSSQEKCNNKNKYLPDEDGIVRSEFQSVPIQSEPFTETLLNRIRQFSAEQPKRAIFVDAENPSNITTFGQFLSKTHSAAHFLNSIGFSSGDVACVILPNCWHFFAIFLAASMQKACISPVSTLLNEVELARIFNETKCKGVFCADSLLERILATRPLCPHLKYVVLIS

SEQ ID NO: 163461 - protein, 53 aa, Heterodera glycines
  Coding regions on vcDNA: vcDNA=SeqID_89884; Strand=+; Position=44-205
LIFHNLFLPLFASLLRLIDHRHHTYTLSDHILLYEFLRLFTIKQNMQFFGPPI

SEQ ID NO: 163462 - protein, 199 aa, Heterodera glycines
  Coding regions on vcDNA: vcDNA=SeqID_89885; Strand=+; Position=2-598
TVVDVAEETVAQSMDQLEEGIEVGTVVNEEMAQNVPEEPMASVQLAKRSKPFNQRIVENIGWRKEFGRVPPKERDSLGLIECIDGATVGCNQRLLASLKSSNPSLFLRTDKFRSRNACGNKKSEVSLQIDEFDEFYKRWISNYEQEGAGKSHGEENSEHDGKEESESGDEEEEPPQNSRGPVIKCPRMPKIRINLKRRI

SEQ ID NO: 163463 - protein, 235 aa, Heterodera glycines
  misc_feature (203)..(203): Xaa can be any naturally occurring amino acid
  Homolog annotation: Hit_ID=CAB56513.1; Match level="QueryCoverage =86%, HitCoverage=70%, E-value=2e-40, Identity=45%"; Hit description =putative thioredoxin-like protein [Mortierella alpina]
  Gene Ontology: Mol. function=thiol-disulfide exchange intermediate activity; Cellular component=intracellular; Biological process =response to oxidative stress
  Coding regions on vcDNA: vcDNA=SeqID_89886; Strand=+; Position=2-704
MKKQPSALLPQRQQFRQLNPPLTHTMTSLANLHNATDDDHFGRLLESSVQSNVVVLNFHADWAPQCKQMNEVFGELAKLHPAVDFISIEAEELVDTSELFDIAAVPSFVVLKAGKPVDRVNGANAIELTNIVEKHAKAAKSRSAGANADFSDTASTAAGGAGADASMAAAPLAPAALEARLKQLINMAPMVLFMKGTPQQPRXCGFSRQTIELVSKYNARYSTFNILGDDQVRQG

SEQ ID NO: 163464 - protein, 139 aa, Heterodera glycines
  Homolog annotation: Hit_ID=NP_610662.1; Match level="QueryCoverage =98%, HitCoverage=97%, E-value=1e-17, Identity=34%"; Hit description =CG9067-PA [Drosophila melanogaster] gb|AAF58685.2| CG9067-PA [Drosophila melanogaster]
  Coding regions on vcDNA: vcDNA=SeqID_89887; Strand=+; Position=29-448
MALCVAIYDKHDALLYLRLKDRMSASPLEVQRFLHSSSDIVADKMNSPGNKATQQENFLGALLLSDRFRSLAYLTNTGTKFLLVIDAEEGTLKDHEIQLFFKNIHTKYCSAISNPFYSFGSTLQSSKIDAVVNELLTSF

SEQ ID NO: 163465 - protein, 139 aa, Heterodera glycines
  Homolog annotation: Hit_ID=EAL31744.1; Match level="QueryCoverage =89%, HitCoverage=51%, E-value=2e-12, Identity=37%"; Hit description =GA14878-PA [Drosophila pseudoobscura]
  Gene Ontology: Mol. function=signal transducer activity; Cellular component=cytoplasm; Biological process=DNA dependent DNA replication
  Coding regions on vcDNA: vcDNA=SeqID_89888; Strand=+; Position=41-460
MENADEKPPPVTSSGGTNAAAATAALAMQKIVQQHAATIANQVQQQQQQQTVSSSAVVAPSVGIASLPQYHVSAPHQNMPGSKYQQLLLFIDELGRVIRPTYNANRNAQERLKRDIVQARLLVRECMAELEQQRKQQQT

SEQ ID NO: 163466 - protein, 294 aa, Heterodera glycines
  Homolog annotation: Hit_ID=NP_500378.1; Match level="QueryCoverage =94%, HitCoverage=25%, E-value=1e-74, Identity=49%"; Hit description =TBP-Associated transcription Factor family member (taf-2) [Caenorhabditis elegans] gb|AAD12824.1| Taf (tb
  Gene Ontology: Mol. function=general RNA polymerase II transcription factor activity; Cellular component=transcription factor complex; Biological process=G1-specific transcription in mitotic cell cycle
  Coding regions on vcDNA: vcDNA=SeqID_89889; Strand=+; Position=1-882
KVSHIFNRKRNIIELELRQTVPLQKGCQNYTGPLTIVDQELEGHFAHTIQIDAAVSRHDIQCHSKGRKLKKKRIMLGTGEEVDVDLNSMDFDSPVLWIRVDPNLLLYRQMSINQPFYQWELMLLHERDVLAQQQAIETLCRFSEHKTKILLEETVRNDKFFYRIRREAAHCLVQIYNSLPESRLGESPPLIDYFRQNFGSKTSPDIPLPNNYAATSSNLQNNLLGQALPAAIGLIRGQDGRECPEYVLEFIINLIRLNDNSTNRYSDDYYRGALIHALGKTLTMSERTVEQPDC

SEQ ID NO: 163467 - protein, 201 aa, Heterodera glycines
  Homolog annotation: Hit_ID=CAE62200.1; Match level="QueryCoverage =97%, HitCoverage=97%, E-value=2e-54, Identity=56%"; Hit description =Hypothetical protein CBG06250 [Caenorhabditis briggsae]
  Coding regions on vcDNA: vcDNA=SeqID_89890; Strand=+; Position=74-679
MTAARLLKMVPSESALLVCDMQEKFREHIKFFPQILQVTCRLIEAAKLLDMKILATEQNPNGLGHTVPEIVLKKHDIPVFEKTKFSMCVPDLQRELGLSPAVRSLLLCGIEAHVCVYQSAIDFQQQGFNVHVVVDASSSRSMVDRIYAYKQLEKVGINLITSECAILGLVGDSAHPKFREVQKLIRESAPDTGLISNTSHV

SEQ ID NO: 163468 - protein, 253 aa, Heterodera glycines
  Homolog annotation: Hit_ID=NP_495593.2; Match level="QueryCoverage =71%, HitCoverage=62%, E-value=5e-48, Identity=57%"; Hit description =phosphoglycerate/bisphosphoglycerate mutase (2H888) [Caenorhabditis elegans] gb|AAK31545.2| Hypothetical
  Coding regions on vcDNA: vcDNA=SeqID_89891; Strand=+; Position=104-862
MYRRVFCYSSAPLAGALGAYAGVTMANQNSPSTEKNTSEVQQKVAKQAVVKSGTHNSQPKDVQSLGTGEITRWDYNWDKRDPFSMVIGKEYEAADEEKKKEILAKFVPTATRNIFLIRHGQYELDSKTKELTALGREQADLLGKRLAEFEVGKGKKINKCFVSTMKRAEETADIALKHLPHAAQIQKHSDLLREGAPCEPEPPLSSWRPQYYFHEDGARIEAAFRKYIHRASPSQKEDSFELFFCHANVIRYF

SEQ ID NO: 163469 - protein, 139 aa, Heterodera glycines
  Homolog annotation: Hit_ID=CAE56793.1; Match level="QueryCoverage =98%, HitCoverage=97%, E-value=2e-22, Identity=42%"; Hit description =Hypothetical protein CBG24605 [Caenorhabditis briggsae]
  Coding regions on vcDNA: vcDNA=SeqID_89892; Strand=+; Position=78-497
MICPNFVLLSLLSVSLFSSLSLADNQTITVHGQTICHRRSVKGLHVELREHDTFDPDDSLGSTTTGLDGSFKVRGLENEIGSIRPYLRITHKCDVKDELKCRRVTEIDIPKEKVNNDVYEMHFVNLNVHGHRDTENCDE

SEQ ID NO: 163470 - protein, 209 aa, Heterodera glycines
  Homolog annotation: Hit_ID=CAE49087.1; Match level="QueryCoverage =100%, HitCoverage=18%, E-value=4e-16, Identity=29%"; Hit description= novel protein similar to human HLA-B associated transcript 8 (BAT8) [Danio rerio]
  Gene Ontology: Mol. function=transcription factor activity; Cellular component=nucleosome; Biological process=regulation of transcription, DNA-dependent
  Coding regions on vcDNA: vcDNA=SeqID_89893; Strand=+; Position=1-627
ISNGFAAVPIPWVNDVDNFELAKFDYSPLPKFAENLPNRVFCNCKGTGGCSAQKGCACVEMSTIELSEPGRVHNAHLLSENAFESRFFECSSLCSCAGTCANRLAPQNDAQRNHLQIFKTLKAGFGCRALKPIRKGSFICFLGGEIFPFDYPSKKAEEFKQIVDADKVCFAFSDKVRQFAFFVRFDRFANESRFFNSACCPNNRLVHLF

SEQ ID NO: 163471 - protein, 179 aa, Heterodera glycines
  Homolog annotation: Hit_ID=CAE56474.1; Match level="QueryCoverage =97%, HitCoverage=81%, E-value=2e-20, Identity=34%"; Hit description =Hypothetical protein CBG24188 [Caenorhabditis briggsae]
  Coding regions on vcDNA: vcDNA=SeqID_89894; Strand=+; Position=20-559
HFQQTNKKMGSSASESPPPPKLVAIQDLPIYKAESVPAVRAARPVDTIGRPATFGEEVFGNFRLVALQLRDFVSEKLGVVNSSLAPIRDAANATEQFILDEQRKVLPRAVAISMGGMAGFVAAMRKGGRMRRTFYPLIGLLTMTAFCYPNETVHSVRVGIAHSQSAWHNFKQAPEPKSS

SEQ ID NO: 163472 - protein, 174 aa, Heterodera glycines
  Homolog annotation: Hit_ID=NP_509637.1; Match level="QueryCoverage =40%, HitCoverage=25%, E-value=8e-14, Identity=51%"; Hit description =putative secreted or extracellular protein precursor (XK352) [Caenorhabditis elegans] emb|CAA87334.2| Hyp
  Coding regions on vcDNA: vcDNA=SeqID_89895; Strand=+; Position=104-625
MPPTSWPNAFVSTANERNERRIVPTQSSSTSSRNRGRHRRVASSPAAPIISSGASPSSSAPLFGHRRPPPSPWPSSPSSSPRFPPFSRVSAHNRLLPLPLLLLLILPMAFSSLLIHSANALHHRHEHPQKCSIEGEICTTINAHVCRNGTCVSACTLRGMKECHCDVEEDNFCF

SEQ ID NO: 163473 - protein, 126 aa, Heterodera glycines
  Homolog annotation: Hit_ID=NP_508205.1; Match level="QueryCoverage =100%, HitCoverage=100%, E-value=9e-44, Identity=67%"; Hit description=profilin 1B (XB698) [Caenorhabditis elegans] gb|AAC69045.1| Profilin protein 3 [Caenorhabditis elegans]
  Gene Ontology: Mol. function=actin monomer binding; Cellular component=actin filament; Biological process=cell organization and biogenesis
  Coding regions on vcDNA: vcDNA=SeqID_89896; Strand=+; Position=31-411
MSWPDLVNNNLIGTGHVSKAAICGLDGSIWGKSDNFNLDATEVTAAMNGLKQPDAVLASGLRFEGEKFFVLQADTDRIIGKKMATGFFIYKTGKAFIISIYEGGVQPEMCSKTTGALADYFRSINY

SEQ ID NO: 163474 - protein, 162 aa, Heterodera glycines
  Homolog annotation: Hit_ID=NP_492437.1; Match level="QueryCoverage =99%, HitCoverage=99%, E-value=1e-73, Identity=82%"; Hit description =sorting nexin (1J640) [Caenorhabditis elegans] emb|CAA22253.1| Hypothetical protein W06D4.5 [Caenorhabdit
  Gene Ontology: Mol. function=protein binding; Cellular component =cytosol; Biological process=signal transduction
  Coding regions on vcDNA: vcDNA=SeqID_89897; Strand=+; Position=1-489
FAMSAAATQRLQAKRQTLDEAYAPPANFLEIEVVNPITHGVGKNRYTDYEVRLRTNLPVFKHKESSVRRRYSDFEWLRNELERDSKIIVPPLPGKAFKRQLPFRSDDGIFEEGFIEERRKGLEQFLNKVAGHPLAQNEKSLHIFLQMNELDKNYVPGRIRTA

SEQ ID NO: 163475 - protein, 65 aa, Heterodera glycines; identical to SEQ ID NO: 127533
  Homolog annotation: Hit_ID=NP_510604.1; Match level="QueryCoverage =100%, HitCoverage=100%, E-value=1e-23, Identity=80%"; Hit description=ribosome associated membrane protein (XQ461) [Caenorhabditis elegans] emb|CAB03157.1| Hypothetical prot
  Coding regions on vcDNA: vcDNA=SeqID_89898; Strand=+; Position=72-269

SEQ ID NO: 163476 - protein, 270 aa, Heterodera glycines
  Homolog annotation: Hit_ID=NP_493928.1; Match level="QueryCoverage =79%, HitCoverage=30%, E-value=2e-70, Identity=65%"; Hit description =Rap1GAP family member (83.9 kD) (2B519) [Caenorhabditis elegans] gb|AAK71368.1| Hypothetical protein F53A
  Gene Ontology: Mol. function=Rap GTPase activator activity; Cellular component=nucleus; Biological process=signal transduction
  Coding regions on vcDNA: vcDNA=SeqID_89899; Strand=-; Position=1-810
SINCPPFTGAIYQKFGQTTEEELFSNDSSNCAALDEFLSIIGHRVQLRHFDGYRGGLDTVHGQSGTEVRWGRVGRAYGTVCIGDAQQLQRKRHIGNDIVAIVFQEQNTPFCPDMIASNFLHAYLVVHPIEPGTDRTRYRVSMTARDDVPFFGPTLPRSSIIWKCQLRDFLLTKLINAENAAYKAEKFAKLAERTRASLLDGLYSNLKERAQFYGMAFLDSVDSATKQQQQEKHHHQWQNNGQNHHQHSQQQQLMNGSVNGGTNPMGLFHS

SEQ ID NO: 163477 - protein, 206 aa, Heterodera glycines
  Homolog annotation: Hit_ID=CAE67479.1; Match level="QueryCoverage =99%, HitCoverage=22%, E-value=2e-61, Identity=54%"; Hit description =Hypothetical protein CBG12983 [Caenorhabditis briggsae]
  Coding regions on vcDNA: vcDNA=SeqID_89900; Strand=+; Position=3-623
EHTFLQGAGQPDCSHTSDEYCQLPYYTAIHELFPPERSRWVPLPTQPPIASPLSVRLVQRQHLPGNQLNLTIAIQGGTDKLSLHITPLNGFQLRHWSLTPFDPATFGIRKTYFVFMTYGFESPGERLVWILLENNERSVSATDEVPSLELAVATKYVHGKNQNSDTLLQLRSLIANRRRTPHAGVGFWRWAITMIAGVSEIVIHFF

SEQ ID NO: 163478 - protein, 319 aa, Heterodera glycines
  Homolog annotation: Hit_ID=CAE68757.1; Match level="QueryCoverage =98%, HitCoverage=41%, E-value=4e-34, Identity=33%"; Hit description =Hypothetical protein CBG14691 [Caenorhabditis briggsae]
  Gene Ontology: Mol. function=protein binding; Cellular component =cytoplasm; Biological process=negative regulation of cell proliferation
  Coding regions on vcDNA: vcDNA=SeqID_89901; Strand=+; Position=67-1023
MAVPSISPLGRPHPPPPPRSPSRPSSKHSFAGDHGSLLQTSPINRIVDEEGQEWEVEEVQLDVSKTGLGFSISGGCDREPDLMYNDRYIRVTDISKGGAVETDRRIRIGDVILFVNDWETANREHDFAVQALKNAGTFVRLLVKRLKYPPLQKSLSQSHLSEPIASGTFQRSLSGGAADSRTLPLQPPVRSQSLHHLPMNAVATSPNVVTAMGTLPRRANVQQQFATPLNDPGRQPRWVVIRKGEMGFGFNIVGGEDGEPVYITRVAPGGAADQTGNIRMGDVLLRVNDVDLSMATHGEAAVALKAIPQGAQVKLLLQF

SEQ ID NO: 163479 - protein, 271 aa, Heterodera glycines
  Homolog annotation: Hit_ID=CAE75173.1; Match level="QueryCoverage =90%, HitCoverage=67%, E-value=2e-34, Identity=32%"; Hit description =Hypothetical protein CBG23110 [Caenorhabditis briggsae]
  Coding regions on vcDNA: vcDNA=SeqID_89902; Strand=+; Position=51-863
MIFRLGNFRHFPVNFCKLCIARFTVAFSRRIFRDHFSLFLRSKRSLLFGASLVGVSFGSNVTLEDEYKRIKTECKECDPFSPPPTDEGWTLFWCNKSLAVYRRRFVANGGNCVFEYRCIGTYEDISPNDFVTVQEDISCRLKWDKNVNSLDELDFDYNTGTQVIRWESKYPFPLWPRLYIFARRQFVDRPRKQIYILSRALSSDNFPDPSQTTVRVECYESILIVRAHDSLDKKGLDFVLSYYDDTRSSIPQKIYQYGINVIGPSFIEDVH

SEQ ID NO: 163480 - protein, 223 aa, Heterodera glycines
  Homolog annotation: Hit_ID=AAH77367.1; Match level="QueryCoverage =99%, HitCoverage=36%, E-value=4e-12, Identity=28%"; Hit description =Socs6-prov protein [Xenopus laevis]
  Gene Ontology: Biological process=intracellular signaling cascade
  Coding regions on vcDNA: vcDNA=SeqID_89903; Strand=+; Position=12-680
MIVINGAAQCSFSASNLPSISESKNLKAVAKNGAKQTISSFTELFDELAECQWYWGGISAGTASRLLQRRSPGTFLVRDSRSDRSIFSFSYATASGVYHSRIYRFNGYFCLGGPNALIRSPSLRDFVLQTVARSSVDSGETNCKKTGLSATTASRNAELPLRILMHPSSAEPTAQPVDIRVPLCRNNFVPTLRGACRLAIRRSISDCSRIEELPIPKKLKKFL

SEQ ID NO: 163481 - protein, 174 aa, Heterodera glycines
  Coding regions on vcDNA: vcDNA=SeqID_89904; Strand=+; Position=8-532
MLLSPPLLFVLSLCSLCVFGHKTPNASDGPAMPELPKALQKLSDAERNCLFTIYTMSKLFENKKVQKTLAKQLKSCDSKDTSEPDIWKSREKSNGWCEVNLERIDSEYGPVIMHAHGSIASINGARLFVKSTSGGIWIAIYQPECLKEKDESKKSEEGVVSNTLDRVRRWVLLK

SEQ ID NO: 163482 - protein, 207 aa, Heterodera glycines
  Homolog annotation: Hit_ID=CAE64576.1; Match level="QueryCoverage =95%, HitCoverage=21%, E-value=2e-17, Identity=35%"; Hit description =Hypothetical protein CBG09328 [Caenorhabditis briggsae]
  Gene Ontology: Cellular component=cytoplasm
  Coding regions on vcDNA: vcDNA=SeqID_89905; Strand=+; Position=75-698
MASQPIKAVLFDLGGVVVEYSDRNAYLNRLKIIQSNAKFVDLFEQFECGLLTIYEIEPEFLKTVMGNKSGDDLIKAANPTNLMKTKNPFVENAIRSLRSSGKYLVGLLTNNGFWVRDRSESKLTIDTSDFDFVIESCKIGARKPNADFYEMALLKMGLSAAECVFIDDLEENCKGAEAVGIRSIWLKDDDYKTAIEQLEEIIGEKLL

SEQ ID NO: 163483 - protein, 349 aa, Heterodera glycines
  misc_feature (69)..(69): Xaa can be any naturally occurring amino acid
  misc_feature (73)..(74): Xaa can be any naturally occurring amino acid
  Homolog annotation: Hit_ID=NP_498060.2; Match level="QueryCoverage =100%, HitCoverage=65%, E-value=5e-17, Identity=22%"; Hit description= putative protein of bilaterial origin (57.3 kD) (3G91) [Caenorhabditis elegans] gb|AAK21454.2| Hypotheti
  Coding regions on vcDNA: vcDNA=SeqID_89906; Strand=+; Position=1-1046
QLAVHLLVQYSTMLDITARAFQRPFAIAFLMPSQPTAKNVEAFQQAAAELLMPIIACNKRYVHSILRQXDANXXSERDQQNVQSYYSTSGNAQQIVIVSNKLKSVVQKTNAWFERVSDQLCESDGSADECFCECAGPEEFRQFVVLLAQKHSSCALLNLMELAPCKDVKLKHSIQEAYLRLTDTEVAKGLLFCGQTAVVRSTFGANSELPRHETEDPNRTEEECIPLVVARESTLKTLSYRLLRCVYPLLTGERIVILASKQRVSTGVDLLNKLNSMRICRRPEGVKWNFDSDIDTESNTMSDNNTHCQLFGISREANATSQWINGEKCEHCTVVDLGNQKMRAHEYSG

SEQ ID NO: 163484 - protein, 120 aa, Heterodera glycines
  Coding regions on vcDNA: vcDNA=SeqID_89907; Strand=-; Position=24-386
SIGISINFDDTEEHFECLLSSKLSHLPSLSLSFRPFFFFYWHRVDERLRVVAVRVRVAAICRSVAAVVSHFAAGIFHCFLLLVPSMTWHSTGGQKGDECQQNNEKNKWGRRIAAHLCQWK

SEQ ID NO: 163485 - protein, 203 aa, Heterodera glycines
  Coding regions on vcDNA: vcDNA=SeqID_89908; Strand=+; Position=2-610
KNKLFRFFLNFLFQKEKTIIPMKDENAHFTPQQISKLLNLHIKSHKCLDVKCQTERQQLLSTIEKLARNFYDIYKMFEKQKREMSRISNLYKDFCIQFGLPVKIDLVKQQEISQIDKVANMIYQHFIKIREVNKKSKVHPNFDENLQSSGLTSINGQCKKDFSGLSNRKKSGSSSSSIVAIDNENSAQKNGCETSLRETDNGK

SEQ ID NO: 163486 - protein, 178 aa, Heterodera glycines
  Homolog annotation: Hit_ID=NP_491663.1; Match level="QueryCoverage =97%, HitCoverage=95%, E-value=9e-43, Identity=49%"; Hit description =adenine phosphoribosyltransferase (20.2 kD) (1G247) [Caenorhabditis elegans] gb|AAB37633.1| Hypothetical
  Gene Ontology: Mol. function=adenine phosphoribosyltransferase activity; Biological process=nucleotide metabolism
  Coding regions on vcDNA: vcDNA=SeqID_89909; Strand=+; Position=36-572
MDEEKLKNEVANCIRSFPDFPTKDVVFRDIFPLFSNPSLIRSICAHIVTLYRQKIDVVVALEARGFLFGPIVALEMDVPFVPVRKRGKLPGSVFSATYVKEYGQDVFEIQKNALSEGQRVLLLDDLLATGGSLNAASQLISQSNAKTQAVFVIIELEGLNGRRKMDFDAEITSLVKYA

SEQ ID NO: 163487 - protein, 143 aa, Heterodera glycines
  Coding regions on vcDNA: vcDNA=SeqID_89910; Strand=+; Position=4-435
SKMRSICFCHFSAFPFSRQFFGGCHRSFSSPMTPLFLSFSLLLIYSQFASPTNAFILQELPLYRNVRNQRHATPPIGPSKPSIDYGIRRSTVSMPLVIRIEDGMPTIFVRPSRAFNFHRLNRLQEFWHRNEALRRLTQTGNRP

SEQ ID NO: 163488 - protein, 172 aa, Heterodera glycines
  Coding regions on vcDNA: vcDNA=SeqID_89911; Strand=+; Position=2-520
SHQNQSSVPLQRAVASVYNANSISTSSSSTKHAVDLINEYLTMLSVCLSHDELNKFAILMRRWRAREMPILEFAQKLLELYGPERRHLLARMRTLLRGDPSDLEALTDFLRANGVVENAAAMAASPLLTAEISLGEGTDSAKSTASSLPSAPLHFSSSHGFPSADFHRPNSS

SEQ ID NO: 163489 - protein, 205 aa, Heterodera glycines
  Homolog annotation: Hit_ID=NP_503146.1; Match level="QueryCoverage =99%, HitCoverage=66%, E-value=1e-86, Identity=75%"; Hit description =TFII(Two)B general transcription factor (33.1 kD) (ttb-1) [Caenorhabditis elegans] gb|AAG24202.2| Tfii(tw
  Gene Ontology: Mol. function=general RNA polymerase II transcription factor activity; Cellular component=transcription factor complex; Biological process=transcription from Pol II promoter
  Coding regions on vcDNA: vcDNA=SeqID_89912; Strand=+; Position=49-663
MNIVCPSHPEADLVEDARAGDLICTRCGLVVGERLIDVGTEWRSFSNESSGKDPSRVGAPENPLLSGSDLSTSIAVSFGSDSDRALANAQRKLLSSTDRQMTQAMMVIREMSEKINLTRTIQDRAAKLYKEVLESKALRGKNNEAQAAACLYIACRQEGVPRTFKEICAVSKVSKKEIGRCFKLIQKTMETNLDHITSADFLSRF

SEQ ID NO: 163490 - protein, 417 aa, Heterodera glycines
  Homolog annotation: Hit_ID=XP_468248.1; Match level="QueryCoverage =88%, HitCoverage=35%, E-value=9e-16, Identity=26%"; Hit description =diaphanous homologue-like [Oryza sativa (japonica cultivar-group)] dbj|BAD19266.1| diaphanous homologue-l
  Gene Ontology: Mol. function=actin binding; Cellular component=actin cortical patch (sensu Saccharomyces); Biological process=signal transduction
  Coding regions on vcDNA: vcDNA=SeqID_89913; Strand=+; Position=28-1278
MDDLCRRGLLTTEQTPHEPSSADKFDGADEAVLALVDKYRRTCGLPTAKRSAPSPLNSLLSPGKLPPAGKPPTPYIPTPGGSAGYAPAALLKQQQRNASFGYHSNSSSSNQDDWQALLQPPPPPPPPMPSLSSVQTALSGGTPRGILSHASSAAAAAHKRDTLRSPGTEARRPKNQTLFKNALEQIRKINEESKSGSGTVPSATSVSDPFPSSSIPPLKTPSPLRPLISTISATSTEQQHLPAPPVPPNLPRDPRLLKHGNATAAAVVVVVDKPNQQQQVRCATIPVDARPNSVLSPPCDPRLKRISAEAVPVSSPSVLPPLPKFKATVPVLNVRPVSSAAAVVVPPPPPSPPPNVSVFKQLVPSAASVSTTAPAPPNLGFKRAYGLVGMVSSGIDIPPPPPPPELAPPEEKKMMLQ

SEQ ID NO: 163491 - protein, 244 aa, Heterodera glycines
  Coding regions on vcDNA: vcDNA=SeqID_89914; Strand=+; Position=47-778
MARQQQSTASSSCSSSSMCCCNALAKMHESFVAKFRVIRPQANLITLDGDNNNDIILHEEADEDEAIAQPCTSSAGQQPRPIGGGTADELQQEAEDNESVLLNGAESPTPGAGTLGYEILAEDSKTPAPFYEMMSESELNAELAKYGHGPMGKRAAIRLLNRIYEATHPVISSDTPIPRKVRRALATDDGCGDKNGAAERQRERRTKQKIGQMLRLANKNAETETTGNYAKQNDDGGGDGFANN

SEQ ID NO: 163492 - protein, 61 aa, Heterodera glycines
  Coding regions on vcDNA: vcDNA=SeqID_89915; Strand=-; Position=97-282
FFFFFFFFFQRKRVLINKKNINVKCNVKADCEVEKDNPISRHYSNKNRRGNFSPPLNFSMR

SEQ ID NO: 163493 - protein, 237 aa, Heterodera glycines
  Homolog annotation: Hit_ID=YP_047926.1; Match level="QueryCoverage =96%, HitCoverage=97%, E-value=8e-34, Identity=35%"; Hit description =putative transcriptional activator (TenA family) [Acinetobacter sp. ADP1] emb|CAG70104.1| putative transc
  Gene Ontology: Mol. function=phosphomethylpyrimidine kinase activity; Biological process=thiamin biosynthesis
  Coding regions on vcDNA: vcDNA=SeqID_89916; Strand=+; Position=20-730
MEKSANNFSKILWTQNEHRFQQICALPFIREQKDGTLAEERYRHYIIQDTLFLEGLSSAIAVAASKATDHPKGHERAMLLLSHGIAILDTELDLHDGILRKLGLVSRSEVHMNYDQSPVCHHYVSFLAATASQQSLPVIVASMLPCYWLYREVPKWMLAERQKAGGTNTVTQYHEWIDMYCSEEYAEAVDEMLAHADELSQEADQRTLAKMATVFERSFQLEWMFWKSAYQMCQWGI

SEQ ID NO: 163494 - protein, 230 aa, Heterodera glycines
  Homolog annotation: Hit_ID=AAK70645.1; Match level="QueryCoverage =91%, HitCoverage=45%, E-value=3e-39, Identity=43%"; Hit description =Protein with tau-like repeats protein 1, isoform a [Caenorhabditis elegans] ref|NP_497253.2| protein with
  Gene Ontology: Mol. function=structural constituent of cytoskeleton; Cellular component=plasma membrane; Biological process=apoptosis
  Coding regions on vcDNA: vcDNA=SeqID_89917; Strand=+; Position=39-728
MISSTAVPRPLRSSNQQKQQPNALTKQNGAHQQKTPIKAREDSRNRNDALGAQKPNGHSPRTPSVPPVNKRYAHVKSKVGSITEYTPSPSRVKIFHESVRVSATPKVGSLQNASHVPAGGNVTIENRKLNFREAAKPRVEDKSEVPIPKSEKKIATQKLEWKAQPKVGSLDNVKHKPAGGNLKIFHESVRVKCESKVGSLDNIGHVPGGGNVKISDYARSVSRSGDGCRR

SEQ ID NO: 163495 - protein, 258 aa, Heterodera glycines
  Homolog annotation: Hit_ID=CAE68811.1; Match level="QueryCoverage =63%, HitCoverage=58%, E-value=4e-24, Identity=36%"; Hit description =Hypothetical protein CBG14763 [Caenorhabditis briggsae]
  Coding regions on vcDNA: vcDNA=SeqID_89918; Strand=+; Position=36-809
MVDVPADFAVLLNSAPPISRIESNKMHWLRKRQQTNATALQRGIDQIGQLATESRGLKRPVTSFARFADSPDEQALYLLWEPLTSDQPTANGGPSSRIYGYLKVVRDRRLYLVDGEGRQFVTTPLCVLDFFIHQSVQHQGKGAQLFRAMLKAEGDLGAHRCAFDKPSDVFLHFLARHFGLERPLWQPNSFVVFPSFFEGIKPEKVSSAGDDRLRSMTALERHRRSVNEQYNGQPPMSSRLSPLPAAQRDQAGALIHQQ

SEQ ID NO: 163496 - protein, 88 aa, Heterodera glycines
  Coding regions on vcDNA: vcDNA=SeqID_89919; Strand=+; Position=3-269
SLSIMTVIRDFLCRSSYQSLAHLCRNQIRVYSVEREGAGTASGIEHALKFNKAGAVHKKELKDYKCVEYLHQNNYSFYDKEVGKLQKI

SEQ ID NO: 163497 - protein, 209 aa, Heterodera glycines
  Homolog annotation: Hit_ID=NP_491557.1; Match level="QueryCoverage =92%, HitCoverage=59%, E-value=5e-25, Identity=36%"; Hit description =DeHydrogenase, Short chain (dhs-1) [Caenorhabditis elegans] gb|AAB37640.1| Dehydrogenases, short chain pr
  Gene Ontology: Mol. function=protein binding; Cellular component =mitochondrion; Biological process=induction of apoptosis
  Coding regions on vcDNA: vcDNA=SeqID_89920; Strand=+; Position=20-646
MASSAAGFAIVTGANTGLGLHFVKSLYASGTYSAIVLACRSEQRAKSAIEQICCGQSSPAENGNGTQTKLEFAKLDLTCNDSVRTFVSQLDERPYQKGSLRLLVNNAGIMGHPFQLVDGVEVHFASNHLGHFLLTNLLIKHNWLASDARILLVTSGLYEKCHSMLTAAELTNNAVAKKRSPAEYYAFSKLANCLHAVGLANRLASPAVA

SEQ ID NO: 163498 - protein, 207 aa, Heterodera glycines
  Homolog annotation: Hit_ID=NP_505711.2; Match level="QueryCoverage =60%, HitCoverage=12%, E-value=2e-17, Identity=34%"; Hit description =related to yeast Vacuolar Protein Sorting factor (119.2 kD) (vps-54) [Caenorhabditis elegans] emb|CAA9733
  Coding regions on vcDNA: vcDNA=SeqID_89921; Strand=+; Position=3-623
LLTPSVASSSGCSSFTINSFTQNLASVLSDTKRSKAEVAAFFTRHWGEQFVPQKTLCSAPTIPKISLEHFRHYLDNTAKKHRQYLRVRKTLQRSNGHLIGEQIAPDEIPSIFFSSAFSYRDSATFEAVFLEPRQGEADKIISGAEQRRGAVGIGSLYRPASCGSLSSMQSVQMSIAPAAEACHGRMFRGCHRLQMRLEHFDDTVGML

SEQ ID NO: 163499 - protein, 244 aa, Heterodera glycines
  Coding regions on vcDNA: vcDNA=SeqID_89922; Strand=+; Position=7-738
DTRKNSLSLLTPSTSSSSADFELKPFLSQSFVLCQSFQKGFSKSLFNSFKSPNFHRLTTSHFPLLNHPKMSRMEKICEDVNRNAALLNIFGNSDSVLLSCSDLCSENGCGAMSRAQMICEDVNYEAMANSDGGGGTDDEAYALMEFGGSLFCVPASIFATAVRVPLQSSVWPNQPANFTVGNPSSQPQQGDVSVGPRLPAVRHGVGGLRQWETVAEDVEGCCSTTFADGPKCLFKFVASTPDAS

SEQ ID NO: 163500 - protein, 189 aa, Heterodera glycines
  Homolog annotation: Hit_ID=NP_620256.1; Match level="QueryCoverage =82%, HitCoverage=60%, E-value=2e-25, Identity=43%"; Hit description =phosphatidylinositol glycan, class L [Rattus norvegicus] gb|AAH74020.1| Pigl protein [Rattus norvegicus]
  Gene Ontology: Mol. function=N-acetylglucosaminylphosphatidylinositol deacetylase activity; Cellular component=endoplasmic reticulum; Biological process=GPI anchor biosynthesis
  Coding regions on vcDNA: vcDNA=SeqID_89923; Strand=+; Position=1-567
KAFKFFFTAFLVSLLSVALHFYFDNKTIFPAKFGERWLLLIAHPDDETMFFGPTLLFLSSIGVQLHLLCITSGNSEGLGTIRRNELYSSASVYGIQPKYISFVDPEERRFPDGFRDWNITSLSALIYSYIRRLKPDGLITFDEWGISGHPNHRDSFKAILNLNTEGKLKELGLKKALALKSSAVLRKYV

SEQ ID NO: 163501 - protein, 323 aa, Heterodera glycines
  Homolog annotation: Hit_ID=NP_496794.1; Match level="QueryCoverage =89%, HitCoverage=90%, E-value=5e-62, Identity=42%"; Hit description =MSTP052 like (35.5 kD) (2N449) [Caenorhabditis elegans] emb|CAB04226.1| Hypothetical protein F32A11.1 [Ca
  Coding regions on vcDNA: vcDNA=SeqID_89924; Strand=+; Position=33-1001
MPSTNANDGITSADDATRLRMVDPVDRYSALIVRGLIVGTGALGLGLFIRNSKLFAAFNHVKQIPQDYYQKGIIMKGIVRDLESNGIIKVEHRPAIRIPRLFGTKKSKVGGNLNLRLAGIELSPVGIEYLQKEMQLKGRFVKFSVIKLAQTEPDIVEADVTAKKAIRHVNLNTELIRKGFARTPTLDNHWHRESLQFNTNYSRLITRLLTCEKVAERRGLGLWERATWVERVQSYPSTAVQIFKHSVPAKLAVFSFELLRDLSMVLYSIAQNIYFICVELFKYCAFGYRKLSIGISKAFLIYTNAKRHLIQIGSKIGARQSPA

SEQ ID NO: 163502 - protein, 285 aa, Heterodera glycines
  Homolog annotation: Hit_ID=CAE73450.1; Match level="QueryCoverage =91%, HitCoverage=33%, E-value=1e-71, Identity=47%"; Hit description =Hypothetical protein CBG20899 [Caenorhabditis briggsae]
  Gene Ontology: Mol. function=actin cross-linking activity; Cellular component=actin filament; Biological process=actin cytoskeleton organization and biogenesis
  Coding regions on vcDNA: vcDNA=SeqID_89925; Strand=+; Position=13-867
MTTTNSASNNYTGEVSKIEKRQQTMRNDPFGQRYLRDECAVFDYNAWDDVDWPEEKEAEILQTIQAQMADAVPESVSLSLLENPKDRWEAFFETHNNKFFMDRKWLSREFSELFVRPKDSAKINVLDVGCGMGNTTIPLLQSAEHLFMYSCDFSKKAIETLRNDQRISSERCRPFVWDITENAHQTQVADGTLDFVLCIFVLSAVRPDRLRAAVSNLVALLRPGGMLLLKDYGRHDLTQLRFKSGRLIQHNLYRRGDDTLVYFFTTEEMDELFREAGLEKIQNFM

SEQ ID NO: 163503 - protein, 129 aa, Heterodera glycines
  Homolog annotation: Hit_ID=NP_501968.2; Match level="QueryCoverage =96%, HitCoverage=23%, E-value=1e-15, Identity=35%"; Hit description =flavin-containing monooxygenase (61.2 kD) (fmo-11) [Caenorhabditis elegans] emb|CAA94291.2| Hypothetical
  Gene Ontology: Mol. function=monooxygenase activity; Cellular component=integral to membrane; Biological process=oxygen and reactive oxygen species metabolism
  Coding regions on vcDNA: vcDNA=SeqID_89926; Strand=+; Position=48-437
MLSSPHNFKVAIVGAGPSGLTAARQALLYGYKVRIFEKEQNFGGVWRLAISENAQRRPVPLQSVMDCSKQLCAFSELAVAEHFPTFLRPSDAVAYLESYVRTFELARHMKLGTEVKTIRRSECWQKTDN

SEQ ID NO: 163504 - protein, 82 aa, Heterodera glycines
  Coding regions on vcDNA: vcDNA=SeqID_89927; Strand=+; Position=51-299
MSQDLFGHSKSEEWKDSDETGNDSDKLSQMYVGIRPVDKCLRIAYAKAMDMKHQKVIVMVENDNDFRTYDTKEVPVGEIIKY

SEQ ID NO: 163505 - protein, 156 aa, Heterodera glycines
  Homolog annotation: Hit_ID=EAL27616.1; Match level="QueryCoverage =62%, HitCoverage=85%, E-value=3e-25, Identity=57%"; Hit description =GA11196-PA [Drosophila pseudoobscura]
  Coding regions on vcDNA: vcDNA=SeqID_89928; Strand=+; Position=78-548
MKSERKGGLVPSLSSKRQQQSVPSHSVPSTEPSPLASPSLFLASQNVGDKGHQPPQKHVYSELALRNNYQMLEQSRTCQAAVSGIASGILGLTGTLGFLFYFLCVFLQAFVWQYKTGFRWSAFFTSRSLFLTHSVVSGLFTYVLFWVFVYGLVHVY

SEQ ID NO: 163506 - protein, 302 aa, Heterodera glycines
  Homolog annotation: Hit_ID=NP_498063.1; Match level="QueryCoverage =82%, HitCoverage=78%, E-value=2e-14, Identity=25%"; Hit description =putative cytoplasmic protein (34.9 kD) (3G98) [Caenorhabditis elegans] gb|AAK93858.1| Hypothetical protei
  Coding regions on vcDNA: vcDNA=SeqID_89929; Strand=+; Position=39-1019
MNSKMHRSFFHWTSLLMQGGILCAPIIVNLQRNKLNHDFKLRKMMSADLPNMPDENLLDLVEAEMLAKSNDRLYPFEKHHFGIKVKDDIESNTYGFFYCQNGVTFRFSSRLALNDVETIRRHYPNFLGLFKENLKSKWAKDLESLRIDTSTLSDDELKRVLLTPNAKRFVISREVLLADSFYHGMPALHSFVAFGTSWGLFSLLKKRMPEKLAIAIAFPLAVITFVLLDRVDQINELATYDKEAVEEDAACLSGAKEYLQSSIELGKLLYRLTDGKAPFDANGNCKRHKMKYTDRMKAIESI

SEQ ID NO: 163507 - protein, 232 aa, Heterodera glycines
  Homolog annotation: Hit_ID=NP_505777.1; Match level="QueryCoverage =82%, HitCoverage=89%, E-value=6e-42, Identity=45%"; Hit description =putative protein, with a transmembrane domain (24.9 kD) (5L375) [Caenorhabditis elegans] emb|CAA98457.1|
  Coding regions on vcDNA: vcDNA=SeqID_89930; Strand=+; Position=48-743
MSRHFSLFSTTGRICELRLQPKCSRRLFCSISPSTSSGAHLDSGRKCQNKPLCALSAFSREQLGTSILHPEANRSTQRIVLISKICSLGSSAFGLVMVPLVTSALWEPIAERPAIAVFAGVANVFLLLFAFTPILLHFLTKRFVQNVFFNEREQMFTTVHYNFFLQKRALRFTADQLVDASELPKDRRFWLPLATCLAHSYPMLLPLDANCYSDQTAFKLLTKNIKLPTKEE

SEQ ID NO: 163508 - protein, 228 aa, Heterodera glycines
  Homolog annotation: Hit_ID=CAE73870.1; Match level="QueryCoverage =91%, HitCoverage=37%, E-value=7e-72, Identity=65%"; Hit description =Hypothetical protein CBG21460 [Caenorhabditis briggsae]
  Gene Ontology: Mol. function=chaperone activity; Cellular component =cytoskeleton; Biological process=protein folding
  Coding regions on vcDNA: vcDNA=SeqID_89931; Strand=+; Position=3-689
RVTGARIVHDTADLRESDIGTQADLYEINKVGDEYFAWITSEKTTAVTVVLRGPSKDIINEVERNIQDALHCVRNVLTNPRVVPGAGALEMALSHALLEKAKSIPGVRAGPYKAVAHALEIVPRTLIQNCGGSSTIRQLTALRAKHAQQPDTNWTWGINGRDAGGELVDMAQPAGVWDSLTVRLQAIKTAIETSIMILRIDDIVSGTKKRDKDENGGGGAMPGPGGFE

SEQ ID NO: 163509 - protein, 213 aa, Heterodera glycines
  Homolog annotation: Hit_ID=BAA21484.1; Match level="QueryCoverage =93%, HitCoverage=49%, E-value=2e-72, Identity=63%"; Hit description =cdc2-related kinase [Bombyx mori]
  Gene Ontology: Mol. function=ATP binding; Cellular component =cytoplasm; Biological process=apoptosis
  Coding regions on vcDNA: vcDNA=SeqID_89932; Strand=+; Position=3-641
FKSHKIPLAIVGKGACRSVNEFDKIRQLGEGTYGVVYEGRDKKSGQTVALKQIRLNLKKEGVSVSVMREIQSLMDIEHENVVRLFDVVVGRRIDQIFLVMEYCDQDLASLLDNMNSPFTESQIKCLLLQLFRGLRHLHSRFIVHRDIKVSNLLLTEFGALKIADFGLARLCGVPPTEMTPRVVTLWYRSPELLFGSKFQSPAIDMWACGCIMG

SEQ ID NO: 163510 - protein, 237 aa, Heterodera glycines
  Homolog annotation: Hit_ID=CAG10886.1; Match level="QueryCoverage =73%, HitCoverage=45%, E-value=1e-20, Identity=30%"; Hit description =unnamed protein product [Tetraodon nigroviridis]
  Gene Ontology: Mol. function=protein binding; Biological process=DNA repair
  Coding regions on vcDNA: vcDNA=SeqID_89933; Strand=+; Position=6-716
MKMGQQFIPATSSMAFFARNVQLSGSSNLSAKFDIIDRRIASLEQSWRNAMPISSNSATAGTSAMSFDYAENRFLLCGNARGNVSVVDFESFSNSLSNAEVYPRHYVVINTNRKSHHEFMVNGCQWYPVDSSIFATSGRDKLLKIWDADQLKSVEKFAFEQPISSFHWFVPCDCNSSLIPIATSSSNVVLLDPRLGNTAQQIRCLQQRIWSVRWDRFRDYVLVTGSDSGEIALWDIR

SEQ ID NO: 163511 - protein, 187 aa, Heterodera glycines
  Coding regions on vcDNA: vcDNA=SeqID_89934; Strand=+; Position=3-566
EGLRKCFTNKLFIMKRPSSVVAFGSHLFVGFILLSLFIGTLGTEKKETKPAAAHSPADAKHPPPVAAHAAAGAGHASDPKHASPSPAGAAAAASHAHPPNGGAAHAAEPKHAAAPAIKITDEANNVYSVCVERDVLPAPENASKDKLKAIAAKCDECGAAKCKAKCGGKEVNDACRTCIMQNCPPAK

SEQ ID NO: 163512 - protein, 101 aa, Heterodera glycines
  Homolog annotation: Hit_ID=NP_496970.1; Match level="QueryCoverage =85%, HitCoverage=88%, E-value=9e-25, Identity=61%"; Hit description =high Mobility Group protein (10.6 kD) (hmg-1.1) [Caenorhabditis elegans] emb|CAB54448.2| Hypothetical pro
  Gene Ontology: Mol. function=DNA binding; Cellular component=nucleus; Biological process=regulation of transcription, DNA-dependent
  Coding regions on vcDNA: vcDNA=SeqID_89935; Strand=+; Position=2-307
KFELFSSDLQFVLLPFSTMPKASKNKDPNMPKRAQSAYFIWMLANREKIKKPGMSVAEVAKAAGVEWGRMSAADKTLWEQKAADDKKRYEQEMTQYRARQK

SEQ ID NO: 163513 - protein, 189 aa, Heterodera glycines
  Homolog annotation: Hit_ID=CAE73726.1; Match level="QueryCoverage =92%, HitCoverage=95%, E-value=7e-25, Identity=41%"; Hit description =Hypothetical protein CBG21248 [Caenorhabditis briggsae]
  Coding regions on vcDNA: vcDNA=SeqID_89936; Strand=+; Position=32-601
MNSFIFRRLPSLRFPTASMNFRKMFSTAASSSQQFNVEKPVINKSDIMEPEDYDLTDRRKWVIENISNSIGDLTKMIFAVIYIQGKQHKVTQDDIIHVEHNIPLDVGEEIALEKVLMIGNDEFTLIGRPLLDPKFVHVRATVIEKTTTSPEVQYDFRKKNILNPVWLSHELTVLRINNIHLDKMLLGET

SEQ ID NO: 163514 - protein, 214 aa, Heterodera glycines
  Coding regions on vcDNA: vcDNA=SeqID_89937; Strand=+; Position=37-678
RIMHERVQQDFRSSKFSTRANQNGQHGNRSREVRFDNTNGRAYTRRNGSYSSEPSSGRRSSFSRHQDGARTYVPSTAVQRPISPNGCDSGGMFLMVDPFNIPNTLGAQIQVFDLQENANLGIRHIIGYCIPLRCCVGLFKHIQPCRAIKSMESQSMDEQFAHKYKFHPNLPLSVVPLHDTEFHRMMGSPVMPLRDGYQQRNRFFVRPSSPRLAQ

SEQ ID NO: 163515 - protein, 107 aa, Heterodera glycines
  Coding regions on vcDNA: vcDNA=SeqID_89938; Strand=+; Position=164-487
CRFFLKISGGFLCDVKRNLQNFQENPHKRTPSKNKLFENLAMPPATWFPLARFSLNMAQFLGPRDAETSKGSPKINLGSPILSFRSILPDTSSNAVDSWVPLKQRGQ

SEQ ID NO: 163516 - protein, 201 aa, Heterodera glycines
  Homolog annotation: Hit_ID=CAE72193.1; Match level="QueryCoverage =97%, HitCoverage=88%, E-value=3e-35, Identity=34%"; Hit description =Hypothetical protein CBG19301 [Caenorhabditis briggsae]
  Coding regions on vcDNA: vcDNA=SeqID_89939; Strand=+; Position=10-612
MAKSTEEERIANVHFDLELVNSDFIRPMRMNFRRRGRDLYWDMALGHDSVAALIFHTERKQLLFVKQFRPPVFVNVVRSLPENKNKSLAEVRWENYPIENGCTVELCAGLMDEPGKTPLEHMKKEILEECGYRVDESNIRPIRRYVTGISLSGAIQHLFYVELDESMWEPKAGGGNEHEGEFIQNVFMDIGEAEALLEKEN

SEQ ID NO: 163517 - protein, 156 aa, Heterodera glycines
  Homolog annotation: Hit_ID=NP_511045.1; Match level="QueryCoverage =97%, HitCoverage=71%, E-value=2e-43, Identity=59%"; Hit description =CG4528-PA [Drosophila melanogaster] gb|AAF46017.1| CG4528-PA [Drosophila melanogaster] gb|AAL29039.1| LD4
  Gene Ontology: Cellular component=snRNP U1; Biological process =primary sex determination, soma
  Coding regions on vcDNA: vcDNA=SeqID_89940; Strand=+; Position=93-560
MLSPTILCTSTNEKVKKEELKKALYAIFSQFGQIIDILAFKHLKMRGQSHVIFKEINSAATALRSMQGFPFYDKPMRIQFSREDSDVISKAKGTFVERPKKNIAVPKKKKKLAEGPTKKSKTSGKEGQQRSTAPPNKILFITNLPPECTEEMLRVV

SEQ ID NO: 163518 - protein, 200 aa, Heterodera glycines
  Coding regions on vcDNA: vcDNA=SeqID_89941; Strand=+; Position=41-640
DHFLMTYSYIVCEKNNTQRSDNGQCIDNRTKMGYGAGSCRIIPIGELDQLEEELDPCLSAAVRQKKEPSEGLPARLKYCLCCVVVFLLLALLAVSLLLLFGSDCPTNSHQLTTQFEQPKDALLYQEETHIRKENNQPKNGSKYHHEQFTKEASRGKTVQPQFKKDEVFNNATEQQQNEEDEQYSNTTVQQRNLNLEYNNS

SEQ ID NO: 163519 - protein, 120 aa, Heterodera glycines
  Coding regions on vcDNA: vcDNA=SeqID_89942; Strand=-; Position=127-489
MIIIQQCRIQCTNFKSVGAENLTNFMAIEQSKAWRTLHLVFTGGRIVNERIGMDGRLFVDHQYHFSTLKFLFDHTVFTSCPIVESLCAVYKIRSFFAMAAFSSTLDECHQMNCCCCCYNF

SEQ ID NO: 163520 - protein, 186 aa, Heterodera glycines
  Homolog annotation: Hit_ID=XP_414703.1; Match level="QueryCoverage =84%, HitCoverage=7%, E-value=1e-23, Identity=36%"; Hit description =PREDICTED: similar to c407A10.1 (GPI1 (N-acetylglucosaminyl transferase component)) [Gallus gallus]
  Gene Ontology: Cellular component=membrane; Biological process=mitosis
  Coding regions on vcDNA: vcDNA=SeqID_89943; Strand=+; Position=18-575
MSAIHQFLEWSALSAELTFKFENLRRLLYLFVDSLFGLIILTFATSQWTNISTNFWAAIHLYIEQLETLITWLTNNPAGLKLNDALNTFLANFFFYHIHLWKTYVTVFEHSLTNWLLIVAFGALGFSVLVAFLSDFLRVLTVHIFCFHIYTHRLAKVSCTAFVGLGRAFRSKKWNPLRRRVDSVPF

SEQ ID NO: 163521 - protein, 199 aa, Heterodera glycines
  Homolog annotation: Hit_ID=NP_611208.1; Match level="QueryCoverage =90%, HitCoverage=62%, E-value=1e-58, Identity=59%"; Hit description =CG4802-PA [Drosophila melanogaster] gb|AAF57869.1| CG4802-PA [Drosophila melanogaster] gb|AAO49165.1| GM0
  Gene Ontology: Mol. function=5'-methylthioadenosine phosphorylase activity; Cellular component=cytoplasm; Biological process =phosphorylation
  Coding regions on vcDNA: vcDNA=SeqID_89944; Strand=+; Position=71-667
MATQNGAAMATDLLQRKAFKIGIIGGTGLEDPHIMERSGEVRVETPYGRPSDALIEGNVAGVPCVLLSRHGRRHQQSPTNINYRANIWALKKAGVNVIVAACACGSLREELEPGKLVLIDSFIDRTTKREQTFYDGLPGHPPGICHMPMHPALNERLRRALLATATRLGAAHSDRGVLVCVEGPRFSTRAESELFRVWG

SEQ ID NO: 163522 - protein, 121 aa, Heterodera glycines
  Coding regions on vcDNA: vcDNA=SeqID_89945; Strand=+; Position=188-550
MDEFDEDAAMAQRPMPKWKKAGLRIERNCAENQIFLSIVQEIVDKFGWDNSAHDYDMWKKAFGPNFSMFFVLDQNRVPMGCISMALYPQVAHWSMFYVKDPYHGHQLGRALARRALEFAGD

SEQ ID NO: 163523 - protein, 252 aa, Heterodera glycines
  Homolog annotation: Hit_ID=XP_319741.1; Match level="QueryCoverage =91%, HitCoverage=53%, E-value=2e-25, Identity=30%"; Hit description =ENSANGP00000006515 [Anopheles gambiae]
  Coding regions on vcDNA: vcDNA=SeqID_89946; Strand=-; Position=2-757
ERFNFALDCAAPQLADEAKVKLLMTKLSEVAFSQYSKSCLPKKVIDFDYSQTEERLKIAFSRPQSIWIDRYECLRASKSEDESFRPFINRHKRLLRDFQFEKLNEEQFSCLMLLTALKSPKDAELRKRILSKLAADGDLVEYDGVVEDLQMYQSTIAEAKVLEQQPMGSRNLMATKLKAKKKRTNSDHSSNESSISTGTRSSNRSQRVCWRCGLSHSSRNCRHETTVCRKCKKSGHLERMCAKHQAWLKKNG

SEQ ID NO: 163524 - protein, 152 aa, Heterodera glycines
  Homolog annotation: Hit_ID=EAA59914.1; Match level="QueryCoverage =98%, HitCoverage=93%, E-value=2e-43, Identity=60%"; Hit description =hypothetical protein AN3706.2 [Aspergillus nidulans FGSC A4] ref|XP _407843.1| hypothetical protein AN3706.
  Gene Ontology: Mol. function=structural constituent of ribosome; Cellular component=eukaryotic 48S initiation complex; Biological process=protein biosynthesis
  Coding regions on vcDNA: vcDNA=SeqID_89947; Strand=+; Position=1-459
LISKADRKQIYEYLFREGVLVARKDFELPRHKDIPVSNLAVLKACQSLESRGFVKSQFSWQWFYYTLTDAGIEYLREYLHIPAEIVPATFKKVRAAASRPDRPERDARRPRQEGERESYRRADKKEGAPAGEYNPQFRGGIGRGRPAAPAQQ

SEQ ID NO: 163525 - protein, 157 aa, Heterodera glycines
  Coding regions on vcDNA: vcDNA=SeqID_89948; Strand=+; Position=83-553
QVFSQKRRQCLPILSIVFLRPKLARLRRSIAVHARTTHLWADKFWKVACSVDSEKLAFRGQATTAIGAAYWHPMFFTETRRSRSAVQAHLKCASCGKEVNKVYEGTDDAGGGSRNAFGHYTDTEKRTELSGLGGVAYADIERAFAVGGMRSGHRRNA

SEQ ID NO: 163526 - protein, 192 aa, Heterodera glycines
  Homolog annotation: Hit_ID=NP_502959.1; Match level="QueryCoverage =100%, HitCoverage=100%, E-value=5e-99, Identity=90%"; Hit description=small GTP-binding protein RHO RHO-1, small GTP-binding protein RHO, guanine nucleotide regulatory prote
  Gene Ontology: Mol. function=ATP binding; Cellular component=cytosol; Biological process=cell-matrix adhesion
  Coding regions on vcDNA: vcDNA=SeqID_89949; Strand=+; Position=27-605
MSAIRKKLVIVGDGACGKTCLLIVFSKDQFPDVYVPTVFENYVADIEVDGKQVELALWDTAGQEDYDRLRPLSYPDTDVILMCFSIDSPDSLDNIPEKWTPEVRHFCPNVPIILVGNKKDLRNDQQTIRDLSRNKQEPVKSEQGKAIAEQIGAYAYLECSAKTKEGIREVFEKATQAALQQKKKKKKGCNVL

SEQ ID NO: 163527 - protein, 314 aa, Heterodera glycines
  Homolog annotation: Hit_ID=AAG21334.2; Match level="QueryCoverage =45%, HitCoverage=36%, E-value=3e-15, Identity=27%"; Hit description =hypothetical esophageal gland cell secretory protein 4 [Heterodera glycines]
  Coding regions on vcDNA: vcDNA=SeqID_89950; Strand=+; Position=60-1004
MRCNLMFMTLMSVMLAMALAGLANAQDNANAETGLRTARSDRVALRKRRFIGDLIDIGKFAFDTGCKLFHTAICDLGKKRKREAVYGKNEPAPNPAAVNEFKVLQSTPIDELVEKVKKQLREVAEKPGFKDLSPVDQEDTLLDAISADDQFMKDLVRESIDDSVVQLRKVTDDFVTYSHANLEGRKAMKKVFDAYENTYKTPKQKLDKVKQLQAEMSDELRNSLKMTTDPEVLKEASFAFGDVPTFTGITKRVSVLPPKYLSIKGHEQCVDKYPTGSMYKVCLPAKKKYECAEDAWKALNALEGKDKLETCPSY

SEQ ID NO: 163528 - protein, 300 aa, Heterodera glycines
  Homolog annotation: Hit_ID=NP_491131.1; Match level="QueryCoverage =98%, HitCoverage=74%, E-value=3e-89, Identity=53%"; Hit description =predicted CDS, tyrosinase family member (1D831) [Caenorhabditis elegans] gb|AAK21515.1| Hypothetical prot
  Coding regions on vcDNA: vcDNA=SeqID_89951; Strand=+; Position=41-940
MRRFKSSGLYRRFGMIHRRSGVHSGPAFLVWHREFLKRLELVFRALHPENSEPILGLPYWDSTLDHDLPSPEDSVMFSEYLLGEPDEAGFVTNGLFANWTTMDGRHSFQRMFGDQDDGEFINDARIDWVMTQDIVESVMAFTLPTQNCINYEVDDRFLEYSHDYVHYFISGDMQERFSSSNDPIFFMHHGFIDSIWEHWRQNKQSRLQRETDFPRNDAACAPRWHFSEEFMPMLQPLWNIDVLSNNYTDNMYEFMPRPSCARTGKSEECGSSDYLWCDSRTNGGHAVCTSKIKPGGDLCR

SEQ ID NO: 163529 - protein, 222 aa, Heterodera glycines
  Coding regions on vcDNA: vcDNA=SeqID_89952; Strand=+; Position=1-666
SSCPSGHQQQMNACQKLKRPTPPITTYSSVGPERDCPLRKDRAEPNWTETDEAICDDSDLIGIMQRQYVNLPHSTQKAARRTNAVRQRMVADATESSDCSSDVTTPNGAIMEEWASLATEGDGAAMARENGSEKSTSSSRTGVDSLSALLNRRVSPPHHHSLSPSAALSGGAASIQLRRATCGELDKSKRGELGHSIFYVDEPDSPSADGPNASHSLAATPS

SEQ ID NO: 163530 - protein, 262 aa, Heterodera glycines
  Homolog annotation: Hit_ID=EAL04505.1; Match level="QueryCoverage =99%, HitCoverage=100%, E-value=7e-86, Identity=61%"; Hit description= likely cytosolic ribosomal protein L8 [Candida albicans SC5314] gb|EAL04350.1| likely cytosolic ribosomal
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_89953; Strand=+; Position=36-824
MAPKGKKIAAAPFKTAAKAGAVKDPRFEKATRNFGIGNAVQPKRDLTRYTKWPEYVRLQRQRAILKRRLKVPPAINQFSRVVDKNVASQLFKLLNKIRPETKQEKKQRLKAIAEAKAAGKTVEAGKKPVVVKYGINHVTALIEAKKAKLVVIAHDVDPIELVVFLPALCRKMNVPYVIVKGKARIGTVVHKKTATALAIVDVQPENAKELAALVSVAQANFNDKSDEIRKTWGGGIMGKKSNDMMLKREKARAKEVSTAHLA

SEQ ID NO: 163531 - protein, 228 aa, Heterodera glycines
  Homolog annotation: Hit_ID=CAE71585.1; Match level="QueryCoverage =93%, HitCoverage=42%, E-value=8e-28, Identity=38%"; Hit description =Hypothetical protein CBG18542 [Caenorhabditis briggsae]
  Gene Ontology: Mol. function=pantotheine-phosphate adenylyltransferase activity; Cellular component=extracellular space; Biological process=coenzyme A biosynthesis
  Coding regions on vcDNA: vcDNA=SeqID_89954; Strand=+; Position=144-827
MNSAEMASPSIDIGLLVLRGNEELIRQKLKRLLAITMPKVRQKLYVHLEQMDVIRALLPAIYINAASIAPKIDLRVLLNRTTSVPVDRVFYDEVKDPSHPIFPMLREENGPTFKMDSFATSHHKLPEKPYDHVVLGGTFDRLHNGHKLLLSEAAMMARTRITCGVTDGKMNEKKILYELMEPVETRCRSVTEFIGDISEGIECQTVPIYDAYGPAIVGDHYQAIVVSD

SEQ ID NO: 163532 - protein, 257 aa, Heterodera glycines
  Homolog annotation: Hit_ID=NP_490973.2; Match level="QueryCoverage =100%, HitCoverage=99%, E-value=6e-89, Identity=65%"; Hit description= electron transfer flavoprotein (27.6 kD) (1C986) [Caenorhabditis elegans] gb|AAD03129.2| Hypothetical pr
  Gene Ontology: Mol. function=electron transfer flavoprotein; Cellular component=mitochondrial matrix
  Coding regions on vcDNA: vcDNA=SeqID_89955; Strand=+; Position=67-884
MRILVGVKRVIDFAVKVRVKKDGTGVVKDGVNHSMNPFCEIALEEAVRIKERKEKEGGGPVEVVAFSFGTQKAQETLRTALAKGADKALLVEVDNATEEKLEPIHVARALAKLAKEDKYDLLLLGKQAIDDDANQTGQMVAGYLNWPQATFASKIEEDGAYIKVTREIDGGLDTVKLKLPAVVTADLRLNEPRYATLPNIMKAKKKPLEKKTAQEFGIDMTNQTETLEVSDPPVRQAGGFVDDVPGLVSKLKEKGVI

SEQ ID NO: 163533 - protein, 185 aa, Heterodera glycines
  Homolog annotation: Hit_ID=NP_494439.1; Match level="QueryCoverage =73%, HitCoverage=45%, E-value=2e-28, Identity=47%"; Hit description =putative protein, with at least 4 transmembrane domains, of eukaryotic origin (2D354) [Caenorhabditis ele
  Coding regions on vcDNA: vcDNA=SeqID_89956; Strand=+; Position=38-592
MDRLEFRDFPSSGGGASSEFFNSDSVNNKPPPDPAFPSGNLLDVSSSSESQRDDSSKVHFLSLSFYRRFFDIDEEQVFARLLNSAMPRRTGNFISDFVHPNPDLRGPFWVSVSLVFSIAIVGNLSRFLHTFGSDELFISDFSFVTGATSLVFGYVLTMPSLVYAFLWYHRPLNLQYSFLQFAVCL

SEQ ID NO: 163534 - protein, 109 aa, Heterodera glycines
  Coding regions on vcDNA: vcDNA=SeqID_89957; Strand=+; Position=35-364
MGKVSKTKSAKKSAGGSGNKTVIWAVEDIVDGPKYETIGTKRQKLYKVRWGETYELASNIPPGLIDLYEKREKKQIKILGPIGHQRIFDQRRVAKPEGENSAPSDEIRH

SEQ ID NO: 163535 - protein, 220 aa, Heterodera glycines
  Homolog annotation: Hit_ID=ZP_00195689.2; Match level="QueryCoverage =97%, HitCoverage=95%, E-value=1e-66, Identity=58%"; Hit description =COG1926: Predicted phosphoribosyltransferases [Mesorhizobium sp. BNC1]
  Coding regions on vcDNA: vcDNA=SeqID_89958; Strand=+; Position=83-742
MFLGARSALFIDRKDAGQKLAKALAHILPQRDNIVVLALPRGGVPVACEVADAFQAPLDLLMVRKIGAPGHEEYGIGAVVEGNPPELVMNEEAVRITRPSEAYVQQQMQKQLKEMERQRKTYLGDKPPVSLEGRIAIVVDDGIATGGTARVALKALRQKNVSRAILASPMAPSDTLAELRAEGNEVLCLETPPNFSAVGLHYQRFDQTSDEEVIRCMEKA

SEQ ID NO: 163536 - protein, 202 aa, Heterodera glycines
  Homolog annotation: Hit_ID=NP_724441.1; Match level="QueryCoverage =78%, HitCoverage=30%, E-value=1e-61, Identity=69%"; Hit description =CG7873-PB, isoform B [Drosophila melanogaster] ref|NP_476849.1| CG7873-PA, isoform A [Drosophila melanoga
  Gene Ontology: Mol. function=ATP binding; Cellular component=nucleus; Biological process=calcium ion transport
  Coding regions on vcDNA: vcDNA=SeqID_89959; Strand=+; Position=2-607
STPILKSVRSSGGGSPCSTNLSVAEGSKNGGGSSGSANAQQGTNGSGNNLFIALFDYNARTDDDLNFKKGEALEILNDFQGDWWYAKSLISGKCGFIPSNYVARESSIDAQPWYFGKLRRIDAEKLLMLGVNEHGAFLVRDSESRHNEFSLSVRDGEVVKHYRIRQLDNGGFFIARRVTFGTLQELVQHYSEEADGLCVTLT

SEQ ID NO: 163537 - protein, 199 aa, Heterodera glycines
  Coding regions on vcDNA: vcDNA=SeqID_89960; Strand=+; Position=36-632
MPEMFPPSQFLPFSVAITNFFPFAECLLSVLLFALSVGMVRGMNAIIRVLYITLISRPGAEPPASPRLAELDEQIGDIRRRMSALSPTDEFAQYFKLERLANKLEEERKKICVPSRKIVPAFSQKFALGMRAVALFISLALALHSSTETRLFTICADHFYPFNFLLDFPFSIAAFQWTNQNDDVADLQQPVGLFSFSIL

SEQ ID NO: 163538 - protein, 184 aa, Heterodera glycines
  Homolog annotation: Hit_ID=NP_741412.1; Match level="QueryCoverage =97%, HitCoverage=96%, E-value=8e-63, Identity=62%"; Hit description =MCT-1 protein-like (20.8 kD) (4G918) [Caenorhabditis elegans] gb|AAM81123.1| Hypothetical protein C11D2.7
  Gene Ontology: Mol. function=RNA binding; Biological process =regulation of cell cycle
  Coding regions on vcDNA: vcDNA=SeqID_89961; Strand=+; Position=18-572
MFKKFDSAEDVVGSQQLKGSVQKSIRAKLVEQYPSIEPYMDAILPKKENFKLVKCKDHLQLIADANGTVHFVKSRDLANYFPTLRLLHKYPFMLPHQQVDKGAIKFVLNGSHIMCPGLTSAGGRLLDDCNEGALVAIMAEGKQHAMGIGQMKLSSANVRSQNVGIAIDNVHFMNDGLWRLTTVQ

SEQ ID NO: 163539 - protein, 257 aa, Heterodera glycines
  Homolog annotation: Hit_ID=CAE57189.1; Match level="QueryCoverage =93%, HitCoverage=98%, E-value=9e-61, Identity=47%"; Hit description =Hypothetical protein CBG00033 [Caenorhabditis briggsae]
  Gene Ontology: Cellular component=integral to membrane
  Coding regions on vcDNA: vcDNA=SeqID_89962; Strand=-; Position=89-862
MFLSNFVAQTLPTMTEEWKDAVLYAPYQKEQALMYQYADTLAVRAFLMMADLSFVLEQRPNAEFMSPTGEVPFLRLQNTLVAEFFPIVDLVGKKGIRPSNTLSAAEQADIQAFCSLIEETLRNAEKYLSWLDDESYELVTKKRYGSVYLWPLNWLLPTLKRREMHNYLADIGWADLPIAKVAERCDKCFHALSIKLGQQQFFVGDQPTELDALAFGHLYTLLTTEMPNKAIVETLSKYPNLIAFCQTIDKEYFSQNF

SEQ ID NO: 163540 - protein, 204 aa, Heterodera glycines
  Homolog annotation: Hit_ID=AAH74544.1; Match level="QueryCoverage =72%, HitCoverage=32%, E-value=6e-10, Identity=28%"; Hit description =LOC447984 protein [Xenopus tropicalis]
  Coding regions on vcDNA: vcDNA=SeqID_89963; Strand=+; Position=28-639
MKLPISSNKFNKYELYKFRHATMAIVENIGFSTSNSSAVSSLSFLLRTYFEQLCRDSLNSAINSGRAEVGLEDVSYVFGANGINITELHDYIQQVQPYAADEHPLFPVTEPLNVPPPSSEIADTSEQKNGERESAGNDGAEVDEEGNREQNNKHSLNSFNSRSNVRNAISQKIFPNFVGAFAPNLGFSVRKVELPTENVSVDQH

SEQ ID NO: 163541 - protein, 190 aa, Heterodera glycines
  Homolog annotation: Hit_ID=XP_392810.1; Match level="QueryCoverage =78%, HitCoverage=24%, E-value=4e-11, Identity=30%"; Hit description =similar to ENSANGP00000005617 [Apis mellifera]
  Gene Ontology: Mol. function=death receptor interacting protein activity; Biological process=induction of apoptosis
  Coding regions on vcDNA: vcDNA=SeqID_89964; Strand=+; Position=1-570
RLQFSAMENVVAAADVAVDNFEERTRQFFAFVNEGNIGQLRALVDSLNADELSNLLRMNQPNVQPPRAALINAIVKQHTEMLEKGADPHQTVLGRLNNLDMNVTPLWTAVNMANLDMCRALIAHGANIELGTDSGESTLLCACFEGSFEIVTLLVENGANVNLADSDGMTPLIVTCYFTGKIDIVLLLLL

SEQ ID NO: 163542 - protein, 203 aa, Heterodera glycines
  Homolog annotation: Hit_ID=NP_496483.1; Match level="QueryCoverage =90%, HitCoverage=53%, E-value=3e-47, Identity=51%"; Hit description =ribokinase (2L903) [Caenorhabditis elegans] emb|CAA91318.1| Hypothetical protein F07A11.5 [Caenorhabditis
  Gene Ontology: Biological process=carbohydrate metabolism
  Coding regions on vcDNA: vcDNA=SeqID_89965; Strand=+; Position=39-647
MTSTSPPLTNGVANHLSENGSATSPELIVFRSIVQDLVSYVDRFPNPGKSVRGHTFKTFCGGKRANQAVMASRMGTHVTMVSMDGDDLFAAENVRSIAQNDVDVSLVKQLSGQTTGTTTITVSRDGENCIVVTLGANTSLGAECALAIEHTVARARLVLCQQEIDQQGTLTVFRIAKRHSVTTFFNPAPGRADIDRTILPLCD

SEQ ID NO: 163543 - protein, 197 aa, Heterodera glycines
  Homolog annotation: Hit_ID=CAE72119.1; Match level="QueryCoverage =98%, HitCoverage=54%, E-value=4e-28, Identity=34%"; Hit description =Hypothetical protein CBG19214 [Caenorhabditis briggsae]
  Coding regions on vcDNA: vcDNA=SeqID_89966; Strand=+; Position=3-593
RPICDAKTGNYQPQQCRDEKHCFCVNYLTGVRQNKKEVPTNEILHCEGGQVDFSIDDSHIIKSEKGEGEKGDEELIPIGSPVCKKPRDAGHRCHGRAGGPIAAKNLKWYFDTETFDCLAFSYNGCGGNGNHFDSPADCWDKCKLVDLAGCAGMRLPATDKQGHTIICAGAGYPSPTAACPSGYRCTMLAHMGVCCHS

SEQ ID NO: 163544 - protein, 236 aa, Heterodera glycines
  Homolog annotation: Hit_ID=EAL25139.1; Match level="QueryCoverage =100%, HitCoverage=54%, E-value=1e-66, Identity=50%"; Hit description= GA19676-PA [Drosophila pseudoobscura]
  Gene Ontology: Mol. function=chromatin binding; Cellular component =SWI/SNF complex; Biological process=signal transduction
  Coding regions on vcDNA: vcDNA=SeqID_89967; Strand=+; Position=74-781
MSGGIYGGDDVGALVFDPGSHSFRVGYGGEEFPRFDIPARVGVCPRPSAGTDASQTADATIEEVASGRGANASNKFDHYIGTTKLNVPRAGMEVKPYMREGMVEDWELFEKMLDYIYGPCLGAESREHGVLFTEPPWNPKEKRQRLTELVFEKYGVPAYYLAKNAVLAAFASGRTAGLVIDSGSSHTSAVPVYDGYCITNSVVKSPVGGDFVVDQCRKMLVKEGVDIVPYYKVASK

SEQ ID NO: 163545 - protein, 214 aa, Heterodera glycines
  Homolog annotation: Hit_ID=CAE66170.1; Match level="QueryCoverage =98%, HitCoverage=37%, E-value=7e-81, Identity=70%"; Hit description =Hypothetical protein CBG11408 [Caenorhabditis briggsae]
  Gene Ontology: Mol. function=RNA helicase activity; Cellular component=bud neck; Biological process=cell growth
  Coding regions on vcDNA: vcDNA=SeqID_89968; Strand=+; Position=2-643
PIVHLLSVHYHIPTTIQSISWPVALSGRDLISIAKTGSGKTLGFILPAIVHTMAQPPRRPNDGPGVLVLLPTRELAVQVEQVAREYCKLMKLDVTCCYGGAPKAGQANDLRRGVDICVATPGRILDFMEANTTNMRRCTFLVLDEADRMLDMGFEPQIRKIVGQIRPDRQSLMFSATWPKEVRSLAADFQVNPVHLNVGSLELAANHNIQQHVE

SEQ ID NO: 163546 - protein, 244 aa, Heterodera glycines
  Homolog annotation: Hit_ID=NP_502575.1; Match level="QueryCoverage =95%, HitCoverage=99%, E-value=1e-85, Identity=67%"; Hit description =putative protein of eukaryotic origin (26.5 kD) (4O146) [Caenorhabditis elegans] emb|CAB60598.1| Hypothet
  Gene Ontology: Cellular component=membrane
  Coding regions on vcDNA: vcDNA=SeqID_89969; Strand=+; Position=34-768
MLPPGEWRMTDLLLDPAIRTWVFVPIVLITFLVGIVRHYVFLLLVTKKSADLQSVRDSHWLLKARLLRENGRFLPADSFAQRRWLLCDEQHGQLVKRQDKQNTQPNPMLDPSTMTEMVKGNMLNMVPMLVIGGWINWTFSGFVTTRVPFPLTLRFKPMLQRGVDLQSLDASWVSSASWYFLNVFGLRSVYALVLGGENAAEMMDEQAMLGMAQPQMVAPGQDPKGAFKSEWEALQLYTHTFNPR

SEQ ID NO: 163547 - protein, 195 aa, Heterodera glycines
  Homolog annotation: Hit_ID=CAE57511.1; Match level="QueryCoverage =83%, HitCoverage=91%, E-value=1e-38, Identity=49%"; Hit description =Hypothetical protein CBG00486 [Caenorhabditis briggsae]
  Gene Ontology: Cellular component=cytoplasm; Biological process =synaptic transmission
  Coding regions on vcDNA: vcDNA=SeqID_89970; Strand=+; Position=21-608
MSQSPQMATFSGLTANIYHEKQKRQLCLLHTLNNLFQREEFVRDELDEICERLDDSKWFNTHRSWLGLGNYDANILLCALKTRGLVGRWFDKRMPASWIRKEVIVAYIFNIPSTGFMPLPFLNGRHWFTIKQFGPTYYNLDSKLAAPTLISTANGIVHYINSLLAQGNELLLVVRPENEANCLLANGEEEHGGGE

SEQ ID NO: 163548 - protein, 206 aa, Heterodera glycines
  misc_feature (30)..(30): Xaa can be any naturally occurring amino acid
  Homolog annotation: Hit_ID=CAE65136.1; Match level="QueryCoverage =100%, HitCoverage=28%, E-value=4e-50, Identity=47%"; Hit description= Hypothetical protein CBG10002 [Caenorhabditis briggsae]
  Coding regions on vcDNA: vcDNA=SeqID_89971; Strand=+; Position=4-622
DFSDECALRIRSGEEKPQRETHATAIPLPXAANLFLLVKKIITESTKLFADPNAVLSKLVELFRQCLRQFAHGCLSAFLPQALPGVSPGAGGIIGASTSILQNLMRDDSVVRLDADQTFFTCCVLATADWSAETTMQLQDKLRQKIADGDFGQETDLFHSICNSALMLLVQDAETMCEPSLQAMNKIDWSNVDQVGDESPYVSTIR

SEQ ID NO: 163549 - protein, 208 aa, Heterodera glycines
  Coding regions on vcDNA: vcDNA=SeqID_89972; Strand=+; Position=1-624
GTPRQLSAFFGIAMAFPLLPFFFLFPLALVPLQRTAAVHPPLFNRIVPTSERTVNLTLTRDFGEAKAGNDESANNSNLTASPVEAKIHRLKELRNEMRALTAMIKEERRRSKSKDIRHRHRSIAEKMRTEISRQFRKWRKKVLSKIHLVMQRLDQLEGEMHRTKDNLQKVMHDNGREEGGKWGGGSKKRRPPPSHSAESLSAVRRVQM

SEQ ID NO: 163550 - protein, 117 aa, Heterodera glycines
  misc_feature (55)..(55): Xaa can be any naturally occurring amino acid
  Homolog annotation: Hit_ID=AAQ83632.1; Match level="QueryCoverage =79%, HitCoverage=8%, E-value=9e-15, Identity=40%"; Hit description =solute carrier family 4 sodium bicarbonate cotransporter-like member 10 [Homo sapiens]
  Gene Ontology: Mol. function=anion exchanger activity; Cellular component=integral to membrane; Biological process=bicarbonate transport
  Coding regions on vcDNA: vcDNA=SeqID_89973; Strand=-; Position=53-407
YGTVRWIKLEQCVEGAGTRLSKPYISLLSIYPLLQLKHCFRRGVVLLESGANSYXRLCDLLVDEWTHSGQLGEDMANLVKDIIYAPKLHLNQGKLRKVNESNGKLKQMEGEERVWKT

SEQ ID NO: 163551 - protein, 107 aa, Heterodera glycines
  misc_feature (40)..(40): Xaa can be any naturally occurring amino acid
  Homolog annotation: Hit_ID=CAE65942.1; Match level="QueryCoverage =100%, HitCoverage=18%, E-value=5e-15, Identity=43%"; Hit description= Hypothetical protein CBG11119 [Caenorhabditis briggsae]
  Coding regions on vcDNA: vcDNA=SeqID_89974; Strand=+; Position=59-378
VGNQLELLLDFRTNSWLSLGWRPLNIPPSCRLFPQMHGTXSRRSARGGRSADERIWLVVTWRTNGHSLAANSAKSALSLPLHPMDCTDVIMASVLEGTDLLHIADMY

SEQ ID NO: 163552 - protein, 67 aa, Heterodera glycines
  Coding regions on vcDNA: vcDNA=SeqID_89975; Strand=-; Position=16-219
VVRTRKCLSPISCGVIHPSVSPFICCFSLGLLLDSDGGRRRLFHVLLSDAEGVEVSIQFSLERVTGN

SEQ ID NO: 163553 - protein, 162 aa, Heterodera glycines; identical to SEQ ID NO: 159253
  Homolog annotation: Hit_ID=Q27666; Match level="QueryCoverage=96%, HitCoverage=97%, E-value=2e-56, Identity=63%"; Hit description =Superoxide dismutase [Cu-Zn] emb|CAA93447.1| cytoplasmic superoxide dismutase [Haemonchus contortus]
  Gene Ontology: Mol. function=copper, zinc superoxide dismutase activity; Cellular component=cytoplasm; Biological process =neurogenesis
  Coding regions on vcDNA: vcDNA=SeqID_89976; Strand=+; Position=41-529

SEQ ID NO: 163554 - protein, 368 aa, Heterodera glycines
  Homolog annotation: Hit_ID=NP_495408.1; Match level="QueryCoverage =99%, HitCoverage=48%, E-value=1e-110, Identity=56%"; Hit description= ATP-binding cassette sub-family D member 3 like (74.9 kD) (2H174) [Caenorhabditis elegans] gb|AAA68340.1
  Gene Ontology: Mol. function=nucleotide binding; Cellular component =extracellular space; Biological process=peroxisomal long-chain fatty acid import
  Coding regions on vcDNA: vcDNA=SeqID_89977; Strand=+; Position=3-1106
AAGFRERLTHHFYAQYLDGFTFYKMTNLDNRIANADQLLTQDVDRFCEGIVELYSNLSKPFVDVLLYVSRIGASIGWQAPIQLFVYLLFSGTALTYLRRPIGRMTVMEQQLEGDYRFVNSRLIVNSEEIAFYQGNERERVSVLNAFQRMISHLRSLILFRFSIAFMDNIVAKYVATVVGWSTLSRPYFNEQNEGMMRKDKTELMQAYYTTGRMMVKLADALGRLALAGREMTRLAGFFFRVDQLMHVLADLEQGKYQRTMLSINADSKNVANGNGGLVVIEQQQKLNNDDQHSNSTTAPSSPPALLFSSSSNSSSSCSLSSFRPGSGHVLVQDNLIRFQQVPLVTPNGDVLIRSLDFEVPSGTNVLVC

SEQ ID NO: 163555 - protein, 202 aa, Heterodera glycines
  Homolog annotation: Hit_ID=NP_505118.1; Match level="QueryCoverage =77%, HitCoverage=24%, E-value=3e-16, Identity=34%"; Hit description =component oligomeric golgi complex 6 (73.6 kD) (5I700) [Caenorhabditis elegans] gb|AAA96179.1| Hypothetic
  Coding regions on vcDNA: vcDNA=SeqID_89978; Strand=+; Position=42-647
MTLEGERGGLHALLTARLDEDEQFIATINYLNDNLRLDAETTEQKLRMVLEDRELELNQQYLEQLEKMNDRVQGFVQQIRSMNSICCELTERIQTNKEKTRELLKRTAVLQTEKRELGAKNAFLDEFFAKYSLNEEEETALALPNQQGSPSDAFFSALRRLLEVEKNVTEQLALEPNSLALMELSHLLGDKLRQTYATLYAC

SEQ ID NO: 163556 - protein, 183 aa, Heterodera glycines
  Homolog annotation: Hit_ID=NP_731868.1; Match level="QueryCoverage =41%, HitCoverage=16%, E-value=3e-12, Identity=51%"; Hit description =CG2988-PA [Drosophila melanogaster] gb|AAF54999.1| CG2988-PA [Drosophila melanogaster]
  Gene Ontology: Mol. function=DNA binding; Cellular component=nucleus; Biological process=development
  Coding regions on vcDNA: vcDNA=SeqID_89979; Strand=+; Position=63-611
MPFANFSVDSILSTGEGNSGTSKCHNSFRPSVVFASSCHGCLTDEGSSCFEMRPFDSVDTEFCPRAGDDDTSLVISRWALQCIRMIAGDDAKMTTMKTVNADSPEQISPTDAANSIFLNPSIALGNGNAFPLFQQMQKAKRIRTAFSPSQLVKLEQAFNGSQYLVGSERKVLAKQLALSETQV

SEQ ID NO: 163557 - protein, 355 aa, Heterodera glycines
  Homolog annotation: Hit_ID=NP_495933.1; Match level="QueryCoverage =97%, HitCoverage=82%, E-value=6e-73, Identity=38%"; Hit description =putative protein, with a coiled coil-4 domain, of eukaryotic origin (47.3 kD) (2J345) [Caenorhabditis ele
  Coding regions on vcDNA: vcDNA=SeqID_89980; Strand=+; Position=40-1104
MALPNRPPYLPDNWDNDVEMSGLMSFLKARHVNSTNYDRVIEFWKRVISDYCRHQKNCIFSLDELKLKFKRGTQLPSPLPTVVMEMQNAGLVQSKEELEKQNQGWLQWSISLLKPNSWLPGLANPTDAGKRHPFELVHIPTLKQQAKELLRFYRNHFEMFADCSDVVDYNDLREQTAHLMDERCFDLVINELARMGEVSMGSSKSGDRVLKFKDQSSKGPARFTETDANVHDLKRTMQRLDLDIKNAEKREQSLKEEARVALGRKDKKGALNIMRKVARVRKDIQDKDVQYQRLLAMLEQLAASKQTKEIIDVYKQGSNAFRETMARQGLTPDKVDLTMDGVLETMQDYQDVEEA

SEQ ID NO: 163558 - protein, 262 aa, Heterodera glycines
  Homolog annotation: Hit_ID=XP_394833.1; Match level="QueryCoverage =45%, HitCoverage=24%, E-value=5e-17, Identity=39%"; Hit description =similar to CG5504-PC [Apis mellifera]
  Gene Ontology: Mol. function=co-chaperone activity; Cellular component=mitochondrial inner membrane; Biological process =embryogenesis and morphogenesis
  Coding regions on vcDNA: vcDNA=SeqID_89981; Strand=+; Position=6-791
MHLFHAFLHRSLLMNLPPSSSSSPVLFNRLTNRQTLAFSAIVRRVTRGFSTRQRNLYKVLGVSPSASQSDIKKAYYTLSKKYHPDVTGSNESCAKKYLEIKEAYDVLRDEKQREEHDRWLAAEEVQRQRPINGRQPYVRRQKVYDDLWPNNGTFSDEEIRRIWRSMSGNSEFGRSNWEFETEVKRKRQMAYEEQTRRRNEWAKNGFGQNNGRSDWTDQDQYKIIGKILLCYVLITFFIEIFSASLGLFRDPFLPPYNREEDI

SEQ ID NO: 163559 - protein, 181 aa, Heterodera glycines
  Coding regions on vcDNA: vcDNA=SeqID_89982; Strand=+; Position=2-544
LMLVGLDHLLPVRPVALCLIEYSSTLSPSFLFVHFISNFSKSSSSAGTSDHHITFVSLHTTLGLLRMVMGKMAQRLNLDTFHFVSVSDFLGDSLLFDCDRLFSWITKEVLRSVLPDRPQLVVLDDLFLSHPSIRPAKLLQFLLALFVRLPDRSFFIMATANATPLSAYISNFFNFHIRLTP

SEQ ID NO: 163560 - protein, 289 aa, Heterodera glycines
  misc_feature (13)..(13): Xaa can be any naturally occurring amino acid
  Homolog annotation: Hit_ID=NP_492638.1; Match level="QueryCoverage =99%, HitCoverage=32%, E-value=1e-114, Identity=66%"; Hit description= eukaryotic Initiation Factor (103.8 kD) (eif-3.C) [Caenorhabditis elegans] emb|CAB03403.1| Hypothetical
  Gene Ontology: Mol. function=translation initiation factor activity; Cellular component=eukaryotic translation initiation factor 3 complex; Biological process=regulation of translational initiation
  Coding regions on vcDNA: vcDNA=SeqID_89983; Strand=+; Position=1-914
AICALIERAQNYXDTRRQSGAIDQAEILIIYGLRIEHLYYKYSSNEVEDEQLMDSLCKIVYAIGNAPLARQRAMLCQIYHHALHDRWHKAKNLLLMSHLQALVDHSDASTQILYNRTICQLGLCAFRHGFVREAHQNLSEIQNTQRAKDLLAQGIPPRQSEKTAEQELKERSLQVPYHMHINLELMECVYLICSMMLEIPNIACYEYDVRRRLLSRSFHYQLKFSEKAALIGPPENTREHVVAASRAMLRGEWIKCRNYIINDKMNAKVWNLFRNSDAVKQMLIQRVQE

SEQ ID NO: 163561 - protein, 115 aa, Heterodera glycines; identical to SEQ ID NO: 140217
  Coding regions on vcDNA: vcDNA=SeqID_89984; Strand=+; Position=2-349

SEQ ID NO: 163562 - protein, 211 aa, Heterodera glycines
  Homolog annotation: Hit_ID=AAD27589.1; Match level="QueryCoverage =97%, HitCoverage=34%, E-value=9e-87, Identity=79%"; Hit description =chaperonine protein HSP60 [Onchocerca volvulus]
  Gene Ontology: Mol. function=heat shock protein activity; Cellular component=mitochondrial inner membrane; Biological process=cell organization and biogenesis
  Coding regions on vcDNA: vcDNA=SeqID_89985; Strand=+; Position=18-650
TNNFLKMLSRLSKITVRGYAKDLKFGSEGRKAMLSGVDMLADAVAVTMGPKGRNVVIEQSWGSPKITKDGVTVAKAIDFKDKFQNMGAKLVQDVANKTNEEAGDGTTCATVLARAIAKEGFENISKGANPVEVRKGLMNAVDELVKELKAMSKTVTTPEEIAQVATIAANGDKTIRKLISDAMKNVGNKGVITAKDRTTLLDQLEFIEGIK

SEQ ID NO: 163563 - protein, 245 aa, Heterodera glycines
  Homolog annotation: Hit_ID=CAE63612.1; Match level="QueryCoverage =92%, HitCoverage=95%, E-value=4e-54, Identity=51%"; Hit description =Hypothetical protein CBG08105 [Caenorhabditis briggsae]
  Coding regions on vcDNA: vcDNA=SeqID_89986; Strand=+; Position=88-825
MQMMEPPKGKKSKNKLPNGLRPLLEAFARESLRSQPTDLAQFGQIFFETLIEQKMRNSESTVEALLGDKFNYDIFRSELHEKLKKFSSPQQNGRPKSPMDIAATKIQAIFRGHMVRTHPEKFGLDAETMDGLNQKMRRNSNERLETVDFKKDLKRHSIGGYSHAEQTNATPEDRAATKIQSEIRGFLARKHYEQQKKDSSVAATKIQAQIRGFLTRKRLEEQGFVLSPPRSRASTRASAGDVKAQ

SEQ ID NO: 163564 - protein, 373 aa, Heterodera glycines
  Homolog annotation: Hit_ID=EAL31058.1; Match level="QueryCoverage =58%, HitCoverage=54%, E-value=1e-17, Identity=29%"; Hit description =GA20281-PA [Drosophila pseudoobscura]
  Gene Ontology: Mol. function=transcription factor activity; Cellular component=nucleus; Biological process=transcription from Pol II promoter
  Coding regions on vcDNA: vcDNA=SeqID_89987; Strand=+; Position=39-1160
MIASENNHLEAQNGNSPEGEEESNCGGSASPSSLRDCHSRASTNEHTNISHHSLHDDNAPPSPSLANISTNIELHPHNNALGGSSSHKFIKRPLNAYMIWTRQERKRILTDDPKMKMNEVSKAIQMGEKWKKMSDKEKKPYFEMAKKFSEEHKLVLQEHPELQYAPSKKKVVKKLADGKQLSVVDSSSVKSCTITPDASRSTTPRGSSNLITPQPVSQSQMFSPFQSPTVQLAQVLQGVRSVTNQAAISSNSPIQNPLLGSASTFPQAFLQSHSLPQRVANSSVSLLGGMSQSGTTPVSAATRTTPGQMLDLYYTSLCQPAFPSITENPVNPLGMYPSHYLLEQYNQHLSQQQQQQGNNGGTSNASANGGGRF

SEQ ID NO: 163565 - protein, 174 aa, Heterodera glycines
  Homolog annotation: Hit_ID=NP_496065.1; Match level="QueryCoverage =97%, HitCoverage=92%, E-value=3e-49, Identity=51%"; Hit description =adrenal gland protein ad-004 like (21.0 kD) (2J887) [Caenorhabditis elegans] emb|CAA87383.2| Hypothetical
  Gene Ontology: Cellular component=nucleus; Biological process =response to oxidative stress
  Coding regions on vcDNA: vcDNA=SeqID_89988; Strand=+; Position=19-543
MGRRLPNVLVTGTPGTGKSTLAKKVAQNVGMEHIDTALIIKEREFYAEYDAQLDTHVLNEDALLDHLEERFGSDAGGLILDYHCAEMFPKRWFDLVIVLRCATDSLFDRLTERGYSERKRRENLEAEIFGIIAEEANASYDESVVHELENSTAEQLEANVRTVTNLVGAHKQRK

SEQ ID NO: 163566 - protein, 324 aa, Heterodera glycines
  Coding regions on vcDNA: vcDNA=SeqID_89989; Strand=+; Position=194 -1165
AVRGEDKENRGTTDTAKYGVDYDEMDKGSQQRPPPHPSDLPQSTSLRYPSNLSKISESPDEFSFSFKRGENAIQQFNRDHEELRRQNHLRLPSVSFHTSHYSMKHSWEESALRLQNATHCSFARPELDLSTVDVTETKQQLSSIKNQTVANSFSAFPNTSASNQSAAASPQFLSGSRHCIYFGFCRLDFESEQTLILRNRHPRGERVQIKCEWTVNTTNQPHYRILYPRETTQSREHTQILGSEQAAKVVIGFTPSDCAYYKNFLRIECKSRDETREYYFLVHGYGGRAVVEPTMEDRSANLCFSTNGQFQLIVRSISKFRFWL

SEQ ID NO: 163567 - protein, 93 aa, Heterodera glycines
  Coding regions on vcDNA: vcDNA=SeqID_89990; Strand=+; Position=95-376
MTSSTLGATIIRHSILALRTRSAMPKQQKRFRRQCRLSKTTMPSRARSMMMAFSLYNNNIPPTTPPTTVGRRMAFLLSAKNCRRTNSKSRRCC

SEQ ID NO: 163568 - protein, 423 aa, Heterodera glycines
  Homolog annotation: Hit_ID=AAH68338.1; Match level="QueryCoverage =66%, HitCoverage=72%, E-value=5e-21, Identity=27%"; Hit description =Unknown (protein for MGC:85638) [Danio rerio]
  Gene Ontology: Cellular component=nucleus; Biological process=DNA damage response, signal transduction resulting in cell cycle arrest
  Coding regions on vcDNA: vcDNA=SeqID_89991; Strand=+; Position=1-1269
PSPTPEVTFKDRSVHEIHLENGYTYVIEQNLKHFASVITVLAKFSEQILLQPTEDGLMLSASSSARSAYAKVKLCRQFFDRLRARENLGPDGEVFCRLATKSLMHIFKSAAQSSVGPVPSCSLELDPQSDFAYVHLQCLSGIRRCFVLSLREYAMVCDNVFNERQRLKNRVTAHAKMLATLLSPLDCSDLELVALADRFTACRYIPREEYGKVRRTEVQIPVDHCEQYRIEVPTRVVVNLRELRPILQFADLCGMSVSLHFDRAGRPLIVAVEENVDFAAEFVLGTLDEQLPLNEQQQQPTPQQQQEQQPVVQQREEQPPQHRHNQMLRHHSPAPAAVAERVEEEHNETTPNRDQMLMVQQEEDVQLSIRSTPILPIAALRQEEHNETAPNHGQMSIGPTPILAVAATVQQQQEAHNEISQND

SEQ ID NO: 163569 - protein, 200 aa, Heterodera glycines
  Homolog annotation: Hit_ID=CAE57332.1; Match level="QueryCoverage =75%, HitCoverage=54%, E-value=3e-18, Identity=35%"; Hit description =Hypothetical protein CBG00261 [Caenorhabditis briggsae]
  Coding regions on vcDNA: vcDNA=SeqID_89992; Strand=+; Position=19-618
MNDLLPLPNSLSSPSLLSSSSSSADAVKEYRLVLLGTQHKKPLFEKMCSAAQKFEQHIQYADIWYLTFQFKDSEEPVVVEITDPGTEKTGERQMAIQQKSDAIILCYSAFNPGSFLALESVTEDFQTFNGKPPATLLLCNEDQLAEEGFEDGHETDTADDGYGTNSGGGSPSDREMPPQTVPKRRSTTPTGRQHSMERIR

SEQ ID NO: 163570 - protein, 209 aa, Heterodera glycines
  Homolog annotation: Hit_ID=NP_729620.1; Match level="QueryCoverage =82%, HitCoverage=52%, E-value=1e-23, Identity=36%"; Hit description =CG32066-PC, isoform C [Drosophila melanogaster] ref|NP_729619.1| CG32066-PB, isoform B [Drosophila melano
  Coding regions on vcDNA: vcDNA=SeqID_89993; Strand=+; Position=31-657
MTRSRSGSRCGDVVRYVLGQNTHQQSYNQHIYDDIDVFLDFSHCRPSDQERALFFELEAVLQFAQRSADCLAIYGAGASAEVRAALQNCDDADIQNASFAIVRQFVRRIRKYFETAQRIEKVVPELLWELCSGPLPPVEQLDSAQALCKQLARLIDFVFHFEKMKMNTPGDAGTTFSFFRRVISRKQAAAREAETDCSLELGHTISLFL

SEQ ID NO: 163571 - protein, 92 aa, Heterodera glycines; identical to SEQ ID NO: 148997
  Coding regions on vcDNA: vcDNA=SeqID_89994; Strand=+; Position=67-345

SEQ ID NO: 163572 - protein, 69 aa, Heterodera glycines
  Coding regions on vcDNA: vcDNA=SeqID_89995; Strand=-; Position=1-207
FFFFFFLFKQIYFYATVRHSAAAKETKKKNSKNNKSAKFHVKKDKVNQIFLGADFSPRFSASLFYCRVQ

SEQ ID NO: 163573 - protein, 165 aa, Heterodera glycines
  Coding regions on vcDNA: vcDNA=SeqID_89996; Strand=+; Position=7-504
VTFFLMLATVRFHSVTNNRIDCCQQTLFSLDDSENLPGTDFSVGKAKSKLLSDGRREQQKMAKKTNGGKTEGIGKTAAGGSRGSDSLLTDEVQLDGGAADGASDDESGDFLPIALGTKCAAGHAEENGRANWAANWRLSGRRCLKRASVVLGCCFPWAVGFKQFK

SEQ ID NO: 163574 - protein, 104 aa, Heterodera glycines
  Homolog annotation: Hit_ID=NP_502198.1; Match level="QueryCoverage =71%, HitCoverage=19%, E-value=3e-09, Identity=40%"; Hit description =splicing factor (41.2 kD) (4M403) [Caenorhabditis elegans] emb|CAA97799.1| Hypothetical protein F58B3.7 [
  Coding regions on vcDNA: vcDNA=SeqID_89997; Strand=+; Position=337-648
MPQLLNKKGGTFKLKPHKAIPLPIDSTGAFTLVPKSLKEDKVFLFGELMVEDEYNPTAPTDYSSFKQKREQQRLKEKIAKEIADRLAKEAADEEDKRRKGAAIA

SEQ ID NO: 163575 - protein, 202 aa, Heterodera glycines
  Homolog annotation: Hit_ID=NP_496925.1; Match level="QueryCoverage =96%, HitCoverage=61%, E-value=4e-57, Identity=55%"; Hit description =aldo-keto reductase family 1 member (35.2 kD) (2O262) [Caenorhabditis elegans] emb|CAB54385.1| Hypothetic
  Gene Ontology: Mol. function=electron transporter activity; Biological process=glucose metabolism
  Coding regions on vcDNA: vcDNA=SeqID_89998; Strand=+; Position=46-651
MSSASSPVPSLILNSGFPMSQIGFGTWMCKPTEVNEIVKSAIRNGYRHLDCAFIYQNQSEIGAALKDMLQHGEIKREDLFITSKVWNTFHSFDAALANVQKSLEQLGLDYLDLCLIHWPMGYKEGTELFPKDAEGQKVFLSDVDFLDTWRALEKAVALGRVRSIGVSNFNSAQIQRIIDNCNIRPSVLQTECHVFFQQKKLR

SEQ ID NO: 163576 - protein, 330 aa, Heterodera glycines
  Homolog annotation: Hit_ID=CAE66637.1; Match level="QueryCoverage =100%, HitCoverage=79%, E-value=1e-121, Identity=66%"; Hit description=Hypothetical protein CBG11974 [Caenorhabditis briggsae]
  Gene Ontology: Mol. function=phosphoglycerate kinase activity; Cellular component=cytosol; Biological process=glycolysis
  Coding regions on vcDNA: vcDNA=SeqID_89999; Strand=+; Position=58-1047
MGSFSKLAIDQLELKGKRVLMRVDFNVPIKDGKVTSNQRIVAALSTIKYAIDHEAKSVVLMSHLGRPDGQAQAKYSMKPVHEELERLLGKTVVFLTDCVGTEIENATADPKPGTIILLENLRFHVEEEGKGKNSAGETVKASKEAVNAFRASLSKHGDLYVNDAFGTAHRAHSSMVGCAMEKRASGFLMKKELEYFAKALESPTRPFLAILGGAKVADKIQLINNLLDKVDEMVICGGMAFTFYKVLTGKSIGKSLFDEEGSKIINDLMAKAKDKNVKIHQPVDFVVGDEFKEGTPFANVDAKDGIPNGKMGLDIGQETLKQFAEVIGRA

SEQ ID NO: 163577 - protein, 127 aa, Heterodera glycines
  Coding regions on vcDNA: vcDNA=SeqID_90000; Strand=+; Position=81-464
MAEETSKTSENIAEDNGIKALDSLFAAVAHASKCLASAAGTPNFCLATPAFLAFMVWCCFLMPPVAVLFRSYRRDGNAFTVQAAYNVILCFFLWVPGMLHALWFCFGETVRMLRRRVPPSDDAQKNE

SEQ ID NO: 163578 - protein, 83 aa, Heterodera glycines
  Coding regions on vcDNA: vcDNA=SeqID_90001; Strand=+; Position=65-316
MHFLLNFKLFASIFLVLCVVSFVVCQDKPAEACLHPKDEGTGGLALTRWWWDGSDCEEFTYKGQGGNTNNFPSKELCDDVCKP

SEQ ID NO: 163579 - protein, 150 aa, Heterodera glycines
  Homolog annotation: Hit_ID=CAE56164.1; Match level="QueryCoverage =78%, HitCoverage=62%, E-value=2e-15, Identity=32%"; Hit description =Hypothetical protein CBG23784 [Caenorhabditis briggsae]
  Coding regions on vcDNA: vcDNA=SeqID_90002; Strand=+; Position=177-629
MEHMWSCATKWQWEKPGVSMKWEITDTLTEAAVDTDCPSRKNRMNNCCYLQTECYNKQIGQKSCDNQFCECMERATAGKKRCSIWEGPGFCRHYRLYGESAYRAAAPPFWSSCGTVLNSEKYLGCPCGTYKTWERCGFLYMGYRYLCYAC

SEQ ID NO: 163580 - protein, 224 aa, Heterodera glycines
  misc_feature (66)..(66): Xaa can be any naturally occurring amino acid
  Homolog annotation: Hit_ID=CAA65506.1; Match level="QueryCoverage =99%, HitCoverage=77%, E-value=1e-73, Identity=60%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Coding regions on vcDNA: vcDNA=SeqID_90003; Strand=+; Position=3-675
DSLRRLAFFGVALSTVSTLICVLSVPMVYSYVQHINSQMMAEVDFCKMRSGNIWREVTRTQGMHAXTRHRVARNADACCGCGESPRGPPGPPGPDGNPGGDGQPGGPGQPGAPAQAPPRPKPSGTGCQTCAPAENGHPGPQGPPGQPGAAGEPGAPGYPGKKGPRGPPGPAGPDGKPGDAGAPGQPGAPGELKPGPVKVGPPGPPGYPGKPGGPGQPGQPGEPG

SEQ ID NO: 163581 - protein, 181 aa, Heterodera glycines
  Homolog annotation: Hit_ID=NP_496839.1; Match level="QueryCoverage =97%, HitCoverage=96%, E-value=5e-33, Identity=45%"; Hit description =putative mitochondrial protein of bilaterial origin (18.4 kD) (2N784) [Caenorhabditis elegans] emb|CAB043
  Coding regions on vcDNA: vcDNA=SeqID_90004; Strand=+; Position=70-615
MSKIPKLAPAGLKNRAPSPFIAWLRNALLKVKRDPTLTPPSNIPKPDEQSQFRPHNRFPNTQSSRSIEPAMAQGGVHHKLADNYYLERDGRREVRPPKPIYKALGETPLWEKPSGGQSLTTEQMGKNIGAAINKGPAQNYGISFPTPGFGYEWKRNAEVEQFTQQRNAEFAKLEKYDKFVK

SEQ ID NO: 163582 - protein, 186 aa, Heterodera glycines
  misc_feature (153)..(153): Xaa can be any naturally occurring amino acid
  Homolog annotation: Hit_ID=NP_741434.1; Match level="QueryCoverage =89%, HitCoverage=33%, E-value=3e-24, Identity=42%"; Hit description =jun N-terminal Kinase, required for movement coordination and response to heavy metals (52.9 kD) (jnk-1)
  Gene Ontology: Mol. function=protein tyrosine kinase activity; Cellular component=nucleus; Biological process=JNK cascade
  Coding regions on vcDNA: vcDNA=SeqID_90005; Strand=+; Position=83-641
FAAPFHCRHSKIPNSTLPGQISTFGSSFRGHLSNLFGSVQQWFNTSASARVVSSADEAFTPSFEQSALSPPLSQTHMNSISSQGLAEPSVMNNSNTNLQTFREVLFNETVLKLLRRYEFVGSIGSGAQGLVICCKDLLTNQRVAIKRLTRPFXNVIHAKRAYREFEIMNLVNHRNIIKLLYAYTSQ

SEQ ID NO: 163583 - protein, 260 aa, Heterodera glycines
  Coding regions on vcDNA: vcDNA=SeqID_90006; Strand=+; Position=30-809
LIRFPSQMPFLSLFSSVSAFALLSLLSFSSSVHHFHHNHHSDSSKGHNGHHQQKDHQTAQEIPSNSFPCACGGHSSGGENARWMNGMPANGVPLFLFPDNVLRLVGVVLRSENAFHRDNNELARHLFHLLAHQFPRKWFIVGIGTMPSNGANEPKMWAREGIDALNGTVQLQSPPGYGSFPFLDGRRFQRENGSKIWYFVYAVEPMTDKAKDGLPKQSLAKCLSEGCPSRDNFASLCANNRRQLGTVVEFDQSSEMSIFA

SEQ ID NO: 163584 - protein, 82 aa, Heterodera glycines
  Coding regions on vcDNA: vcDNA=SeqID_90007; Strand=+; Position=87-332
CIFLQSLTISKISPPTLVTFPIVLFASFLSLFISFRFKAFSVFSLSLHSLRVFLFNYLFSYIIVDYTALKKIHVKKKKKKKK

SEQ ID NO: 163585 - protein, 66 aa, Heterodera glycines
  Coding regions on vcDNA: vcDNA=SeqID_90008; Strand=-; Position=2-199
FELAAVHLSSALLSLSLIILHFPHLLRHFSWHRPEILGPRAHSQAALFDHTDAQVDATVQHAHIVL

SEQ ID NO: 163586 - protein, 129 aa, Heterodera glycines
  Homolog annotation: Hit_ID=CAE62128.1; Match level="QueryCoverage =74%, HitCoverage=40%, E-value=2e-22, Identity=53%"; Hit description =Hypothetical protein CBG06172 [Caenorhabditis briggsae]
  Coding regions on vcDNA: vcDNA=SeqID_90009; Strand=+; Position=21-410
MLFASSVFRFFLRPPPKRYSSFLLNTMWSPLFCLLVFAGLAACCVSLPQIQYVNDKPYYLMQNMECRGGKIYEINQVQDIDECKAACVTRNCRAVNLFQLGEFQFKCEILAHVHGYFPAQGAACYISYV

SEQ ID NO: 163587 - protein, 171 aa, Heterodera glycines
  Homolog annotation: Hit_ID=CAE74703.1; Match level="QueryCoverage =89%, HitCoverage=78%, E-value=6e-25, Identity=39%"; Hit description =Hypothetical protein CBG22518 [Caenorhabditis briggsae]
  Coding regions on vcDNA: vcDNA=SeqID_90010; Strand=+; Position=260-772
MDSVSTIAKDGHGVVKYFCVASLDLPDDGGDNEIVAEKEFAVTAYLNLDAPHFREPAHSSEQITKGGVFCGRIRRVKAELCVEELGLMTGETCEVTLTVENTAKRGRRKSHAGEGHKCGLISLCQQVDFKAKAKTGEWQKRSLTTAVQSQGICKANCAKKPETRRTQFIIP

SEQ ID NO: 163588 - protein, 135 aa, Heterodera glycines
  Homolog annotation: Hit_ID=XP_326638.1; Match level="QueryCoverage =95%, HitCoverage=73%, E-value=4e-13, Identity=37%"; Hit description =predicted protein [Neurospora crassa] emb|CAD21384.1| related to high mobility group protein i/y (hmga) [
  Coding regions on vcDNA: vcDNA=SeqID_90011; Strand=+; Position=59-466
MDPSAPAKKRGRPPKAGGVAKTIAKKPPATTKAAPKSPSKSPAKSPPSSPPQPAKGSPAAKNAVKPAAATGRGRGRPKGTGTSAAAKKKAAAPAGGGTGKRGRPPKKTAQKAKESDTDEHDEGTDPDESASSKSP

SEQ ID NO: 163589 - protein, 334 aa, Heterodera glycines
  Homolog annotation: Hit_ID=NP_493547.1; Match level="QueryCoverage =98%, HitCoverage=61%, E-value=1e-112, Identity=59%"; Hit description= endoplasmic Reticulum Oxidase (59.3 kD) (ero-1) [Caenorhabditis elegans]
  Gene Ontology: Mol. function=electron carrier activity; Cellular component=endoplasmic reticulum; Biological process=protein folding
  Coding regions on vcDNA: vcDNA=SeqID_90012; Strand=+; Position=3-1007
PLDDSLSEFDRAQLRELDMFEDNSNKFCEVEDENPERMHYVNLAKNPERYTGYKGNSAVKVWKCIYNENCFKPDPKFDKKFLLQPTPTGMCLEKRVFYRLISGLHSAITVSIAAHNYRPAPGGFGTGTWYRNVEFFENRFGTKWGKEGPERLRNLYFTYMLELRALVKATPYIRKSQLFYTGNEQEDRETQQSLEHFLAVLKEFPNQFDETQLFSNFQESHARLLKEEFRLHFWNISRIMDCVGCDKCRLWGKLQTHGMGTALKVLFSDLPRNGNGGKANGRKEQTENGESAANGGLFKLTRNDLVALFQSFGRYSSSIWEIDGFRKEFRHDEL

SEQ ID NO: 163590 - protein, 153 aa, Heterodera glycines
  Homolog annotation: Hit_ID=XP_448490.1; Match level="QueryCoverage =84%, HitCoverage=97%, E-value=4e-43, Identity=66%"; Hit description =unnamed protein product [Candida glabrata] emb|CAG61451.1| unnamed protein product [Candida glabrata CBS1
  Gene Ontology: Mol. function=structural constituent of ribosome; Cellular component=cytosolic small ribosomal subunit (sensu Eukarya); Biological process=ribosomal small subunit assembly and maintenance
  Coding regions on vcDNA: vcDNA=SeqID_90013; Strand=+; Position=25-486
MGRVRTKTVKKASRVMIEKYYPRLTLDFQSNKKVASEVASISSKRLRNKIAGFTTHLMRRIQKGPVRGISFKLQEEERERKDNYVPDVSALEQNELVVDTETAALLASLDIKLPQIRTVAVTAQGERQGRNAVVGANFRGDRGDRPRRPKTQQ

SEQ ID NO: 163591 - protein, 72 aa, Heterodera glycines
  Homolog annotation: Hit_ID=CAE56710.1; Match level="QueryCoverage =100%, HitCoverage=17%, E-value=3e-18, Identity=56%"; Hit description= Hypothetical protein CBG24496 [Caenorhabditis briggsae]
  Gene Ontology: Mol. function=protein binding; Cellular component =postsynaptic membrane; Biological process=muscle contraction
  Coding regions on vcDNA: vcDNA=SeqID_90014; Strand=+; Position=2-217
KIFPGMSADKTGALFVGDIILAVNGESLLNARHDDAVRALKQNGKMVNLQVQYRRDLHLRRENMLHRLNWEE

SEQ ID NO: 163592 - protein, 251 aa, Heterodera glycines
  Homolog annotation: Hit_ID=CAE72273.1; Match level="QueryCoverage =99%, HitCoverage=35%, E-value=8e-25, Identity=30%"; Hit description =Hypothetical protein CBG19393 [Caenorhabditis briggsae]
  Gene Ontology: Mol. function=calpain activity
  Coding regions on vcDNA: vcDNA=SeqID_90015; Strand=+; Position=19-774
MIRLIIDEPTQLCATLFQQHARTMLDQVDIMLLLHRQDGEATPGELICRSSRRVLPCVRIDDTFLPRGEYLLCAHSFSKFGEQMVSGTIVIHSSREIQTMKLRTTTLDDLRQSMCSLLLKEGVLQNSSPGIATRYLTNEFAGLVLMVDNYSSDNCLKVHSDCQNSTNVLSTRSSLLAFDSIPPLHRQVVTLLTHFEPSQSFMVTHRWVYHQTKFPQLRDFVPCTEFASAQNFPPLQTETIGYLHGPFPVYK

SEQ ID NO: 163593 - protein, 212 aa, Heterodera glycines
  Coding regions on vcDNA: vcDNA=SeqID_90016; Strand=+; Position=3-641
MFHIHRYDKLQWCGLAIHRRTLSLTVDYCRYRQRRPSISFPSSAVRSSDHFRFICNTTNHRFLPLGVGRLNSILHSTVCGVGPSNFSAGFANHLVQHRFLSSKSDGLNVFEPKWKKAILVVLLVSAVIVLIILEARSNLATDEEGEGLEEHRRKEEEKRRGRQERMAANRLPPAEPEAEEEPEVIPWQARSADDDDDHDDPDAPDNWRNRTN

SEQ ID NO: 163594 - protein, 209 aa, Heterodera glycines
  Homolog annotation: Hit_ID=CAE70921.1; Match level="QueryCoverage =81%, HitCoverage=16%, E-value=5e-18, Identity=31%"; Hit description =Hypothetical protein CBG17720 [Caenorhabditis briggsae]
  Gene Ontology: Mol. function=translation initiation factor activity; Biological process=embryonic development
  Coding regions on vcDNA: vcDNA=SeqID_90017; Strand=+; Position=36-665
MLRKLKANRERPPSLIFIIRDGLDEGKVDNALSSEIGLFRESCSQISQSWKPKFVYCLADKRHNRRFFEVEERLPDAAQPRNVCNPQPGSAVDRKLTRSGVLNLYVQAHHPVRGTAKIPEFIFPCNEVCATKEELEAFINGLCHSWQIVKAATSLPVPVYQAHELAKRGRSNYMELRRMAPERIPRSVVFSSDVRTIIRVALLQRQSSQ

SEQ ID NO: 163595 - protein, 200 aa, Heterodera glycines
  Homolog annotation: Hit_ID=AAH44041.1; Match level="QueryCoverage =99%, HitCoverage=20%, E-value=2e-89, Identity=78%"; Hit description =MGC53479 protein [Xenopus laevis]
  Gene Ontology: Mol. function=ATP binding; Cellular component=snRNP U6; Biological process=signal transduction
  Coding regions on vcDNA: vcDNA=SeqID_90018; Strand=+; Position=3-602
LVLMEGIDQPVTKTCTIVEKDYDQHELFIFRPLKFNTCSVVKLSIEPINPSELPKMLDSLRKVNKSYPLLTTRVEESGEHVMLGTGELYMDCVMHDMRKVFSEIDIKVADPVVSFCETVGETSSLKCFAQTPNQKNKITMIAEPLEKGLAEDIEGEIVKIIWNRKQLGDFFQTKYEWDLLAARSIWAFGPETNGPNIFLD

SEQ ID NO: 163596 - protein, 99 aa, Heterodera glycines
  Homolog annotation: Hit_ID=AAH87436.1; Match level="QueryCoverage =87%, HitCoverage=24%, E-value=6e-21, Identity=50%"; Hit description =Unknown (protein for MGC:99248) [Xenopus laevis]
  Gene Ontology: Mol. function=galactosyltransferase activity; Cellular component=integral to membrane; Biological process=sphingolipid biosynthesis
  Coding regions on vcDNA: vcDNA=SeqID_90019; Strand=+; Position=1-583
EITNSGKWDCIILHDVDLVPEHDHNLYRCFKDHPTHFFRRFDENNYAPLPDNNFGEVSGFTPEQYQRVNGYSNLFWGWGDEDVDMFNRILSVGYPDERK

SEQ ID NO: 163597 - protein, 207 aa, Heterodera glycines
  Coding regions on vcDNA: vcDNA=SeqID_90020; Strand=+; Position=7-627
AAFICPFRFLLLFLALVIKFHPLRSFWPSLPQMTEVPPNARQWTLHFGGLVEAVNGAHIDPSGRTDLLKVLDRAKRDGSLQLDGGEITLLECDCDAVRVSSAKVDESSKPLAFIPLHQLSSVGFVHEPPQNILALKVGDVDENKPDQFDLIILYTSTEEMAGEICQYLAFCFQFIYREALSTLEQNEHEREERKKTPQQGDISAKFA

SEQ ID NO: 163598 - protein, 172 aa, Heterodera glycines
  Homolog annotation: Hit_ID=CAE60358.1; Match level="QueryCoverage =97%, HitCoverage=96%, E-value=4e-71, Identity=76%"; Hit description =Hypothetical protein CBG03955 [Caenorhabditis briggsae]
  Gene Ontology: Mol. function=calcium ion binding; Cellular component =plasma membrane; Biological process=regulation of action potential
  Coding regions on vcDNA: vcDNA=SeqID_90021; Strand=+; Position=33-551
MVTSSPDIQLIFQSVDRDRSGQISADELQQALSNGTWKPFNPETCRMMISMFDSNNDGGINFQEFGALWEYINDWTRTFRTFDRDNSGNIDRDELVNALTQFGYRLSGTFYDMLMRKFDRTQSGRINFDDFIQLCVVLQTLTTAFREKDTDRDGWIRIYYEEFLAMVFSLKM

SEQ ID NO: 163599 - protein, 260 aa, Heterodera glycines
  Homolog annotation: Hit_ID=CAE56933.1; Match level="QueryCoverage =95%, HitCoverage=94%, E-value=3e-54, Identity=44%"; Hit description =Hypothetical protein CBG24778 [Caenorhabditis briggsae]
  Gene Ontology: Mol. function=endopeptidase activity; Cellular component=26S proteasome; Biological process=proteolysis and peptidolysis
  Coding regions on vcDNA: vcDNA=SeqID_90022; Strand=+; Position=62-844
MNNYEFAMNSPHMEMAKFKEFMDDSSEEFVALSPMIQNQRDWSPYSNQGGTVCVLVGDDFVVVANDTRLTGDAEIEILSRKCEKTHILTNKIIMTSCGFYGDVLQLRRILELRINHFEFIYQRPMSLDQCGEMLSRTLYSRRFFPYFTGTIICGITSDGRGDLYSYDPVGCIETKLFEASGNGGSTLSTFFENQWAYSTVAPEERKNMPKRTLERALSVIRDAFRGLSERETTTGDSLNVYWLQAGDEKVHQETYRLRGD

SEQ ID NO: 163600 - protein, 110 aa, Heterodera glycines
  Coding regions on vcDNA: vcDNA=SeqID_90023; Strand=-; Position=2-331
AAGTAVISTRGSTTVISSSSSSSSSAMLTASSSRAMAGFFAQNTAPSGFNGSADNANEAAFDQRRQRAQSDQKNKSDQTKEGHFGNEVIELVSSCYELRVYETMRLVLAA

SEQ ID NO: 163601 - protein, 161 aa, Heterodera glycines
  Homolog annotation: Hit_ID=EAA00161.2; Match level="QueryCoverage =95%, HitCoverage=57%, E-value=1e-14, Identity=31%"; Hit description =ENSANGP00000011626 [Anopheles gambiae str. PEST]
  Coding regions on vcDNA: vcDNA=SeqID_90024; Strand=+; Position=19-504
MEKERDILVSLASKHRTVPYDVLMNALKIANEREFEDFIIESIYQDIIQGRLNPIKRHLEIYDWKNEKVGDFQFMAETLNQWDKHCGNFLNSIGTEMIRSNNTAAEFVANEKAVNEEIENIRKTFSYEDPKKFLGDKDTFKTSSKPEAKKFKSMKNKKPGN

SEQ ID NO: 163602 - protein, 155 aa, Heterodera glycines
  Homolog annotation: Hit_ID=CAE73776.1; Match level="QueryCoverage =94%, HitCoverage=19%, E-value=1e-49, Identity=64%"; Hit description =Hypothetical protein CBG21320 [Caenorhabditis briggsae]
  Gene Ontology: Mol. function=glycine-tRNA ligase activity; Cellular component=mitochondrion; Biological process=tRNA modification
  Coding regions on vcDNA: vcDNA=SeqID_90025; Strand=+; Position=2-469
LVPNSARGGRILYAVLEHSFRQREGDEKRCYLELPPLIAPIKCSILPISSNERLDPIIFAVRDQLTSREISSKIDDSSGSIGRRYARTDEIGIPFGITVDFESELQPWTVTLRNAPTMQQIRVSVSEIGEVVGHLVKGKMNWETAMAKYPIFNAK

SEQ ID NO: 163603 - protein, 208 aa, Heterodera glycines
  Homolog annotation: Hit_ID=CAE68901.1; Match level="QueryCoverage =94%, HitCoverage=68%, E-value=5e-62, Identity=60%"; Hit description =Hypothetical protein CBG14873 [Caenorhabditis briggsae]
  Gene Ontology: Mol. function=structural constituent of ribosome; Cellular component=mitochondrial ribosome; Biological process =protein biosynthesis
  Coding regions on vcDNA: vcDNA=SeqID_90026; Strand=+; Position=24-647
MHLSVCSLLLKRLPSTRLATTLANVRAKNVKQPSTERINAISLDDFPIAYPDFLRSEVLDRRDPLFEQLVQADMFERRMVIDIPEFYVGSVLAVTMSDPNTVSKQHRFVGICIRREKQGLQHTFTLRNVIDGLGIEIMYEIYNPTILRIETLLLEKRLDEDLTYLADALPEYTTFKFNMEPVSHTAGKPVPVNPLKVKLKPPPWTLQW

SEQ ID NO: 163604 - protein, 186 aa, Heterodera glycines
  Homolog annotation: Hit_ID=AAH67612.1; Match level="QueryCoverage =95%, HitCoverage=96%, E-value=1e-51, Identity=51%"; Hit description =LOC407684 protein [Danio rerio]
  Gene Ontology: Cellular component=endosome; Biological process =conjugation with cellular fusion
  Coding regions on vcDNA: vcDNA=SeqID_90027; Strand=+; Position=10-570
AYFINFDVKLAMSFQWPWHFDFPPFFTIQPNLSTRDKQLKAWGRLLLDYCQANRIYTTDLDEISKSDLFNNRRLNRHLDLSGIRAVFDFLELQKHVEWKDKDKTRCNIYWRRPEEWGQLLYEWANSIGLLNTVVTLYELTQGEDVAKESFYGLDKDVLLKGLQHLENQGKAVLIDIDGEKGGVKFL

SEQ ID NO: 163605 - protein, 154 aa, Heterodera glycines
  Homolog annotation: Hit_ID=EAA05601.2; Match level="QueryCoverage =77%, HitCoverage=29%, E-value=1e-10, Identity=33%"; Hit description =ENSANGP00000012577 [Anopheles gambiae str. PEST]
  Gene Ontology: Mol. function=transcription factor activity; Biological process=cell proliferation
  Coding regions on vcDNA: vcDNA=SeqID_90028; Strand=+; Position=59-523
SSMNAYQQQQQQQLLQAYYSQFQPQGVAGADGQVPAKYKSTLCNIWLMEGICTRGKQCHYAHGIKELNYRQDDTMSRFYKTSLCTFYQQRGFCNNGDQCRWAHGEAELRKGADGSSNGLANYYAATMQAMATGQQNANGSSAEAAAAAAAAGWN

SEQ ID NO: 163606 - protein, 192 aa, Heterodera glycines
  Homolog annotation: Hit_ID=NP_499693.1; Match level="QueryCoverage =84%, HitCoverage=33%, E-value=3e-45, Identity=53%"; Hit description =dehydrogenase, E1 component (3O58) [Caenorhabditis elegans] pir||T26758 hypothetical protein Y39E4A.3 - C
  Gene Ontology: Mol. function=3-methyl-2-oxobutanoate dehydrogenase (lipoamide) activity; Cellular component=mitochondrion
  Coding regions on vcDNA: vcDNA=SeqID_90029; Strand=+; Position=54-629
MMNLFKFRDIVLLRTIAFPPNFVLNRGINYRENSTIGSKQSIGNADEFKLREFGQKYLGKKEVKFTEKLEFRSSANEVPMPIYQCINSRGEFVDGSEECPLPKEIAVKIYKEMVKLNTMDKILYESQRQGRISFYMTNFGEEASHMGSAAALELRDLVYGQYREVGVLLWRGFSLDQCMNQCYGNELDEGKG

SEQ ID NO: 163607 - protein, 168 aa, Heterodera glycines
  Coding regions on vcDNA: vcDNA=SeqID_90030; Strand=-; Position=50-556
FQKLKTVSAEKKAFSGKSGIFGENVEQQRRRRAWQQRTRFTAPDGRRKGRTSRNRAKFVLPMRKPTTGTEHQRRRRAWQQRTRFTAPDGRRKGRTSRDRAKFVLPMRKPTTGTEPAKSILTVVMAQLRFELLRLLRLGLRLDTVTNPMKGTTLHAKASTVDQCDKMVH

SEQ ID NO: 163608 - protein, 207 aa, Heterodera glycines
  misc_feature (197)..(197): Xaa can be any naturally occurring amino acid
  Homolog annotation: Hit_ID=AAK94486.1; Match level="QueryCoverage =100%, HitCoverage=98%, E-value=1e-114, Identity=98%"; Hit description=putative gluthathione reductase [Heterodera glycines]
  Gene Ontology: Mol. function=thioredoxin reductase (NADPH) activity; Cellular component=mitochondrion; Biological process=response to oxidative stress
  Coding regions on vcDNA: vcDNA=SeqID_90031; Strand=+; Position=22-641
MKKFDYLVIGGGSGGIASARRAAEFKVKVGLIESERLGGTCVNLGCVPKKVMYNTAIHAEFLRDHADYGFDSMNVKFNWSKIKNSRDEYIRRLNSMYQTNLENSKVEIVRGRAKFNKDGSVEVSRSDGSKETCQGTHTLIAVGGAPRIPKDVPGAKYGTSSDGFFGFEQMPNKTVVVGAGYIAVELASILADLGSEXHLLIRYDRVL

SEQ ID NO: 163609 - protein, 195 aa, Heterodera glycines
  Coding regions on vcDNA: vcDNA=SeqID_90032; Strand=+; Position=3-587
RLPTEDNGTTSGENPSHQLDDGDDVHQFQLPLAFRSSLVHPSTTTAQNVHHHQLLQQPQLNIIVPSMECVSVIHPKREQQFSASVDQFLDGEDDLFKTEPLDLSLSSARTKANENGTMVGNGATVAGGIQRRKRTTNKRQMVEEMCETAATGRKVTPTEAEKRTSPPSAVGISLPPSVVPPSGTLFTPLASPSAV

SEQ ID NO: 163610 - protein, 195 aa, Heterodera glycines
  misc_feature (158)..(158): Xaa can be any naturally occurring amino acid
  Homolog annotation: Hit_ID=CAE68470.1; Match level="QueryCoverage =68%, HitCoverage=48%, E-value=4e-14, Identity=32%"; Hit description =Hypothetical protein CBG14269 [Caenorhabditis briggsae]
  Coding regions on vcDNA: vcDNA=SeqID_90033; Strand=+; Position=49-634
MSQREEPRPQIKAKLKNSLIAFHLFLLVSGVVLFSFALWLQFDPAREFLLRLVHFSESTPFFEIAVYLMLGTSLFIFIAVGIGFSGIWKLERCLLSGFSVLLLLLIHCKLLILILLVAYRFKFPDDTVMTEYLSKMAQHHYHRDKWATPLMDSVQFYXNVAEETVRKTIRSHFGTKRTPKWECQQTAQDARAWHL

SEQ ID NO: 163611 - protein, 84 aa, Heterodera glycines
  Homolog annotation: Hit_ID=CAE59446.1; Match level="QueryCoverage =100%, HitCoverage=100%, E-value=2e-24, Identity=64%"; Hit description=Hypothetical protein CBG02821 [Caenorhabditis briggsae]
  Coding regions on vcDNA: vcDNA=SeqID_90034; Strand=+; Position=48-302
MPAVPSGYQVVQQGRQGPSCMDKLKLGFAMGVLIGGSTGVLIGTFTSLRMGLRGRELLRQTGKIAAQMGGSFGVFMTVAQGIRC

SEQ ID NO: 163612 - protein, 252 aa, Heterodera glycines
  misc_feature (162)..(162): Xaa can be any naturally occurring amino acid
  Homolog annotation: Hit_ID=CAE71307.1; Match level="QueryCoverage =82%, HitCoverage=62%, E-value=4e-62, Identity=54%"; Hit description =Hypothetical protein CBG18196 [Caenorhabditis briggsae]
  Coding regions on vcDNA: vcDNA=SeqID_90035; Strand=+; Position=112-870
MDPPDLSETQPTIPKRGHHHRRRVDISASRLPRAVLVRIFGHLSVAELGAVSLVCCSWKFIVDSNDFDLWARHARAQLPESALSDPYLFVNISSHREMLRAFKHAWNPSDCSRNAFVRTNGFTVHRQPIAQSTDGIRGKVGVSSGAHCWEFCWEGPLGTTAXVGVATKHAALHCPGYLPVIGSDDQSWGWNLVNNTIAHNGEFVERYPRLNKRRNDGSKQRKTERTKKVIKTPTSMSLTDRGLMVYFHYTYK

SEQ ID NO: 163613 - protein, 179 aa, Heterodera glycines
  Homolog annotation: Hit_ID=CAE75263.1; Match level="QueryCoverage =98%, HitCoverage=91%, E-value=1e-61, Identity=62%"; Hit description =Hypothetical protein CBG23226 [Caenorhabditis briggsae]
  Coding regions on vcDNA: vcDNA=SeqID_90036; Strand=+; Position=3-583
LLLLFAFLVILPPVCSRYEDRYNMNMLPWDLKPVQDFIGLWQMDRSSGNFKELPPPNLIDLAINPIPKFGARTMNITHTYLDSARNVIRSDYGFMPVKNATRRDPRVHVAYLTTSSEGWSMMEQGFFKDGKLIFHLKQFLKRSFGAGSNLDIREFERQFELSGFHSMTLKVRAETSFQT

SEQ ID NO: 163614 - protein, 324 aa, Heterodera glycines
  Coding regions on vcDNA: vcDNA=SeqID_90037; Strand=+; Position=74-1045
MSVEESPLLREFKTFLQATLVAFGSDGAPFSLVNQRFSEDWVGSPSLKEYATKLGYVHPNGIFKLLQSIPDQVTMMVNPTGEVILKPVPMEETRDNLEKIDATNKELKAERKRRQQYQQGPLPASVIAQLAAGICWPPPVPAQPLSSVFNASIERTAPLATPSIATISRPPPPPPMTKKFNPNLIPLGTPRFARCASTSNIAADSSADSGPSASGGPTPSPMVFHPPHQQPQQQPQRSKVFFGQRKKPPPPVAVPRNDFGDLAPPVAVSRNDFGDLAPPVAVPRNDFCDMPPPAAVSRNDVAQTLSSVFKRNEGYYEEDFHALA

SEQ ID NO: 163615 - protein, 186 aa, Heterodera glycines
  Coding regions on vcDNA: vcDNA=SeqID_90038; Strand=-; Position=70-630
FFSDRQFIHKEKTREYADRLQEKQNTKFSKTNTKFSMVYRIVTLFSNGGGAVVQMEFVTTFLFVADETDHHNDNEQNGGDGQKNEHQTKEIFAIVQLATIFRSRTVRFVVAGFEGFVSEKRSRLIVRWRMERIGHAVDVGDTVRLVRLKLLRIAVQLLTIHNLCRANETKMDEQKDEEEKTERIHW

SEQ ID NO: 163616 - protein, 165 aa, Heterodera glycines
  Homolog annotation: Hit_ID=NP_501571.1; Match level="QueryCoverage =96%, HitCoverage=39%, E-value=4e-44, Identity=43%"; Hit description =galectin (4J798) [Caenorhabditis elegans] pir||T20191 hypothetical protein C53D6.7 - Caenorhabditis elega
  Coding regions on vcDNA: vcDNA=SeqID_90039; Strand=+; Position=3-497
KLFGYRRKKVTKKDSITGRNNSFPVPYLSKLEGNQLQPGQSLIVRGIIISSDEFVINLTNGPRVELDDEVRTLDDRLLCMRVEMGQKRRKVHLNACINGEWGREALIKHKWRNGDEFDIRVRCHEDEFELFIDHKLCARFAHYVPLSTISHIYINGGIELYSVSW

SEQ ID NO: 163617 - protein, 106 aa, Heterodera glycines
  Coding regions on vcDNA: vcDNA=SeqID_90040; Strand=+; Position=2-319
LHTTRLPRTPSRLCTAFRFPFAWLCQGESALCGPSWPHRTAAELAVHACRVSFVLMSVISQPIAVISVSHGQAKASRLAESIVTTQLLATTPSFAFPIVDAPHCHS

SEQ ID NO: 163618 - protein, 184 aa, Heterodera glycines
  Homolog annotation: Hit_ID=CAE58867.1; Match level="QueryCoverage =100%, HitCoverage=80%, E-value=1e-79, Identity=76%"; Hit description= Hypothetical protein CBG02097 [Caenorhabditis briggsae]
  Gene Ontology: Mol. function=RAB small monomeric GTPase activity; Biological process=signal transduction
  Coding regions on vcDNA: vcDNA=SeqID_90041; Strand=+; Position=30-612
MSYNYPLKIVVVGDHNCGKSCILLRFSENSFRSDHVSTLGVDFKLKTIKIGRDKIRLELWYFNVLTLRMERYRTIYNSYYHSAHGVMCVYDLTNEKSFQNLENYWLRQVKEHAPQNAVLLMVGNKADLDSERKVDFDRAENLAKKIGVSIYEVSAKTGINCDDAFVELATVMRDRLLNSALNSD

SEQ ID NO: 163619 - protein, 232 aa, Heterodera glycines
  Coding regions on vcDNA: vcDNA=SeqID_90042; Strand=+; Position=39-737
MYIRELESPGELPLVWLNALSRSCFRPTKDDQLVSLVELRQAAERIAVENAQLNRVNAMLLILIQRPAGVLPHQAVPVAGAFGQQQNQQPANAFPIPPVVPVVPVNANNRLHTDELQLEISRHARTLNELSVEYARLMHTNRTLVEQLFAGGAPPYVHQQFEPVDALVNQNVFHVNPPAPNGNNNEAVDALVNQNVFHVNPPAPNGDNDGDDLQMFFEDDVVDAYLQNMDPN

SEQ ID NO: 163620 - protein, 212 aa, Heterodera glycines
  Coding regions on vcDNA: vcDNA=SeqID_90043; Strand=+; Position=6-641
LRFSNKMPKFSRKMLRPPRKRIAKKSDDKKSTEDEKKKKKKRRLPKTLKECFECVDVGSIVLCASYLDIPPEPISSSSDEKSNGKRKKQKGQTKKEGPKIVTDVHEFGCIPWRLSLVHQLRKDDNGGYSKHILKLALHSDYRKDVAWRADVSGTLTMKKWVDKMPEGTDPRKLDEHSERFATIFNQCCQTQAFGTEFPLPIGNSSAETANSV

SEQ ID NO: 163621 - protein, 196 aa, Heterodera glycines
  Homolog annotation: Hit_ID=CAG13211.1; Match level="QueryCoverage =99%, HitCoverage=23%, E-value=1e-45, Identity=46%"; Hit description =unnamed protein product [Tetraodon nigroviridis]
  Gene Ontology: Cellular component=mitochondrion
  Coding regions on vcDNA: vcDNA=SeqID_90044; Strand=+; Position=37-624
MIDCHCHLADESFNEDISQVIDRAKQNGVKAALVVAEFKDDFERILELAHQFPDFIFPCLGMHPVQRGHISCSEEMYKNFEVDKWIRTHSDQLIAVGEVGLDFKPQHLKNGDADKEEQRKVFRAQIELAKELQLPLNVHSRSAGTPVIEWLAAHGAQNVLLHAFSGNVKNAQKGIEKGFFFSIPPSFTLSKEKRAI

SEQ ID NO: 163622 - protein, 169 aa, Heterodera glycines
  Coding regions on vcDNA: vcDNA=SeqID_90045; Strand=+; Position=342-851
VKEENDSQTEHGILELNNQNAEMRLELSRLRNELVFRRRHMLKSLYEVFFLPKLKRSSIAAPLVFRRQCFCSNFDAIRSLHFPSVPARLGHNDAELSSAAGFIVQLLLAISHILDIPLKHLLLFNGSRSAIFSRSSLERFGPLFHFLCKESKESAGPNDVPAQRRHRPT

SEQ ID NO: 163623 - protein, 184 aa, Heterodera glycines
  misc_feature (170)..(170): Xaa can be any naturally occurring amino acid
  Homolog annotation: Hit_ID=NP_495953.1; Match level="QueryCoverage =84%, HitCoverage=37%, E-value=3e-26, Identity=44%"; Hit description =acyltransferase 3 family (2J447) [Caenorhabditis elegans] pir||T26257 hypothetical protein W07A12.6 - Cae
  Coding regions on vcDNA: vcDNA=SeqID_90046; Strand=+; Position=1-552
PRAEFGTRLGFAAAFDDHFQHFPWLFSALFAWLLLLFLLLELFPSFSANLSLQLVSPRRALIALFRAPNPTEHYLAFLDIFRIGAICWVISNHLGSEGRLDVLLGLPHGEHFKQSVHSLPIFGPIFGNSALGVEVFLVLSGFLAARSWHRRWQSDLGFWPNSLNFLLHRXLRLAPTTKAFVFLA

SEQ ID NO: 163624 - protein, 206 aa, Heterodera glycines
  Homolog annotation: Hit_ID=CAE70385.1; Match level="QueryCoverage =98%, HitCoverage=36%, E-value=2e-79, Identity=72%"; Hit description =Hypothetical protein CBG16947 [Caenorhabditis briggsae]
  Gene Ontology: Mol. function=pyruvate kinase activity; Cellular component=cytosol; Biological process=glycolysis
  Coding regions on vcDNA: vcDNA=SeqID_90047; Strand=+; Position=1-618
EKYPARNNLEHLAMLKCTEEPHIVRKTGIICTIGPVCRSVEMLVQMIENGMDVARMNFSHGDHEYHGGTIKNVREAAAKCTKKRNVAIALDTKGPEIRTGLLAGGGSAEILLEKDASIRLTTDSAFEKSGTAINLYVDYKNITKVVTKGSRVYIDDGLLSLIVEEIFDDAILCKVENGGKLGSRKGVNLPGTPVDLPAVSEKDIKD

SEQ ID NO: 163625 - protein, 117 aa, Heterodera glycines
  Coding regions on vcDNA: vcDNA=SeqID_90048; Strand=-; Position=2-352
KSLADNQSIFPLLICRRWWRPRISSKHHSSPCANGRRLCPTFSREVFQPFRHSTVQKSDWQTKREWIPWHMSLSPSSVGSAPLPSPTKRIRHIFHRVLLVRHHFLLQQKRIRHIFLR

SEQ ID NO: 163626 - protein, 200 aa, Heterodera glycines
  misc_feature (185)..(185): Xaa can be any naturally occurring amino acid
  Homolog annotation: Hit_ID=CAE62177.1; Match level="QueryCoverage =96%, HitCoverage=47%, E-value=2e-17, Identity=29%"; Hit description =Hypothetical protein CBG06224 [Caenorhabditis briggsae]
  Coding regions on vcDNA: vcDNA=SeqID_90049; Strand=+; Position=35-634
MPGICGGIVRKFSNSKNESKEDFCIENDNLEMMAELSEEDMDSSEEDENWKEINDEEQNTSAGQKGTQVSRRKRLKERLEQRKANEMRTVFVGNAPPTSTRRDITKIFRAFGKIEAVYQRTLLQMTEKLTKLMEGKDKTLKDRLKSTNFFVRFSSQEETENAACKMNGTHLGGNTIRVTTSNRRXFEHSLSIFLGNLPYS

SEQ ID NO: 163627 - protein, 281 aa, Heterodera glycines
  Homolog annotation: Hit_ID=CAE59009.1; Match level="QueryCoverage =96%, HitCoverage=94%, E-value=1e-62, Identity=40%"; Hit description =Hypothetical protein CBG02285 [Caenorhabditis briggsae]
  Gene Ontology: Mol. function=protein binding; Cellular component =lateral plasma membrane; Biological process=intercellular junction assembly
  Coding regions on vcDNA: vcDNA=SeqID_90050; Strand=+; Position=62-907
MGNEHSNRSKGHPSSSSSKKDSPATRLQKALPSALKFGSNDLSSSALRRLLEQSKKSRSLQLKGAGIKRVPSGIVEEVHSLLRILELSSNKLRELPSTIGTFSMLKQLYIANNRLTNLPDEIGCLKTLELLDVSGNQLTELPDPLAACNSLTQMNASNNKFSTFPSVVTRLLRLEVIDLSENSITELPDEIAILRATELIIRRNQLALLNASNLTKCEHLKILRVEENCLPREAFTAELLEKSELTLITHEGNLFAEKEFQALPGYDAYEQRFTATRRRLF

SEQ ID NO: 163628 - protein, 206 aa, Heterodera glycines
  Homolog annotation: Hit_ID=CAE73617.1; Match level="QueryCoverage =100%, HitCoverage=26%, E-value=5e-46, Identity=46%"; Hit description= Hypothetical protein CBG21107 [Caenorhabditis briggsae]
  Coding regions on vcDNA: vcDNA=SeqID_90051; Strand=+; Position=1-621
EQKTKEHAMQSKQQPRELKAKETIIRKQFRQAVKIQTRQFKAYQSQMLQMAPREEHRELLNRLKEEQSRKIASLADQYEATIETMVTEQTIKLDAQQEEDLRQLTEKLNRELSMLTEYQEKQRVELSAQIERERVQLQDRVNLRLAVLKQKMNEEKVHFERNRERQLAQLHDRQAQALSAFSVDERRKKSSMGSDGGRNDASSTNL

SEQ ID NO: 163629 - protein, 89 aa, Heterodera glycines
  Homolog annotation: Hit_ID=NP_494216.1; Match level="QueryCoverage =71%, HitCoverage=60%, E-value=3e-13, Identity=48%"; Hit description =protein of fungal metazoan origin like (11.1 kD) (2C514) [Caenorhabditis elegans] gb|AAF35960.2| Hypothet
  Coding regions on vcDNA: vcDNA=SeqID_90052; Strand=+; Position=2-271
FILLAIKMSENELGRTLDQCLADTALKILAGGSIGVVTALALFKGKRSWPVWLGTGVGIGMGFNNCQNQLKRDTAKTMAQKSAKNGQMR

SEQ ID NO: 163630 - protein, 246 aa, Heterodera glycines
  Homolog annotation: Hit_ID=CAE57516.1; Match level="QueryCoverage =98%, HitCoverage=49%, E-value=1e-76, Identity=58%"; Hit description =Hypothetical protein CBG00491 [Caenorhabditis briggsae]
  Gene Ontology: Mol. function=translation elongation factor activity; Cellular component=mitochondrion; Biological process=gametogenesis
  Coding regions on vcDNA: vcDNA=SeqID_90053; Strand=+; Position=3-743
DEPWMPAEKVYTIKGRGTVITGKLEQGTLKKNDKVTIVGLGKKLDTTIAGLETFRKTVDQAEPGDQLGVLLKGLGPKDVRRGSVLLKQGQDAHFTDKVRAQIYLLKPEEGGSKMPLAHMFKEHMFSLTWDSAATVMLQGRDFVMPGETVELEFLFNTPQFVRPQQRFTLRHDKTTIACGVFLEALPESEGEIRDKKWRKMQMRGVMERVGFNPFGNRSFERACKPDYTNSPKDNPAEALFKAEAKA

SEQ ID NO: 163631 - protein, 165 aa, Heterodera glycines
  Coding regions on vcDNA: vcDNA=SeqID_90054; Strand=+; Position=3-500
KRKKMLFYDHHTRTCCFFNVQKCAFTFALIGFVLNLVALVPIFLPYSPTSQEKPSIYIGKCLHILFSAMLFLSIMLAYKLRKAWLYTPYLIYTGISLALAVFGCLTYLYFLITDPQSLLDDNWRKAHPGKATNDSEARAIASAWLALMLVYLLFSGWIYSVIYRA

SEQ ID NO: 163632 - protein, 85 aa, Heterodera glycines
  Homolog annotation: Hit_ID=NP_495514.1; Match level="QueryCoverage =88%, HitCoverage=48%, E-value=3e-10, Identity=53%"; Hit description =u6 snRNA-associated Sm-like protein (lsm-2) [Caenorhabditis elegans] gb|AAC46661.1| Lsm sm-like protein p
  Coding regions on vcDNA: vcDNA=SeqID_90055; Strand=+; Position=1-258
RGSTIKYLRIPDEVPDLVKDEVKEVRRQQKDNQRMKKQFAKGTKGAGGPSAGGGRPQQGGRPGGGPSRGAYRGGAHPSGGQPRRN

SEQ ID NO: 163633 - protein, 281 aa, Heterodera glycines
  Homolog annotation: Hit_ID=AAC47437.1; Match level="QueryCoverage =100%, HitCoverage=96%, E-value=1e-124, Identity=68%"; Hit description=COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_90056; Strand=+; Position=2-844
YRFVAYTTVSFSIISLLSVCLTLPMLKSYVSNVGMKMDSELSSCQHNAKDIWSEVSQLKGMPLLVAGNRTARSAYGSCQECCSGGAQGQPGQPGQPGRPGNPGAPGSPGQPGQTPQTPCEQVHPPPCTPCPGGQPGNNGPPGPPGAPGAPGQPGTGGGQPQPGEPGPPGPNGQPGQPGQPGAPGQPGQPASPPPTEPAPAGPPGEAGAPGQPGQPGAPGQPGAAGQPGPKGPPGGPGQPGNGGAPGQPGQPGQPGNPGERGICPKYCAVDGGVFFEDGTRR

SEQ ID NO: 163634 - protein, 70 aa, Heterodera glycines
  Coding regions on vcDNA: vcDNA=SeqID_90057; Strand=+; Position=1-213
RGTHFLAGSIFFSALTVSWVLWDNRNQQHKRTSSVRSILASAQRQKNMEEYLEQQKLYEEYKMSVSDGHN

SEQ ID NO: 163635 - protein, 187 aa, Heterodera glycines
  Homolog annotation: Hit_ID=NP_497931.2; Match level="QueryCoverage =57%, HitCoverage=15%, E-value=6e-29, Identity=54%"; Hit description =WD repeat endosomal protein (76.3 kD) (3F671) [Caenorhabditis elegans] emb|CAA86338.2| Hypothetical prote
  Coding regions on vcDNA: vcDNA=SeqID_90058; Strand=+; Position=53-613
MQPQSKRKIQVSFLIRNGSVESKHRGFVNALQFDPTTRSLFSAGSDSVIRQWDTSAPSGSAAFLRSLEHHCDWVNDKRQIVTRDSDGNVELWDVMQCGRVNTFPMGTNMEEVIKDNVRKVWIPSWFGVDAKCGVLEITLDESDAFSAWVSARDAGFTDKANDAKVNYGGLLLRSLFEHWPHAYVGDD

SEQ ID NO: 163636 - protein, 182 aa, Heterodera glycines
  Coding regions on vcDNA: vcDNA=SeqID_90059; Strand=+; Position=59-607
RQFCPITSDHHYSCVFNFFIILSPVSIPLSPTITKTPPKSLFLHYFCVANVPSDGAVFFYTNNSTSNSSNTEEQLLTLIIFKEYIRKKQHQFWNGTTARKRKTTANEEATSNRTEDQRKERETKEQVIRTLDQHQQQQNEQQNGDKRLRLLTKQKHKHRQVQQQNNNNRRRSYCLLLRLIRQ

SEQ ID NO: 163637 - protein, 190 aa, Heterodera glycines
  Homolog annotation: Hit_ID=AAR01198.1; Match level="QueryCoverage =46%, HitCoverage=68%, E-value=2e-13, Identity=42%"; Hit description =cellulase binding protein [Heterodera glycines] gb|AAN32887.1| cellulose binding protein [Heterodera glyci
  Coding regions on vcDNA: vcDNA=SeqID_90060; Strand=+; Position=25-597
MTKFVCVLLLLFAWTLQIVHPSVVPSDQIYIIEFNRDNSNNQQDNDLKSANGVEDSKMTNGVISQDSAQVVTTNGTTELETDPLTVSVELQRGGRAVGNQFNINFTDISYVLVCSARFRISLPSDTTLRSHSKMTAVPNTSDQFTLPNGVHLYPGLSHTAEVILSGNGQPEVTILDTLTVLTTEKCPNDV

SEQ ID NO: 163638 - protein, 191 aa, Heterodera glycines
  Homolog annotation: Hit_ID=NP_505613.1; Match level="QueryCoverage =75%, HitCoverage=26%, E-value=2e-38, Identity=53%"; Hit description =solute carrier family 23 member 2 (5K638) [Caenorhabditis elegans] emb|CAB01641.1| Hypothetical protein C
  Gene Ontology: Mol. function=sodium dependent multivitamin transporter activity; Cellular component=integral to membrane; Biological process=molecular hydrogen transport
  Coding regions on vcDNA: vcDNA=SeqID_90061; Strand=+; Position=66-638
MICPNESKPDTANGEQHKNSAAMNGHGFVPSGNAETEGKADKRHQQQRKLYKADENPPFLLTFLFGFQQVMVSLSVLVSIPFLISDEACPGRDRDQLRVRLIAATFVTCGIGTILQTAFGMRLALLQGVAFAYIPSIKAFMSMDQFRCNATIDDFVPPKVYEDKMAIIQGTLMASSSITFLIGATGMVGKM

SEQ ID NO: 163639 - protein, 124 aa, Heterodera glycines
  Homolog annotation: Hit_ID=CAE67660.1; Match level="QueryCoverage =87%, HitCoverage=79%, E-value=4e-12, Identity=36%"; Hit description =Hypothetical protein CBG13223 [Caenorhabditis briggsae]
  Coding regions on vcDNA: vcDNA=SeqID_90062; Strand=+; Position=17-391
MKTALELAKKIACGVFIAHVFRQKVGRILTGVGDSMLPTIHDGDILWARVWDPNDALRPGDVVCLVDPLDAEEYVIKRISAVHKDCIEVRGDNAKKSLDSRKYGPVPAGLVRYRVSLRLLPLNR

SEQ ID NO: 163640 - protein, 186 aa, Heterodera glycines
  Coding regions on vcDNA: vcDNA=SeqID_90063; Strand=+; Position=34-591
TKALVTTHSLITQMLCFATSKCFPQSFDQYKSRSNPLIFIFLLTIHLLLAEIASEKSSKETFKDSLVQNSPKSDLNFLFQQRSTQKTAFIRHHYASSVANGQSGQHSRHRRRIPTGIIGKLIAKLSGKTGKIAATASKSDDIFVGTAKVGRIPNRGTAPGRFYKSRGFEPPPFVSYAAPAGSEVAK

SEQ ID NO: 163641 - protein, 168 aa, Heterodera glycines
  Homolog annotation: Hit_ID=AAR06361.1; Match level="QueryCoverage =94%, HitCoverage=98%, E-value=2e-33, Identity=54%"; Hit description =histone H3.2 protein [Oryza sativa (japonica cultivar-group)] ref|XP_ 493701.1| histone H3 [Oryza sativa (j
  Gene Ontology: Mol. function=DNA binding; Cellular component =nucleosome; Biological process=embryogenesis and morphogenesis
  Coding regions on vcDNA: vcDNA=SeqID_90064; Strand=+; Position=6-512
MARTKQTARKTQSQKGFSSSSGSQHMQSQLHNLRKQLATKRPNPKRGIGYKELPPVKIAQKRHHKKGALALKEIRKYQKSVNLLIPRRPFMRLVREVTQDMSQSTDLRWQGLALLAIQEAAELYLVSLFDDTNLCAIHASRVTIMPKDMQLVRKIRGETFLKPLSSQY

SEQ ID NO: 163642 - protein, 51 aa, Heterodera glycines
  Coding regions on vcDNA: vcDNA=SeqID_90065; Strand=+; Position=3-158
TAVKSGETKDISRGFSFSNGSGLHSPRADDQLTFFIHILLYYLFIIKGSTF

SEQ ID NO: 163643 - protein, 142 aa, Heterodera glycines
  Coding regions on vcDNA: vcDNA=SeqID_90066; Strand=-; Position=21-449
FFFFFFFFLNKYLFCKIKNSANSSNKRKTKKATRITKTATAIDQWVGHRSHGSATARTFLEMFKHQCFCVQNPTDTIGNARLSPSVQFTRKTRIGDAKVETSIIHFQNLFLQSLLLNFCLELLDKMVELMVTAGHFHDAITK

SEQ ID NO: 163644 - protein, 66 aa, Heterodera glycines
  Coding regions on vcDNA: vcDNA=SeqID_90067; Strand=-; Position=2-199
FDIITSLVSISFLNTDIWAHIFSFCRGTIPSHSRMNSHKSAQCKSPASDCHNLAHIRCNSFGPAPH

SEQ ID NO: 163645 - protein, 70 aa, Heterodera glycines
  Homolog annotation: Hit_ID=CAE71538.1; Match level="QueryCoverage =84%, HitCoverage=12%, E-value=4e-11, Identity=50%"; Hit description =Hypothetical protein CBG18478 [Caenorhabditis briggsae]
  Coding regions on vcDNA: vcDNA=SeqID_90068; Strand=+; Position=2-214
RSREPNSELAQRVILRLKRQDGVLLSSDGPYGNILKFKPPLCFGEDDLRKAVNALDKALAEFTTEEEKTK

SEQ ID NO: 163646 - protein, 194 aa, Heterodera glycines
  Homolog annotation: Hit_ID=1NEX; Match level="QueryCoverage=78%, HitCoverage=88%, E-value=1e-17, Identity=32%"; Hit description=Chain C, Crystal Structure Of Scskp1-Sccdc4-Cpd Peptide Complex pdb|1NEX|A Chain A, Crystal Structure Of Scskp1-
  Gene Ontology: Mol. function=protein binding; Cellular component=SCF ubiquitin ligase complex; Biological process=mitotic spindle orientation
  Coding regions on vcDNA: vcDNA=SeqID_90069; Strand=+; Position=13-594
MVVEKNTSSSTSATDSSPDGGNYIKEEMLQREVFCECLGGERVSVRASLMFQSQTFANMWKSLNVDTNELPDDFVFPMTSVAVPVFKKIINWMESHVGQQVPEFEEDPNTRERKWFVQTDFEKDFFKVEVEELVDFLNASNFLNLQSLYRHSCQAMAALLKDRSPEEIRDLLGIEDDLTEEHKAEIRPQNVWCN

SEQ ID NO: 163647 - protein, 142 aa, Heterodera glycines
  Coding regions on vcDNA: vcDNA=SeqID_90070; Strand=+; Position=3-431
MFNNHANHFMPNFCIPPPPPPQLPQPLNSARVFFPPVPHHHHPAYYLQPQHAHPHMNPQFFNLSVPPPQITQNISSLIAANINNYPTRHPLNGTHQITTSERFSKTFHTGHANGFTSKGNGAPLSRSRKRFLEQITNEEGWI

SEQ ID NO: 163648 - protein, 158 aa, Heterodera glycines
  Homolog annotation: Hit_ID=P41824; Match level="QueryCoverage=74%, HitCoverage=47%, E-value=4e-16, Identity=36%"; Hit description=Y-box factor homolog (APY1) gb|AAA60373.1| Y-Box factor
  Gene Ontology: Mol. function=transcription factor activity; Cellular component=mitochondrion; Biological process=transcription from Pol II promoter
  Coding regions on vcDNA: vcDNA=SeqID_90071; Strand=+; Position=25-501
MSTQQQQRKTRSPIVLERGVSGRVKWFDFWKGYGFITRDDGGQDVFLHASSIVRKVQMHFVLIEGQKLEFDIIDGEKGREAAVVSGPGGIRVGTAIRYNPQQQLAAGKDFKRINASAGGSRLPPRPPVAKKTTKKMANSKCDDHNEPKVDNNEEQQEH

SEQ ID NO: 163649 - protein, 69 aa, Heterodera glycines
  Coding regions on vcDNA: vcDNA=SeqID_90072; Strand=-; Position=2-208
IIYGMFCSSFRSLFNSSSDLPFSSVVSPLPLRSVLNSVTLWPYPSIIASTMNLISRPNALIVSALSLSS

SEQ ID NO: 163650 - protein, 86 aa, Heterodera glycines
  Coding regions on vcDNA: vcDNA=SeqID_90073; Strand=-; Position=144-404
FKSKKFKLSADYSDLVFFEFGILILCPFFHCKTCQNEGCLNSLPHSTAALSFPAADTVPPFVAVVAGDGVIGGLSVFFASLFGLAT

SEQ ID NO: 163651 - protein, 22 aa, Heterodera glycines
  Coding regions on vcDNA: vcDNA=SeqID_90074; Strand=-; Position=3-68
SKPSFIQIKMCQSMLTNAKMKI

SEQ ID NO: 163652 - protein, 196 aa, Heterodera glycines
  Homolog annotation: Hit_ID=CAE67355.1; Match level="QueryCoverage =99%, HitCoverage=55%, E-value=1e-53, Identity=54%"; Hit description =Hypothetical protein CBG12818 [Caenorhabditis briggsae]
  Gene Ontology: Cellular component=26S proteasome
  Coding regions on vcDNA: vcDNA=SeqID_90075; Strand=+; Position=60-647
MTQESTMICVDNSEWMRNGDLPPTRFNCQQEAVRVLIQLKLRSNPENAVGLLSLADRIDVLNSLTTEDRKLLVRLHSLEILGVSKVFDGIKTAYLALKHRKNRNHRQRIVVFVGSPLDPLLAEKEMFMKFAKKLKKEKVSVDFVLFGEATAENNKIIADFVDILNGTEEGGASHLLVVPVGDTKLYDALLRSPICA

SEQ ID NO: 163653 - protein, 72 aa, Heterodera glycines
  Coding regions on vcDNA: vcDNA=SeqID_90076; Strand=-; Position=11-229
CSSRLSVQISHQSPFHRQIRRQIHRRRSHNAFAEVEHFQFDCPLLAWQLLMKGKWQLSAALREWWTQKTFSV

SEQ ID NO: 163654 - protein, 321 aa, Heterodera glycines
  Homolog annotation: Hit_ID=CAE69120.1; Match level="QueryCoverage =92%, HitCoverage=80%, E-value=4e-80, Identity=51%"; Hit description =Hypothetical protein CBG15146 [Caenorhabditis briggsae]
  Gene Ontology: Mol. function=structural constituent of ribosome; Cellular component=mitochondrion; Biological process=protein biosynthesis
  Coding regions on vcDNA: vcDNA=SeqID_90077; Strand=+; Position=31-993
MPFLTLNAMRSLCRLPPSLFSNGIMQIRFVHHHKELEEPGGFERFMGWRRSNPAKANRNTHINERYMRRLRGAKRLIIDLEEDYAERRQLDQMRPDEVRMYLLRKGKPNIFKDVAPRDWNEHQITLNTFGQAIDPYIPPETSLFSRGAKDIFPDLKAFATRKYQGIFYGLRRIRKKDGFQNFNLKDFTKLAEQIYANAYNALALRDKTKLHELITEAAFSKMWPDVEKGTLHWKLVQFSEPSKVLTVRCLDNPTKSGNDIAQIIVRMHSTQILALYDKDGHLLLDSEEEPRQCLEYVVFENHVASVDGMWRLHCRIYPNWL

SEQ ID NO: 163655 - protein, 194 aa, Heterodera glycines
  Coding regions on vcDNA: vcDNA=SeqID_90078; Strand=+; Position=3-584
KFEHIFKISFQLFVPMTFFKEVDYLSLRLDDPVSALADYLPNSIIYTINYSLALPPNLVLLYMGLRPSLITSRVKFPTLGMTCANLFGLFGFLLLNIVYLYTVFSDVRLSLFMCSLLRTVFYNTTYVCYFLFPVLAVDQYLYVCQNVELSIRSLKAVIGVCFAIPMIVAVYDLWLQKVILYDFMFAYIRMSPYT

SEQ ID NO: 163656 - protein, 412 aa, Heterodera glycines
  Coding regions on vcDNA: vcDNA=SeqID_90079; Strand=+; Position=1-1236
PTRLRRFAICVGVDEENGTCLMVYENDLNAIEVRMVFSGVQIGKWYRFDLAKGTRRNWEVAEERLPTRIMPRGDAGSGGTRGDRIQLCLPIFFVPNFKCFGCTWRVTSPTSFNDKMHFNFVSPRLEAPGKINFSEERLAELNIRPGEQCFAFLTLDCQGPGPSIKPPQWTLDAVEHFHRVNVDPLAPSVLSVSLGASKEWGILLDLVIESEDERNGMGFILCLRDGKFAFGRILKTEGHNDSCWRANVGDTVGFSLIDVDCFNYPVRLALNVIAWQSPAFTSVDSDVLADQFPQESLPEFPSVRLISKSTGKMAQHLFELCFPIDDSQMSCLRMGSLKVDRLGVLIDLNGDLLSAWSNMKRKGTDAISSLLLARVRARFSSLPDQQQPLWMVAEMLEIAKMRVDTESKRQTL

SEQ ID NO: 163657 - protein, 148 aa, Heterodera glycines
  Homolog annotation: Hit_ID=CAG12591.1; Match level="QueryCoverage =94%, HitCoverage=93%, E-value=9e-23, Identity=44%"; Hit description =unnamed protein product [Tetraodon nigroviridis]
  Gene Ontology: Biological process=cotranslational membrane targeting
  Coding regions on vcDNA: vcDNA=SeqID_90080; Strand=+; Position=27-473
MEVKLKPYSDPSRWVAIYPLYIDASKSLAQGRRIAKAKAVNNPTCQEIFDVLNHAGLRCELEQKKTHPRAQSRGAANPKQQQQEEGRIRVQLKGDDGENVSEGAAQPKFMTRQQMMEYAAEMVPKLKTRQQQTQVEQNDATGKQKKRK

SEQ ID NO: 163658 - protein, 197 aa, Heterodera glycines
  Homolog annotation: Hit_ID=NP_956276.1; Match level="QueryCoverage =96%, HitCoverage=21%, E-value=1e-18, Identity=32%"; Hit description =Unknown (protein for MGC:63531) [Danio rerio] gb|AAH61450.1| Unknown (protein for MGC:63531) [Danio rerio
  Gene Ontology: Mol. function=structural constituent of cytoskeleton; Cellular component=cytoskeleton; Biological process=protein targeting
  Coding regions on vcDNA: vcDNA=SeqID_90081; Strand=+; Position=48-641
MASNSNAQLLDACEKGAELKNIKSLIERGANVNFADKDGLSPLMGACVFGNVEIAHCLVELGATIEQKDDEGLTALGHAVIAGQLESVKMLTGKNANCLVFAKDNRSPMVIACQEGRMEILSHFRSVGVNLNHCDEHGITPLMVATQKKRVDVVCFLLQNGADKSQTDAKGRTALAFADDLRDSKERNQLLKLLSDR

SEQ ID NO: 163659 - protein, 127 aa, Heterodera glycines
  Homolog annotation: Hit_ID=NP_509346.1; Match level="QueryCoverage =96%, HitCoverage=47%, E-value=4e-29, Identity=50%"; Hit description =predicted CDS, phosphoglycolate phosphatase (XI605) [Caenorhabditis elegans] gb|AAB04900.1| Hypothetical
  Coding regions on vcDNA: vcDNA=SeqID_90082; Strand=+; Position=1-384
HDLEGLFARLKELGIKIAICTADSRAGTTRVLKTRKVEQFEDLIVCGDDKGSVPKPQPDNALFICRQLGVDPKNAMVIGDTPADLGMGRSAKLGSIAGVLAGIGEHKELNEADHLVEHVGELLPLIG

SEQ ID NO: 163660 - protein, 274 aa, Heterodera glycines
  Homolog annotation: Hit_ID=AAB53231.1; Match level="QueryCoverage =99%, HitCoverage=99%, E-value=1e-123, Identity=82%"; Hit description= prohibitin-like molecule TC-PRO-1 [Toxocara canis]
  Gene Ontology: Cellular component=mitochondrion; Biological process =cell aging
  Coding regions on vcDNA: vcDNA=SeqID_90083; Strand=+; Position=30-854
MMAAQRILGALGQIGVGLTAAGVLAQAALYNVDAGQRAVIFDRFTGVKPNVTGEGTHFLIPWVQRPIMFDIRSTPRAVNTITGSKDLQNVSITLRILHRPDPSKLPQIYLNIGTDYAERVLPSITNEILKAVVAQFDAHEMITQRESVSHRVSVELAERAKQFGFILDDISITHLSFGREFTEAVEMKQVAQQEAEKARYLVEKAEQMKLAAITTAEGDAQASKLLAQAFSQVGDGLIELRKLEAAEEIAELLSTSKNVSYLPKDISPLLALPQ

SEQ ID NO: 163661 - protein, 220 aa, Heterodera glycines
  Homolog annotation: Hit_ID=CAF99237.1; Match level="QueryCoverage =99%, HitCoverage=28%, E-value=2e-58, Identity=53%"; Hit description =unnamed protein product [Tetraodon nigroviridis]
  Gene Ontology: Mol. function=GTPase activity; Cellular component =nucleus; Biological process=regulation of G-protein coupled receptor protein signaling pathway
  Coding regions on vcDNA: vcDNA=SeqID_90084; Strand=+; Position=1-660
EFSGTVCADCGASCPSWASLNHGVLICSDCCFVHRNLGRHFSQVRSLTKGVWHDKQLALLQLLCRNGANNVWEHSLIDSLGGAGRAKKKPVSNDPIIPKKEAFITAKYAQLAFAIRPAKDEFNVDDLNRQLWSCVRTAHVETALRLLALGACPNYADTEKGNTPLHVAAKEGQNLQAELLWLYGADIGQRNGAGQTPAELAKTEGFNELAERLVELEYEM

SEQ ID NO: 163662 - protein, 150 aa, Heterodera glycines
  Homolog annotation: Hit_ID=NP_506690.1; Match level="QueryCoverage =92%, HitCoverage=96%, E-value=3e-58, Identity=79%"; Hit description =ribosomal Protein, Small subunit (16.3 kD) (rps-16) [Caenorhabditis elegans] emb|CAB01658.1| Hypothetical
  Gene Ontology: Cellular component=eukaryotic 48S initiation complex; Biological process=protein biosynthesis
  Coding regions on vcDNA: vcDNA=SeqID_90085; Strand=+; Position=34-486
MAAIEKPQIVQQPVQVFGRKKTATAVAFAKKGKGLIKVNGRPLEFIQPEILRIKLQEPILIVGKDKFAGIDIRIRVKGGGHVAQIYAVRQALAKSVVAFYQKNVDEQSKKELKEQFVAYDRNLLVADPRRHEPKKFGGPGARARYQKSYR

SEQ ID NO: 163663 - protein, 215 aa, Heterodera glycines
  Coding regions on vcDNA: vcDNA=SeqID_90086; Strand=+; Position=26-670
ELKFCGMSNDKKDESSISTNTLVNKEKASIVQESSFVTPGIFRRRKMLTGRQLNDEGNNEAKEKSADFKWSIDQIAKIQPIEFDETEEFSLPPENWDPCAKFKTPQFENIDHFWTHNNLIAPSPGLFATASALRRVQPSANSPTTSPFQLALSPFGSGPSCSSKCSLSDSTFMSPTMMLTHSQMSESTKAKMFTAKEELTTTSTGNGDTKENMIA

SEQ ID NO: 163664 - protein, 143 aa, Heterodera glycines
  Homolog annotation: Hit_ID=CAE69837.1; Match level="QueryCoverage =95%, HitCoverage=93%, E-value=1e-25, Identity=43%"; Hit description =Hypothetical protein CBG16161 [Caenorhabditis briggsae]
  Coding regions on vcDNA: vcDNA=SeqID_90087; Strand=+; Position=32-463
MNFSPITLFLLSSLAIFYAAVAFRQQTVAVRGRLMCGDKPLTDTKVKLWNKNKIGRDDQLADVKTDAQGNFALDGGVGSIFGMNVHLKIYHDCDRGILPCQRKVNLGIPGEYVTRTSTVQRWLDAGTMNMQLKFHDESTSCIN

SEQ ID NO: 163665 - protein, 82 aa, Heterodera glycines
  Coding regions on vcDNA: vcDNA=SeqID_90088; Strand=+; Position=1-249
IFISILKKKFKMKSLTQITPIILPIFLLLLVLSPPNAIGQDLCQWDSGKCFDRGCPYGCPYDTEPECGCTSPKHDAGKKQTN

SEQ ID NO: 163666 - protein, 204 aa, Heterodera glycines
  misc_feature (14)..(14): Xaa can be any naturally occurring amino acid
  Homolog annotation: Hit_ID=NP_498138.2; Match level="QueryCoverage =98%, HitCoverage=43%, E-value=2e-31, Identity=39%"; Hit description =putative cytoplasmic protein of bilaterial origin (50.0 kD) (3G415) [Caenorhabditis elegans] gb|AAA81060.
  Coding regions on vcDNA: vcDNA=SeqID_90089; Strand=+; Position=13-625
MVISQIAKTLWSHXKKSIFAVIATAYGANALRARLRDDRIRYSFAERARKYGLVSFGPAQRLRRVTVLVNRESGGRRAADLFKRNALPLLNLAGLQVNVVEVSSASELESLCRVLDNSEADCIFLVGGDGTLSRALVGLSQNSAPLPIGLFPGGRKNIAFWRIFQSKNQNRDSMDLNDQDSKSVPMFCESAMALIEGENRLVYP

SEQ ID NO: 163667 - protein, 119 aa, Heterodera glycines
  Coding regions on vcDNA: vcDNA=SeqID_90090; Strand=+; Position=1-360
QYFAQERTDVQTKQIFLAICRSFVSPAVPLTVPLSEDRQGNIYVSWDVLSFDGIRRSFAGALAWQKSQFEAFLTIICLIASSTLSQDVLQTASELRRKLRLIDEFFADPFSYAQERQKR

SEQ ID NO: 163668 - protein, 249 aa, Heterodera glycines
  Homolog annotation: Hit_ID=NP_055975.1; Match level="QueryCoverage =79%, HitCoverage=37%, E-value=4e-46, Identity=46%"; Hit description =mitochondrial matrix processing protease, alpha subunit [Homo sapiens] emb|CAI13945.1| peptidase (mitocho
  Gene Ontology: Mol. function=phosphatidylinositol-bisphosphatase activity; Cellular component=Golgi membrane; Biological process =proteolysis and peptidolysis
  Coding regions on vcDNA: vcDNA=SeqID_90091; Strand=+; Position=43-789
SPPVTPIIKSSASLKFWSKFFDTRLNWHCRRNSTAKVVPKKVLRDNCYQSTSLDSGLRIATLPAYGQFTTIGVAIYAGSRNEVHYPPGTAHFLEKISFLSSQQFPDKAHTLDLLEKFGALIDCQSTRDTFVYAASCRVENAFDVLSIIADAVLRPNILDNEVEYCRDVIRYENETLSRQPECEPLLTDWIHQAAFRSNTVGLSRYCPNKLVDVVNSGHILSFLSQYYTSPRIVLASVGVDQQFLVDSGK

SEQ ID NO: 163669 - protein, 209 aa, Heterodera glycines
  Homolog annotation: Hit_ID=NP_543138.1; Match level="QueryCoverage =97%, HitCoverage=76%, E-value=9e-71, Identity=59%"; Hit description =SPRY domain-containing SOCS box protein SSB-4 [Homo sapiens] dbj|BAB71165.1| unnamed protein product [Hom
  Coding regions on vcDNA: vcDNA=SeqID_90092; Strand=+; Position=43-669
MHPYEFKLDAILSRSELPVEKLEKHAWNPEDRSLNLYVKEEDVLTMHRHPVAQSTDGMRGKVGYTRGFHVWQLNWPVNQRGTHAVVGVATKDAPLHAPGYVSLIGADAEGFGWNIVENKCYHDAQNTKPWSFPYEQPFVAPEKLFCVLDMDEGQLAFATDSKYLGVAFRGLKGKKLYPAVSAVWGHCEITLRYLGGLNPDSHLMDTCRR

SEQ ID NO: 163670 - protein, 116 aa, Heterodera glycines
  Homolog annotation: Hit_ID=CAE59298.1; Match level="QueryCoverage =100%, HitCoverage=94%, E-value=6e-55, Identity=84%"; Hit description= Hypothetical protein CBG02633 [Caenorhabditis briggsae]
  Gene Ontology: Mol. function=tubulin binding; Cellular component =plasma membrane; Biological process=microtubule cytoskeleton organization and biogenesis
  Coding regions on vcDNA: vcDNA=SeqID_90093; Strand=+; Position=58-408
MKWTYKEENSFDKRRAEGEKIRRKYPDRIPVIVEKSPNSRLRDLDKKKYLVPAELTIGQFYFLIRKRIHLRPEESLFFFINSVIPQTMTTMGQLYQDRHEEDLFMYIAYSEENVYG

SEQ ID NO: 163671 - protein, 120 aa, Heterodera glycines
  Homolog annotation: Hit_ID=EAK87022.1; Match level="QueryCoverage =57%, HitCoverage=23%, E-value=9e-09, Identity=48%"; Hit description =hypothetical protein UM06140.1 [Ustilago maydis 521] ref|XP _403755.1| hypothetical protein UM06140.1 [Usti
  Coding regions on vcDNA: vcDNA=SeqID_90094; Strand=+; Position=15-377
MFQKNTAFFLLFIAFFLGIASARLKRGSYGYNPPPTPLPLPQPCGQYNQYGSGGAFGGGGGGSYSQPNCNTYGQQNNYGQSNYGGQSNYGQQESAGGFGGIGGSPSQFGVGAPGCGGASC

SEQ ID NO: 163672 - protein, 35 aa, Heterodera glycines
  Coding regions on vcDNA: vcDNA=SeqID_90095; Strand=-; Position=1-105
FFFFFFFHSIRVSYQNVVDYADTNKVFVQNIEITF

SEQ ID NO: 163673 - protein, 163 aa, Heterodera glycines
  Homolog annotation: Hit_ID=P29778; Match level="QueryCoverage=65%, HitCoverage=64%, E-value=5e-11, Identity=34%"; Hit description=SMALL HEAT SHOCK PROTEIN OV25-1
  Coding regions on vcDNA: vcDNA=SeqID_90096; Strand=+; Position=53-544
MLSPFSYDPFYRRSLWPMATHVGNVLSPFRQLERELDHFFEGMQPMLRDHAAQLNVTDKGELTYKVDVSGFRPEEINVEVIGNEIIVNGEHREQNDSESVHRQFSRRVLIPEGIQKESIKCELDGGRLFICGMKTAGKGGRTIPIEMKKKAAVDQQKEEEKQQ

SEQ ID NO: 163674 - protein, 211 aa, Heterodera glycines
  Coding regions on vcDNA: vcDNA=SeqID_90097; Strand=+; Position=1-633
PNSYVFPFLFLYFKFTANFLELLHTMSAIENDETKSRIWQQLKTKLHSTMVAFGSGSVQLPKLMDTFRHDWGSELTSYAVQLGFGCNDAAVYKMLLTMPDEIESGFISATGTFAFKVIPKAETSENLTKIDQSNQYQDEMRRIFARRRSSMSSGFHRSFPFNQSFHVRPPVRMPPPPPPMPFNLSAPILNGPKFPGLVIQLPNCADAQRRV

SEQ ID NO: 163675 - protein, 187 aa, Heterodera glycines
  Homolog annotation: Hit_ID=CAE62837.1; Match level="QueryCoverage =99%, HitCoverage=98%, E-value=9e-41, Identity=50%"; Hit description =Hypothetical protein CBG07016 [Caenorhabditis briggsae]
  Gene Ontology: Biological process=pyrimidine base metabolism
  Coding regions on vcDNA: vcDNA=SeqID_90098; Strand=+; Position=15-578
MTNKTALIIASDGSEDIELIVTSDVLRRAGINVTIAGLQDRAQIELARKAKLQVDALFKDVLDKQYDAVVLPGGQPGSDNLAADPRVGTVLRAHEKAGAIVAAICAAPIAFVAHQIGVGGVLTSYPSVQKTITDAGYAYSDQHKVCVHKNVVTSRGPGTAFDFALKLVELLVNIGKADEIRGAMLLD

SEQ ID NO: 163676 - protein, 178 aa, Heterodera glycines
  Coding regions on vcDNA: vcDNA=SeqID_90099; Strand=+; Position=1-534
VMLNDTKLESTLSTTIKSIDLQIELPKCLDCLADGLNVTEEAITENGGGTIRFLRSSPPVSVPILPPYILLLHDQTNDANVWRKTLQILSASGFCCVAPHLSNFVFDEEENVNFLLNLTSHIGAREVVLVASSMSGIYLIPFLSRGIKKKDIHFHVKAFIAIGVSDTHRLKVEELVNN

SEQ ID NO: 163677 - protein, 117 aa, Heterodera glycines
  Coding regions on vcDNA: vcDNA=SeqID_90100; Strand=-; Position=55-408
HILTNKNKTGDFSNIECNQRFFLRACSNFLPVTPCRTFVETAESVVSANWNTFPLATGGAAPNWKGPLAAGGTVVVNENPPPKGIGFDSDCPWIPPFVNFGGCHASGTMFTRPVSVC

SEQ ID NO: 163678 - protein, 260 aa, Heterodera glycines
  Homolog annotation: Hit_ID=CAE63759.1; Match level="QueryCoverage =98%, HitCoverage=74%, E-value=6e-60, Identity=48%"; Hit description =Hypothetical protein CBG08294 [Caenorhabditis briggsae]
  Gene Ontology: Mol. function=retinol dehydrogenase activity; Cellular component=membrane; Biological process=lipid metabolism
  Coding regions on vcDNA: vcDNA=SeqID_90101; Strand=+; Position=1-780
SMSWFIIIILLIFFIFLLVVFFSLPKSLPFDPSGKHCLITGGSRGIGKAIGAELLLRGCRALSVFARDPIALATARKELEALCRQPGQTVHTFQVDLAADGPAKIEEIVREAERQSGAVDLLVNNAGTCVQGAFDELPSDAFERQLRTNFLGAVYVTRSVVGGMKRRRFGHISFVCSAAGQLAIWGYSAYSPSKFALRGFANALHMELLPWNVGVSILFPPNTATDGFRDELRTMPPQIRAISGTAGLFQASDVAARLVQ

SEQ ID NO: 163679 - protein, 81 aa, Heterodera glycines
  Coding regions on vcDNA: vcDNA=SeqID_90102; Strand=+; Position=2-247
GMAIASDYKKLHAKSTKCQKIKLSKMEQKLFGQKPVEIIGKTQHNGIVWYIVQLEKKNAILLNHDFVIKKYPQLLLKSYGL

SEQ ID NO: 163680 - protein, 83 aa, Heterodera glycines
  Coding regions on vcDNA: vcDNA=SeqID_90103; Strand=+; Position=35-286
QSRPSGKINHEILMEETRRIPILGEVVGQLRNIYGSSLAEQFKNELIIASQLNRGPMNNGISNPHMDMLLGVDEKISDLLHQL

SEQ ID NO: 163681 - protein, 96 aa, Heterodera glycines
  Coding regions on vcDNA: vcDNA=SeqID_90104; Strand=-; Position=0-287
SLCIININKQHQNTAFVSIRGIRSKVTSQLLDIPLNHVTFVLQTLDFSVNFSHPSAEKSVTGKLYFHTGTTNSHVALFIYRHFLILIKYCNFVNVG

SEQ ID NO: 163682 - protein, 235 aa, Heterodera glycines
  Homolog annotation: Hit_ID=JC4382; Match level="QueryCoverage=100%, HitCoverage=58%, E-value=1e-105, Identity=79%"; Hit description =ribosomal protein L3.e, cytosolic - Toxocara canis gb|AAA92285.1| ribosomal protein L3 sp|P49149|RL3_TOXCA 6
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_90105; Strand=+; Position=39-743
MSHRKFSAPRHGSMGFTPKKRAKRHRGKVKAFPKDDPKKPIHLTAFIAYKAGMSHIVRDVDKLGSKVHKKEVVEAVTILETPPMVIVGVVGYIETPRGPRPLKTVFAEHLSEDCKRRFYKNWYKCKKKAFTKYAKKWQDEAGQKSIEADLNKIKKYCSYVRVIAHTQMKLMKHRNKKAHIMEIQINGGTVAEKMDWAREHLEKQGPRGAVCELATPSTASVSQRKGLKGVTSGWH

SEQ ID NO: 163683 - protein, 212 aa, Heterodera glycines
  Homolog annotation: Hit_ID=NP_496154.1; Match level="QueryCoverage =100%, HitCoverage=97%, E-value=5e-50, Identity=47%"; Hit description= PRO2290 like (24.1 kD) (2K260) [Caenorhabditis elegans] emb|CAA91349.1| Hypothetical protein R53.5 [Caen
  Coding regions on vcDNA: vcDNA=SeqID_90106; Strand=+; Position=35-670
MAFIGYGALTAALSGIILYANLPTRLTIGAIVPTVEFLAETQLKKLEPGQAVAGPQIKASDLFNAGHPLLVMAVRRPGCAFCRKQASALCSAASTRFADKGVRVVGVVHEQHGVDQFRPFLPCADAIYLDEEKRFFGPSQRWLPLWMGFLRLSTYVNYYKAWKAGFAGNTEGEGRLLRGVYLVNGDNMLFAHLEKQWGDEVKMDKLVDAVSK

SEQ ID NO: 163684 - protein, 84 aa, Heterodera glycines
  Homolog annotation: Hit_ID=CAE71709.1; Match level="QueryCoverage =100%, HitCoverage=100%, E-value=1e-25, Identity=65%"; Hit description=Hypothetical protein CBG18686 [Caenorhabditis briggsae]
  Gene Ontology: Mol. function=RNA binding; Cellular component=nucleus; Biological process=mRNA cleavage
  Coding regions on vcDNA: vcDNA=SeqID_90107; Strand=+; Position=65-319
MASSGFSVYVGNIPYNATEADIGNLFSQCGVVTNVRIVYDRETNRPKGFGFCEFQDQQGAQNAVTNLNGAELNGRALRVNWTNK

SEQ ID NO: 163685 - protein, 198 aa, Heterodera glycines
  Coding regions on vcDNA: vcDNA=SeqID_90108; Strand=+; Position=58-651
MAKENKTGEQQSKRKKCRRSNSPSDEFHRPMEVPDHIYVAGMPRHRAKSETKPEMFVPSRITVAGGNTTVASKAQPVEILRERQTLLQPSDNENNVMNGIPEMLTANELTHEDSTNNASEIMAAQGNETTSIVVDKDPLKELKMMRRRLIQLTKRVSELETQNAQNANERTLLLGIVSASTLLSVVLLASQIRTWLSR

SEQ ID NO: 163686 - protein, 119 aa, Heterodera glycines
  Coding regions on vcDNA: vcDNA=SeqID_90109; Strand=-; Position=3-362
SYQFITLSTPSFAAFFSVLISAWGKAQTDAEQVEDGHTKLPARTISIACACRTTAAPVFKLSSSTTADRRFSFKFQHISSLGRAEGERSQKQAAENDRKKLGNHFCKLNFRKRANKIIK

SEQ ID NO: 163687 - protein, 244 aa, Heterodera glycines
  misc_feature (68)..(68): Xaa can be any naturally occurring amino acid
  Homolog annotation: Hit_ID=CAE63437.1; Match level="QueryCoverage =81%, HitCoverage=85%, E-value=2e-46, Identity=49%"; Hit description =Hypothetical protein CBG07885 [Caenorhabditis briggsae]
  Coding regions on vcDNA: vcDNA=SeqID_90110; Strand=+; Position=3-738
FVRHFCSQNITKPTTKCDEQENSSAPSCSSSSAALVHVQNRGQWPVEVLAKFLADCFVLGDFVSEYLXTQMLDEVGPHMKRMRWEDEHWDGQIQRYREREQMLENWLPENQALIRRIWHTSFPAPFEPSPYVHILDLHQDGFISPHLDKSRYCGRVISGLSLLSASVMRMRHKSAELGQLCVADLLLSRLSLYWLSGSARYDFTHALLGAEESRFGTQTVPRERRIALICREVVVPTAKSDQID

SEQ ID NO: 163688 - protein, 208 aa, Heterodera glycines
  Coding regions on vcDNA: vcDNA=SeqID_90111; Strand=+; Position=1-624
PRAEFGTRVKMSELNPLNISDSLFATHLSSQHSPTFFGTSQFQPFPSRELIATSYANAFNYHSIEQQRSIDSHNLTTFSPSCCWEGHHRPLPPSNTLAINATECHANPHECADENELEIGCGGLSVLSVSHDGTDNSFFISGTSADSLSPRESGGDVHRRPFNNILNSNNTPPLNSATSKGFRTELEKQRYLERRSRNNEAAKQSRNK

SEQ ID NO: 163689 - protein, 222 aa, Heterodera glycines
  Homolog annotation: Hit_ID=NP_498620.1; Match level="QueryCoverage =98%, HitCoverage=96%, E-value=6e-75, Identity=59%"; Hit description=- related (24.4 kD) (3I436) [Caenorhabditis elegans] gb|AAK68310.1| Hypothetical protein F08F8.7 [Caenorha
  Gene Ontology: Mol. function=ribulose-phosphate 3-epimerase activity; Cellular component=cytosol; Biological process=pentose-phosphate shunt
  Coding regions on vcDNA: vcDNA=SeqID_90112; Strand=+; Position=7-672
MASKIKPLICPSILNADLSDLANECRKLMAAGADYLHLDIMDGHFVPNLTFGHPLIECLRNKLGNDAKLDVHMMVSNPSKWLDPLHKAGIDQFTFHWEALGEDEAVDTLIDRVKSKGIRCGLSIKPMTPLDKLMKFCEKIDTALIMTVEPGFGGQKFMQDQMEKVRQLRKAYPNLDIQVDGGVGLDNIEHCANAGANMIVSGTGIVRSADPRQTMPKMKETV

SEQ ID NO: 163690 - protein, 165 aa, Heterodera glycines
  Coding regions on vcDNA: vcDNA=SeqID_90113; Strand=+; Position=1-498
TLINPMEKRLNPSALPTLMLSNFGGYSVETLCTLGKEFVLELMTRMISIVSTLKMDIKGDNKKDLDIVRIQLDYSRLIFLCLTEVRLRIDLKLAEGIGENQNLKDVRPSDERLLELLSEPNQPEENAKKANLAERFEQNRKELIRLNCHLKKLDWLSVNAENGDK

SEQ ID NO: 163691 - protein, 76 aa, Heterodera glycines
  Homolog annotation: Hit_ID=CAE59427.1; Match level="QueryCoverage =100%, HitCoverage=97%, E-value=4e-14, Identity=41%"; Hit description= Hypothetical protein CBG02799 [Caenorhabditis briggsae]
  Coding regions on vcDNA: vcDNA=SeqID_90114; Strand=+; Position=135-365
MVCVPCIILPVVLAIYLRFVQPYILRFMPQRWRIWFDSVLYPTCPVNKMETTNKSKTENNKTDGEGETGKECEKDK

SEQ ID NO: 163692 - protein, 177 aa, Heterodera glycines
  Homolog annotation: Hit_ID=CAE73621.1; Match level="QueryCoverage =94%, HitCoverage=57%, E-value=7e-29, Identity=38%"; Hit description =Hypothetical protein CBG21115 [Caenorhabditis briggsae]
  Gene Ontology: Mol. function=protein binding; Cellular component =basolateral plasma membrane; Biological process=RAS protein signal transduction
  Coding regions on vcDNA: vcDNA=SeqID_90115; Strand=+; Position=102-632
MHTVDLSQRFIDSLPSSFFLGEHATYKDHAAISLLNLAHNHFVTVPPLVAQFINLISLDISNNHLALLPKEISSLKNLRELSLRNNLLENLPKEFQRLQCLRELNISGNLLEHFPRELLQIKSLRVLYLGANRLQSFPSDICRLSNLQVLYLGGNALVDVPDTIGQLSELTSLGLAD

SEQ ID NO: 163693 - protein, 162 aa, Heterodera glycines
  Homolog annotation: Hit_ID=CAE62111.1; Match level="QueryCoverage =100%, HitCoverage=100%, E-value=2e-44, Identity=56%"; Hit description=Hypothetical protein CBG06149 [Caenorhabditis briggsae]
  Gene Ontology: Mol. function=transcriptional activator activity; Cellular component=nucleus; Biological process=regulation of transcription, DNA-dependent
  Coding regions on vcDNA: vcDNA=SeqID_90116; Strand=+; Position=36-524
MSKMGRMESDTDPNTVTILRKHQAPQRVLKSDADVNAAKKRGDDVETTKKYFAGVNRQHKTDKNTAVLDAETEQLHHERVSLKLGTVIQQARQAKEWTQKELATRANEKVEVIREYENGKAVPNQSILTKMERCLGVKLRGKELGQPLAPASTAKPTTTAKK

SEQ ID NO: 163694 - protein, 197 aa, Heterodera glycines
  Homolog annotation: Hit_ID=XP_330983.1; Match level="QueryCoverage =100%, HitCoverage=36%, E-value=5e-75, Identity=74%"; Hit description= hypothetical protein [Neurospora crassa] gb|EAA30290.1| hypothetical protein [Neurospora crassa]
  Gene Ontology: Mol. function=chaperone activity; Cellular component =cytoskeleton; Biological process=cell organization and biogenesis
  Coding regions on vcDNA: vcDNA=SeqID_90117; Strand=+; Position=1-591
SFSPVQIFNDEASEERAENARLSSFIGAIAVGDLVKSTLGPKGMDKILQSMSTGEIMVTNDGATILKSIWLDNPAAKVLVNLSKVQDDEVGDGTTSVCVFGSELLREAEKLVNQKIHPQVIIEGYRIASAAALKALEAAAVDNGSNPEKFRQDLINIAKTTLSSKVLSQDRVYFAQLAADPVLKLNGPTHLGTLHNI

SEQ ID NO: 163695 - protein, 164 aa, Heterodera glycines
  Homolog annotation: Hit_ID=NP_501713.1; Match level="QueryCoverage =82%, HitCoverage=87%, E-value=2e-21, Identity=39%"; Hit description =predicted CDS, ctr copper transporter family member (4K417) [Caenorhabditis elegans] emb|CAA92470.2| Hypo
  Gene Ontology: Mol. function=copper ion transporter activity; Cellular component=integral to plasma membrane; Biological process =copper ion transport
  Coding regions on vcDNA: vcDNA=SeqID_90118; Strand=+; Position=33-527
MMWMFFHTQIKDTVLFKWWKVETIGSLLITCLVMYFGAICFEAIKWLRLMLEQKSRQPNSANSAGLNMTDQNKTVPMTNRRYAESLLSRVHLLQSVLFTVQLLLSYLLMLCFMTFSVWIGMAICAGAATGFWLFGRRVPMLAFASSGAAGSGQGYASTGRTELH

SEQ ID NO: 163696 - protein, 255 aa, Heterodera glycines
  Homolog annotation: Hit_ID=NP_490660.1; Match level="QueryCoverage =90%, HitCoverage=94%, E-value=7e-53, Identity=46%"; Hit description =AD-003 protein (26.6 kD) (1A478) [Caenorhabditis elegans] gb|AAF36050.2| Hypothetical protein Y74C9A.3 [C
  Coding regions on vcDNA: vcDNA=SeqID_90119; Strand=+; Position=38-805
MDSQLLATNDHSNGETAATLEEIYRKALEYWNSVGSDLNGMLGGFQQLHRPDINDSINFLCELRKKSFLRHFDRALDCGCGIGRVTKHLLLPAFRSVDMVDFSDHLIAQSHIFVPSSSNPTENNSVGQRFVESLHTFAPAEKGGDYDMIWIQWVTGQLEDNHLVDFLRRCKESVLRRDGCIVVKDNVAKGTEKEFDEVDNSWARPREMLHKLFERADCRIVLERKQPNIPKALYEVRTFALKPLSNDETNGMNDD

SEQ ID NO: 163697 - protein, 188 aa, Heterodera glycines
  Homolog annotation: Hit_ID=NP_497128.1; Match level="QueryCoverage =69%, HitCoverage=55%, E-value=6e-16, Identity=33%"; Hit description =calcium-dependent protein kinase precursor (26.9 kD) (3A636) [Caenorhabditis elegans] gb|AAC26922.1| Hypo
  Coding regions on vcDNA: vcDNA=SeqID_90120; Strand=+; Position=19-582
MKLFLLFSLFLIQFSSAIDNMEHLMPENDADSLISYLEFQRWHKAVMGAEPRESSILFGKNDKDADGMLTVAEFVPLAFELSRKPPERQTDKIFKKFDVNSDEQLDRQELLKGDSISEEIVDGLFQVADVNNDGRISFDEFSTVANTLESRLSKDEKNAGMAMSLLAQLDTDKDEPINGTELFEYAHK

SEQ ID NO: 163698 - protein, 183 aa, Heterodera glycines
  Homolog annotation: Hit_ID=NP_509361.1; Match level="QueryCoverage =100%, HitCoverage=28%, E-value=2e-76, Identity=76%"; Hit description= methylenetetrahydrofolate dehydrogenase (XI700) [Caenorhabditis elegans] ref|NP_509360.1| methylenetetra
  Gene Ontology: Mol. function=formate-tetrahydrofolate ligase activity; Cellular component=mitochondrion; Biological process =coenzymes and prosthetic group metabolism
  Coding regions on vcDNA: vcDNA=SeqID_90121; Strand=+; Position=3-551
DRDGNPITADDLCVAGALAVLMKDTVKPNLMQTLEGTPVFVHSGPFANIAHGNSSILADQVALKLVGSDGFVITEAGFGADIGMEKFFNIKCRTSGLWPNAVVIVATVRALKMHGGGPPVVPGNPLPFEYLNPNLELVAKGCDTNLRKQIENAQLFGVPVLICVNKFGTDSDDELGLVVDKPR

SEQ ID NO: 163699 - protein, 35 aa, Heterodera glycines
  Coding regions on vcDNA: vcDNA=SeqID_90122; Strand=+; Position=1-108
ISRTHCQLDEMKFNCTAFIMLSKVNFQINVHCSLI

SEQ ID NO: 163700 - protein, 105 aa, Heterodera glycines
  Coding regions on vcDNA: vcDNA=SeqID_90123; Strand=+; Position=37-354
SVSFFLTNNLCCVIEQMSTVTNGKAESSMGRYVYILPYLPTVIPSYFFYKTAQSARKWAPVHKFGPFKVSAAHGFALLIPMPHLVILALQIWYTRLSRRINEKNK

SEQ ID NO: 163701 - protein, 88 aa, Heterodera glycines
  Homolog annotation: Hit_ID=CAE63753.1; Match level="QueryCoverage =100%, HitCoverage=20%, E-value=2e-32, Identity=78%"; Hit description= Hypothetical protein CBG08288 [Caenorhabditis briggsae]
  Gene Ontology: Mol. function=transcription co-repressor activity; Cellular component=cytoplasm; Biological process=small GTPase mediated signal transduction
  Coding regions on vcDNA: vcDNA=SeqID_90124; Strand=-; Position=523-789
QSYQMFYAVVQLIGTKKEAENFVYKLELSNNRRRLCWEASPRSIHEGVAAAISQSDCLAFDTNHANFFAENGNLGINVTIQRAEGINR

SEQ ID NO: 163702 - protein, 125 aa, Heterodera glycines
  Homolog annotation: Hit_ID=NP_499391.1; Match level="QueryCoverage =84%, HitCoverage=82%, E-value=1e-19, Identity=53%"; Hit description =putative nuclear protein (3L943) [Caenorhabditis elegans] emb|CAA19507.1| Hypothetical protein Y39A1C.1 [
  Coding regions on vcDNA: vcDNA=SeqID_90125; Strand=+; Position=1-378
HLLDQFVAPALRLWMVIDLVSSVLLVMIVIKKCFVRIRIPRTKRQIELRAAKRRKRKALKESGGGDGGESQESEHNQYRGGQTIVLNSFNGANGGNGMRRSGNGANGGAERAAQRQTIASRSIPV

SEQ ID NO: 163703 - protein, 352 aa, Heterodera glycines
  Homolog annotation: Hit_ID=CAA65018.1; Match level="QueryCoverage =90%, HitCoverage=85%, E-value=4e-83, Identity=50%"; Hit description =S-adenosylmethionine decarboxylase [Onchocerca volvulus] emb|CAA65017.1| S-adenosylmethionine decarboxylas
  Gene Ontology: Mol. function=adenosylmethionine decarboxylase activity; Biological process=spermidine biosynthesis
  Coding regions on vcDNA: vcDNA=SeqID_90126; Strand=+; Position=18-1125
MVDCPQQNGHRQQLPLFNASEHFFEGAEKLFEIWFDNDQQKRENGHKSTLRTIPENELRQLLNTAGCHILQVLRTAEIDAYLLSESSMFISDRRLILKTCGQTRPLLVIGKLLELARKHCQMDTVTNVYYSRKNFFRPHLQPQLHATFDEEVDYLDGFFQGGSAFCMGPLKHDRWYLYTLTTPRAPLNCSDHTLELQMTGIPVELLSVYSKSACPGGAAECTRRSGILSLLPRGTIVQDELFEPVGYSMNGVPAGDEYVTIHVTPEPEFCYASFETNHRRGCLYEQTLRVLDCFRQPGRFILTLFANEHSNGAIEVQQRLWAEDFPGYRRLSVQMLRLQANWGGGEGEKSFN

SEQ ID NO: 163704 - protein, 201 aa, Heterodera glycines
  Homolog annotation: Hit_ID=XP_392469.1; Match level="QueryCoverage =95%, HitCoverage=38%, E-value=5e-33, Identity=41%"; Hit description =similar to CG5735-PB [Apis mellifera]
  Gene Ontology: Biological process=germ-cell development
  Coding regions on vcDNA: vcDNA=SeqID_90127; Strand=+; Position=39-641
MTTIAANGGGETFSRKVFVGGLPLDIAQQTELELSRAFRQFGELQIEWPTKRVNQGKTTLDGKPAGPGYAFIVFADPRSVGLLLSKCRREVTAPGEKTRRYFLTLSSRTVHNKPVQVRPWRHSDAVFTPRSGLPVNIRWTVFIGGLPRPTRAIDLYQVLMPPIRGGVGRDCIVHVDIDVDSEMRYPKGAARICFSRYDAFV

SEQ ID NO: 163705 - protein, 304 aa, Heterodera glycines
  misc_feature (145)..(145): Xaa can be any naturally occurring amino acid
  misc_feature (272)..(272): Xaa can be any naturally occurring amino acid
  Homolog annotation: Hit_ID=NP_495261.1; Match level="QueryCoverage =91%, HitCoverage=66%, E-value=6e-94, Identity=63%"; Hit description =beta-ureidopropionase (43.2 kD) (2G578) [Caenorhabditis elegans] gb|AAK31488.1| Hypothetical protein F13H
  Coding regions on vcDNA: vcDNA=SeqID_90128; Strand=+; Position=53-964
MAEENTNQSEGLDFFLNRSGWTDAQLEEVIRLLYGKRLQQLSIAQRFLDSAQEANFELKGFQMVAQEEQCRRPKKMRVAAIQNKIVLSTSAPVQAQRDALHQRVGKMIDAAARAGAQIVCLQEAWTMPFAFCTRERLPWTEFGEXAEDGATTKFLSELAKRLGGVKIAPILERDIHKDDLLWNTAVIISQTGAVIGKTRKNHIPRVGDFNESTYYMESTLGHPVFETAFGAKIAVNICYGRHHPQNWMMYALNGVLLLMLPNALVSSPPTVXGADIIFNPSATVSGLSEALWPIEARNAAIANH

SEQ ID NO: 163706 - protein, 161 aa, Heterodera glycines
  Homolog annotation: Hit_ID=XP_416776.1; Match level="QueryCoverage =83%, HitCoverage=8%, E-value=1e-18, Identity=37%"; Hit description =PREDICTED: similar to cofactor required for Sp1 transcriptional activation, subunit 2, 150kDa; human homol
  Gene Ontology: Mol. function=transcription co-activator activity; Biological process=regulation of transcription from Pol II promoter
  Coding regions on vcDNA: vcDNA=SeqID_90129; Strand=+; Position=12-494
MPAPLAVQQKMISEDGSDANIPQQHFSANGTPQQPPSATVPPAAAAAHLLKNSLSAPLLANLPPVPPQCGPPTVSLALLIDFAIHWNYRQFEILSELNSKKKETDRKISVVEFAHNTRLIFVRLLAIVRWLKSAKKFEPLASIRHLLDEQATRYVETADRL

SEQ ID NO: 163707 - protein, 180 aa, Heterodera glycines
  Coding regions on vcDNA: vcDNA=SeqID_90130; Strand=+; Position=2-541
DNHRKLIRVTAPPPQRQQQQLINGVVMSHNQHLHVPNTAIGGRTTTVDMAIPQRQQLSDSEVLPVHHHCLYRIDHPQILSSGTATDFSVLQNFPAAKPRNAVNLNNNNMQQFVPTTESFSSPSSSSAPNTAIELTLMNGELSMDSSATISQFHPIVLDNSPTKTLPEDVRNAYEQMLKEN

SEQ ID NO: 163708 - protein, 114 aa, Heterodera glycines
  Coding regions on vcDNA: vcDNA=SeqID_90131; Strand=-; Position=81-425
MKQSMPTTTKWPSRACLCMSPSRSVVLPSLSHCPFRRPRCCCCRYFCCPSPLSILCSLCRSFSAFFSSHPPSHCSLSSSAVVPMPFGVGDRSLLRPNETAEVKRTSWSRTNVDR

SEQ ID NO: 163709 - protein, 199 aa, Heterodera glycines
  Coding regions on vcDNA: vcDNA=SeqID_90132; Strand=+; Position=20-616
IEMDLFDIFEHINTNEDVQFLRSSGNAGALAPQPLVPNTVYSLSDLCSAFSSAASLSAPPMGMASNSDAFGLRSTILPAAPLSAPPVGISTNSDDFGLRSTIVPAAPLSAPPMGISSNIDNTGATRERNHQYFFGHDFTTESFSSNSGTTRIRKPQPLNFSLKVFLGGIPANMTTNGLELNFARFGKSIIDWPKKTGNK

SEQ ID NO: 163710 - protein, 125 aa, Heterodera glycines
  Homolog annotation: Hit_ID=NP_508842.1; Match level="QueryCoverage =100%, HitCoverage=37%, E-value=2e-65, Identity=96%"; Hit description= actin (act-4) [Caenorhabditis elegans] gb|AAK77622.1| Actin protein 4, isoform b [Caenorhabditis elegans
  Gene Ontology: Mol. function=structural constituent of cytoskeleton; Cellular component=cytoskeleton; Biological process=actin cytoskeleton organization and biogenesis
  Coding regions on vcDNA: vcDNA=SeqID_90133; Strand=+; Position=2-379
GNERFRCPEALFQPSFHSMESAGIHETSYNSIMKCDIDIRKDLYANTVLSGGSTMYPGIADRMQKEITALAPSTMKIKIIAPPERKYSVWIGGSILASLSTFQQMWISKSEYDESGPSIVHRKCF

SEQ ID NO: 163711 - protein, 98 aa, Heterodera glycines
  Coding regions on vcDNA: vcDNA=SeqID_90134; Strand=+; Position=74-370
TVWTLTDLVFILRKMCFLPSNSTVFGRSIGFIHQFGRRFLFPPIAQCEHVAGLKMDKMLQLQCRFCFFTRRNGRWIVECTKFGRHRTILRDFNADLYW

SEQ ID NO: 163712 - protein, 159 aa, Heterodera glycines
  Homolog annotation: Hit_ID=NP_499240.1; Match level="QueryCoverage =51%, HitCoverage=17%, E-value=5e-27, Identity=74%"; Hit description =speckle-type POZ protein (51.1 kD) (3L182) [Caenorhabditis elegans] emb|CAA83138.2| Hypothetical protein
  Coding regions on vcDNA: vcDNA=SeqID_90135; Strand=+; Position=183-659
MDVDGAAQDEMVTDGPGYIANCPTGSMAQQSSNNGGGSSTSSSSGGGNGAGGNSAVGSSHQQYRSMSPLSGLGMAAASSASGTSSTSSSSSSSSSSVIPLDIGLGMLPIAENWCNTQVKVVKFNYMWTINNFSFCREEMGEVLKSSTFSAGPNDKLKWC

SEQ ID NO: 163713 - protein, 158 aa, Heterodera glycines
  Coding regions on vcDNA: vcDNA=SeqID_90136; Strand=+; Position=3-476
KMKLGICISWGRTGGRLMVPPSNEPIRPFTLIWNKTDGLVALLGQKLEKGTWVLFTLSTRTAFLHSVDRKLVDRVSITDQRRETAVDSMNIQVMAFVRSFRRYNDYYRIGMDQLIGWVLVSEDSFVRRVVLQENLAAQMSIIFKHDCVRGFNWVAVSV

SEQ ID NO: 163714 - protein, 266 aa, Heterodera glycines
  Homolog annotation: Hit_ID=NP_491117.1; Match level="QueryCoverage =100%, HitCoverage=88%, E-value=2e-73, Identity=51%"; Hit description= brix domain containing protein 1 (33.5 kD) (1D742) [Caenorhabditis elegans] gb|AAF60765.1| Hypothetical
  Gene Ontology: Mol. function=rRNA binding; Cellular component =nucleolus; Biological process=ribosome biogenesis
  Coding regions on vcDNA: vcDNA=SeqID_90137; Strand=+; Position=32-829
MKVEKIKTRRGKKFLEDRAPKLVENDKVTLFVKGKKCSVMLNKILGELYQLKKPLANRLQRNNDSHPFEDDSLLCRFSHKFDASLFVFGSSTKKRPNSLLFGRMYDHQMLDMVELQVENFVSSDEFKQVKSVTLGSKPCIILQGHLFESNGILQRIGNLMVDLFRGPKVEYLRLQGTELIISLTAVSEERIKFRVYRASLKKDMESATPKIELVEMGPNIDFKIDRTKLASDSLFKTALRKPQEVQKSAKKNVKFDAFGNKVAQVH

SEQ ID NO: 163715 - protein, 320 aa, Heterodera glycines
  misc_feature (235)..(235): Xaa can be any naturally occurring amino acid
  Homolog annotation: Hit_ID=EAA08107.2; Match level="QueryCoverage =70%, HitCoverage=52%, E-value=1e-38, Identity=41%"; Hit description =ENSANGP00000018195 [Anopheles gambiae str. PEST]
  Gene Ontology: Mol. function=chaperonin ATPase activity; Cellular component=mitochondrion
  Coding regions on vcDNA: vcDNA=SeqID_90138; Strand=+; Position=7-965
MRSHQFNLRQLRKPFRNVASTNSEGLRHRNSIVGPPGVPWTSLALLATAPPIVAPEDDILNSLFAQVGGMPTLKSTGTTVELVRRRSFSYGSNCAKCGKPLRRTPTTNDNSKLLYCKDCNIIFSSSSSNDASSKKFNILKNGPIQSPPYPTEISAYLDKYVVGQQQAKKALSVGIYQHYKRLENNQRFLNQFFDNNFPNVASVQQQHHQQQSQMHPNISIHYPFSHPHDLATDLXLCDCTSMTQAGYVGEDVESVLQKLLQNAQGNVEKAQRGIVFLDEIDKIAATREAISHAYRDVSGEGVQHALLKMVEGAVVNVKTG

SEQ ID NO: 163716 - protein, 140 aa, Heterodera glycines
  Homolog annotation: Hit_ID=NP_872192.1; Match level="QueryCoverage =100%, HitCoverage=99%, E-value=5e-42, Identity=58%"; Hit description= transthyretin-like family member (15.7 kD) (5I318) [Caenorhabditis elegans] gb|AAN84848.1| Hypothetical
  Coding regions on vcDNA: vcDNA=SeqID_90139; Strand=+; Position=31-453
MHSLAFISFAFCLSLTDAFRTQSSGVRGTLLCGGKALADTKVKLYDHDKGPDADDLMGTTTTDEQGRFQVSGKTTELTTIDVQLRIYHDCDDGMMPCQRKVTFNIPDSYVTSGAVPAKFFDIGTVNMQIIFDHEERSCIH

SEQ ID NO: 163717 - protein, 154 aa, Heterodera glycines
  Homolog annotation: Hit_ID=CAE67008.1; Match level="QueryCoverage =91%, HitCoverage=5%, E-value=1e-26, Identity=41%"; Hit description =Hypothetical protein CBG12408 [Caenorhabditis briggsae]
  Gene Ontology: Cellular component=mitochondrion; Biological process =polar body extrusion after meiotic divisions
  Coding regions on vcDNA: vcDNA=SeqID_90140; Strand=+; Position=132-593
MCKKTKSEPCCKKQVVELRNDIATNGCIAGGIECCDLTAHTVQRRPQTTGQLFLEELYFVKHVDNNSLADSPREREILAEYRNLLYSIILNGLRQWSKSGVLAQITNGEQFEHALKLLEGKEGIPTVADEERKRKFLDDSKCSLVNALDELFNL

SEQ ID NO: 163718 - protein, 176 aa, Heterodera glycines
  Homolog annotation: Hit_ID=CAE68033.1; Match level="QueryCoverage =84%, HitCoverage=49%, E-value=4e-36, Identity=51%"; Hit description =Hypothetical protein CBG13650 [Caenorhabditis briggsae]
  Coding regions on vcDNA: vcDNA=SeqID_90141; Strand=+; Position=86-613
MECPPGSSFDPSPSPSVASQPFSEECHSPDNQISLDNSVPEESPNGNANVCMGEAKPRWGPTHAGAKQLASMYGKGKRLQEVTCICVASALFLSVGCSLLYHFRLVPVGQLILASLPRVLMADFNSGVVHWGADTWGTVDTFVGRNYNRSFREHHVDSTAITRHDLVEVNGDNFML

SEQ ID NO: 163719 - protein, 118 aa, Heterodera glycines
  Coding regions on vcDNA: vcDNA=SeqID_90142; Strand=+; Position=42-398
MGSLLEYSMEGGGGAMDGSAYIDMESWSNVLSACGVDNHEMRERYHQVRLRSRSQNGKYTYTLTTRTFEDADGKKLPQPVETRKQLDRREYQSYLKLRDRSRQSIHKKRVCFVLFTIS

SEQ ID NO: 163720 - protein, 316 aa, Heterodera glycines
  Homolog annotation: Hit_ID=CAE61684.1; Match level="QueryCoverage =68%, HitCoverage=65%, E-value=5e-17, Identity=27%"; Hit description =Hypothetical protein CBG05629 [Caenorhabditis briggsae]
  Coding regions on vcDNA: vcDNA=SeqID_90143; Strand=+; Position=22-969
MDSQLSAAETSVDSVCHQLVLRSANWQISPKLEQSIYWNVDRIFVDLNWSQNRSCPNPEVIQVQHTPMPSKEKAIEYLRHILDNSFRIRRLDLNIQVSTELVVNDILDVLNGHAKVQLEELFVRRRYVGSKFSGLVPLIRSNAKTLKQIGKIGLGEAIKALSDEIHLERLSLINFDLVEQDQRLDSEELAQNSRFYIRRLAGIGTTFDHLSYTCFTGFEITKMPALNMLRQCKVKSLRLTMQSGVAIKDPELPRPLLPMMQRIQLVGGMDASSERLSLLFPALEELEIEKQDLITGHRLEKRARVLSNYAPDFVGD

SEQ ID NO: 163721 - protein, 177 aa, Heterodera glycines
  Homolog annotation: Hit_ID=NP_505164.3; Match level="QueryCoverage =86%, HitCoverage=27%, E-value=2e-09, Identity=26%"; Hit description =putative membrane protein family member (5I863) [Caenorhabditis elegans] gb|AAM45372.2| Hypothetical prot
  Coding regions on vcDNA: vcDNA=SeqID_90144; Strand=+; Position=1-531
KGPKSQKNETEKPPQQKQPQEKPGAQQDDTETEEDSKEDKRKPIKCQEERKCYAHSECGARSKCKPATLDRKKKVGTCDCGVCGGFQLLLLCSLNSGALSLDKNIVPRECAGLKDACVEKPLFVGSKSKKCDCEVGFQKAGFKNLRDGQKKVCNKQKCDGKKDTCFGMNCYGGKCRC

SEQ ID NO: 163722 - protein, 106 aa, Heterodera glycines
  Coding regions on vcDNA: vcDNA=SeqID_90145; Strand=+; Position=173-490
PFTDNRIHLKHKGRLDHHHHCIGSILSLWTRTSVIVILVTSLPLSGYLLVVSCIHLYKSGSRYFASSGGTSTPASSLAGGSSTGDALIPMVVAGAQVLGSIGNFIN

SEQ ID NO: 163723 - protein, 135 aa, Heterodera glycines
  Homolog annotation: Hit_ID=BAC03887.1; Match level="QueryCoverage =91%, HitCoverage=56%, E-value=3e-09, Identity=40%"; Hit description =unnamed protein product [Homo sapiens]
  Coding regions on vcDNA: vcDNA=SeqID_90146; Strand=-; Position=285-692
DPEPEADDDAEPEPLSEVSGVPEVSSVVSVVSSVVSSVVADFSPPVSAAASSFFSSAADPPSSFFSSSALSPPSSSFCCSSTTRSDGTATTSPAAEGGVSFLSSSAPFSTSPSAPPLPSSSSSSPSAFFGFMNRR

SEQ ID NO: 163724 - protein, 102 aa, Heterodera glycines; identical to SEQ ID NO: 162191
  Homolog annotation: Hit_ID=NP_492370.1; Match level="QueryCoverage =100%, HitCoverage=96%, E-value=6e-21, Identity=45%"; Hit description= transport to INner mitochondrial membrane (yeast TIM) TIN-13, TIMeless related (11.7 kD) (tin-13) [Caeno
  Coding regions on vcDNA: vcDNA=SeqID_90147; Strand=+; Position=39-347

SEQ ID NO: 163725 - protein, 36 aa, Heterodera glycines
  Coding regions on vcDNA: vcDNA=SeqID_90148; Strand=+; Position=3-110
RLGFMENVRKSIPVNVGTYFLPFFHFLTISIKECIP

SEQ ID NO: 163726 - protein, 189 aa, Heterodera glycines
  Coding regions on vcDNA: vcDNA=SeqID_90149; Strand=+; Position=3-569
PFKQFIYIFFLQISWCHGVSTDLMQIDEQQQQQMAAANECCFIYPFPASGLSSRQLMRVLSAWLMPSFSADEEGPSMNVPSCFSDIDSSFECASFSVPMVFSHDEWFVQCVPALGEQLDKLLLLSQHQRDRGRKLMPPTTTEYGRRRGVSCATGAAPFARVDHPNSDADTAQDRNATVHCGFRHFAPLV

SEQ ID NO: 163727 - protein, 188 aa, Heterodera glycines
  Homolog annotation: Hit_ID=CAE68288.1; Match level="QueryCoverage =57%, HitCoverage=46%, E-value=4e-16, Identity=38%"; Hit description =Hypothetical protein CBG13973 [Caenorhabditis briggsae]
  Coding regions on vcDNA: vcDNA=SeqID_90150; Strand=+; Position=18-581
MYVERQFVRIVAVITMGGSSLRSIRRISSFYPSLSVNRPQRFSYVVQMSSDSNNVRHGVALLCWHCGGDSMTPSDDNAGTVLLCSRCGRLQPLPARIDFFSYFGLDDPAGATIGEAELKRRFRRMQSLVHPDKFAGRDENERALAEQHSAFLNNAYRTLREPFARAEYLLTLLETLKNDDGTSPGTAS

SEQ ID NO: 163728 - protein, 182 aa, Heterodera glycines
  Coding regions on vcDNA: vcDNA=SeqID_90151; Strand=+; Position=110-655
MEMELSSIFLGRFSFSDLVEFSENLFIYCSRFMFTPFSSTGSVGNGDQIHFNSDGMSSGRIADRNYKQRLFGLFLCYSLYFLQPSQYVVPISVTSSQLDDFYEFTSSVLLPEENFEALYCFYRLLNANAFSIAPVLGNFNPLLQGTFHPTLLDKSSSESSGIELVQDFGLLFSLSNSEVLKQ

SEQ ID NO: 163729 - protein, 222 aa, Heterodera glycines
  Homolog annotation: Hit_ID=NP_498518.1; Match level="QueryCoverage =84%, HitCoverage=74%, E-value=2e-48, Identity=50%"; Hit description =pyridoxamine oxidase (3I53) [Caenorhabditis elegans] gb|AAA21167.1| Hypothetical protein F57B9.1 [Caenorh
  Gene Ontology: Mol. function=pyridoxamine-phosphate oxidase activity; Biological process=coenzymes and prosthetic group metabolism
  Coding regions on vcDNA: vcDNA=SeqID_90152; Strand=+; Position=35-700
MFLKRRISEPSDEDEKQRTNQIPIDNNSCVDGIPLNIQSLRKTYVDREEPFLLEKDMLSCPFDQFSIWFGNAITQTDLKYEEVNGFALSTVSRNGRPSSRMLLLKGFSKVGGFVFFTHSNSKKGKELSENPYVSALFYWPKVNRQIRIEGRVEILGEEVADVYWSKRPIESRIGSKLSDQSSVIPNREHLTRKQRELEELCSVNGEEAITRPSDWLSYSLPP

SEQ ID NO: 163730 - protein, 208 aa, Heterodera glycines
  Homolog annotation: Hit_ID=NP_502269.1; Match level="QueryCoverage =95%, HitCoverage=53%, E-value=2e-84, Identity=73%"; Hit description =zinc-containing alcohol dehydrogenase superfamily (40.2 kD) (4M724) [Caenorhabditis elegans] emb|CAA98080
  Coding regions on vcDNA: vcDNA=SeqID_90153; Strand=+; Position=47-670
MAQSQNGGVKNRRISLGSPKDLKEVHFFEEDEVPDVPLNGARVKVCYAGVCLTDKEISNTKQARITHGVKDTSLFPGYEVSGVIDEFGPNATPVEYNLKVGDKVIVWPTEEMCQNGYADFVAVPNLSLLVKIPDTLSMHVASILPAGATWALSAIVHARPVVEAIASTKGCCNILIVGAGGLGLWILTLAKHFLTAGQENRIKLIGAD

SEQ ID NO: 163731 - protein, 157 aa, Heterodera glycines
  Homolog annotation: Hit_ID=CAE73340.1; Match level="QueryCoverage =80%, HitCoverage=86%, E-value=6e-19, Identity=36%"; Hit description =Hypothetical protein CBG20771 [Caenorhabditis briggsae]
  Coding regions on vcDNA: vcDNA=SeqID_90154; Strand=+; Position=26-499
MAAKELFLAQQPDLFKPIQSINAVLILICLGSSTAVPGIGVLWFIGLCSLIVSVTATEFVYSSVLTLLCGVGFWLSFGFASHVPDNGHSAGYIFAGIFLVAQVACYAIPVLIIYDRSRTDGPAAAGHEQIANVHPFGVTTDGCEQHYQSMQHERPIV

SEQ ID NO: 163732 - protein, 212 aa, Heterodera glycines
  Homolog annotation: Hit_ID=CAF98199.1; Match level="QueryCoverage =96%, HitCoverage=35%, E-value=4e-71, Identity=62%"; Hit description =unnamed protein product [Tetraodon nigroviridis]
  Gene Ontology: Mol. function=cystathione beta-synthase activity; Cellular component=cytoplasm; Biological process=cysteine metabolism
  Coding regions on vcDNA: vcDNA=SeqID_90155; Strand=+; Position=3-638
MVKLQRIPAEFGIECNVYGKCEFFNAGGSVKDRIALRMLEIAEQSGRLRAGMTVIEPTSGNTGIGLALACAVKGYHCVIVMPERMSREKELTLKALGAKIVRTKDKARYDSEQSHIGMAFKLRKETPNSVVLDQYKNIANPLTHFEGTAAEILDALDGKVDMVVVGVGTGGTITGISRRIKKANPNCIIVGVDPIGSILGGEDEHAGHKYNV

SEQ ID NO: 163733 - protein, 370 aa, Heterodera glycines
  Coding regions on vcDNA: vcDNA=SeqID_90156; Strand=+; Position=6-1115
MTKKTAETVVAKKETKPKELNEMQLQRLNLIKKIKEKKAVAKEKRERERNEKQMQRLEFIRRMTELRHLNPLASPSRGPFLYEGDYFYREILVGRSDSNANNGEAEVDCVSVSAPGGFDELFVTNPAENSAISISKMICGRKKALNNKEEDGGTYSEESFKNLGVEAREFLGSFLKFIDDQRLVDLATQGVTGGASMFHSLTMKNANCLRESLRLYCKSGQALLVQVHFWLLKHLSQTRLTSYLNLLRFLKNAGSNLSDYIASSPTAEAELEKANKTISEFIAQKLYEPPLSSSSKFIECDPIKNVSLVLVYPQINAKMSQHTIRAHETLFRNLLPLAVCCVEKVELNLNVDRPISVEECAWMCIQMIRQ

SEQ ID NO: 163734 - protein, 116 aa, Heterodera glycines
  Homolog annotation: Hit_ID=CAE60539.1; Match level="QueryCoverage =92%, HitCoverage=11%, E-value=1e-22, Identity=47%"; Hit description =Hypothetical protein CBG04166 [Caenorhabditis briggsae]
  Coding regions on vcDNA: vcDNA=SeqID_90157; Strand=+; Position=3-353
VMAAVIISMGFSVDIPAHVSYHFHIAKWTEDGQRQRTIEERIRMSFASVGFPAVQASTCTNICILCLLVVPVYPAQVFVRILCTCITLCTIHSLCLLPALFNLLGTLEAFLSSKFA

SEQ ID NO: 163735 - protein, 209 aa, Heterodera glycines
  Homolog annotation: Hit_ID=NP_741554.1; Match level="QueryCoverage =98%, HitCoverage=41%, E-value=1e-56, Identity=52%"; Hit description =ALDH3C1, ALdehyde deHydrogenase (55.6 kD) (alh-4) [Caenorhabditis elegans] gb|AAM45357.1| Aldehyde dehydr
  Gene Ontology: Mol. function=aldehyde dehydrogenase activity; Cellular component=cytoplasm; Biological process=acetaldehyde metabolism
  Coding regions on vcDNA: vcDNA=SeqID_90158; Strand=+; Position=61-687
MTSPFHSLVESQREFFRTGKTAELAHRRQQLKKLRKTILDNSEFLCEAVQKDLKRDAKLNYPLEISSVIIEIEYVLDNLERWTAPLNVEKTFTTLLDSPQIVREPKGVVLLIGPWNYPLNTLLMPLVDVLAAGNTAILKPSEVASNTAAAVDEIISKAFDRNYLAVVQGGVEQTGELLKEKFDHIVFTGSALVARHISRAAAEHLTPCT

SEQ ID NO: 163736 - protein, 186 aa, Heterodera glycines
  Homolog annotation: Hit_ID=CAE71199.1; Match level="QueryCoverage =64%, HitCoverage=17%, E-value=6e-16, Identity=39%"; Hit description =Hypothetical protein CBG18058 [Caenorhabditis briggsae]
  Coding regions on vcDNA: vcDNA=SeqID_90159; Strand=+; Position=343-903
ALCPLGSLLLILLLALLLWCPHWLWSVPPYASSSHSSVPSPFFPALYAAFHRTAWATLLLLLAILLDASRGNALNSFFCWRCFHPLSKLVFPVLLLSEPIALSLFSSLHRPVHSTPLSTVLAWIGILVCSLIVALLIDTALTRPIRWICGAREETNDAVNTSSSNRMKNGRMIMEMEGEGKKRTLG

SEQ ID NO: 163737 - protein, 190 aa, Heterodera glycines
  misc_feature (99)..(99): Xaa can be any naturally occurring amino acid
  Homolog annotation: Hit_ID=NP_871946.1; Match level="QueryCoverage =38%, HitCoverage=12%, E-value=2e-18, Identity=58%"; Hit description =3'5'-cyclic nucleotide phosphodiesterase family member (2H918) [Caenorhabditis elegans] gb|AAO38608.1| Hy
  Gene Ontology: Mol. function=cAMP-specific phosphodiesterase activity; Cellular component=insoluble fraction; Biological process =signal transduction
  Coding regions on vcDNA: vcDNA=SeqID_90160; Strand=+; Position=7-578
PTPSWRHCGWPVHSSRHLHGRPGRVSSSVPGPRTVAELPKSFLEQHHLTVAFKVLKVHRSAIHLAICSNPIKPIKLYWQWNERVMGVYWRQGNRKKRLXPEISQMCDRGNVTVEKSQLLFVLFVAFNLCLWLQHRLSMKSEQDGNRIINAEKWAVSIVRCVHWSVRAIILRLNASNSLVSNHLPNQSPMQ

SEQ ID NO: 163738 - protein, 211 aa, Heterodera glycines
  misc_feature (183)..(183): Xaa can be any naturally occurring amino acid
  misc_feature (206)..(206): Xaa can be any naturally occurring amino acid
  Homolog annotation: Hit_ID=CAE65984.1; Match level="QueryCoverage =82%, HitCoverage=93%, E-value=8e-32, Identity=42%"; Hit description =Hypothetical protein CBG11175 [Caenorhabditis briggsae]
  Coding regions on vcDNA: vcDNA=SeqID_90161; Strand=+; Position=11-644
MHIINNSIWLKFLITAFLFKIACSKFGSSENKGFFFYFGYGSNLLEERIHVQVKGATFVAIGALKGYRLAFVDFEEPNRWHSAAATIEQKQGSLVWGCIWKVPNSFADELDKQETKYKRIDVTVFPRPSTNERFNLNMRLFSNFVIKCRTYQYERPDMKYGLPSPQYKHVIVTGAEEHGLPTXYIQWLRENFEDNGYDGPVELNLXALETM

SEQ ID NO: 163739 - protein, 91 aa, Heterodera glycines
  Coding regions on vcDNA: vcDNA=SeqID_90162; Strand=+; Position=459-734
LISSQKSCQLKTAKKAEFSKFFISIFFYSSKFSVISSRLIEPVKSFRMISRLFDSVNNFKSYIDSKLAGRSWPVPRSAVLVFQIFQRFLFF

SEQ ID NO: 163740 - protein, 208 aa, Heterodera glycines
  misc_feature (198)..(198): Xaa can be any naturally occurring amino acid
  Homolog annotation: Hit_ID=NP_004090.4; Match level="QueryCoverage =92%, HitCoverage=67%, E-value=2e-61, Identity=58%"; Hit description =stomatin isoform a [Homo sapiens] emb|CAH70728.1| stomatin [Homo sapiens] emb|CAH72707.1| OTTHUMP00000064
  Gene Ontology: Mol. function=protein binding; Cellular component =lipid raft; Biological process=signal transduction
  Coding regions on vcDNA: vcDNA=SeqID_90163; Strand=+; Position=1-624
QSSSRSFRPSDDTDSRGSCSSLLICFSYCSSIICFPCAICLSIRVIQQYERAVIFRLGKVMREAAGPGLIFILPCIDDFRCIDMRTTSFDVPPQEVLSKDSVSVTVDAVIYFRVFDANKAVVNVENATMSTQLLGQTTLRNILGTKTLSELLSKRDQINFEMQQVLDKLTDAWGVKVERVDVKDVRLPKDMQRSMAAXAEAAREARAK

SEQ ID NO: 163741 - protein, 269 aa, Heterodera glycines
  Homolog annotation: Hit_ID=NP_497276.2; Match level="QueryCoverage =98%, HitCoverage=85%, E-value=3e-52, Identity=47%"; Hit description =RNA-binding protein S1 serine-rich domain like (rnp-4) [Caenorhabditis elegans] gb|AAK21429.2| Rnp (rrm r
  Gene Ontology: Mol. function=RNA binding; Cellular component=nucleus; Biological process=RNA splicing
  Coding regions on vcDNA: vcDNA=SeqID_90164; Strand=+; Position=30-836
MVERRKESPKRRRRSSSSSSSGSSSSTGSSSSGSSSSSSTTASRSPSPKKQRAAARPSARDDRTTRRSPRRSRSPHRVQPKTEKSTVSSRRSPSPRRRRPSPPSRGPRRRSRSPRHERAAPSPPPVKRERTPEPPPRRLCVRNLSRNITKAHMEEIFALFGALKSCELPMDRVHVHLPRGYGYVEYEKAEDAEKALKHMDGGQIDGLEIQCEMTFPFKGTGGGRGHSPVGINSMGIGIKRERSRSPARRFAARLSPPRRGRRSRSPTPM

SEQ ID NO: 163742 - protein, 183 aa, Heterodera glycines
  Coding regions on vcDNA: vcDNA=SeqID_90165; Strand=-; Position=45-596
SARGFGKFSEHFLFLSLGRLACFDDCVITETYPRKQHTTHQGLHGHTNGDADHDFVVVPVFVVIVVNQISGAENQRENGQSGDDRIRNLVRSVKGEETIEHRRKGPAEQKAASEHEVDESDHVILPNGRVQEEDEDQHQKGQNCSDQLNRPNRHHSDGVVVYTTTSRPSGCCAHDSGRHFGTE

SEQ ID NO: 163743 - protein, 139 aa, Heterodera glycines
  Coding regions on vcDNA: vcDNA=SeqID_90166; Strand=+; Position=230-649
MNNNDMQLLMNRFKEASQRGSNDEVERFFSDLRKTPHMFNAFLKLTKKQGVCISGDPFPHQHQPQGGAATQPQQQHFVQPQSSFYQPNQPQQNGGNIPSSQFGGPFQQQMPSHGAGTAQWMQPPNQSQQQSAASQRNSS

SEQ ID NO: 163744 - protein, 233 aa, Heterodera glycines
  misc_feature (111)..(111): Xaa can be any naturally occurring amino acid
  Homolog annotation: Hit_ID=NP_510638.2; Match level="QueryCoverage =79%, HitCoverage=63%, E-value=4e-52, Identity=52%"; Hit description =solute carrier family 25 member 21 (31.8 kD) (XQ807) [Caenorhabditis elegans] emb|CAB04651.3| Hypothetica
  Gene Ontology: Mol. function=intracellular transporter activity; Cellular component=mitochondrial inner membrane; Biological process =mitochondrial transport
  Coding regions on vcDNA: vcDNA=SeqID_90167; Strand=+; Position=183-882
MTNVLNSPMLEGIKDSGRHFVSGGIAGMAEVCFAHPFDCMKTRLQIGQFHGILDCARRTLLNEGPSGFYKGLLPPLVIETPKRALKFMAFDRYWRVLRSDALPTWLVIESXSMSGLFTGLTEAVLVCPFEVVKVRLQSELNTPFFQQKSSATVAREIVHSNGWGTEGLYRGIGANLWRHGVWNSCYFGIYHNLRLFLCSIPSKNSQSSADRLETASLTMRLTIASLSAIVANL

SEQ ID NO: 163745 - protein, 200 aa, Heterodera glycines
  misc_feature (143)..(143): Xaa can be any naturally occurring amino acid
  Homolog annotation: Hit_ID=EAA00491.2; Match level="QueryCoverage =100%, HitCoverage=95%, E-value=1e-43, Identity=40%"; Hit description= ENSANGP00000014102 [Anopheles gambiae str. PEST]
  Gene Ontology: Mol. function=structural constituent of cuticle; Cellular component=actin filament; Biological process=signal transduction
  Coding regions on vcDNA: vcDNA=SeqID_90168; Strand=+; Position=3-602
ETPGPPGPSTETPGPESSTSTPSEGPGTPSTETPGPPGPSTETPGPPGPSTETPGPPGPSTETPGPPGPSTETPGPPGPSTETPGPPGPSTETPGPESSTSTPSEGPGTPSTETPGPSTEAPGPSTETPGPPGPSTETPGPPXPSTETPGPESSTSTPSEGPGTPSTETPGPPGPSTETPGPPGPSTETPGPESSTSTPS

SEQ ID NO: 163746 - protein, 147 aa, Heterodera glycines
  Homolog annotation: Hit_ID=NP_500272.2; Match level="QueryCoverage =100%, HitCoverage=97%, E-value=9e-73, Identity=90%"; Hit description= ubiquitin conjugating enzyme (16.9 kD) (ubc-13) [Caenorhabditis elegans] gb|AAK93865.2| Ubiquitin conjug
  Gene Ontology: Mol. function=ubiquitin conjugating enzyme activity; Cellular component=cytoplasm; Biological process=flight behavior
  Coding regions on vcDNA: vcDNA=SeqID_90169; Strand=+; Position=2-445
LPRRITKETQRLLQDPVPGISAVPDEANARYFHVIIAGPDESPFAGGVFKLELFLPEEYPMAAPKVRFMTKIYHPNIDKLGRICLDILKDKWSPALQIRTVLLSIQALLSAPNPDDPLATDVAEQWKNSETEAIQTAKQWTRLYAHA

SEQ ID NO: 163747 - protein, 91 aa, Heterodera glycines
  misc_feature (30)..(30): Xaa can be any naturally occurring amino acid
  misc_feature (39)..(40): Xaa can be any naturally occurring amino acid
  Coding regions on vcDNA: vcDNA=SeqID_90170; Strand=-; Position=3-275
ISLLATFHHTTMPNPPIRLIDHALPSVATXRHGDGGVRXXDEGDDVGTVVQIQLLLRVVRHFGCQLLRPLHLLVQSRLFVFNYQSQLCAGL

SEQ ID NO: 163748 - protein, 109 aa, Heterodera glycines
  Coding regions on vcDNA: vcDNA=SeqID_90171; Strand=-; Position=126-455
RSSLVGSGEGDAVDGVTSKWKPNRGSWSSSGDDKLRFNVPLDPIDCCCCCCCWSLLPLYFSLVSSPSRFFSGFSSSVENSVIRFAFGPSLSPEFFSLCFSLSNDENLSE

SEQ ID NO: 163749 - protein, 204 aa, Heterodera glycines
  Homolog annotation: Hit_ID=NP_509652.2; Match level="QueryCoverage =97%, HitCoverage=93%, E-value=5e-38, Identity=42%"; Hit description =glutathione S-Transferase (23.9 kD) (gst-36) [Caenorhabditis elegans] emb|CAA88541.2| Hypothetical protei
  Gene Ontology: Mol. function=glutathione transferase activity; Biological process=glutathione conjugation reaction
  Coding regions on vcDNA: vcDNA=SeqID_90172; Strand=+; Position=452 -1063
MSSQQPKLYYFAGVRGRGEYIRQILKFAKVPFEEVSINIEDWPKYKEEMPLGQIPVLEVNGVKFSQSLAISRYLGETYGLSFNDPLERALLNMIVDQISDTQNSGAFKEWPMVRLDLVPCGDKAAFFREKIRPQLDGCASLVEKYLVEKGDGILLGKDKITWADIYAAEFFAKCIHFGEKDCLEAYPQIKSLIARVQNEPIIKE

SEQ ID NO: 163750 - protein, 196 aa, Heterodera glycines
  misc_feature (98)..(98): Xaa can be any naturally occurring amino acid
  misc_feature (184)..(184): Xaa can be any naturally occurring amino acid
  Homolog annotation: Hit_ID=CAE64114.1; Match level="QueryCoverage =79%, HitCoverage=45%, E-value=2e-09, Identity=28%"; Hit description =Hypothetical protein CBG08723 [Caenorhabditis briggsae]
  Coding regions on vcDNA: vcDNA=SeqID_90173; Strand=+; Position=27-613
MLSRRSLPIFFFRRSRASNFPVFCYSTENGAQMLESDTSGEQLQLLRTIVDSHLTNGQTFFVPWSDKRALQSILLPFKELANQGVALEFIIDACSKKXSALFMALTKNGRETTKKLGVFVDCMEMTYEDAMRFYAKWASGLEEVSADCVQQRLSIFLGRGVRAGAQMRSVVMRCPEILFMGVPXQMDMFWENILDF

SEQ ID NO: 163751 - protein, 229 aa, Heterodera glycines
  Homolog annotation: Hit_ID=NP_510634.1; Match level="QueryCoverage =77%, HitCoverage=53%, E-value=5e-41, Identity=46%"; Hit description =misexpression suppressor of KSR (35.6 kD) (XQ738) [Caenorhabditis elegans] emb|CAA92227.1| Hypothetical p
  Gene Ontology: Cellular component=cytoplasm; Biological process=cell differentiation
  Coding regions on vcDNA: vcDNA=SeqID_90174; Strand=+; Position=139-825
MSNLNFEDNLQRVQVEIQWKQCLYNPIVAPFADVGSYPIFTDEFKGTRKCTLDVYVQGNLEHLDDKVVFLTVHDVGKTYLSCVDLANSPTLSPLVGQRAVFLHVSVPGQAPGAENFVGDFPSMEQLGDGLSQVMEQFNLSKCIAIGESAGADIVCRFAMSFPQLVVGAVLVHCISTTHGIIASIKELFTNLLLNDGEMTHSAWNWLLVHKFGNHEMDKEKRNYVDAIKA

SEQ ID NO: 163752 - protein, 214 aa, Heterodera glycines
  Homolog annotation: Hit_ID=CAE70897.1; Match level="QueryCoverage =90%, HitCoverage=67%, E-value=4e-34, Identity=37%"; Hit description =Hypothetical protein CBG17688 [Caenorhabditis briggsae]
  Coding regions on vcDNA: vcDNA=SeqID_90175; Strand=+; Position=6-647
MLSRSPEMEEERLPIVSMVIVADKSRAPANFITLTKTYDDGSDADLWKDGFGFGLFNRSVRYIAVSRHIAETPPSGLEVLTDVAVISDKEAVPSSFVCLDFTVDTKERALKKKYLCARFTPRTDAIDAVTNLIVLARSRRPPKGYTLAGDIDGMDIWFRVSIIPESYGRLTHSQSTELQHFFTGASPKGVGIYPNIAPPLGTTAQNRHSTTDLD

SEQ ID NO: 163753 - protein, 153 aa, Heterodera glycines
  Homolog annotation: Hit_ID=CAE66470.1; Match level="QueryCoverage =92%, HitCoverage=92%, E-value=3e-11, Identity=29%"; Hit description =Hypothetical protein CBG11749 [Caenorhabditis briggsae]
  Coding regions on vcDNA: vcDNA=SeqID_90176; Strand=+; Position=70-528
MAELITKLCTTKLAILKWLQMLCAVITVLFLIDGQRQSWFYTLVFVVSIVFGLISLLTLIANFFLHSRNQSVPLPAFEIGFNALAAFVCLAFAVLLTIDSVRMFGDDFSHHRFLPPANIGKDGWRNRTLVVAIVQMVDAICYGLSLHRVRQRM

SEQ ID NO: 163754 - protein, 223 aa, Heterodera glycines
  Homolog annotation: Hit_ID=NP_788326.1; Match level="QueryCoverage =96%, HitCoverage=54%, E-value=2e-50, Identity=50%"; Hit description =CG30019-PC, isoform C [Drosophila melanogaster] gb|AAO41411.1| CG30019-PC, isoform C [Drosophila melanoga
  Gene Ontology: Mol. function=(S)-2-hydroxy-acid oxidase activity; Cellular component=peroxisome; Biological process=fatty acid alpha -oxidation
  Coding regions on vcDNA: vcDNA=SeqID_90177; Strand=+; Position=26-694
MVNILADLVALGDVEKRALDFLPRAARGYYESGADDEQTLRENREAFRNFLIRPFALRDVSQLDPSVTVRLSPSTANPKCRPFARTFACPIGIAPSAFHRMAHDEGEIATVKAAGETGTLMICSTLSTVPLEKVAEAAPEGSTLWFQLYIYKDRTLTEKIVRRAEKAGFAALVLTVDAPLFGRRRADERNAFQLPGHLNIANFASHMEQSTLSGAEVGSSGLS

SEQ ID NO: 163755 - protein, 210 aa, Heterodera glycines
  Homolog annotation: Hit_ID=NP_498209.1; Match level="QueryCoverage =100%, HitCoverage=40%, E-value=3e-66, Identity=56%"; Hit description= biogenic Amine Synthesis related (58.3 kD) (bas-1) [Caenorhabditis elegans] gb|AAV58886.1| Biogenic amin
  Gene Ontology: Mol. function=aromatic-L-amino acid decarboxylase activity; Biological process=dopamine biosynthesis from tyrosine
  Coding regions on vcDNA: vcDNA=SeqID_90178; Strand=+; Position=3-632
HSSVDKGIMLSGVKMRKLPTNREKGGNFVLRAEVLEAAIKEDKANGLTPFILVVTVGTTNTCAVESCRELGPICNREGIWMHVDAAYAGSFFICDEFRHLSDGVELADSFNFNAHKALMINFDCSPMWFKNGDEAIAFFNVDPVYLKHEHQRDAYDFRHLQVALGRRFRALKIWFVFRAIGIQRIQDFLRMQNKFGKLFADLLLGDDRFE

SEQ ID NO: 163756 - protein, 227 aa, Heterodera glycines
  Homolog annotation: Hit_ID=NP_871815.1; Match level="QueryCoverage =93%, HitCoverage=61%, E-value=2e-51, Identity=52%"; Hit description =DeHydrogenase, Short chain (dhs-2) [Caenorhabditis elegans] gb|AAO38639.1| Dehydrogenases, short chain pr
  Gene Ontology: Mol. function=steroid dehydrogenase activity; Cellular component=mitochondrion; Biological process=steroid metabolism
  Coding regions on vcDNA: vcDNA=SeqID_90179; Strand=+; Position=25-705
MGPAALLLLLPSLLLLFLLIRALLELIPVSRLDKRSVLITGCDSGFGFDLALRCLGAGMRVFAGCLTQTGIQSLKKSAQEKGIAVELLEPIELDVTSDESVAKALEFVERKLGPGKGLHALVNNAGISGNESWDDWLIPKDYEDVFQVNTLGTIRVTHAFKRLVKRERESRIVIMASSCGRVALPTLGPYSVSKFPVEAYPDIIRTELILFGVKVAVIEPGFFRTPI

SEQ ID NO: 163757 - protein, 161 aa, Heterodera glycines
  Homolog annotation: Hit_ID=CAE61639.1; Match level="QueryCoverage =96%, HitCoverage=96%, E-value=7e-34, Identity=49%"; Hit description =Hypothetical protein CBG05572 [Caenorhabditis briggsae]
  Gene Ontology: Biological process=mechanosensory behavior
  Coding regions on vcDNA: vcDNA=SeqID_90180; Strand=+; Position=34-519
MFGRFVSSLFSSTVSSVFRPERFLQKFSPNFCCHSNFLRQFSFTAQNHYDDILMRDIRRGSPPKHARKPHDRKPIKGTAFRKGIVIKVVVKHPKKPNSGNRQCVLVRLSTGRQCIAYIPGEGHNLQEHSQIYVRGGRRRDLIGVRANVMRGKLDCAAVKKK

SEQ ID NO: 163758 - protein, 123 aa, Heterodera glycines
  Coding regions on vcDNA: vcDNA=SeqID_90181; Strand=+; Position=54-425
GFDVSEMDQTPVEDRSVELCSDDDETKRKVETDSEDYFMVEKQLRERRVGIQNFSSMVLFDRKAKQRQKMAEKRRKERNNAKLILYGRPRKTKQCSSVFSKEDFAQIGKKDGSSANERIKRIR

SEQ ID NO: 163759 - protein, 204 aa, Heterodera glycines
  Coding regions on vcDNA: vcDNA=SeqID_90182; Strand=+; Position=11-622
EALAQSVASSKHTNSKMARKSRQEQQRRSQSREQQENIPPCCAQMRHENELLRRALRKERERRMFTTNAYRQLLEQFNHLVDFRRVVVANGGGERSEQLQQCQSSPSSVNGASVPLSSEAETALAMAPTATAAAVTPSITAPVVNNQHKQIITEQPAALNQHHHPNWYFVALERDANNTRGNSSNNDSAELLRDERVWRMFARS

SEQ ID NO: 163760 - protein, 181 aa, Heterodera glycines
  Coding regions on vcDNA: vcDNA=SeqID_90183; Strand=+; Position=157-699
MLETPRTIPGFHSAGPRRLSLATSHYRQFGIVSSPLATSSPSPMLFSSAAAATLPDRLPLRRPKKPPQKLPLLMPQLHLQFPSSRTNTIRSTDLSSIYTVQPEEAALDERNAHLLQCIQMQQELINQATAAIALCHKKFRFSGTLQELSAQRLLLVSQERLALLNRQMDQLNEQRILTNLS

SEQ ID NO: 163761 - protein, 339 aa, Heterodera glycines
  Homolog annotation: Hit_ID=CAE60538.1; Match level="QueryCoverage =99%, HitCoverage=99%, E-value=1e-135, Identity=72%"; Hit description= Hypothetical protein CBG04165 [Caenorhabditis briggsae]
  Gene Ontology: Mol. function=fructose-bisphosphatase activity; Cellular component=cytosol; Biological process=gluconeogenesis
  Coding regions on vcDNA: vcDNA=SeqID_90184; Strand=+; Position=55-1074
MPSEYGIETDSVTLQRFVLNEQKKFPDATGDLTTLLTSLLTAVKAISSAVRKAGLAQLYGVAGNVNVQGEDVKKLDVLSNELMINMLKSSYTVSTLVSEENEQVIEVEVSGTQGKYIVTFDPLDGSSNIDCLVSIGTIFGIFRKASNTSTKEEDTLQTGRKMVAAGYALYGSATMVVLSTPGRVDGFTLDPSIGEFILTNPAMRVPKKGKIYSINEGYAKKWSKGITEYIRSRKFPEEGKSAYGQRYVGSMVADVHRTLLYGGIFMYPATTDAPNGKLRLLYECNPMAFVMENAGGKAHSGKCPILDIQPKSIHQRAPIFLGSKEDVEELLEYIRKHDQ

SEQ ID NO: 163762 - protein, 316 aa, Heterodera glycines
  Coding regions on vcDNA: vcDNA=SeqID_90185; Strand=+; Position=76-1023
MATACKLEMSLDEIIKANKSKTNQASINGRKTQMTGKRLIRGNIAKGKPFIRKQINGQNQTKKFGLKRVGINVRRGRPLRKSNRVVVMRKNFAAKNRAVISATKNLVNKLVKKALNKSNVSPRGKRFIANSARRVRTIILNKVSPRSRVITRQRQRIVAVQPQQQPVFVQRVVRGRGPIRYASDAALVPQTMKMVPKRRFRINPMQQQQPVLLVQNQSPKRRLPSFSSMSVRQHVNALRRATTVQQLQTQFVNQQLPIRQQFRGRQAITTPVVPNRSRGKQQFILDQPVQAGPQFMKFSPRRQRRQTASTNTSSFN

SEQ ID NO: 163763 - protein, 296 aa, Heterodera glycines
  Homolog annotation: Hit_ID=AAK29898.3; Match level="QueryCoverage =98%, HitCoverage=55%, E-value=2e-81, Identity=53%"; Hit description =C-terminal src kinase protein 1 [Caenorhabditis elegans] dbj|BAC76831.1| CSK-1 [Caenorhabditis elegans]
  Gene Ontology: Mol. function=protein C-terminus binding; Cellular component=cytoplasm; Biological process=regulation of cell cycle
  Coding regions on vcDNA: vcDNA=SeqID_90186; Strand=+; Position=105-992
MEADFHAPWFYGSLSREKTEKCLQSCADGTFLIRNSTNYPGDFTLCVACNLRVEHYRIYMVNDHFTCDKEELFDTLTQLVSHYKRDADGLCHRLVCPYISEECQRQRTHIDLVLVEERKKEFEQAALLLSVDHLRLGTVIGHGEFGDVLSGTYRGRKVAVKTLKNGMVQDLLAEARFMIGLHHEKLVFLVGVVIEDPRESEVYMLTEFMANGNLVDFLRSRGRHHVDRPRLVQFAQDVAEGMAFLESRNFVHRDLAARNVLLDDRLGAHIGDLRTPSIGQSARKKSRGKGKFPDQW

SEQ ID NO: 163764 - protein, 62 aa, Heterodera glycines
  Homolog annotation: Hit_ID=AAK95156.1; Match level="QueryCoverage =100%, HitCoverage=100%, E-value=1e-19, Identity=71%"; Hit description=ribosomal protein L29 [Ictalurus punctatus]
  Gene Ontology: Mol. function=heparin binding; Cellular component =cytosolic large ribosomal subunit (sensu Eukarya); Biological process=protein biosynthesis
  Coding regions on vcDNA: vcDNA=SeqID_90187; Strand=+; Position=91-279
MAKSKNHTSHNQNRKDHRNGIHKPKKERYMSMKGVDPKFLRNLRFAKKHNKRNVKASTESAK

SEQ ID NO: 163765 - protein, 46 aa, Heterodera glycines
  Coding regions on vcDNA: vcDNA=SeqID_90188; Strand=-; Position=125-265
TFSYIHLTDAKYETELTRVEFLNIHWSCIESINFEPLSSFFVENHT

SEQ ID NO: 163766 - protein, 218 aa, Heterodera glycines
  Homolog annotation: Hit_ID=AAG21339.1; Match level="QueryCoverage =62%, HitCoverage=75%, E-value=4e-18, Identity=49%"; Hit description =hypothetical esophageal gland cell secretory protein 10 [Heterodera glycines]
  Gene Ontology: Cellular component=secretory vesicle
  Coding regions on vcDNA: vcDNA=SeqID_90189; Strand=+; Position=1-657
PGPSTETPGPPGPSTQTPGPESSTSTPSEGPGTPSTETPGPSTEAPGPPGPSTETPGPSGPSTETPGPSGPSTETPGPPGPSTAGTSSTKTYTVPTTPKPPPCCYGCDYPVDCHTSGKDCDYSPLQPPYQSDPYPVGKCVFKNVTCAAPNTGKVLFMKLNNDPNSVVSSSVSPFNKVTVILQCTCKPYFAPYWVQVGVDGNPAKQVNVKSATCGRHCY

SEQ ID NO: 163767 - protein, 135 aa, Heterodera glycines
  Homolog annotation: Hit_ID=AAF68270.1; Match level="QueryCoverage =85%, HitCoverage=80%, E-value=5e-18, Identity=38%"; Hit description =ornithine decarboxylase antizyme [Onchocerca volvulus] sp|Q9NHZ5|OAZ_ ONCVO Ornithine decarboxylase antizym
  Coding regions on vcDNA: vcDNA=SeqID_90190; Strand=+; Position=73-480
ISRLVIPVVRIARASRGAPDIPNSENIDRDAVAGLVKSVAEGWCCHLAEKNTLALFIPSKLFSSTLSRENFVDLLEYCEEHLKVRRILACFNKSDINPCQGIPRALRCIGFTLLPPERYPAGIDKNTIFAMVYKI

SEQ ID NO: 163768 - protein, 189 aa, Heterodera glycines
  misc_feature (90)..(90): Xaa can be any naturally occurring amino acid
  misc_feature (150)..(150): Xaa can be any naturally occurring amino acid
  Homolog annotation: Hit_ID=NP_497426.1; Match level="QueryCoverage =74%, HitCoverage=96%, E-value=5e-45, Identity=61%"; Hit description =predicted CDS, putative cytoplasmic protein (3C697) [Caenorhabditis elegans] gb|AAK84595.1| Hypothetical
  Coding regions on vcDNA: vcDNA=SeqID_90191; Strand=+; Position=3-572
SSSSPFPNCRCFLILFSVCCCCSLFCPFSNGENVYCTYYRDSNEITCGTVTCETHSPFTPDNSELDGLDTKLPRGWYRIGTLSIRHDRAXFNLYRRRATGLGYWDFYTQIPERNCIGQFGLHAGENIAGSVAVKDKRCFDRLVVQIGAQXRPTEKFDVLQCRKRVFNSCWLGSHTLHDQHTYLTNLQSY

SEQ ID NO: 163769 - protein, 219 aa, Heterodera glycines
  Coding regions on vcDNA: vcDNA=SeqID_90192; Strand=+; Position=1-657
EILQMHFCARQLFIPNVSAIPLANAFRSVHRISFCLPSLFGKTPNRPTHFLSGMPLSSDSKNVRLVEESAQPMEWTADELALKEKATAENAWTPIYRYRGFVGVWFILRFNLVFLIFSLASLPLSISQHIPISPSIGLILFSSLVFAGIKKYFTRIVAVISVDTASRSIYRIGYPSVFATRRSRFARFLDVQPLSTNSDSVRGVARLRFTDGAKDDFLL

SEQ ID NO: 163770 - protein, 170 aa, Heterodera glycines
  Homolog annotation: Hit_ID=EAK82881.1; Match level="QueryCoverage =100%, HitCoverage=53%, E-value=3e-39, Identity=48%"; Hit description= hypothetical protein UM05090.1 [Ustilago maydis 521] ref|XP_402705.1| hypothetical protein UM05090.1 [Ust
  Gene Ontology: Mol. function=hydrogen-transporting ATP synthase activity, rotational mechanism; Cellular component=proton -transporting ATP synthase complex (sensu Eukarya); Biological process=ATP synthesis coupled proton transport
  Coding regions on vcDNA: vcDNA=SeqID_90193; Strand=+; Position=2-514
ALVVLGDKCRNQLAREYRDAIKLTYSQLGKTVPSFLEASIIADEILAIKDLPANPKINVVYNKFLSVIAYEPTHMHTISYADLKAAPKLATYEMEGDILSNLHQFMFATSVHWAMNEGHAAEFAARRSAMDNATKNAGEMVDRLTLLYNRQRQASITNDLVDIITGASAL

SEQ ID NO: 163771 - protein, 146 aa, Heterodera glycines
  Homolog annotation: Hit_ID=NP_508390.1; Match level="QueryCoverage =78%, HitCoverage=33%, E-value=2e-36, Identity=63%"; Hit description =dTDP-glucose (XC730) [Caenorhabditis elegans] gb|AAB52650.1| Hypothetical protein F53B1.4 [Caenorhabditis
  Coding regions on vcDNA: vcDNA=SeqID_90194; Strand=+; Position=434-871
MSDETILNATDSDWPFSKSETRNSTVAVLPQKVLVTGGCGFIGSNFINYIFEKWPKASFVNLDKLAFGASPDHIIDDISFSPRYVFVHGSLLDENLVKTVLNEHRIDTVIHFAAITHVDESYTDRIGTIQENVIATTTLLEAINFY

SEQ ID NO: 163772 - protein, 126 aa, Heterodera glycines; identical to SEQ ID NO: 160953
  Coding regions on vcDNA: vcDNA=SeqID_90195; Strand=+; Position=48-428

SEQ ID NO: 163773 - protein, 88 aa, Heterodera glycines
  Homolog annotation: Hit_ID=EAL21618.1; Match level="QueryCoverage =100%, HitCoverage=96%, E-value=4e-36, Identity=78%"; Hit description= hypothetical protein CNBC6540 [Cryptococcus neoformans var. neoformans B-3501A]
  Coding regions on vcDNA: vcDNA=SeqID_90196; Strand=+; Position=21-287
MTKGTPSFGKRHTKAHTLCKRCGRRAFHNQKKTCAQCGYPSAKLRSFNWSEKAKRRKTTGTGRMRHLKNVNRRFGNGFRSGTPKAASA

SEQ ID NO: 163774 - protein, 205 aa, Heterodera glycines
  Homolog annotation: Hit_ID=AAH78046.1; Match level="QueryCoverage =87%, HitCoverage=51%, E-value=1e-43, Identity=47%"; Hit description =MGC82811 protein [Xenopus laevis]
  Gene Ontology: Mol. function=endopeptidase Clp activity; Cellular component=extracellular space; Biological process=protein folding
  Coding regions on vcDNA: vcDNA=SeqID_90197; Strand=+; Position=22-636
MGPFSLFPFVSLFLSAVLFVPSAVSELVSLTVGVSAFSALGLFIGDFGGLYTLTKCKFYECCDAPWINRDIAMRLEPDVDERLYGQHIAQNTVVRALKAHLAKSNPNKALVMSFHGWTGSGKNYLAKMIAKAIYKKEMRSQFVHQFVATHHFPNADEVDKYKGQLRTWIRTNLTNCERSLFIFDEMDKMPMQVLDAIVPFIDFYD

SEQ ID NO: 163775 - protein, 75 aa, Heterodera glycines
  Coding regions on vcDNA: vcDNA=SeqID_90198; Strand=+; Position=34-261
NQKMKSLTQITSIILPMCFLLLLLSPPNAIGQNLCQWEGKCVDYGCPTACTSECVCASLEKFVNASNLAPGKQTD

SEQ ID NO: 163776 - protein, 243 aa, Heterodera glycines
  Homolog annotation: Hit_ID=NP_498122.2; Match level="QueryCoverage =99%, HitCoverage=58%, E-value=1e-53, Identity=44%"; Hit description =abnormal GROwth rate GRO-1, tRNA isopentenyl transferase, metabolic activity and lifespan regulator (49.5
  Gene Ontology: Mol. function=tRNA isopentenyltransferase activity; Cellular component=mitochondrion; Biological process=tRNA processing
  Coding regions on vcDNA: vcDNA=SeqID_90199; Strand=+; Position=23-751
MLTSKFSERIKSLQPLFIICGCTGTGKSDLGIELAKHFNGEVINADSMQIYKGLDIATNKVTTEEMQGVTHHLMSFCDPCESNYNVHHYRNAVLPLIERLWANGKLPIIVGGTGYYMEAAIYYDNLVQTNAQKSDDLRNELLQKFPTCDLLHEELKRVDPISAGEVHKNAKFKVLRALEIFYSTGQTKSEHHKMQREGQAANFHLAGRLHTKSTLLFTLDADKEVLSQRLNSRVDDMLKRGLI

SEQ ID NO: 163777 - protein, 212 aa, Heterodera glycines
  Homolog annotation: Hit_ID=CAG07650.1; Match level="QueryCoverage =96%, HitCoverage=88%, E-value=1e-25, Identity=33%"; Hit description =unnamed protein product [Tetraodon nigroviridis]
  Coding regions on vcDNA: vcDNA=SeqID_90200; Strand=+; Position=43-678
MMSSSSFEQLSCEIAELEKLRQQSQLPNVQKAIDELIGRWKVKKEEQKMKTDKGTAETLSAPTEAPKLISGSVHVRPTKKLTTYAFDESDKFVKLYYSLPGISDSVPGTISTDFRENSFSIVCSDVKGIDYEIRVQGLCQAVEPEKCVVKQKSGDQLLIMLKKAKERQNWGSLLKLEKEVGKSKAKTMDKESDPQEGLMNMMKQMYDDGDDE

SEQ ID NO: 163778 - protein, 270 aa, Heterodera glycines
  Coding regions on vcDNA: vcDNA=SeqID_90201; Strand=+; Position=1-813
RKYFFKTYFYFILTIFSSMSTNRGRGRVSLPSGDHSQTSEYGGRGRGMYSFHQQDVKESSQIAGRGRGTTLQQKTEHGGGYSMGMQQQQEISPMRGPRGGRGHDVSGHGLDRHPVAPTMPSPVPFGGVSAVQPTSGRGQLPSMSRYGAYAAFTKQRDQMDQQKAVLEEVATRLEEHKGDETSVESQAEEVTSTTLQRGLLQHEVGGMEAQQMVVGEQAQCPSAEGVPHAFLCAGCQFRADCANLLRAIGALLKDFGSAASVDGGRNNGTT

SEQ ID NO: 163779 - protein, 187 aa, Heterodera glycines
  Homolog annotation: Hit_ID=NP_699909.1; Match level="QueryCoverage =98%, HitCoverage=40%, E-value=3e-36, Identity=41%"; Hit description =glutamine synthetase family protein [Brucella suis 1330] gb|AAN33914.1| glutamine synthetase family prote
  Coding regions on vcDNA: vcDNA=SeqID_90202; Strand=+; Position=66-626
MTLTMDELRNKVQNGQISTVVVGSVDLHGRLIGKRLTARHFVEMAQKKDKMSMCYYFLAMTIEGHVAEGFEVARWENGFGNGLLQLDFGTLCRTPWMEKTALIMADMHDHRDLPFFCAPRTILRRQLQKLSEKGFRAKFASELEFHLFSESQKSAREKQWRNLGTAQPHHRCMHLVGSSGDEPFMRR

SEQ ID NO: 163780 - protein, 161 aa, Heterodera glycines
  Coding regions on vcDNA: vcDNA=SeqID_90203; Strand=-; Position=7-492
PVVGGAVPPLPTAVSVVVLWCAVIITAAFRRPLTNGMYAVARTAFRKYSIASANWWPKARSACTVVVSLNSFRPMPWADVPLCSADNDATPSAVPSALLLGVSGSKRRNGLSKGERISGGPHSEWEEKSEEQTMPFTIRLPAVLVEQNAAIIVKSAEIQTA

SEQ ID NO: 163781 - protein, 148 aa, Heterodera glycines
  Homolog annotation: Hit_ID=CAE72023.1; Match level="QueryCoverage =70%, HitCoverage=73%, E-value=3e-16, Identity=38%"; Hit description =Hypothetical protein CBG19105 [Caenorhabditis briggsae]
  Coding regions on vcDNA: vcDNA=SeqID_90204; Strand=+; Position=38-484
MSTNDVKEAAASTVLPPSSSQSISMASSADGSPLREENFVHSLKSQVDGENIEEIIQSQKKALERFEKTNEMLATCSSLAEKRLDRARKDFAIGREKICRAKSDLDSIFRRIASFKQTLASNYPAEFVAAQTDSPHNQNSDCINEPNG

SEQ ID NO: 163782 - protein, 165 aa, Heterodera glycines
  Homolog annotation: Hit_ID=NP_741446.1; Match level="QueryCoverage =84%, HitCoverage=93%, E-value=4e-44, Identity=62%"; Hit description =serine/aRginine rich pre-mRNA SPlicing factor, Serpin (20.5 kD) (rsp- 6) [Caenorhabditis elegans] gb|AAA82
  Gene Ontology: Mol. function=pre-mRNA splicing factor activity; Cellular component=nucleus; Biological process=spliceosome assembly
  Coding regions on vcDNA: vcDNA=SeqID_90205; Strand=+; Position=106-600
MSSRRNEYLDAKVLGFSTIIFRKTVKIYVGGLPEDATSEELDDAFHRFGRIRKIWVARRPPGFAFVEFEDARDAEDAVRALDGTRICGVKARVELSHGSGRGGGRGFRGGGGRYDDRYGRDRYDRDRDRRYRSRSRSRTPRRSRSRSPPLRERSRSPSYSRRSRS

SEQ ID NO: 163783 - protein, 82 aa, Heterodera glycines
  Homolog annotation: Hit_ID=NP_501187.1; Match level="QueryCoverage =100%, HitCoverage=97%, E-value=4e-37, Identity=76%"; Hit description= cysteine-rich protein 1 (4I208) [Caenorhabditis elegans] gb|AAK18878.1| Hypothetical protein B0496.7 [Ca
  Gene Ontology: Cellular component=nucleus; Biological process =myogenesis
  Coding regions on vcDNA: vcDNA=SeqID_90206; Strand=+; Position=91-339
MPLCPKCQRPVYFAERVTSIGKDWHRPCLQCHNSACKKTLTVGKHCEHDGKPYCERCYGALFGPRGYGHGGVESHVFLDGTT

SEQ ID NO: 163784 - protein, 206 aa, Heterodera glycines
  Homolog annotation: Hit_ID=AAC06296.1; Match level="QueryCoverage =65%, HitCoverage=62%, E-value=5e-58, Identity=83%"; Hit description =GTP-cyclohydrolase [Ostertagia ostertagi] sp|O61573|GCH1_OSTOS GTP cyclohydrolase I (GTP-CH-I)
  Gene Ontology: Mol. function=GTP cyclohydrolase I activity; Cellular component=cytoplasm; Biological process=neurotransmitter metabolism
  Coding regions on vcDNA: vcDNA=SeqID_90207; Strand=-; Position=1-618
MSKSSTSNTSYSSSSSSSGFLEAISGEENEQKLKKGEEETLATAAKPIDKVSRLLPPSPTAVPMAGLGEHPQLDNMVKAYESIISHVGEDVQRQGLLKTPVRAAKAMLYFTKGYDENFDDVLNEAVFDEDTDEMVIVRDIEMFSLCEHHLVPFLGKVHIGYLPNKKVLGLSKLARIVEMFSRRLPVQERLTKQIASAILQAVHPTG

SEQ ID NO: 163785 - protein, 163 aa, Heterodera glycines
  misc_feature (43)..(43): Xaa can be any naturally occurring amino acid
  Homolog annotation: Hit_ID=NP_496216.1; Match level="QueryCoverage =87%, HitCoverage=89%, E-value=6e-26, Identity=41%"; Hit description =surfeit 5 (18.1 kD) (2K591) [Caenorhabditis elegans] emb|CAA88887.1| Hypothetical protein ZK970.3 [Caenor
  Coding regions on vcDNA: vcDNA=SeqID_90208; Strand=+; Position=30-519
MAARSNTNKETLKNHSNIDKTIATKKLVVQDYKNRLKDRIKSXLNDNFECILGASKVNCDDATHRSNSAGKLGEHYAIRNEAIARAALLVKATNELKMLTNEIREFLTIRDFNFISNSISKAEEDFKKRLKQYENDYSALRMSISTMASEIDRELVENSLYRF

SEQ ID NO: 163786 - protein, 162 aa, Heterodera glycines
  Homolog annotation: Hit_ID=CAE67008.1; Match level="QueryCoverage =81%, HitCoverage=5%, E-value=4e-26, Identity=43%"; Hit description =Hypothetical protein CBG12408 [Caenorhabditis briggsae]
  Gene Ontology: Cellular component=mitochondrion; Biological process =polar body extrusion after meiotic divisions
  Coding regions on vcDNA: vcDNA=SeqID_90209; Strand=+; Position=160-645
MCKKTKSEPCCKKLSSCFSEEMKGSQMFRQVVELRNDIATNGCIAGGVECCDLTAHTVQRRPQTTGQLFLEKLYFVKHVDNNSLADSPREREILAEYRNLLYSIILNGLRQWSKSGVLAQITNGEQFEHALKLLEGKEGIPTVADEERKRKFLDDSKCSLVN

SEQ ID NO: 163787 - protein, 278 aa, Heterodera glycines
  Homolog annotation: Hit_ID=AAA20541.1; Match level="QueryCoverage =98%, HitCoverage=97%, E-value=1e-141, Identity=84%"; Hit description= beta-galactoside-binding lectin
  Gene Ontology: Mol. function=lectin; Cellular component=plasma membrane; Biological process=cell adhesion
  Coding regions on vcDNA: vcDNA=SeqID_90210; Strand=+; Position=61-897
MAAESQYPIPYRSKLTEPFEPGQTLIVKGKTAEDSVRFTINLHHTSADFSGNDVPLHISVRFDEGKIVFNTFSKGEWGKEERKSNPYKKGDDIDLRIRAHDSKFTVYADQKELKEFEHRVPLSHVTHFSIDGDVLITQIHWGGKYYPVPYESGITGDGFAPGKTLLIFGTPEKKGKRFHINLLKKNGDIALHLNPRFDEKAIIRNSLIANEWGNEEREGKIPLEKGIGFDLKVINEEYAFQIFINDERYCTYAHRVEPHDLHGLQIGGDVEITGIQIF

SEQ ID NO: 163788 - protein, 206 aa, Heterodera glycines
  Homolog annotation: Hit_ID=CAF90384.1; Match level="QueryCoverage =75%, HitCoverage=88%, E-value=8e-16, Identity=35%"; Hit description =unnamed protein product [Tetraodon nigroviridis]
  Gene Ontology: Mol. function=lamin/chromatin binding; Cellular component=nuclear heterochromatin
  Coding regions on vcDNA: vcDNA=SeqID_90211; Strand=+; Position=52-669
MSAANDVAATANDPSTVVCEEKKSSAAEEELIDVVTVGENNPTGSAGTKTGESDEVFVVEQIKNKRSVNGTDEYLIKWKGYDDEQDDTWEPLENLHCPELLKEFETNYCPAKTKRRKKSSGKVAKKRKISSDSTLPTIPLVLKDRYHIGEDGAVPEHIIGVMKHEESGKMMALLTYTDHREATEFVPTEILLENKLTAKMILNFYQ

SEQ ID NO: 163789 - protein, 438 aa, Heterodera glycines
  Homolog annotation: Hit_ID=CAE62915.1; Match level="QueryCoverage =99%, HitCoverage=44%, E-value=2e-38, Identity=27%"; Hit description =Hypothetical protein CBG07108 [Caenorhabditis briggsae]
  Coding regions on vcDNA: vcDNA=SeqID_90212; Strand=+; Position=3-1316
LFKSLGKSLHRVNGYISNKSGFVDAWKLAKETLELWTEIQSSTLRNLNDLLKEVARYQEELARMRKRAKDADTLETINLMLTTTTCLQKARDTFNQRSTEVVSLKQSNKEWTAASTKEYLRARNKLNKAHEEYKQYMDKYSQIRDTFEERVNQAARSFQEHDRLHLLQMKSFFTQMAKCLENAHGANAQVSATLRQRVEQNINVEQMMFRFIEEKGTGTEPPQKLQWTNADELPPELDVVSCVQSQSSSSNSSAIVPNFSGNQLQSNANHLLGLNDSWLTVGGGKSIAAGGGESANSGGSIDGGFGESMCSLGVKRGSINGCSEQNKSAGESDSERHLELPFSANPSSSVLSNFSAQNPSSSYVPQQISSWLGRQKFSGRLKKHFSTSQSNLAGPMAIEPFAVGESDQQTKDELIGSASNFSKSCNDPSIKTNSSAGL

SEQ ID NO: 163790 - protein, 133 aa, Heterodera glycines
  Coding regions on vcDNA: vcDNA=SeqID_90213; Strand=+; Position=3-404
CVKKIEFPDEPVFFCSDRLARYEQSMLIETGHVYAQAARDNALAARNNSVTAQESARAVRDITDLMVKQLESKDRQIVDKDFQLAQKDVLLEEKDRLLRQKDEMIARLQGYINGLGVPLPAPAEQQQQGGGGQ

SEQ ID NO: 163791 - protein, 214 aa, Heterodera glycines
  Homolog annotation: Hit_ID=NP_741220.1; Match level="QueryCoverage =80%, HitCoverage=25%, E-value=2e-41, Identity=57%"; Hit description =heat shock protein 75 (3I314) [Caenorhabditis elegans] gb|AAK29856.2| Hypothetical protein R151.7a [Caeno
  Gene Ontology: Mol. function=tumor necrosis factor receptor binding; Cellular component=extracellular space
  Coding regions on vcDNA: vcDNA=SeqID_90214; Strand=+; Position=11-652
MRFAIAPSLCRRVLCRHCWPRLHFGRLLSSSASVPWHCPQSVTATTSTNSFRTCRYSSQAAAVAPENYEFQAEIDSLLGIVAKSLYSDQEVFIRELISNASDALEKRRCSELQGDAAEEMATLELRIEVDEKGKKLTFVDTGIGMSREELVNLLGTIAKSGSKAFRADEKNAAAAEAIIGQFGVGFYSAFVVSEKVSVTTRKLGEVMGHIWSWK

SEQ ID NO: 163792 - protein, 281 aa, Heterodera glycines
  Homolog annotation: Hit_ID=NP_388707.1; Match level="QueryCoverage =83%, HitCoverage=48%, E-value=2e-38, Identity=36%"; Hit description =hypothetical protein BSU08260 [Bacillus subtilis subsp. subtilis str. 168] emb|CAB12655.1| yfiG [Bacillus
  Gene Ontology: Mol. function=permease activity; Cellular component =cytoplasm; Biological process=acrosome formation
  Coding regions on vcDNA: vcDNA=SeqID_90215; Strand=+; Position=14-856
MSSGTVSPLRDVPLRLSDKPSLPFPSPRRLTNDCPSSPSPAPITLYLRLVSWVCSMGGLLFGYASSSINDLLPFIVREMRLGPAEVGVVISCFMVGAGIGGFVGGRLADRIGRKRSLVLFDALFIVFSVCTSLAPTFTFLVIARMFYGFTCGGISSSAPVLLAEISTIEFRSQSVSMSLLFIVFGELCVFIIGAVFGNIWYETVSIWRWINIAVVIPAVALLFCHAFLVPESPRWLAQNGQLQKCLDTLRRMRSDSLQTQKEFREIQQVVNGNSGRDNFGD

SEQ ID NO: 163793 - protein, 233 aa, Heterodera glycines
  Homolog annotation: Hit_ID=NP_506245.1; Match level="QueryCoverage =93%, HitCoverage=91%, E-value=4e-30, Identity=36%"; Hit description =signal recognition particle receptor (5N446) [Caenorhabditis elegans] emb|CAB01443.1| Hypothetical protei
  Gene Ontology: Mol. function=signal recognition particle binding; Cellular component=integral to endoplasmic reticulum membrane; Biological process=protein-ER targeting
  Coding regions on vcDNA: vcDNA=SeqID_90216; Strand=+; Position=3-701
FLSSQLVAADHHPLILPALITFVILLVSSVFFFIYRRFRQKPNIILFVGLSGSGKTTLFTKLINSKNCWDSFISLKENQFDSYATDNGQTLTLLDFPGSDSFKKTLCRKWLNEKRNSLKGVVFVLDSATFNKKDAAELLYDVLFESGNAVPVLIACNKQDIGHAKSHSLIKKALENEFGLINVSREAALSSISGESEKRILTKSGKEFAWSELKNKKIDCLECTTPKDENLSL

SEQ ID NO: 163794 - protein, 197 aa, Heterodera glycines
  misc_feature (167)..(167): Xaa can be any naturally occurring amino acid
  Homolog annotation: Hit_ID=NP_505573.1; Match level="QueryCoverage =63%, HitCoverage=26%, E-value=3e-26, Identity=47%"; Hit description =ectonucleoside triphosphate diphosphohydrolase precursor (53.8 kD) (5K487) [Caenorhabditis elegans] emb|C
  Gene Ontology: Mol. function=uridine diphosphatase activity; Cellular component=membrane; Biological process=protein amino acid glycosylation
  Coding regions on vcDNA: vcDNA=SeqID_90217; Strand=+; Position=30-620
MRIWPSPFVPPSLPFALLLPFCFCVALLLRFGAGRDDAAVGELQHNRLHPPDTKEIQQCLSPDLEAEESTSGRFFAAVIDAGSTGTRLHLFEFSHELEQEPSAFKLEAEIYKEIKPGVSCFAKTPELAAENVRELLLTAKRQIPAELWAKTPIAFRATAGVRLLSEXEADAILSEIESEVLSRGLLVDDDAVGVLSG

SEQ ID NO: 163795 - protein, 296 aa, Heterodera glycines
  Homolog annotation: Hit_ID=CAE71918.1; Match level="QueryCoverage =98%, HitCoverage=98%, E-value=2e-91, Identity=53%"; Hit description =Hypothetical protein CBG18981 [Caenorhabditis briggsae]
  Gene Ontology: Mol. function=palmitoyl-protein hydrolase activity; Cellular component=extracellular space; Biological process =neurogenesis
  Coding regions on vcDNA: vcDNA=SeqID_90218; Strand=+; Position=34-921
MTFAFAVLLLLFIPPLTLAKNARAEGPVPVVLWHGMGDSCCNPYSMGFIRKLILTNMPHAYVLSLQLGSSVAEDIGRGYFANMNDEVAAVCQQLAEDARLANGYNAIGFSQGALFVRALAQRCPHPPIRNLISIGGPQQGIFGLPFCPGSFYVCSLIRRLLDNGAYTEFAQHNLVQAQYWHDPNLAEGYRRANIFLAHGNCERSCDSTYRDNMGKLRNFVLVGFSNDHKLVPKETAWFGFYADNDTQTIVPMEQTELYKQDRIGLKTLNESNRLHFLTFNGEHLQIPHDLFISEIV

SEQ ID NO: 163796 - protein, 148 aa, Heterodera glycines
  Homolog annotation: Hit_ID=AAT92164.1; Match level="QueryCoverage =97%, HitCoverage=97%, E-value=8e-64, Identity=77%"; Hit description =ribosomal protein S15 [Ixodes pacificus]
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_90219; Strand=+; Position=3-449
RLFNMADNAPKKRTFRKFTYRGVDLEDLMDLTSEQLVELVHCRARRRFQRGLKRKPLTLIKKLRKARKECPENEKPAVVKTHLRNMIIVPEMIGSVVGVYNGKTFNQVEVRPEMVGHYLGEFSITYKPVKHGRPGIGATNSSRFVPLK

SEQ ID NO: 163797 - protein, 127 aa, Heterodera glycines
  Homolog annotation: Hit_ID=CAE67931.1; Match level="QueryCoverage =100%, HitCoverage=89%, E-value=5e-60, Identity=84%"; Hit description= Hypothetical protein CBG13531 [Caenorhabditis briggsae]
  Gene Ontology: Mol. function=pre-mRNA splicing factor activity; Cellular component=small nuclear ribonucleoprotein complex; Biological process=cell cycle
  Coding regions on vcDNA: vcDNA=SeqID_90220; Strand=+; Position=3-386
QAILAEEDRVVLIRFGHDWDPSCMRMDETLYKITNKAKNFADIYLDDISEVPDFNKMYELYDPVTAMFFFTNKHIMIDLGTGNNNKINWPMHDGQELIDIIETVYRGARKGRGLVISPKDYSTKYKY

SEQ ID NO: 163798 - protein, 177 aa, Heterodera glycines
  Homolog annotation: Hit_ID=NP_727486.1; Match level="QueryCoverage =98%, HitCoverage=43%, E-value=4e-42, Identity=46%"; Hit description =CG2061-PC, isoform C [Drosophila melanogaster] ref|NP_727485.1| CG2061-PB, isoform B [Drosophila melanoga
  Coding regions on vcDNA: vcDNA=SeqID_90221; Strand=+; Position=1-534
LNGRAGFLASLLELRLLFGQQLLSDDEIRSVLDAMVSSGRKYSKKHKSPAQLMFEWYNTEYLGAAHGVSGIYQMMLSFWDLLDASAKSDLKQSVDWLLSTQFSDGNFPSSSDRIGLSEELVHWCHGASGVLHLLIVASLEFKEDKYLESAERCVNLIWARGILRKGPGICHGVAGEL

SEQ ID NO: 163799 - protein, 293 aa, Heterodera glycines
  Homolog annotation: Hit_ID=NP_871881.1; Match level="QueryCoverage =80%, HitCoverage=84%, E-value=3e-20, Identity=25%"; Hit description =putative protein of bilaterial origin (33.1 kD) (1I415) [Caenorhabditis elegans] emb|CAD56580.1| Hypothet
  Coding regions on vcDNA: vcDNA=SeqID_90222; Strand=+; Position=47-925
MSLLPISRCSSLFHAARSLACRRPPPLASCHCLLSVPSTAPFSSHLSSSSPVVLHSLTTPVTSTHWCHRRAFASQSTPSAPAPNSTNNTPAAAGRGGIGLYHRYKQWLQNYPALYKLHRLTVDGSKWCYSDLKTFFWLAYGLRKGRITLNDLNARELFIYIQAGSQLVKLSLLAALAVLPAGFPLIIISMLVSPKLVLTRHFWTDWQSQQFQMDDLRRNERKLFPRIVDALRQHNPSSAAALAALEQQLPLTVDQLVTLQKSANIVPASLDAYTQQHRFFLKRVHNLPFWTTD

SEQ ID NO: 163800 - protein, 245 aa, Heterodera glycines
  Homolog annotation: Hit_ID=NP_490882.2; Match level="QueryCoverage =95%, HitCoverage=72%, E-value=4e-88, Identity=64%"; Hit description =ubiquitin conjugating enzyme (ubc-3) [Caenorhabditis elegans] gb|AAK73914.2| Ubiquitin conjugating enzyme
  Gene Ontology: Mol. function=ubiquitin-protein ligase activity; Cellular component=chromatin; Biological process=DNA replication initiation
  Coding regions on vcDNA: vcDNA=SeqID_90223; Strand=+; Position=110-847
MSSSSGHPQTSSASAIRALQMELRSLQSQPLEGFTVTCDDDNMFKWTVGIFGPPGTLYQGGYFKAHLKFPTNYPYSPPTMRFIHPVWHPNVYENGDICISILHPPVDDPHSGEMPSERWNPTQSVRTVLLSVISLLNEPNTSSPANVDASVMYRKYKDHGDQEYATIIRKQVEKSKEEAKKDGIKVPETIDEYVVKAKPRVQGNESNDVIELDEDYYDYEDDDTDEDAEYGGEEEQDSGQGDDES

SEQ ID NO: 163801 - protein, 138 aa, Heterodera glycines
  Coding regions on vcDNA: vcDNA=SeqID_90224; Strand=+; Position=10-426
MAQNFRLFCHQTPPSVNSDGSEAKRRQINEPPKEGSGGAPSLSVDPFGWEPTKWERFFLVLTRCYERSADIPAIIPLRVGKQYTKRMRLLRFSFALLVAIIVCFGAEFYMASWDRRMRRGQLSDGDVKFLEKMRDKVR

SEQ ID NO: 163802 - protein, 217 aa, Heterodera glycines
  Homolog annotation: Hit_ID=AAH83453.1; Match level="QueryCoverage =94%, HitCoverage=92%, E-value=3e-49, Identity=50%"; Hit description =Zgc:103648 [Danio rerio] ref|NP_001005950.1| zgc:103648 [Danio rerio]
  Gene Ontology: Mol. function=thiol-disulfide exchange intermediate activity; Cellular component=intracellular; Biological process =response to oxidative stress
  Coding regions on vcDNA: vcDNA=SeqID_90225; Strand=+; Position=1-651
MLKVIGNKNQFEAFVSSTEGESKRSLFVHFSAPWASSCAQLDDLLMELQREYGQNAFDIAKVDAESLPEVSMAQKVCAVPSVIIFKGGKVAGRVEGFQPAELKDWAAKCSLDSFSAGESDAPSGAAICEDPNSRLKRLINTARLTLFMKGTPEGPKCGFSRQIVDLLRSHNVDFWTFDILADEQVRQGLKSYSDWPTYPQVYLDGELLGGLDVIREE

SEQ ID NO: 163803 - protein, 339 aa, Heterodera glycines
  Homolog annotation: Hit_ID=CAE71758.1; Match level="QueryCoverage =99%, HitCoverage=76%, E-value=3e-81, Identity=44%"; Hit description =Hypothetical protein CBG18748 [Caenorhabditis briggsae]
  Gene Ontology: Cellular component=mitochondrion; Biological process =sulfur metabolism
  Coding regions on vcDNA: vcDNA=SeqID_90226; Strand=+; Position=127 -1143
DHFRLVVVGGGTAGCAVVSKFARILPKQQIAVIEHQNIHYYQPGLTLAAAGLMDFEQLHRDESSILPHGVKWFQKPVHRLHPDSNELFLKNGQAISYDFLVLATGLELRFDLIEGLPSGTESVLLSPSISSIYFPDGAKKTLEELKNFSTGEAVFTFPSTHIKCAGAPLKICFLAEEILRRKGVRSNCSVHYYTALGRIFGVPKYAASLERIVKERGVEFHPRHNLVKVNPEKHEAEFELLDEKGKGTGQRQIVEYSFLHIGPPCSPVKVLREYAKESRNNSNGTQLTDPEGWVNVDPGTLQSPAFQNIFAIGDCANTPNSKTAAAVSSQFKALSKNLK

SEQ ID NO: 163804 - protein, 315 aa, Heterodera glycines
  Homolog annotation: Hit_ID=O02623; Match level="QueryCoverage=93%, HitCoverage=68%, E-value=6e-80, Identity=53%"; Hit description =[Pyruvate dehydrogenase [lipoamide]] kinase, mitochondrial precursor (Pyruvate dehydrogenase kinase) gb|AAB525
  Gene Ontology: Mol. function=pyruvate dehydrogenase (lipoamide) kinase activity; Cellular component=mitochondrion; Biological process=glucose metabolism
  Coding regions on vcDNA: vcDNA=SeqID_90227; Strand=+; Position=19-963
MRLSLSRFASTVAMFAGGPIERPLAYYSQFRPASLTMHQYLDFGRKGSAFTSYHFLKTELLVRMANIMQEFDLLPAKLMQTPSARHVGSWYKQSFSELLHFEGLEPSDMALDKFNNQLRTILHRHNTVVETMAEALLELKESHGVDIACERNIQYFLDRLYLNRISIRMLQNQHLAIFAAACDTNGTNNQSRKTVVVDPAGHVGHIDPQCNVRDILLDAYENARFLSEQHFCVSPMLDLRCFNTRIPDQQISVPLVPLHLYYIVFELLKNSMRATIEHHHRVKGFDADSSDDLAEVRACIVLGAENLSIKISDRG

SEQ ID NO: 163805 - protein, 139 aa, Heterodera glycines
  Coding regions on vcDNA: vcDNA=SeqID_90228; Strand=+; Position=28-447
KMAIIAKVFLLLLLFLMSMASLLFCANWPKNTVPLETYVDESLHLHCKLCNKIANSASDGAKWLQKSEEGYVSLLKFCIDELRNSDKRSQTLPAEEGHHQFLFACHGFTADKRKLSETIGAIAKKEADFCKEQKYCQMF

SEQ ID NO: 163806 - protein, 130 aa, Heterodera glycines
  Homolog annotation: Hit_ID=NP_502336.1; Match level="QueryCoverage =87%, HitCoverage=93%, E-value=7e-12, Identity=33%"; Hit description =putative membrane protein (13.8 kD) (4N46) [Caenorhabditis elegans] gb|AAB97553.1| Hypothetical protein C
  Coding regions on vcDNA: vcDNA=SeqID_90229; Strand=+; Position=5-397
MSKTGLSAAIDDEFDPDIDLSQRSRSDWVGSFAGNPSTAPTVYAMFNNSVWTFMLVYGVTGRFISASVVSLLTMPATAALWVWEADRDYERWEGSRVLRERRVPKFVLPRTIFDWSDFDYAQQMRKAPTG

SEQ ID NO: 163807 - protein, 172 aa, Heterodera glycines
  Homolog annotation: Hit_ID=NP_492569.2; Match level="QueryCoverage =96%, HitCoverage=26%, E-value=8e-40, Identity=49%"; Hit description =mRNA Capping Enzyme Like, ELAV-like, phosphatase/guanylyltransferase (70.8 kD) (cel-1) [Caenorhabditis el
  Gene Ontology: Mol. function=protein tyrosine phosphatase activity; Cellular component=nucleus; Biological process=RNA processing
  Coding regions on vcDNA: vcDNA=SeqID_90230; Strand=+; Position=1-519
VAQRFLPMKTPLDSSYDHLIESPKYFFHPSSVFRSPLLGATKGAKIGLWVDLTNSDNFYNEEEVLNNGSKFLKMKMVGHKQTPTPEQTTAFIEAIDRFITNNPDDVIVVHCTHGFNRTGFLISAYLYEKCDMSIEMAVREFAECRPNGIYKQYYLDDLRKRYGDEDEDEMTV

SEQ ID NO: 163808 - protein, 148 aa, Heterodera glycines
  Homolog annotation: Hit_ID=NP_501211.1; Match level="QueryCoverage =94%, HitCoverage=49%, E-value=4e-32, Identity=47%"; Hit description =voltage-dependent anion channel 2 (30.0 kD) (4I272) [Caenorhabditis elegans] gb|AAB00622.2| Hypothetical
  Gene Ontology: Mol. function=voltage-dependent anion channel porin activity; Cellular component=integral to plasma membrane; Biological process=adenine transport
  Coding regions on vcDNA: vcDNA=SeqID_90231; Strand=+; Position=53-496
MAPPKFSDLGKSAKDLFSKGYAHGFMKLDVTSDVAPTVQFKTSAAHDLNSQKLDGNLEVKYKILEHGLTITEKWKTDNQLTNVLELKDKVLRGLKLTVETAFKPHVEGSRHAIAKADWANDAFHVNGDLTLFGGPLFTGSFGAKMSND

SEQ ID NO: 163809 - protein, 139 aa, Heterodera glycines
  Coding regions on vcDNA: vcDNA=SeqID_90232; Strand=+; Position=69-488
PKGPMCFSFTNYCLIMVKKKCLLSTKCVKMPSNYMRNQTNDTGKDEASIAADTGAGKKKLPDAEQKQTTDTKERKSPIMVDKGVQVIPERTIFPSPSFSSSFRTQLPASPILRTAKKEQTSSLVLPLRDASNHEKLSFD

SEQ ID NO: 163810 - protein, 210 aa, Heterodera glycines
  Homolog annotation: Hit_ID=AAQ96373.1; Match level="QueryCoverage =100%, HitCoverage=55%, E-value=4e-82, Identity=70%"; Hit description= endophilin [Caenorhabditis elegans]
  Gene Ontology: Mol. function=protein binding; Cellular component =cytoplasm; Biological process=synaptic vesicle endocytosis
  Coding regions on vcDNA: vcDNA=SeqID_90233; Strand=+; Position=37-666
MSLSALKKQFNKANQYLNESIGTAEATKLDEEFTEMERKVDMTNELITQVIAGTNEYLQPNPAVRAKIAALGAMSKVRGSTKNQSYPQTEGMLADTMQKYGRSLGIQSDFGKALCDAADAFRQMADVKYQLEDNVKHNFLDPISDFQNNELKDFNAHRNKLKSRRLDYDAKKRKQTKEDELVQAEEKLEESKRLTEKAMFNILNNDVEQI

SEQ ID NO: 163811 - protein, 129 aa, Heterodera glycines
  Coding regions on vcDNA: vcDNA=SeqID_90234; Strand=+; Position=1-390
LVTIQGTAYTVADMANLLALANVPNLATIYQNSASQINAQQYTPMYCVHGNSADSTPQQYAYPNGINSTGTVTKGAGDGTVNIDSLRVCQQWKDQGKLVNQVVEIANVSHERILHTRQFYDVIDSILIA

SEQ ID NO: 163812 - protein, 218 aa, Heterodera glycines
  Homolog annotation: Hit_ID=CAE60592.1; Match level="QueryCoverage =98%, HitCoverage=99%, E-value=2e-92, Identity=78%"; Hit description =Hypothetical protein CBG04228 [Caenorhabditis briggsae]
  Gene Ontology: Cellular component=cytosolic ribosome (sensu Eukarya); Biological process=protein biosynthesis
  Coding regions on vcDNA: vcDNA=SeqID_90235; Strand=+; Position=81-737
MSSSKITRDQLNESVAEVLKQSQEKKRNFRETIELQIALKNYDPQKDKRFSGTVRLKHIPRPKTKVCILGDQKHCDEANANGIPCMTADDLKKLNKDKKLIKKLSKSYDAFLASESLIKQIPRILGPGLNKAGKFPSVVSHNDMLNAKVDEVKATVKFQMKKVLCLAVAIGHVEMSQDELVSNISLGVNFLVSLLKKNWQNVRSLNIKSTMGPAVRLF

SEQ ID NO: 163813 - protein, 202 aa, Heterodera glycines
  Homolog annotation: Hit_ID=NP_504455.1; Match level="QueryCoverage =93%, HitCoverage=30%, E-value=4e-47, Identity=52%"; Hit description =nuclear Hormone Receptor (64.6 kD) (nhr-47) [Caenorhabditis elegans] gb|AAC19212.2| Nuclear hormone recep
  Gene Ontology: Mol. function=ligand-dependent nuclear receptor activity; Cellular component=nucleus; Biological process=blood coagulation
  Coding regions on vcDNA: vcDNA=SeqID_90236; Strand=+; Position=108-713
MSSISPANPKKFSIPSETNCVVCVDIATGNHYSVASCNGCKTFFRRAIVNNRSFICMGNGNCPIDKGVRCACRACRLEKCLQVGMDPNAIQSERDRIGYTKRTRREKLVGFDEGIGHERGDLCAESFASNDADLEESDEDDVIFRDTEPIGCSPSVNIAQRSKSQLYEEVLERLTQLENNFTLLLSRSEIQPYATLEEALKA

SEQ ID NO: 163814 - protein, 302 aa, Heterodera glycines
  Homolog annotation: Hit_ID=NP_507876.1; Match level="QueryCoverage =94%, HitCoverage=91%, E-value=2e-67, Identity=46%"; Hit description =histidine triad HIT-5 (5U558) [Caenorhabditis elegans] gb|AAL86013.1| heat shock-like protein [Caenorhabd
  Gene Ontology: Mol. function=hydrolase activity, acting on acid anhydrides, in phosphorus-containing anhydrides; Cellular component =nucleus; Biological process=rRNA processing
  Coding regions on vcDNA: vcDNA=SeqID_90237; Strand=+; Position=24-932
MSENMGAIFENIALHDFVVKEVINSFPDKKSIFLLLAKSDEKALLICNKQAFEEEVANVSDWLVKSKLRYIDSNDRFGNFEMALPSESNQIKVTFIYPATEWDIEKYSRQTPFFIYETPEDYKNITLNYLSEIDYVKQLKWVYNFLEKKSESERIVFEDEDKQNGFVLAPDLKWNGTNVDDLYLLAIAHRHGLRSVRDLTPDDLPLLENIRDQSAKLIKTKYGLDQNQLKMYFHYQPTFYHLHVHIVTLKYDAPGWGGTSILLQSVIDNIKNYPNFYKNATLPFIGKEKHSLTKKFFEAGRV

SEQ ID NO: 163815 - protein, 137 aa, Heterodera glycines
  Coding regions on vcDNA: vcDNA=SeqID_90238; Strand=-; Position=192-605
KFGVHGHLFSVLHSVVVQVGKVDFSGSDLILQKCDVLLRLFGAFFHIFQVFAQQLSRFVQFVFDHNIGTEPNTNFVHLFDQCPRVKVLVQFVSDLDRVNAFFNFVLRAFRERSNSCGSLEYFPQSLPFAEVRSSQTF

SEQ ID NO: 163816 - protein, 286 aa, Heterodera glycines
  misc_feature (109)..(109): Xaa can be any naturally occurring amino acid
  Homolog annotation: Hit_ID=NP_477448.1; Match level="QueryCoverage =94%, HitCoverage=40%, E-value=2e-49, Identity=40%"; Hit description =CG6521-PA [Drosophila melanogaster] gb|AAF53027.1| CG6521-PA [Drosophila melanogaster] gb|AAO74697.1| LD0
  Gene Ontology: Mol. function=SH3/SH2 adaptor protein activity; Cellular component=Golgi apparatus; Biological process=synaptic vesicle endocytosis
  Coding regions on vcDNA: vcDNA=SeqID_90239; Strand=+; Position=48-906
MPIFGDPSSPYDEAVEKATAETMTNENWTLMFDICDRVASEGPRACKQCLLSVRKRLNHRDPHVVLLVLSLLDCLWNNCGTHFRREVSSKDFVGELNYKCTNSNRVVAXRARSLVKKWAENECSKDSSLSLVESLYRDLRDQGLSFELDSTTNNHCQKKKAIVSNDPNVMSSEQEEADIAKAIALSLPEGGKQQASSRNFYTSAVVGTAPTRHMPINSTTQKSQLKKVKALITFDAAEDHQVSFLAGELMIRFRQCGPNWGGRVNRTRRGSHRDFFRGSVLTKNFN

SEQ ID NO: 163817 - protein, 87 aa, Heterodera glycines
  Coding regions on vcDNA: vcDNA=SeqID_90240; Strand=-; Position=55-318
ITYTLPKIRHSHRFVQSAKTAANVCTEQNGGHPSKSPKVAGAEFRVIYKVFAVPDGLVLLLTFTMTCLQFTRDLRTFRKNILSVERL

SEQ ID NO: 163818 - protein, 257 aa, Heterodera glycines
  Homolog annotation: Hit_ID=CAC21848.1; Match level="QueryCoverage =75%, HitCoverage=78%, E-value=1e-16, Identity=37%"; Hit description =hypothetical protein [Globodera rostochiensis]
  Gene Ontology: Biological process=signal transduction
  Coding regions on vcDNA: vcDNA=SeqID_90241; Strand=+; Position=85-858
MGEFRVKFRQLEADIEELKGKNEAIQKRLVEFEQKLSTSANYTRIVSGQEMIRILAKNNWNQTDSHKELFLFKPNLLKVVCLGAEKVPRTVRAKNRAPKNLEIVYYEVKILSAEQKDFGTQNDSIGIGFAPKSMPLGTKVGTHPGTFAYFNDGNVRGHRIVGSTKQNLAKFDAGDVIGCGLNLTSKEIILTKNGERLGKKEQPYHRFISSHYGSELFDSNFFFASKETDDLYPAISLNNPGDEVEANFGPNFKYTLN

SEQ ID NO: 163819 - protein, 264 aa, Heterodera glycines
  Coding regions on vcDNA: vcDNA=SeqID_90242; Strand=+; Position=4-795
MYIRELKSPDIKPPEELLQVFSNPSRRSIRLADEARQCAYQNEMSRLARIIQSQQWTISSQQRTIESQQRTIEMLVSRLPRNDGAAAPPNGDERRDMGGAPNEQQHGQPPILQIDNRPHIAPEPNGRGGQNGGGHGQRPNGNANIVRGQNVVPVAPPPFVAQRQQEQGQNEGGNGRRPHGNANIVRGQNVVPVAPPPFVAQRQQEQGQNEGGNGRRPHGNANIVRGQNVVPVAPPPFVAQRQQEQGQNEGGNGRRPNGNANIVR

SEQ ID NO: 163820 - protein, 297 aa, Heterodera glycines
  Homolog annotation: Hit_ID=NP_491977.1; Match level="QueryCoverage =83%, HitCoverage=44%, E-value=3e-62, Identity=46%"; Hit description =ceramide kinase (62.4 kD) (1H511) [Caenorhabditis elegans] gb|AAC67466.1| Hypothetical protein T10B11.2 [
  Gene Ontology: Mol. function=diacylglycerol kinase activity; Cellular component=integral membrane protein of membrane fraction; Biological process=ceramide metabolism
  Coding regions on vcDNA: vcDNA=SeqID_90243; Strand=+; Position=14-904
MLSKKSEGVTTIALEEGLIDVTRTDSESKPIWHDAIPLNHVVAVRQSRVKLRSGVPTGNVSSIESANSNSLFLYYSYRRNAYAWRIRECVIKFETNTDVEKWSTLLGNALTAQKHRPKRLLVFINPFGGKGHAISIWEKEVEPIFKLANIQYEVRKTERADHALEIVREFSVDSWEGIDGIVSVGGDGLFNEILSATVIRTQIEHGKNYNNIETVLERPRIRLGIIGAGSANSIVSTVHGVNDYQTAAIHVAVGNERMVDICAVYENGLLSRFSGDAISCGWLGDVLRDSESYRCLG

SEQ ID NO: 163821 - protein, 213 aa, Heterodera glycines
  Homolog annotation: Hit_ID=F89530; Match level="QueryCoverage=46%, HitCoverage=28%, E-value=6e-30, Identity=64%"; Hit description =protein H28G03.1 [imported] - Caenorhabditis elegans
  Gene Ontology: Mol. function=heterogeneous nuclear ribonucleoprotein; Cellular component=cytoplasm; Biological process=RNA processing
  Coding regions on vcDNA: vcDNA=SeqID_90244; Strand=+; Position=12-650
MMFFQLSSSAPTSSSVDGPQQFFQHHHHQFVPSISPLFDTSGAGMLGTLAAPTTASIFMPSLFGGCGGAAAGDGTITAAGSLMQSLLSAAVCSGAFPLVGTTVAASPLTATTSQHRKLFIGGLSHETTDEQLRDYYSKWGKVIDCIVIRDPVTRQSRGFGFVTYATIEMADSAMADRPHTIAGKVGDPKRAIPREQMLQATSCPPAFLDVEPP

SEQ ID NO: 163822 - protein, 188 aa, Heterodera glycines
  Homolog annotation: Hit_ID=CAE70160.1; Match level="QueryCoverage =66%, HitCoverage=70%, E-value=8e-37, Identity=58%"; Hit description =Hypothetical protein CBG16627 [Caenorhabditis briggsae]
  Gene Ontology: Mol. function=structural constituent of ribosome; Cellular component=mitochondrial small ribosomal subunit; Biological process=protein biosynthesis
  Coding regions on vcDNA: vcDNA=SeqID_90245; Strand=+; Position=9-575
MGLLFMARINYFRAFSSTVSRSFKQVKHTVQDNVTTIELVDVPIASTHRELKESAATQSKTPDDCSCVLCKIPTSISYKDVLILEQFMRLDGTVFPRQLTGLCHDQQQRLERCVMQAHWSGLFPDRTIPEFDRAGYKRFNRHWDDDLAMFRLKYKLHPGSWFYIKRYNPRIREYRPFKADEIPDIERE

SEQ ID NO: 163823 - protein, 234 aa, Heterodera glycines
  Coding regions on vcDNA: vcDNA=SeqID_90246; Strand=-; Position=39-743
LFSQIFNQMACSVRLDHHILLPSHFFPKFPPHGPPPPIPPPYGEPYIPRLARRAAGSLSTLSSCAVISAEKAHKTTKRKAMIKRRGDILRVISARVLKASCRIRHEGMANFLYIYSSLRILPQSVSSAFSIVHCQRNISIDNKCHQQNQAFAKGNNFQLPKQQKDAREREALERQLRAAPRGRFSLPNVDRVYNSDEVYEELCKPAKDRAKALFLLSIVVITVCFITDLEHSRK

SEQ ID NO: 163824 - protein, 123 aa, Heterodera glycines
  misc_feature (78)..(78): Xaa can be any naturally occurring amino acid
  Homolog annotation: Hit_ID=BAC87222.1; Match level="QueryCoverage =82%, HitCoverage=86%, E-value=3e-13, Identity=26%"; Hit description =unnamed protein product [Homo sapiens]
  Coding regions on vcDNA: vcDNA=SeqID_90247; Strand=+; Position=476-844
ILWRLLLHWQHRSNWHPFGWAEERNGPLKSQRQKKRKNGKRSERMSRRGRRQHSQRTQKRRRKSRQRKRQRKSQNKEXWRKRAKRKRRKRKEEKQAKKESKWARRRRSSSRRRRSRKRSGTER

SEQ ID NO: 163825 - protein, 105 aa, Heterodera glycines
  Coding regions on vcDNA: vcDNA=SeqID_90248; Strand=+; Position=29-346
MLIQDGAIAKSEGDLVNAERLATVVLRMIAVGPFFAPSVAQANAQINASGDEGNEFNRLTVLFSDHQYDIVIGNSAGGISIGGGRQTQHQKQTIHVVKRTLPICE

SEQ ID NO: 163826 - protein, 123 aa, Heterodera glycines
  Homolog annotation: Hit_ID=CAE74899.1; Match level="QueryCoverage =87%, HitCoverage=96%, E-value=8e-18, Identity=38%"; Hit description =Hypothetical protein CBG22765 [Caenorhabditis briggsae]
  Coding regions on vcDNA: vcDNA=SeqID_90249; Strand=+; Position=88-459
MSVPETHSPTVEQLPKLPTELQSEVAQRAGLKHVTTLEKNVLPTKEDLEEERKHESLKKGIQNFDALKLRHVETEDKCMLPSSNDIAVEKTPQLAAEFDQSGLKHVETTVKTNIEVIDKAEQN

SEQ ID NO: 163827 - protein, 197 aa, Heterodera glycines
  Coding regions on vcDNA: vcDNA=SeqID_90250; Strand=+; Position=28-621
IFVLLKMLSLAIRRFIVQHSNGTFMSTNFVATSSNFLLMDQENDKETKKDFRKIVKLLERSPTQKRKKEQEKAEENAKRDKREENGREEERTNWKEHISKSLHKSYDEYATRKSMESWKRRARRDTFCYMRDRNLPDLVTYTHRYIEGLTELNGKNNQRSFEDNELVVVVLKFVMNELLKGNNVQSARNERIEKKPK

SEQ ID NO: 163828 - protein, 300 aa, Heterodera glycines
  Coding regions on vcDNA: vcDNA=SeqID_90251; Strand=+; Position=2-901
MMMNSDNSSAINSKSFDQISEIGSMATDGLLQDDGVPDYAKIIIKQQQALIATLMNMQQQQQESRYASTISLFQQHQPHFLSNNDSSFPPPGIPTHPSPPPGIRPPVSPAPVSAPPPPPPGFRAPPGFNVSVSSRKFELDSTKSDTGGSHKFDIREELKKAFALDDTNENDSSSAEQQNLSPRSQNIREAQNARLPMSSSFSSIENLQNFTGLSQQDSSSPVSALSRQPIAAAVPSPQSASSSVCALALNYVLVDQMVLNYERVYEQKEKMASETLTMVDRQSSPERSIYQRFANLGAVL

SEQ ID NO: 163829 - protein, 143 aa, Heterodera glycines
  Homolog annotation: Hit_ID=AAO64256.1; Match level="QueryCoverage =99%, HitCoverage=97%, E-value=2e-68, Identity=88%"; Hit description =putative ribosomal protein S28 [Aspergillus fumigatus]
  Gene Ontology: Cellular component=eukaryotic 48S initiation complex; Biological process=protein biosynthesis
  Coding regions on vcDNA: vcDNA=SeqID_90252; Strand=+; Position=28-459
MGKPRGLNAARSLSNRRRDQRWADKQYKKRALGTAFKSSPFAGASHAKGIVLEKIGVEAKQPNSAIRKCVRVQLIKNGKKITAFVPNDGCLNYIDENDEVLVAGFGRKGRAVGDIPGVRFKVVKVSGVSLLALYKEKKEKPRS

SEQ ID NO: 163830 - protein, 114 aa, Heterodera glycines
  Homolog annotation: Hit_ID=NP_502668.1; Match level="QueryCoverage =90%, HitCoverage=85%, E-value=1e-17, Identity=41%"; Hit description =synaptobrevin (13.5 kD) (4O626) [Caenorhabditis elegans] emb|CAC70077.1| Hypothetical protein B0513.9 [Ca
  Gene Ontology: Cellular component=plasma membrane; Biological process= nonselective vesicle transport
  Coding regions on vcDNA: vcDNA=SeqID_90253; Strand=+; Position=37-381
MDPPSVIASADANGDQRQQGGDVKIEQVRNQLDGVTTVMSQNVERILERGERLDQLDNRSQALHESSQSFTHTSQRVQRRMCLQSMKWSIIFGLFLCVMLVLLVLTILRIFNVI

SEQ ID NO: 163831 - protein, 104 aa, Heterodera glycines; identical to SEQ ID NO: 158774
  Homolog annotation: Hit_ID=AAO92290.1; Match level="QueryCoverage =100%, HitCoverage=100%, E-value=2e-52, Identity=100%"; Hit description=FMRFamide-related peptide precursor [Heterodera glycines]
  Coding regions on vcDNA: vcDNA=SeqID_90254; Strand=+; Position=63-377

SEQ ID NO: 163832 - protein, 140 aa, Heterodera glycines
  misc_feature (78)..(78): Xaa can be any naturally occurring amino acid
  Homolog annotation: Hit_ID=NP_648239.1; Match level="QueryCoverage =85%, HitCoverage=25%, E-value=1e-24, Identity=52%"; Hit description =CG6638-PA [Drosophila melanogaster] gb|AAF50398.1| CG6638-PA [Drosophila melanogaster] gb|AAL90378.1| RE6
  Gene Ontology: Mol. function=isovaleryl-CoA dehydrogenase activity; Cellular component=mitochondrial matrix
  Coding regions on vcDNA: vcDNA=SeqID_90255; Strand=+; Position=187-607
WRNCHVLAVPLASVTASIPTSENVLGEEDCGLYILMSGLDSERLVFAAAPLGLMQSACDIAFEYAHCLRQTDRQFSGXFRLLFRISTPAQLMQGKLADMYTRLCASRAYLYAVARNAVSAECLKAKDSAAAILFLAEKAL

SEQ ID NO: 163833 - protein, 220 aa, Heterodera glycines
  Homolog annotation: Hit_ID=CAE73159.1; Match level="QueryCoverage =91%, HitCoverage=93%, E-value=5e-70, Identity=60%"; Hit description =Hypothetical protein CBG20552 [Caenorhabditis briggsae]
  Gene Ontology: Mol. function=phosphatidylethanolamine binding; Cellular component=soluble fraction; Biological process=regulation of proteolysis and peptidolysis
  Coding regions on vcDNA: vcDNA=SeqID_90256; Strand=+; Position=31-693
MCSSSVAAFRFCQFSSSLFKAQCPQRIFCRAASTVMSTSEEFKKQTIVPDVVTKAPEKRAKVVFDSGVEANLGNVLTPTQVQNPPKVTWEAEAGKLYSLIMTDPDAPSRKEPKFREWHHWLVVNIPGTEVDKGDVLSEYVGSGPPQDTGLHRYVYLIYQQKNTIKDTEHGHLTNRSGDNRGGWKTEKFAKKHELGDPVAGNFYQAEFDDYVPKLYKQLGC

SEQ ID NO: 163834 - protein, 101 aa, Heterodera glycines
  misc_feature (51)..(51): Xaa can be any naturally occurring amino acid
  misc_feature (53)..(53): Xaa can be any naturally occurring amino acid
  Coding regions on vcDNA: vcDNA=SeqID_90257; Strand=+; Position=1-306
EGYLSGISYSFYKIFPFQMLPPKEIWENDAYDRWNDFNVALIIVICVIGFXTXTRYAPQLPFGLQWRNAIKRHGSHGICLPLIALTSDVRWNQWLWKRAIW

SEQ ID NO: 163835 - protein, 109 aa, Heterodera glycines
  Coding regions on vcDNA: vcDNA=SeqID_90258; Strand=+; Position=27-356
LLVLKYLRKWQSLHRKWQQLRNLNTSPAYTTKRTLSNPTTVVQTQEASLNQQKMWSLLNGPKRKCKSKNTVRSSLLRRNTNGQKWNRIEKKSKRRKCIFFGLIKRSFDD

SEQ ID NO: 163836 - protein, 142 aa, Heterodera glycines
  Homolog annotation: Hit_ID=CAE61811.1; Match level="QueryCoverage =78%, HitCoverage=87%, E-value=7e-09, Identity=32%"; Hit description =Hypothetical protein CBG05778 [Caenorhabditis briggsae]
  Coding regions on vcDNA: vcDNA=SeqID_90259; Strand=+; Position=53-481
MSIDEIERTIPLPSSHLFSHSQFVRAEIHSFEEAFVHNKRFKEFEGLLKTNHKTYESVEAKFDLQKIEKMSTLTNRLNKLADHLGKIGHLHFEKGELNAMDLEEKPMFEIVRLAEQKQHEIEEGRRNGKSKAEKVTEAMANE

SEQ ID NO: 163837 - protein, 186 aa, Heterodera glycines
  Coding regions on vcDNA: vcDNA=SeqID_90260; Strand=+; Position=133-690
METMKASSSSLCYKNSCFLSDLLSNTNRRGNLRLLESEPFANEAATEAETERLLFAELEQQMDEDGNKQKHPDEQMPCHSASSSAFSADNYHTQLPIFCGVCFAECAAFDSFALRRCEPFGATHTFCDDCWRQHIGQCLSNGRVPISCMAPNCSSVVRPSVALLVVGQPIAQRYRQLMVKRRRLCR

SEQ ID NO: 163838 - protein, 176 aa, Heterodera glycines
  Homolog annotation: Hit_ID=XP_394208.1; Match level="QueryCoverage =86%, HitCoverage=30%, E-value=2e-30, Identity=45%"; Hit description =similar to PDK1 [Apis mellifera]
  Gene Ontology: Mol. function=3-phosphoinositide-dependent protein kinase activity; Cellular component=plasma membrane; Biological process=insulin receptor signaling pathway
  Coding regions on vcDNA: vcDNA=SeqID_90261; Strand=+; Position=120-647
MSDIAGASSSAFSADASSTKKKGDFLFLAELGEGSYSTVYLASERQTSRKFAVKMCLKKKIIKEKKVQQIFRERDILRLLSTPANACPFVVHLFCTFQDDESLFFVLSYAPKKDLMARLKKLQRFSVGQCQFAMAELFLALEHIHALDVIHGYVNAEKIWLPEGRDILLSDFGCAK

SEQ ID NO: 163839 - protein, 187 aa, Heterodera glycines
  Coding regions on vcDNA: vcDNA=SeqID_90262; Strand=+; Position=3-563
EMNRATANEVSVFDDFHSDIEKSKKINKDRLSKFCPKLFKKENGIGMSSIASVPFEALLAGEFVFPCSSIHSYVHNAYKSKNPAEIADELELLLNKLTDFCRSDSDFEKVLNFSLALSDCFGRLFFDCKSLELNMKLVRMQEKVKNLTSAQFLFAQNMALIKNKAAFVPSFDDCSDYIVKEIRMREL

SEQ ID NO: 163840 - protein, 152 aa, Heterodera glycines
  Coding regions on vcDNA: vcDNA=SeqID_90263; Strand=+; Position=123-581
MNSNSLLFSLFTLLLSIAANGHFCFGKAMGQQRSRRVAAVDNGNFIVVDGSVSVVNGVISGNGCYYHDGKVTDYGKTRTLTGAERAKLKKFIDEMQQMSVKFAQEMQRMFSATFPFGPPAAPPPQFHLPPQVPCFCSSSSCSKFREKANRMK

SEQ ID NO: 163841 - protein, 154 aa, Heterodera glycines
  Coding regions on vcDNA: vcDNA=SeqID_90264; Strand=-; Position=3-464
FFFFFFFFFFFLKSDHLLERKNRFMHLIIEIWKKGLKWGRKGGIKLKMNVYFFGIHPEFFFFFFFTHSLHSLFTTAQNALIPSAATGTDVERCFGFLPAFVHFLVVPTGHLFIPISRNKIGANEKADNYQQKKHNETQMEHLEKAENYLKLLKA

SEQ ID NO: 163842 - protein, 260 aa, Heterodera glycines
  Homolog annotation: Hit_ID=NP_506013.2; Match level="QueryCoverage =93%, HitCoverage=38%, E-value=7e-74, Identity=55%"; Hit description =ADDucin, spectrin assembly factor, adducin head domain related (add -2) [Caenorhabditis elegans]
  Gene Ontology: Mol. function=calmodulin binding; Cellular component =spectrin; Biological process=actin cytoskeleton organization and biogenesis
  Coding regions on vcDNA: vcDNA=SeqID_90265; Strand=+; Position=41-820
MDISLSLNGLGAKPLVPIADLGDSNKYSAEETDCRNKLASLYRLVDLFHWSQAIYNHITLRLPGKNHEILINPLGMIYREVTASSFVKISVDGRIVDPGSTPLGINQAGYILHTAIHEARPDVKCVLHLHSASGAAVSSMKCGLLPLNQESMVIGPVAYHEYCGMLSAEDEKTEIVKHLGDKKVIFLRNHGFAACGASVEEALHLAYHTLIACETQVSAMAAGEKNLIYPYEIAKKCSYDIAQHGANGMNRTASAQNGTM

SEQ ID NO: 163843 - protein, 288 aa, Heterodera glycines
  Homolog annotation: Hit_ID=NP_491349.1; Match level="QueryCoverage =95%, HitCoverage=61%, E-value=2e-79, Identity=56%"; Hit description =GDP-mannose pyrophosphorylase (43.9 kD) (1E875) [Caenorhabditis elegans] gb|AAF60647.1| Hypothetical prot
  Gene Ontology: Mol. function=mannose-1-phosphate guanylyltransferase activity; Cellular component=cytoplasm; Biological process=protein modification
  Coding regions on vcDNA: vcDNA=SeqID_90266; Strand=+; Position=226 -1089
MTTITPQQKPILKAVILVGGAQKGTRFRPLSLQLPKPLFPVAGVPLIEHHISQLCEQLENLHEIFIVGFYPAEQFANFISDCEKKYRRVPIRYIQENCPLGTAGGLLQYKDILIDRKPPDALFVLNADACGEFPFLEMVQELNQKTEAKCLILTTEATREQSVNYGSVVIDSVGLECSRGRVLHYVDKPATFVSTHISCGVYLLRGNSFDVILEQAEKTASERGLNTDSPTMQLFHSNQLWFEKDIFPQMTSDGTLFAWHTNRWWSQTKTAGAVLYANRHYLGLYRAR

SEQ ID NO: 163844 - protein, 111 aa, Heterodera glycines
  Homolog annotation: Hit_ID=AAP06016.1; Match level="QueryCoverage =83%, HitCoverage=91%, E-value=3e-30, Identity=63%"; Hit description =similar to GenBank Accession Number AJ238010 heat shock protein 10 in Oryzias latipes [Schistosoma japonic
  Gene Ontology: Mol. function=ATP binding; Cellular component =mitochondrion; Biological process=protein folding
  Coding regions on vcDNA: vcDNA=SeqID_90267; Strand=+; Position=34-369
MLGHFSKLSVRCYASATSFRPFFDRVLIERFLPEQKTKGGIMIPEKAQGKVLEGTVVAIGPGYRNDEGKTIPMQLQIGDRVLLPEYGGAKIVMEDKEYHVFRESDIIGKFE

SEQ ID NO: 163845 - protein, 158 aa, Heterodera glycines
  Homolog annotation: Hit_ID=XP_391955.1; Match level="QueryCoverage =80%, HitCoverage=19%, E-value=4e-46, Identity=66%"; Hit description =similar to ENSANGP00000010338 [Apis mellifera]
  Gene Ontology: Mol. function=zinc ion binding; Cellular component =cytoskeleton; Biological process=signal transduction
  Coding regions on vcDNA: vcDNA=SeqID_90268; Strand=+; Position=19-495
MLIRSRQQLCALFRSSIPLLKPRIGCYSVLAQMSTEVEKAQKAKPGGDTIFGKIIRKEMPSTILYEDDEVLAFKDINPEAPVHFLVIPKKCITALSNSEEQDQAVLGKLLLTANNVAKAQGLSNGYRIVINNGRHGCQSVYHLHLHVLGGRQLGWPPG

SEQ ID NO: 163846 - protein, 391 aa, Heterodera glycines
  Homolog annotation: Hit_ID=NP_506247.1; Match level="QueryCoverage =85%, HitCoverage=95%, E-value=2e-38, Identity=31%"; Hit description =Pinin/SDK/memA protein (42.5 kD) (5N453) [Caenorhabditis elegans] emb|CAC42335.1| Hypothetical protein R1
  Gene Ontology: Mol. function=protein kinase activity; Cellular component=cytoplasm; Biological process=cell adhesion
  Coding regions on vcDNA: vcDNA=SeqID_90269; Strand=+; Position=105 -1280
MAVDVNSALTKAYDELRSIDMNISMLSGVSERFNRKRSAPTNDSFSTPFDRRVQEGGRKIIIGPESSDRNAKRGRYAADEGPPGDYSPPSSARTHRTLQSSVVMPTIETKSRTAVINEMKKNENKEDQVRNRRLFGNLLVATLRKFQNEEKTVGSKGQVQIDKQREVERRLEETEKENRNRMMREREALMAKKREKEMEIQSLRRQKAIEQSAEEKTKHFRRLQCFIQTQTKPPLFFLPSKHTLRTLELLKESSKKIETLIELRRDEMTRELRRLDTYTTASFGGTIGQAKNNVADESDDQDEEETNVRGGLKSAIVVKMEGMTGETVAEAEEEKRDEEEGEEETGQKDGEGEDEAEPKDGEEGEEETGPKEGEEQAEQQQNGRADSEGPD

SEQ ID NO: 163847 - protein, 228 aa, Heterodera glycines
  Coding regions on vcDNA: vcDNA=SeqID_90270; Strand=+; Position=11-694
AAPFSVRFCHFCSQQPTTRLSTTTTTLSTSKTITAVAGRRVFPPPPFATAAPSLRLASFSPLSSPASPLPPLLSKLIIGAFVGRNNSPRRLLCPQQRSSSRALTLAKGFFLSTSAAFMAERSGAGHINHNGIATLSERNAHRTSVQQCPSFAPFKPNRALIVSKSSLLEYEFDRRGPKNEYSGLDDPRFLKELHIQQINMEDLRIRHKLQLHYLDTIVEELERHKIEW

SEQ ID NO: 163848 - protein, 313 aa, Heterodera glycines
  Homolog annotation: Hit_ID=CAE62049.1; Match level="QueryCoverage =86%, HitCoverage=89%, E-value=3e-53, Identity=42%"; Hit description =Hypothetical protein CBG06065 [Caenorhabditis briggsae]
  Coding regions on vcDNA: vcDNA=SeqID_90271; Strand=+; Position=31-969
MDLAKAYGAPYDLVEQTLNKRRKMLRKTAKGTSRNIGPKNAKDAAYDHKMIRHKIFPMAAASYGDTENVKNCIRNTFRNATLYRNSVVQCNGKAYELCSAFTAVSHEDKAIILSFRGTDTGYQLIEETIQIALFKRSQSPDEEWGKVGSYFLKIFNQLVEEGKIIDYLAKLVNTYNNYELWVTGHSLGGAMAAIASATIGDAKLISAQRLKLVTFGQPRTGNGEWATAMDQKVGPFNYRVVNNRDLVPHMPPLWFEGYRHHMTEVFYNNAKNKTEEFVICADEAESEECAGKYWFYNVRDHLNYFGKSVSEWG

SEQ ID NO: 163849 - protein, 88 aa, Heterodera glycines
  Coding regions on vcDNA: vcDNA=SeqID_90272; Strand=-; Position=64-330
MFTFLCCCCCCTISNSSSSPPDAKYDESIEMSPSLWSLVSAGNISSSQMRKSQVNWTPLKAVQNAGLTFKMADSPAPISRSVIRTGQV

SEQ ID NO: 163850 - protein, 270 aa, Heterodera glycines
  Homolog annotation: Hit_ID=AAH59753.1; Match level="QueryCoverage =91%, HitCoverage=80%, E-value=2e-39, Identity=33%"; Hit description =Hypothetical protein MGC75760 [Xenopus tropicalis] ref|NP_988891.1| hypothetical protein MGC75760 [Xenopus
  Gene Ontology: Mol. function=homocysteine S-methyltransferase activity; Biological process=sulfur amino acid metabolism
  Coding regions on vcDNA: vcDNA=SeqID_90273; Strand=+; Position=33-842
MLSLNGTFPPQSLKPLALAFVLDGGIGSQLEELGYPINNSVIWSGEAIIDAPDLLAKCHKKFIDAGADIIETNSYHVSIQKLMESRGFSLGQAESILHKSVLIAREAIAASGRPVALVGAVGPYATYLRDASEYTGAYVKKPDFQEQTIIDYYLLQCRPLIAAGVTTLNFETIPSVKEIECVAKVMDQLDDTVQAWVSCSCQDRKRTRSGDAFADAVKIANGHPKIVAIGINCTAPDHITELLTEAKKANNSKALVVYPYSGQVYNAETR

SEQ ID NO: 163851 - protein, 216 aa, Heterodera glycines
  Coding regions on vcDNA: vcDNA=SeqID_90274; Strand=+; Position=864 -1511
KENYIKKSKMDAFQQFKREDGQFRHPFTMIVSGSTGSGKSEWIMRLLRNVDKMISTPVERVIYSYGELNTNVMNLQRAGKVANVPVTVHSGVPRAEQVRECAKKEKTLLVLDDLVVGMSQQYLDALFTRGSHNWGVSVILVTQHLFNKELRVARTNSHYLVLMRNPAGALQIRTIATHLFPSRTAHFIEAYRDACAKNFGYLLVDMHPESPEDIRL

SEQ ID NO: 163852 - protein, 241 aa, Heterodera glycines
  Coding regions on vcDNA: vcDNA=SeqID_90275; Strand=+; Position=35-757
MDGELNQGTDPKIVHRDVIEMFPELDLTQIVSEFGHLSPEGLAGIVIDRMALIPRKKNGTLKRKADNESNDEVLSEYSGGSETAEQLGNLLVDKMLGEMLRSCKVELRSKRAVVDSSAWTGVKTLMIEHFPMVRADFVTKMVRHFEGAIVPTAIACFFVENSFGDKLQKIAPSFNQSFWYKMAIPIQCRGRRLKQAYVSEQLREHFKLYNELMCQYQSQYPELLTGLKLTQQARHILLERS

SEQ ID NO: 163853 - protein, 215 aa, Heterodera glycines
  misc_feature (139)..(139): Xaa can be any naturally occurring amino acid
  misc_feature (210)..(210): Xaa can be any naturally occurring amino acid
  Homolog annotation: Hit_ID=NP_506599.1; Match level="QueryCoverage =99%, HitCoverage=46%, E-value=1e-110, Identity=85%"; Hit description= histone deacetylase, abnormal GONad development GON-10 (52.1 kD) (hda- 1) [Caenorhabditis elegans] emb|CA
  Gene Ontology: Mol. function=transcription factor binding; Cellular component=cytoplasm; Biological process=chromatin silencing
  Coding regions on vcDNA: vcDNA=SeqID_90276; Strand=+; Position=7-652
MPNSGVQNHYRKRVAYYYDSNVGNYYYGQGHVMKPHRIRMTHHLLLNYGVYRHLDVYRPFPASLEDMTRFHSEEYMDFLRSATPETLKQFNKQMLKFNVGEDCPVFDGLFEFCQLSSGGSLAAAVKLNKQKAEIAINWXGGLHHAKKSEASGFCYTNDIVLGILELLKYHKRVLYVDIDVHHGDGVEEAFYTTDRVMTVSFHKYGDFFPXTGELK

SEQ ID NO: 163854 - protein, 95 aa, Heterodera glycines; identical to SEQ ID NO: 125597
  Coding regions on vcDNA: vcDNA=SeqID_90277; Strand=-; Position=394-681

SEQ ID NO: 163855 - protein, 326 aa, Heterodera glycines
  Homolog annotation: Hit_ID=CAE60606.1; Match level="QueryCoverage =96%, HitCoverage=65%, E-value=2e-63, Identity=43%"; Hit description =Hypothetical protein CBG04246 [Caenorhabditis briggsae]
  Gene Ontology: Cellular component=endoplasmic reticulum; Biological process=signal transduction
  Coding regions on vcDNA: vcDNA=SeqID_90278; Strand=+; Position=102 -1079
MSDSIPRAVELFMEKKRARISKFLYTYNGNLQLNLPQLHAFACSTGGLIDDEFRERIWPILAKNLPQAKRCKDTQWDALRSEEYNDQTNHSSDELQQQQQTLFLSDSDFESALSTFTPSISGCDDQLMDAEDDAEGDDAQRMAPQNATVFDFSPDQLRAHKEWNQVELDVARTLARFPPNIDEDERACLQNELTPLIVRILCENEDFRYYQGFHDVCLTFLLVLGADSALQVMRDICARGAFHNYLCCSLEESAMRELQDLYVLLFLHDQEVEKRLRSAELGTLFALSWPLTWFSHALQNYSQVVLFFHLFLSSHPLMPIYGSGRV

SEQ ID NO: 163856 - protein, 385 aa, Heterodera glycines
  Homolog annotation: Hit_ID=NP_502680.1; Match level="QueryCoverage =87%, HitCoverage=36%, E-value=2e-36, Identity=30%"; Hit description =putative protein, with a coiled coil-4 domain, of bilaterial origin (86.8 kD) (4O727) [Caenorhabditis ele
  Coding regions on vcDNA: vcDNA=SeqID_90279; Strand=+; Position=638 -1792
LSRVSLVAIRAAMSAIEGETCGVLGRLQFEVHAIVGFARLCAGDVFEVSVRHGHQRWRSRGKTLADKSQRWEQRMSTMDVLWNEPVVVKVLEVKFLKSRCLNERQFDPAKFALAQPQLVTMNLNSAGSIKLRLVVTWLPLLATKTIGENSLNNCQKGNLTEREKQRTDHRTNGSKQNARLTQNEQKKREEEERGREMQQQNTETKEEDQCQNESADGAAVKVCLRDKKRQREQRIQLGNSVSTGSNFGIGKEKWRCSSTTLLDDVYKDLAKSIPTIDDLTVLHPSHFASLPSSSPRHRSFDSESDRAKTEAKNPRRIFSFIKRGQSEASADQQKKDWRKSASLGEIALAKDECFTTTNAEKASPVSTEKNGNGAKRGKPSSVKKG

SEQ ID NO: 163857 - protein, 194 aa, Heterodera glycines
  Homolog annotation: Hit_ID=AAM54703.1; Match level="QueryCoverage =96%, HitCoverage=43%, E-value=5e-38, Identity=43%"; Hit description =vasa-like [Sparus aurata]
  Gene Ontology: Mol. function=RNA binding; Cellular component=polar granule; Biological process=pole plasm RNA localization
  Coding regions on vcDNA: vcDNA=SeqID_90280; Strand=+; Position=2-583
TFDITVQNTASNFLRNNYIFITVGKLNSAVETIDQQFIEVQKYSKQDKLLEMLKTDAIWRPRPNEDPFLKPAKKTLIFVETKRNSDRLAIALTQEKFYNTQSLNSDRTLEQRHLAVPKFIQGQYDILGATDVAARGINIPNVEHVINYDLPEKEIDTYIHRIGRTGRAGNTGLATSFFDPTSPEDMAHGAFYVE

SEQ ID NO: 163858 - protein, 275 aa, Heterodera glycines
  Homolog annotation: Hit_ID=CAE56861.1; Match level="QueryCoverage =80%, HitCoverage=15%, E-value=2e-13, Identity=27%"; Hit description =Hypothetical protein CBG24691 [Caenorhabditis briggsae]
  Coding regions on vcDNA: vcDNA=SeqID_90281; Strand=+; Position=1-825
NNRIWATNDQLQVDFPGPITGLFKGKQTSSATNCFAQPATLYVKWHSLQLLSPIHRADHCNYASEYCQLQDNSSLIWTSACPNDNCFMCDFQEAEEIHGEFTKLNGQTTAFWISEDRQKALTFTETHAVQACDGRQIVLSEQNFGIPKEQYDIIMSNHTRERRNVQPEQLASQLSAAQLATTMALSQLYLKECQRNVRVSNPTLQARKLLKRDNLQARWISETTIEVFPCVPISLSNISYRTTKDCYKFIPVTIHLPNATRDAFLDPEMRILSLI

SEQ ID NO: 163859 - protein, 130 aa, Heterodera glycines
  Homolog annotation: Hit_ID=NP_498148.1; Match level="QueryCoverage =54%, HitCoverage=10%, E-value=3e-11, Identity=46%"; Hit description =i-45 protein (3G466) [Caenorhabditis elegans]
  Coding regions on vcDNA: vcDNA=SeqID_90282; Strand=+; Position=268-657
CDIGTFASNRIFLTLRLQRTLPRKDTRSQTSTQSKCSRRSTSSRSNVKLGKARLTKSSQIKVPINEEEMMSFPGMEEGSQKSDKISTHRRFWQLNCKGVHFSGLPTWLQHNEFLHFGHRPPLPSFGSCFN

SEQ ID NO: 163860 - protein, 160 aa, Heterodera glycines
  misc_feature (43)..(43): Xaa can be any naturally occurring amino acid
  misc_feature (61)..(61): Xaa can be any naturally occurring amino acid
  misc_feature (79)..(79): Xaa can be any naturally occurring amino acid
  Homolog annotation: Hit_ID=AAR06638.1; Match level="QueryCoverage =95%, HitCoverage=94%, E-value=4e-51, Identity=62%"; Hit description =superoxide dismutase [Brugia malayi]
  Gene Ontology: Mol. function=copper, zinc superoxide dismutase activity; Cellular component=cytoplasm; Biological process =neurogenesis
  Coding regions on vcDNA: vcDNA=SeqID_90283; Strand=+; Position=108-592
MQKRAAVCVLVGDEDPNVKGKINFIQEKDDSPVTIQGEITGLXPGKHGFHVHAFRDLSSGXMSAGPHFNPTNKTHGGPXDETRHVGDLGNVLAGQDGVAKLDFTDKVISLVGPHNIIGRALVVHKLEDDLGRGEGLKKPESMETGNAGPRLACGVIGIAQ

SEQ ID NO: 163861 - protein, 212 aa, Heterodera glycines
  Coding regions on vcDNA: vcDNA=SeqID_90284; Strand=+; Position=331-966
FMTKLISCRRTAIAWEFSPIVFCPLAVISALFFGVGCNANHLYSEGGSFPVLSSDNSPPIPNDPPTFGSPADLLDNELQQPNQQYQTEFAPSMEQMVDEQRRNRLAKIIEQMRDNGQFSQQEIADGPGLFLEEGEANVPIERPSETETYWDGLKEGELESSEMFGENEGKKIAAVKKGQNEFVEFVEPRQHQNNRHKEWMDKRVPTDSDRKT

SEQ ID NO: 163862 - protein, 262 aa, Heterodera glycines
  misc_feature (172)..(172): Xaa can be any naturally occurring amino acid
  Homolog annotation: Hit_ID=CAE60585.1; Match level="QueryCoverage =95%, HitCoverage=57%, E-value=8e-44, Identity=42%"; Hit description =Hypothetical protein CBG04220 [Caenorhabditis briggsae]
  Coding regions on vcDNA: vcDNA=SeqID_90285; Strand=+; Position=12-798
MGSKRRLLLHFSQAHQTFRRAEFDAICQIKGISVVPNSPSDGIHIQSFEFQNDEFDVFRLLERAVLVKAAYELIAEGDGHEQVMAKLASDPSSSLARFDSADQSWSLLVRPHQKKRSGDYARSVVERYTAIPLLTLAPVDLAHPSNVFSVIEMYEANGRRETPDKVYFVRLXGEGRGHLKTLFSLSQRRYIGNSTMDPELAFIQANLAKTRPGALAMDPFCGTGGLLLPAAYFGSSDFGAQIKWDVARARGRSSRDGEQWLC

SEQ ID NO: 163863 - protein, 273 aa, Heterodera glycines
  Homolog annotation: Hit_ID=NP_505312.1; Match level="QueryCoverage =84%, HitCoverage=16%, E-value=2e-19, Identity=30%"; Hit description =TPR repeat containing protein (5J441) [Caenorhabditis elegans] gb|AAC69037.1| Hypothetical protein T19A5.
  Coding regions on vcDNA: vcDNA=SeqID_90286; Strand=+; Position=15-836
MIGFDPTNEQNSGQQLFMAEIGQRINNLIKFNIGPKWMSLNFAALFFRFFGFPSEAANCLEAALTFPQFLDISLTQLAQLLLHLNPPMENAKKENDGIERILRIAMQKGENEPVPFHLMGIFHLRQNRSVLAYRFFREALDRDPNFEPALNELLRMKCTQRVGKKPRLIRDIYAPICCWPNEQNVVCFERRAKGSVWRESVRCFRLESPPVSSGGEFPAVHFVYFRCNTPYTGRSYPPPPFAPLVAPLLRPAGRNCVKLNFVDSSNKSRLRNH

SEQ ID NO: 163864 - protein, 266 aa, Heterodera glycines
  Coding regions on vcDNA: vcDNA=SeqID_90287; Strand=+; Position=2-799
RIVEPKREESKTDKENRSKANSRPPSPFSSSSQRPRRSVSPVSVSNGFHNSRASSRLGSTNSLAANHSKTHCQPDVANLRKYSASTLPLAQLRQKQIVYQEWQWRYLIGNGGEALAKMVREVQEAGGHQPNVLSYGYKEVGRLHFSGPVEAVEELHKKITAKISLLNKNGSMMKDSISMEKQFHCQVIGKGGEFLRRLKRKHGVKEINVPSEFSNSDQIHIERPSLFKLRSCKDDLLKLVDDWRNDCYEEVPVQRRFVPMIRGKNS

SEQ ID NO: 163865 - protein, 108 aa, Heterodera glycines
  Coding regions on vcDNA: vcDNA=SeqID_90288; Strand=+; Position=656-982
MKRARQSEKLGAFPEIEFAVNTMGVTVYCPRHLQTPRFVPWDQPGRCPSCRSGTVELDYIIQPEGVTIFSNRLKTDGENFVPFDAIGKLLHLFAKNLTLFLSGFCRSC

SEQ ID NO: 163866 - protein, 199 aa, Heterodera glycines
  Coding regions on vcDNA: vcDNA=SeqID_90289; Strand=+; Position=3-599
GILQRYEMQQFRLSCANFESESSCCSTSQQMEIIVDSESDSNLTRCPCCRCAQVNLICANCLNTNDVRIGKAREDKRRLLRSKSAICHLIQNALADEIKFEGEFHHLSRSIEEIRAKIAHKKDQVGRLRQRISHTESQSERNRQNVLLLEKKMVSHSDRINRTNAKKTELQKQLMNTKAKLNTQIVHIARFLFHLLRLE

SEQ ID NO: 163867 - protein, 190 aa, Heterodera glycines
  Homolog annotation: Hit_ID=CAG08516.1; Match level="QueryCoverage =91%, HitCoverage=14%, E-value=2e-17, Identity=35%"; Hit description =unnamed protein product [Tetraodon nigroviridis]
  Coding regions on vcDNA: vcDNA=SeqID_90290; Strand=+; Position=111-680
MPKKRPSLALLRRGASVVPSPEIHSASSSLESAFSFHQQNVRTAFLFGKNNVLAFSGDREAPGYLSLHHDQNRMLILKWIPNSLLLSKPGGSTTNAVKSPSHSSHCVPVSIKFETVSHLHLHKNEGTLSSSIVLIDSDGVQQFCFSFSLEQHCFSFLKTLEGALFPLFKIDPPLNSIKIECGATGRPLMG

SEQ ID NO: 163868 - protein, 231 aa, Heterodera glycines
  Homolog annotation: Hit_ID=S25548; Match level="QueryCoverage=96%, HitCoverage=92%, E-value=3e-42, Identity=37%"; Hit description =surface-associated glycoprotein gp15/400 - nematode (Brugia pahangi) (fragment)
  Coding regions on vcDNA: vcDNA=SeqID_90291; Strand=+; Position=3-698
HEIHEQIHEFYEVSPEEVKATARGILQRGCESIFKRIFGEYNAEEIIQMRDEGASNVEIEEKITEALNQIRSPQKRQEAGRFAMSCRRIFAMIERRRRSADNAEHSLDQLFKSHLIWLNEQQREELKQMKGSGKGRTEMQQRVMEWYGQLEGQEKQKAREHLRDGCRDILAQVLGKEKADQLKQLREGGMSGTELEAKANEMVDQIQEEEKKAKAKEFGTVCRKILLEESD

SEQ ID NO: 163869 - protein, 335 aa, Heterodera glycines
  Homolog annotation: Hit_ID=CAE70071.1; Match level="QueryCoverage =94%, HitCoverage=99%, E-value=1e-130, Identity=70%"; Hit description= Hypothetical protein CBG16511 [Caenorhabditis briggsae]
  Gene Ontology: Mol. function=electron transporter activity; Biological process=nucleotide-sugar metabolism
  Coding regions on vcDNA: vcDNA=SeqID_90292; Strand=+; Position=57-1064
MTKKGDDESGGEAAAAIRVLVTGGTGLVGSAIRQVVTEEEQQQKPQRLQEQWFFVGSSECDLTDLEQTRALFRRVRPTHVVNLAAMVGGLFHNLRHNLQFFVKNLAICQNVLQCCHETDVERCVSCLSTCIFPDKTPYPIDETMVYNGPPHDSNFGYSYAKRMIDVLNRGYAQEHNRKYTSAVPCNIFGPRDNYNLENAHVVPALIHKCFLAKRDGGPVVGAGSGKPLRQFIYSLDLGRLFVWAIREYEDVEPIILSVDPSDEVTITDVVTAIVKAMQFKGEVIFDTTKADGQYKKTSSNAKLRARLPDFKFTPFERAIAESVQWFEANYEKARK

SEQ ID NO: 163870 - protein, 199 aa, Heterodera glycines
  Homolog annotation: Hit_ID=NP_493175.1; Match level="QueryCoverage =82%, HitCoverage=40%, E-value=4e-26, Identity=36%"; Hit description =predicted CDS, zinc finger protein EZNF (1N119) [Caenorhabditis elegans] emb|CAB05558.1| Hypothetical pro
  Gene Ontology: Mol. function=transcription factor activity; Cellular component=nucleus; Biological process=regulation of transcription, DNA-dependent
  Coding regions on vcDNA: vcDNA=SeqID_90293; Strand=+; Position=2-598
SLLSPTHLLNETSLNLRCPYCPKKFLKNTEAISHMDPCLKSRPYPCTNCSRRFKSAQNLSQHERIHTNVRPYNCQYCEKNFTQKSHLQQHERIHTGEPAFSCRYCGETFNIYSSKIQHEKSICGLHEALDKQKENSSEKNGFAKIAPLPQPSKTTPTEQSSSRGPAVRPTVRTAHNGTIHDRLTFCRKDSASMTHLCVS

SEQ ID NO: 163871 - protein, 93 aa, Heterodera glycines
  Coding regions on vcDNA: vcDNA=SeqID_90294; Strand=-; Position=373-654
FSIGGPLILTQTNHIGRISFCCWVFGRILHFISKLLSELNSIGFHIRGGTTLASRLSPTLAIFGTLASHLSFFGTRGENARLSSSGMGTRPLF

SEQ ID NO: 163872 - protein, 187 aa, Heterodera glycines; identical to SEQ ID NO: 162212
  Homolog annotation: Hit_ID=AAF76926.1; Match level="QueryCoverage =100%, HitCoverage=100%, E-value=1e-105, Identity=100%"; Hit description=hypothetical esophageal gland cell secretory protein 12 [Heterodera glycines]
  Coding regions on vcDNA: vcDNA=SeqID_90295; Strand=+; Position=93-656

SEQ ID NO: 163873 - protein, 193 aa, Heterodera glycines
  Homolog annotation: Hit_ID=CAE68855.1; Match level="QueryCoverage =97%, HitCoverage=99%, E-value=3e-74, Identity=69%"; Hit description =Hypothetical protein CBG14817 [Caenorhabditis briggsae]
  Coding regions on vcDNA: vcDNA=SeqID_90296; Strand=+; Position=44-625
MSSAERKIDVNRTNYSVVDSEFDSMRERFEKEMRRVDEEMQRLRHEFEGYRPAASRSSPYTTAGTQPIYGGGSSLSNGAGGGAMARHSPTYDPYLENLKSPLIKDESDGKTLRLRFDVAQYRPEEVTVKTVDNRLLVHAKHEEKTPSRTVYREYNQEFMLPRGTNPEQISSTLSTDGVLTVEAPLPQLAIQNH

SEQ ID NO: 163874 - protein, 122 aa, Heterodera glycines
  Coding regions on vcDNA: vcDNA=SeqID_90297; Strand=-; Position=47-415
FFFFFFFFFFAIGHLFLRLVNITVHTLLCFLQNIFGIFPLCHHSIRCHWCSVGILFGHSSDKRMRTPPMFRRGPHKPSRTFRGQMIQCQCLRRRCHCWHFHWLRQSKRASKELEVYEKAFPN

SEQ ID NO: 163875 - protein, 108 aa, Heterodera glycines
  misc_feature (16)..(16): Xaa can be any naturally occurring amino acid
  Homolog annotation: Hit_ID=NP_509736.1; Match level="QueryCoverage =100%, HitCoverage=26%, E-value=4e-37, Identity=58%"; Hit description= cathepsin L-like cysteine proteinase family member (45.7 kD) (XK958) [Caenorhabditis elegans] emb|CAA890
  Gene Ontology: Mol. function=cysteine-type peptidase activity; Cellular component=lysosome; Biological process=proteolysis and peptidolysis
  Coding regions on vcDNA: vcDNA=SeqID_90298; Strand=+; Position=2-329
APFINPDEQSMIDWLXNFGPINVGISVPPDMKPYKSGIYHPSDFDCQFKVVGLHSMLVVGYGENIYGDKYWIVKNSWGQKWGQEHGYLNFARGVNACGIEDEPIGLMA

SEQ ID NO: 163876 - protein, 264 aa, Heterodera glycines
  Homolog annotation: Hit_ID=CAE70599.1; Match level="QueryCoverage =95%, HitCoverage=77%, E-value=6e-87, Identity=61%"; Hit description =Hypothetical protein CBG17273 [Caenorhabditis briggsae]
  Gene Ontology: Cellular component=integral to membrane; Biological process=erythrocyte differentiation
  Coding regions on vcDNA: vcDNA=SeqID_90299; Strand=+; Position=22-813
MNINSSSLSSLKGRDLTLKPDVSKPRWDQSTYQGRARHFFAVLNPLNLFTSNQGLEESRNIVLDYRKGIFSPELTVERLWKAKHLYESAYHPMSDQKMLPFGRMCAQVPCNMVLIGGMLSFYKSPLAVVFWQWTNQSFNAVVNYTNRSGDSVSTDQLLKAYACATGGALTAALGLNAAAKKMPPLFGRLVPFAAVSVANTINVPMMRRKEFTDGIQLVDERGVPLAKSQTVAWHAVAQVVVSRVLMATPYMVLTPLPRQSVNKK

SEQ ID NO: 163877 - protein, 289 aa, Heterodera glycines
  Homolog annotation: Hit_ID=AAH57752.1; Match level="QueryCoverage =98%, HitCoverage=35%, E-value=7e-79, Identity=51%"; Hit description =MGC69128 protein [Xenopus laevis]
  Gene Ontology: Mol. function=glutamine-tRNA ligase activity; Cellular component=cytoplasm; Biological process=glutaminyl-tRNA aminoacylation
  Coding regions on vcDNA: vcDNA=SeqID_90300; Strand=+; Position=1-870
LLLKLIQAGIVDDWDDPRLFTLTALRRRGVPSETVNKFIAHLGLTVAQSSIDPAMFDAFLRDHLNVTAPRTMAVLEPLRLRITNYRELGFIPAKSTLRVKQFPSSINESTDEWEIAFDEFVYIEQAAFREVAEKSYRRLTLEQPVGLRHVNLAVKIDKLERDEHGNPIELVVTANPVSSECKPKAFIHWVARPVLCEVRLYDKLFVHKNPEDPAEVPGGFLTDINPNSLHVLSNAMVDGSIIRTIRPLDRFQFERNGFFCLDPNDSWSSEKKFVFNRIVSLREDAGKNI

SEQ ID NO: 163878 - protein, 180 aa, Heterodera glycines
  Homolog annotation: Hit_ID=CAE60264.1; Match level="QueryCoverage =97%, HitCoverage=98%, E-value=1e-32, Identity=47%"; Hit description =Hypothetical protein CBG03840 [Caenorhabditis briggsae]
  Coding regions on vcDNA: vcDNA=SeqID_90301; Strand=+; Position=48-590
MRGEAKDPKGEATAEAVSVEKQQEILLMNKLASTGKLPPKSASNFLQKKLQQRKFFDSGDYNMNKNKPIPPPIGQNLTAANTPKLAVPIETEPEKKMEESAPIIVSQLLPMMRPLAGSISGCSMDGGESDDEGGQLQIPRPDTVPQRKSSILHPSAHSKLSPQPHIHHEHTDESLTFPQS

SEQ ID NO: 163879 - protein, 261 aa, Heterodera glycines
  misc_feature (241)..(241): Xaa can be any naturally occurring amino acid
  Homolog annotation: Hit_ID=CAE74145.1; Match level="QueryCoverage =85%, HitCoverage=90%, E-value=4e-18, Identity=25%"; Hit description =Hypothetical protein CBG21816 [Caenorhabditis briggsae]
  Coding regions on vcDNA: vcDNA=SeqID_90302; Strand=+; Position=27-811
MLLLASLRGPCRRPRVLKTLRSLKVPHFSTMNRDYVIETVNFTSERDSVFKFLQEVFLVNEPITRVIGCTPSDTSPIFDDICEKCSKFDLSFTAKNNDGKILGVLLNAPFKLENIHESYRDIGRMPNKKEFGEEIRNGPFPSQNANRIHAILTFVNSHIALLPPEEDIKLVELQAMAVGPGHARTGLGSGMLRALIQTASAKGYSHLFTCATAIASQTGLKKFGFDEIKTVPFNSFLEDGXAIFSGVHDNGVGAKLVALHI

SEQ ID NO: 163880 - protein, 231 aa, Heterodera glycines
  Homolog annotation: Hit_ID=AAM91808.1; Match level="QueryCoverage =55%, HitCoverage=19%, E-value=7e-09, Identity=35%"; Hit description =unknown protein [Arabidopsis thaliana] ref|NP_850429.1| expressed protein [Arabidopsis thaliana]
  Coding regions on vcDNA: vcDNA=SeqID_90303; Strand=+; Position=10-705
PSLSRNDLVDHLTRFDRIFEQVASQVYALNDSAEKLRDIFVEHRQKLGGHFALIDPFEKQKERRRLIDAYSALKGIDAFPSSNALLQLGEYFPKQQPGTAQPQFGMTQFGQPSVGGGLFSASKAPAFSFAPSAQQSSTNLFGTPKPTPFGMPTTTATSPSPFGAAAAVIPTSAGASAVPSLFGTSVSSAGGSSAPSQPTFGGFSNTLSSASSGTLFKGSAPAKPTNLFGSK

SEQ ID NO: 163881 - protein, 138 aa, Heterodera glycines
  Coding regions on vcDNA: vcDNA=SeqID_90304; Strand=+; Position=1-417
VPLSSVRMTLKIVSSLENLIRLTPDVHSILVLDGDGVPVVSAGEEIRNRSQYSISYNSLVEQAKKLGMGEQKFWVFRYEMNQVVMLRRDAFAVFIMASANANMGILCTMSAQLGPILEECKVIVNEVINGQMAGQSPR

SEQ ID NO: 163882 - protein, 163 aa, Heterodera glycines
  Coding regions on vcDNA: vcDNA=SeqID_90305; Strand=-; Position=29-520
DEKGGIKRTILTTEENGVFRRNFAVLFEFICLFAQRMLPERLLISAGHASFAYFFFSGHSSGATADGTLPTESPPLAPPPSNCRAEEFAAGEGPYFDGATAFKEAEGGKAGEYNSKSGAALRVSEPSASEPMRVPEREERAPTGEAAADGWWRSFFFFGSLGV

SEQ ID NO: 163883 - protein, 169 aa, Heterodera glycines
  Homolog annotation: Hit_ID=CAE62851.1; Match level="QueryCoverage =99%, HitCoverage=30%, E-value=8e-22, Identity=32%"; Hit description =Hypothetical protein CBG07030 [Caenorhabditis briggsae]
  Coding regions on vcDNA: vcDNA=SeqID_90306; Strand=+; Position=76-582
MDGDGDESYCDSDLELERSSSANNVNQLTLVPTEFTSIPEAMQNFNADFDSRYGAQHAPFFHGSLQDAIAEAFDSPAGGAEHRRPLAIYLHDDQSVAAHIFAQTVMSNVNVSNLLKCQFILWAWDVSLADNKKHLFDWLELANLTEVSNYIKMVPRSEFPMLIVLIKDR

SEQ ID NO: 163884 - protein, 158 aa, Heterodera glycines
  Homolog annotation: Hit_ID=EAA67771.1; Match level="QueryCoverage =94%, HitCoverage=98%, E-value=5e-62, Identity=81%"; Hit description =RS14_NEUCR 40S ribosomal protein S14 (CRP2) [Gibberella zeae PH-1] ref|XP_382717.1| RS14_NEUCR 40S ribosom
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_90307; Strand=+; Position=2-478
TALKPPKCLPRVKRSLQPQEAGSYGPQVREGELVFSVAHIFASFNDTFVHVTDLSGRETITRVTGGMKDKADRDESSPYADMWAAQDVAVRCKELGITALHIKLRATGGVGPATPGPGAQSALRALARAGMRIGRIEDVTPIPTDSTRRKGGRRSRRL

SEQ ID NO: 163885 - protein, 154 aa, Heterodera glycines
  Homolog annotation: Hit_ID=EAA62601.1; Match level="QueryCoverage =100%, HitCoverage=99%, E-value=3e-62, Identity=74%"; Hit description= conserved hypothetical protein [Aspergillus nidulans FGSC A4] ref|XP _409578.1| conserved hypothetical pro
  Gene Ontology: Cellular component=mitochondrion
  Coding regions on vcDNA: vcDNA=SeqID_90308; Strand=+; Position=17-481
MSLVVSEKGSFSYILRVLNTNLEGKQKIMYALTSIKGVGRRYANLVCKKAEVDTNKRAGDITAEELERIVTIIQNPLQFKIPKFFLNRQKDIRTGEYAQNVSNAVDNNLREDLERLKKIRVHRGLRHWWGIRVRGQHTKTTGRRGKTVGVAKKK

SEQ ID NO: 163886 - protein, 150 aa, Heterodera glycines
  Coding regions on vcDNA: vcDNA=SeqID_90309; Strand=+; Position=63-515
MEPSNENVNGDNVPNAALKGGHPPAEKIGCMRIARKERNLSQQPEEREKSGGTTPASASESGDSAHSEGETRVRPGATNVLAYTDLAKQTKLDYPTDAVRHCHEKPFPSKQAYTAHRTNAAQMQAHQQFQPRRFGHLKFQTREYGPLHKQ

SEQ ID NO: 163887 - protein, 134 aa, Heterodera glycines
  Coding regions on vcDNA: vcDNA=SeqID_90310; Strand=-; Position=204-608
IFLYDLTNTFSATKSGWFSFVYVLTSTGNCFSRSCKCQSVGGTRITIVATTVRLALSFGTSGITVTWFGLSTDVGTLVDATASLPALVSGVSQKLDLLAHTLVPVSQKLVLIAQKLVLVSQKTVLQQPIILFSQ

SEQ ID NO: 163888 - protein, 106 aa, Heterodera glycines
  Coding regions on vcDNA: vcDNA=SeqID_90311; Strand=+; Position=123-443
MTGTTSATSSTNNTINTNNNNNNGNSTCVKGSSTTHTVTAPPSDISLTERMKHLLNTGNDADVHFLVGSDDKKELLPAHKLILKTASNVFEAMFRFDTENLFRPAC

SEQ ID NO: 163889 - protein, 275 aa, Heterodera glycines
  Homolog annotation: Hit_ID=XP_322018.1; Match level="QueryCoverage =100%, HitCoverage=59%, E-value=1e-111, Identity=65%"; Hit description=ENSANGP00000012089 [Anopheles gambiae]
  Gene Ontology: Mol. function=apoptosis inhibitor activity; Cellular component=cytoplasm; Biological process=chromatin modification
  Coding regions on vcDNA: vcDNA=SeqID_90312; Strand=+; Position=12-836
RRILYYHHPDLPNFHYGPQHPMKPARLAATHSLVLNYELHKHLTCVHPPKATQHDLARFHAPEYVQFLKRISPLNADQYEGLFNRFNIGEDCPVFDGIFDFCSLYTGGTLEGAIRLNHGQAEIAINWSGGLHHAKKAEASGFWYGNDIVIGIIQLLKCHPRVLYIDIDIHHGDGVQKAFNLTDRVMTVSFHRYGRYFFPGTGDMYDVGMGHGRYFSVNVPLREGMDDESYHSVFKPVIQAVVDNFNPSVIVLQCGADSLGSDRLGCFNLSFDGHG

SEQ ID NO: 163890 - protein, 103 aa, Heterodera glycines
  misc_feature (10)..(10): Xaa can be any naturally occurring amino acid
  misc_feature (26)..(26): Xaa can be any naturally occurring amino acid
  misc_feature (30)..(30): Xaa can be any naturally occurring amino acid
  misc_feature (45)..(45): Xaa can be any naturally occurring amino acid
  misc_feature (59)..(59): Xaa can be any naturally occurring amino acid
  misc_feature (91)..(91): Xaa can be any naturally occurring amino acid
  Homolog annotation: Hit_ID=AAL78216.1; Match level="QueryCoverage =100%, HitCoverage=30%, E-value=7e-39, Identity=83%"; Hit description= aspartic protease precursor Hgg-33 [Heterodera glycines]
  Coding regions on vcDNA: vcDNA=SeqID_90313; Strand=+; Position=1-312
VSWSLLHGVXCGPKSCWFCAGQRRKXKFQXASSARLRKGRRTLLXIIPTELTILISRWXGRFCNDGLKKIDFIYAIFSFIQFLIHDEAYEXTIFPSLIIVITM

SEQ ID NO: 163891 - protein, 123 aa, Heterodera glycines
  misc_feature (121)..(121): Xaa can be any naturally occurring amino acid
  Coding regions on vcDNA: vcDNA=SeqID_90314; Strand=-; Position=2-370
FWRLFTSSRALEMLLSKSSKHRRKTRKLRTNFSGASGQEGSVQKKDMTGNSIRKVLIHADQLERLYSAEWPQIICQTLGHLAKIQTFTSVFYLFFEFKNNFKAQHGIWGNWKTLLINSGHXRK

SEQ ID NO: 163892 - protein, 129 aa, Heterodera glycines
  Coding regions on vcDNA: vcDNA=SeqID_90315; Strand=-; Position=45-434
LISIRSVNPSIIGTEAFRLQMCMNSLDQVTVTSHEQIGKFRNIVDRLSKKFHLCLNTRRVSLATIVLQKSRNHIPGRNFEVRQLLALQLQTLDVFGQLVVLLNEFVRKRNDFVNGTHKHGIFFVIHLFK

SEQ ID NO: 163893 - protein, 254 aa, Heterodera glycines
  Homolog annotation: Hit_ID=NP_491504.1; Match level="QueryCoverage =46%, HitCoverage=29%, E-value=4e-34, Identity=63%"; Hit description =let-23 Fertility Effector/regulator LFE-2, 1D-myo-inositol -trisphosphate 3-kinase (45.2 kD) (lfe-2) [Caen
  Gene Ontology: Biological process=response to oxidative stress
  Coding regions on vcDNA: vcDNA=SeqID_90316; Strand=+; Position=99-860
MDRSKTNKGRRERQSLADISQEVISQILRLFPFSSSSLRVHFSPFSSSLLFRAKSTSSVQQLKKQQNIPSQSLCRAVINDNANVQIMDRIRRVASNLSLTAKGQRERRQNLALLWGRGEAKKAKNGEQKERTKEEGALSKLCKMSVDTMAITALPLDCWLKERLKNWVQLSGHEGTIVPASNHTLWKKQPRGNRAEAHAYEEIMRDSELCGITPKFYKEIAHNNETFIEIQDLLAQFPNTKSRAIMDIKIGTRT

SEQ ID NO: 163894 - protein, 97 aa, Heterodera glycines
  Homolog annotation: Hit_ID=CAE74333.1; Match level="QueryCoverage =72%, HitCoverage=96%, E-value=1e-15, Identity=59%"; Hit description =Hypothetical protein CBG22046 [Caenorhabditis briggsae]
  Coding regions on vcDNA: vcDNA=SeqID_90317; Strand=+; Position=2-295
FHVKPINYSCTCTLHFLDFFTTRTFRGNQRDLARERNLKKQQQQKKQEQGTSTEKRMERDAEAMRLKQQKAAAKKAEEEKANAQAPKVVKVDPLKGL

SEQ ID NO: 163895 - protein, 283 aa, Heterodera glycines
  Homolog annotation: Hit_ID=CAE63454.1; Match level="QueryCoverage =70%, HitCoverage=74%, E-value=1e-71, Identity=64%"; Hit description =Hypothetical protein CBG07915 [Caenorhabditis briggsae]
  Gene Ontology: Mol. function=farnesyltranstransferase activity; Cellular component=mitochondrial inner membrane; Biological process =heme biosynthesis
  Coding regions on vcDNA: vcDNA=SeqID_90318; Strand=+; Position=2-850
MLFLAYRATLCRNLRLSVVSKAANNVAEQGTSSVSGNKENLLNAYLQLSKCRLTALIACTSVSGFLMSPALSSAPSSLFFSCVVGTALLSASASTCNNVIERQHDKQMKRTRSRVLPVGRLTPIHALLFAGATGTAGLGILCLSCNHLTSALGFVNLALYAGAYTPMKRIHHSCTWIGAIVGAIPPLMGYSAATGHLDSAAFVLGALLFSWQFPHFNALSWNLRADYSAAGYKMMCVTNEGLCKRTTLRHSVALLCLCSFAAPFTHLTTWTFAFTSLPLNLSM

SEQ ID NO: 163896 - protein, 280 aa, Heterodera glycines
  Homolog annotation: Hit_ID=CAE58324.1; Match level="QueryCoverage =99%, HitCoverage=77%, E-value=7e-62, Identity=47%"; Hit description =Hypothetical protein CBG01437 [Caenorhabditis briggsae]
  Gene Ontology: Mol. function=oligosaccharyl transferase activity; Cellular component=endoplasmic reticulum membrane; Biological process=protein amino acid glycosylation
  Coding regions on vcDNA: vcDNA=SeqID_90319; Strand=+; Position=11-850
LAKMVSAIAQYFLAFLLSASVIAFFSFLLLTALSIFKPWTKRNKSHFVAPRFHFRPEEEEEANAQFPCLLTREETSWKGLQHSEPELYLSVIVPAKNEEKRLPRMLDECLKYLEKRAAKDSEFTYEVIVVDDGSTDGTADVAFSYARSHPLFILRLPKNVGKGGAVREGALCARGQFILFADADGASRFSDFRRLEKQMHSLCNGDVLPSSEPTDWTHPAIVVGSRAHLEEESMSRRSILRTVLMVGFHVLVWVFSGRSVRDTQCGFKLLSRAPAAKLFP

SEQ ID NO: 163897 - protein, 224 aa, Heterodera glycines
  Homolog annotation: Hit_ID=XP_213672.2; Match level="QueryCoverage =77%, HitCoverage=10%, E-value=4e-13, Identity=27%"; Hit description =similar to zinc finger protein 294 [Rattus norvegicus]
  Coding regions on vcDNA: vcDNA=SeqID_90320; Strand=+; Position=1-672
RRGPPELGIVWRTINISWHCHGVFKALLSFEFANYSRLNESEVDPLLLSWDVLMRFFGDLDVLSRVRFCDAIDVKTLSNALAHLFNSLSDPPGHKDAICVVSNVDELFAGPFHYKLVDRPFDREHFTSNLFFRTLATIPALFREWHGTLSKTEANTVNEYTQKYLSHLLIQRELRSLENMKRGRLEVRILSKVREIECTYRLEETTMTLTILLPENYPIKAPEV

SEQ ID NO: 163898 - protein, 200 aa, Heterodera glycines
  Homolog annotation: Hit_ID=CAE64381.1; Match level="QueryCoverage =86%, HitCoverage=35%, E-value=7e-46, Identity=51%"; Hit description =Hypothetical protein CBG09068 [Caenorhabditis briggsae]
  Gene Ontology: Mol. function=aminopeptidase activity; Cellular component=cytoplasm; Biological process=peptide metabolism
  Coding regions on vcDNA: vcDNA=SeqID_90321; Strand=+; Position=42-641
MSSHSSSVVVDNCCPPSQMTTSSSPAAFRSSALAFLQFLNKSVTPFHAVESVEAILKSANFVQKSEYDKLQIQPKDRFYVKKSETSIFAFAAGGAFKPSEAGVSIVVAHTDSPCLRIKPVSKKTSEQFLQVGVSLYGGGLWRTWFDRDLSTAGQVLFRESADADAPIRHKLVDLRRPLFHIPSLAIHLDSDPSKFELNKE

SEQ ID NO: 163899 - protein, 144 aa, Heterodera glycines
  Homolog annotation: Hit_ID=NP_508272.1; Match level="QueryCoverage =94%, HitCoverage=97%, E-value=1e-47, Identity=64%"; Hit description =spondyloepiphyseal dysplasia late (XC58) [Caenorhabditis elegans] gb|AAB52862.1| Hypothetical protein W05
  Gene Ontology: Cellular component=TRAPP; Biological process=ER to Golgi transport
  Coding regions on vcDNA: vcDNA=SeqID_90322; Strand=+; Position=1-435
GLCSTTSREYYFVIVGRQDQPLFEMDFPPKKREQQQETHHLLQFIAHAALDIVDEQTLRETQMYFKIVDKFNEWFVSAFVTASRIRFLMLHTQKNEDGIKQFFQEIYEMYIKFSMNPFYRQDTPIRSPSFEQKAAMYGRKFLGV

SEQ ID NO: 163900 - protein, 252 aa, Heterodera glycines
  Homolog annotation: Hit_ID=CAE56729.1; Match level="QueryCoverage =98%, HitCoverage=76%, E-value=7e-63, Identity=50%"; Hit description =Hypothetical protein CBG24516 [Caenorhabditis briggsae]
  Gene Ontology: Mol. function=protein binding; Cellular component =mitochondrion; Biological process=steroid metabolism
  Coding regions on vcDNA: vcDNA=SeqID_90323; Strand=+; Position=103-858
MKIQAGHRYEIGDQTGKTYIVTGATSGIGKTIATELAMKNAEVVMACRNRNKCLEVRRDIVLNTRNKKVFCRMCDLSDMESVHEFVRKMTKGKYDFKKIDGVILNAATKSKKYSTNKDGVETNLATNHLGSFLLVGLLLQKLLDQDGQSRIVFVGTDIATKNSLKLELGKLNTAKYTNKFLRSTEKLDIEKGKYDMHGAYKFSKLTQLVFARELAERLEGNNKIRAVVADPGGAKTNLNKDEPSQKFFLTRW

SEQ ID NO: 163901 - protein, 197 aa, Heterodera glycines
  misc_feature (142)..(142): Xaa can be any naturally occurring amino acid
  misc_feature (152)..(152): Xaa can be any naturally occurring amino acid
  misc_feature (185)..(185): Xaa can be any naturally occurring amino acid
  Homolog annotation: Hit_ID=CAE62157.1; Match level="QueryCoverage =68%, HitCoverage=27%, E-value=2e-35, Identity=55%"; Hit description =Hypothetical protein CBG06204 [Caenorhabditis briggsae]
  Coding regions on vcDNA: vcDNA=SeqID_90324; Strand=+; Position=68-661
MCGCPTSANVVHSSPEPPTEKSAELANSSISRSVGNISTSPAKGLACSLSVNQTFKLVGIGCCLTCITNFPSAFMHTSVNTAVMELNSYLNESYTNRGTQLTDQHFSLLRSAINSCWYAGQIVGALCSPRLCDKYGRKPALXLATAMMTLAXPLQMWAKLFPYPEVMVLRPLMASVFSPMGETGXIPFLQEISPTIL

SEQ ID NO: 163902 - protein, 140 aa, Heterodera glycines
  Coding regions on vcDNA: vcDNA=SeqID_90325; Strand=+; Position=1-423
ETRQQKSLRGRLGIGTYELATDEAPIGNKKSGSERCGGICIIDPTDLLPIERYIRLPSGVFRPVKVPTNAITPLLTSEVNDNSAAVATLTDGRLALFTTDHFDSIADDSATFLPFSTTLSSGMMLDCAMNSDGRLLCSDK

SEQ ID NO: 163903 - protein, 189 aa, Heterodera glycines
  Coding regions on vcDNA: vcDNA=SeqID_90326; Strand=+; Position=75-641
MVDSKAIRKAHCQVCNLDICSTARQRHVYMVHLKKKDLFKCPHCEYTNSNSVWEVQKHSRVQHGKDARPISQEEKHKLEIQMWSQLCFPEWKQKRKIEHGDSTEEETALKRRREGEGGAEVDDLLEGFGELLGHILQQQNEAKNNGQIAEEEGEEEDEQQQESGTTEEQTEEDEWRDNASPSDKAPTTA

SEQ ID NO: 163904 - protein, 338 aa, Heterodera glycines
  Homolog annotation: Hit_ID=NP_505633.1; Match level="QueryCoverage =95%, HitCoverage=79%, E-value=1e-60, Identity=39%"; Hit description =putative RNA binding protein with KH domain(s) family member (65.6 kD) (5K718) [Caenorhabditis elegans] e
  Gene Ontology: Mol. function=pre-mRNA splicing factor activity; Cellular component=nucleus; Biological process=transcription from Pol II promoter
  Coding regions on vcDNA: vcDNA=SeqID_90327; Strand=+; Position=2-1018
LLRGTNVGGGGGNASRSIGEVIVPRTSVGIIIGKGGETIKRLAAETGAKIQFRPDDPNLQERCAVIQGTPEQINRATQMISELVTRSSGGGGQQETFYMHVPANKTGLVIGKGGDTIKQISAETGAHVELSRDSPPNSTEKIFVIKVGDVAPGTPLPSFHGNAGITNATTPLAVGNPYGPTPHQAFSAAPAQQDPSAWTQYYNQQQAMAIAGGPPSQPASFGATPAQHYQTVPGTMQTAVSQAAQLHSTQMQQQQIHQQQQATIAQPQQAVSAGMGAVSSSGGPAINPQTGQPDYSAQWAEYYRTMGMHEQAALIEAQMKQTHAAAQAQRPQQQLYMQ

SEQ ID NO: 163905 - protein, 387 aa, Heterodera glycines
  Homolog annotation: Hit_ID=CAE70385.1; Match level="QueryCoverage =100%, HitCoverage=68%, E-value=1e-152, Identity=72%"; Hit description=Hypothetical protein CBG16947 [Caenorhabditis briggsae]
  Gene Ontology: Mol. function=pyruvate kinase activity; Cellular component=cytosol; Biological process=glycolysis
  Coding regions on vcDNA: vcDNA=SeqID_90328; Strand=+; Position=3-1163
FRQEQIMEKYPARNNLEHLAMLKCTEKPHIVRKTGIICTIGPVCRSVDMLVQMIENGMNVARMNFSHGDHEYHGGTIKNVREAAAKCTKKYNVAIALDTKGPEIRTGLLAGGGSAEILLAKDASIRLTTDPAFEKSGTAVNLYVDYKNITKVVTKGSRVYIDDGLLSLIVEEILGDDAAILCKVENGGKLGSRKGVNLPGISVDLPAVSEKDIKDLRFGVEQGVDIIFASFIRNANGIRTIREVLGEAGKNIKIIAKIENQEGEDNVDEIIAASDGVMVARGDLGIEIPAQKVFLAQKMMIAKCNMAGKPVITATHMLESMVNKPRPTRAEVNDVANAVLDSSDCVMLSGESTKGDYPGGSLKTMQQNLSGRTQTAIYRSQILHRRL

SEQ ID NO: 163906 - protein, 242 aa, Heterodera glycines
  Coding regions on vcDNA: vcDNA=SeqID_90329; Strand=+; Position=3-731
ALISAEEILDTKISFQESVRKIKKTHEEINRAFDMEKFDIIQRTMRMYFESEDSSDVFEGFLNVVKYVKSLTTEQLDISLVKLALLAFYEFQKLGIAQGQQIPFDLHIDKTLLLDALVPCFRLKTKYIEAISSVFHLKDREMVEVAIAQIKTLLENEVPKAVFWMDHLNLRDHFPFNTIVCKLILENQTALIYPFVGESQFRRNKLIHYLDNLLGLVLRNRRAEDEYEREIMKNQKQLEKVG

SEQ ID NO: 163907 - protein, 265 aa, Heterodera glycines
  Homolog annotation: Hit_ID=NP_608376.1; Match level="QueryCoverage =89%, HitCoverage=45%, E-value=1e-21, Identity=29%"; Hit description =CG9581-PA [Drosophila melanogaster] gb|AAF45368.1| CG9581-PA [Drosophila melanogaster] gb|AAL39309.1| GH1
  Coding regions on vcDNA: vcDNA=SeqID_90330; Strand=+; Position=24-818
MFKPKSLLRLFLIRKCVNYRSKTSFSGSEFIERRARLLELVGKARPDFDGKKPFALLLAKRRSFSAPDVPHVYRQCSHFRYLCGVDRPGYRLLIGPKESVLFCALQSAHQILWDGASPSDAQLMCASGVDQVLPLDEFDAYMAGTVRNGLLALDLPSMADHAADAPAQMKKMWKMLSDGVWTHVSLNEHVDTLRWRKSETEKAMMRRTCAVGGEALNAMVRECRKATNESHIVGFLEFECRRRGAHFLAYPPGVAGGSNANTIHY

SEQ ID NO: 163908 - protein, 235 aa, Heterodera glycines
  Homolog annotation: Hit_ID=NP_569117.1; Match level="QueryCoverage =92%, HitCoverage=54%, E-value=3e-70, Identity=58%"; Hit description =acetyl-Coenzyme A acyltransferase 2 (mitochondrial 3-oxoacyl -Coenzyme A thiolase) [Rattus norvegicus] emb
  Gene Ontology: Mol. function=3-oxoacyl-[acyl-carrier protein] reductase activity; Cellular component=mitochondrion; Biological process=ergosterol biosynthesis
  Coding regions on vcDNA: vcDNA=SeqID_90331; Strand=+; Position=57-764
MATKAGIFIVSAKRCAFGAFGGSLKNHTATDLGEIAAAAALKSSSIAAEHIDHVIFGNVIQSSKDAAYLARHIGLRVGVPVHVPAVTVNRLCGSGFEAIAQGGQQILAGDSKVVLAGGTESMSQAPFAVRGARFGTQLGAKIEFEDVLWQGLTDAHANMPMGITAENLGAKYNVTREEADAYAIRSQNRWRLANNAGYFKSEIVPVKLQGNARGKTVQGTNPRESTADKWQLKPF

SEQ ID NO: 163909 - protein, 138 aa, Heterodera glycines
  Coding regions on vcDNA: vcDNA=SeqID_90332; Strand=-; Position=1-414
MTMRYFSGRKRHQGVLCVFKKGFRISVSAGNKPSPACGPMDVILKASTGCAAFLLPYGKTAHSTFRLVRDVSLDRLPSIPLERFFPRRIREAQLIIIDEITMLHSTVIEVIDRVCKEFPIATLKALRKRPQGSGAETV

SEQ ID NO: 163910 - protein, 248 aa, Heterodera glycines
  misc_feature (204)..(204): Xaa can be any naturally occurring amino acid
  Homolog annotation: Hit_ID=NP_509934.1; Match level="QueryCoverage =99%, HitCoverage=22%, E-value=9e-87, Identity=61%"; Hit description =FERM domain (protein 4.1-ezrin-radixin-moesin) (frm-3) [Caenorhabditis elegans] emb|CAB10024.1| Hypotheti
  Gene Ontology: Mol. function=Rho guanyl-nucleotide exchange factor activity; Cellular component=cytoskeleton
  Coding regions on vcDNA: vcDNA=SeqID_90333; Strand=-; Position=1-744
FFPFRHKAAGQALFEELCRYLNLLESDYFGLEFIDSYGNRCWLDKDKSILRQIMVAQSDARFFFVVKFYTPNPAELEEEYTRYLFALQIRRDLSRGELICTNENTAALLVALIVQSECGDFSPLDYPDAGAYLAGTHFVPHQTPTFAQAVLEQHRRLIGMEPAEADFVLLETARRCDFYGLRLHPARDIEGTEVALAVAHMGIXVFHQMNCVTTFSWAKVRKLSFKRKRMMIKVHPDSFHSTKKQSNF

SEQ ID NO: 163911 - protein, 65 aa, Heterodera glycines
  Homolog annotation: Hit_ID=NP_611665.1; Match level="QueryCoverage =86%, HitCoverage=6%, E-value=3e-09, Identity=57%"; Hit description =CG10955-PA [Drosophila melanogaster] gb|AAF46837.1| CG10955-PA [Drosophila melanogaster]
  Coding regions on vcDNA: vcDNA=SeqID_90334; Strand=+; Position=12-206
MKTNKRQKVSSSEEEFDPNQKDEDYDLLMDDEEREKFDKMTEKEREIEIYKRLEQREIMKTREKI

SEQ ID NO: 163912 - protein, 255 aa, Heterodera glycines
  misc_feature (127)..(127): Xaa can be any naturally occurring amino acid
  Homolog annotation: Hit_ID=CAC33829.1; Match level="QueryCoverage =99%, HitCoverage=72%, E-value=4e-97, Identity=72%"; Hit description =annexin 2 [Globodera pallida]
  Gene Ontology: Mol. function=diphosphoinositol-polyphosphate diphosphatase activity; Cellular component=cytoplasm
  Coding regions on vcDNA: vcDNA=SeqID_90335; Strand=+; Position=52-817
MMSNATKNILGTPTIVDNVSFDPKVSANFLHKAIEEKRKDEIIHLLCTISNQQRQELAREFKQLFGEDLSAKLKKALSGDFEELILALLEPPAVYDAQQMHRAMSGLGTLEGRGHGMTLLQLAFVFXSVLIEILVTHSNRQIDEMKRVYEQLYGHPLEKDIVGDTSGAFQRLLVSLCNDSRDESWSSDPIRANMTARALFKESEVESGVNDVLFNQVLANENFIQLHLIFEEYQKVSGHPIEQAIQQQFSGDTRD

SEQ ID NO: 163913 - protein, 245 aa, Heterodera glycines
  Homolog annotation: Hit_ID=NP_741871.1; Match level="QueryCoverage =95%, HitCoverage=35%, E-value=1e-116, Identity=83%"; Hit description= protein kinase C (77.6 kD) (pkc-2) [Caenorhabditis elegans] gb|AAM51503.1| Protein kinase c protein 2, i
  Gene Ontology: Mol. function=protein kinase C activity; Cellular component=membrane fraction; Biological process=protein amino acid phosphorylation
  Coding regions on vcDNA: vcDNA=SeqID_90336; Strand=+; Position=1-738
GNFKEPVAVFYSAEIACGLFYLHSKGIIYRDLKLDNVMLERDGHIKITDFGMCKEGIQGDTTTKTFCGTPDYIAPEIILYQPYGKSVDWWAYGVLLFEMLAGQPPFDGEDEDELFTAITEHNVSYPKSMSKESVLICKGFLSKAPSKRLGCSADGERQVKEHCFFRRIDWHKIETRQVQPPFKPKIRSADDTSNFDSEFTGEAPKLTPVDRLFLMNLDQNEFKGFTFVNAEFTPQGENKTADKTI

SEQ ID NO: 163914 - protein, 144 aa, Heterodera glycines
  Coding regions on vcDNA: vcDNA=SeqID_90337; Strand=+; Position=319-750
ACLVRFPPPPPSLSPPFSRQTFWCHDPGTQTLRRPPTILSLRHSTQVASRPLLGSRQTLTESSAAPFRLSTIHHSSLPPADPLGSRQLNPSLSADHLRPPALITQLKSPAALLGSRQTLTESSAAHFRLSTIHHSSPSRQPPFQ

SEQ ID NO: 163915 - protein, 302 aa, Heterodera glycines
  Coding regions on vcDNA: vcDNA=SeqID_90338; Strand=+; Position=23-928
MDQNGEGGALLGTDKQSVFRDRDDDNIAQQQDSTNPISQNMVSPKKRWTSALRVVTAMARFRNMPRHPNNQQPADGATGNMNSVETGKCRTASSSFSGSSESVPNSGGRNYDEAHEKESESNIDPVYLALKEATEKYGNKAGKNRRFSQNIGCGGAGTGDSTTTPSSCSRNLSQASLLDSGTFSVSGDYGGIGISSNNASSTRLFVSGGSTSQLEGGLFSSAPNTASGRGDRIKLTEKMKSFSLDCAEPPSAADQHQQKHGIAGVYPNYRMKQLRSPRTHAESFDQCMKRSSSPAAATFFAG

SEQ ID NO: 163916 - protein, 198 aa, Heterodera glycines
  Homolog annotation: Hit_ID=CAE71263.1; Match level="QueryCoverage =98%, HitCoverage=43%, E-value=2e-19, Identity=29%"; Hit description =Hypothetical protein CBG18145 [Caenorhabditis briggsae]
  Gene Ontology: Cellular component=extracellular space
  Coding regions on vcDNA: vcDNA=SeqID_90339; Strand=+; Position=64-657
MEWYSGDVTTALNIYQEKKGILIVYVFSDDVNSTKFDQIWDSFDHSILDRVPYVAIRLAKDTEGANQFAQFFPTPVFPVCYFLGLNAQPLEVLTAVEQMTIERLNSSLAKAISLYNDQMKEQGFATDAVSFQSKSSENDSGKNTSENVPEPLNATSNDEKLEYYRKRLEEKHKEDAMKKEQEEREKEIMRRNEGKALA

SEQ ID NO: 163917 - protein, 233 aa, Heterodera glycines
  Homolog annotation: Hit_ID=XP_421149.1; Match level="QueryCoverage =96%, HitCoverage=28%, E-value=5e-23, Identity=25%"; Hit description =PREDICTED: similar to Spectrin beta chain, brain 4 (Spectrin, non -erythroid beta chain 4) (Beta-V spectri
  Gene Ontology: Mol. function=actin binding; Cellular component =membrane; Biological process=actin cytoskeleton organization and biogenesis
  Coding regions on vcDNA: vcDNA=SeqID_90340; Strand=-; Position=29-730
ELDCHSERVPNLIKTGHHLIGTGHICSKEIGEKCDQLEREWAKLTKCAALRGRAIGEALQREHFLFDTAEAENWLTEKQRHLILCRESLGTSEGAKKMLACANTLQNEIVPWRKAFGELRQRGEQLAKRGHESVAERMERVENQAKALEGMAKEAARGAGSVLAVRSFLADGAELEEWMEQQKQTTNIEECGNDLEQCEQLRTKFEEFRQSLRMGDERMAKVEELFRTHKPRR

SEQ ID NO: 163918 - protein, 289 aa, Heterodera glycines
  Coding regions on vcDNA: vcDNA=SeqID_90341; Strand=+; Position=2-871
SADDHQTASVLPRLFVLMAKSEDPAHLERASRMMEVGQSHWKALLKGEELSVRKCRQRPTAKSFSQLSSDSLNTSQFYQLIAKHFCEEFPQQICLGLFVLEKNAILDIFALIGAEWHIRRPFFQNLFSVLFNLQNEGDRQPIVDALVEFEFFASSTGGHSPSADELVFILSLLSDLFQQFATLKPLLLPRENVEKLFNLVFVRMLFQLISTQRKIPSDYFKAMKLFFSLQSVRNFYSENDLYTVRSLQQFLTAFWEHLEKGIPRWHRLHIDRQHWAVKVHNSKELGDEF

SEQ ID NO: 163919 - protein, 256 aa, Heterodera glycines
  Homolog annotation: Hit_ID=CAE59883.1; Match level="QueryCoverage =81%, HitCoverage=6%, E-value=4e-23, Identity=31%"; Hit description =Hypothetical protein CBG03363 [Caenorhabditis briggsae]
  Coding regions on vcDNA: vcDNA=SeqID_90342; Strand=+; Position=111-878
MTTAVSNTNAQQPNDATVPEGVDPAFLAALPEDMRQEVIRDHLLQQQISQADNTTARVDADVPPVERIAAIMGMEIPEGMDPAFLAALPDDIFHEVVRDHQRQQELARQRRAQIQAQQQEANHAMVRHPHIHHRHFAMPRFLSRSIRPHTHRELPSTSAAAATSSVERTVPLLDKESISTLLVLFLLDQEKFDTVRLQKLLKLICIHPGTCDFTIWALLSMFDGLDKFKSVDGSEAPADGGKFQFGWINELRLQNV

SEQ ID NO: 163920 - protein, 490 aa, Heterodera glycines
  Homolog annotation: Hit_ID=CAE61696.1; Match level="QueryCoverage =97%, HitCoverage=95%, E-value=0.0, Identity=74%"; Hit description =Hypothetical protein CBG05644 [Caenorhabditis briggsae]
  Gene Ontology: Mol. function=protein binding; Cellular component =cytoplasm; Biological process=protein amino acid phosphorylation
  Coding regions on vcDNA: vcDNA=SeqID_90343; Strand=+; Position=1-1473
VSLKAGGDLSVGCQWPGSKDEYELQDAIGVGATATVFKAFCKSKNEMCAIKSINLEKCQTSVDELSHEIQAMSLCSHPNVVNYYTSFVVGEELWVVMRLLNCGSMLDILKRKIKAIGKDQAAYGVLDEVIIATVLKEVLRGLEYFHNSGQIHRDIKAGNILLANDGTVQIADFGVSGWLAASGGDLSRQKVRHTFVGTPCWMAPEVMEQVSGYDFKADIWSFGILCIELATGTAPYHRYPPMKVLMLTLQNDPPSLETNADRKEQYKAYGKSFRTVIKDCLQKDPSKRPTASELLKYSFFKKAKDKSWLVHSLIENLGSAPSIPTIPKKVASGKLKKDKDGNWEFEYDTSDEENSPDPENATIQQSASGERPTVSRASSEGKGEEQMPPLQTLNLVLRVRNQQRELNDIKFDYSPNADSVDGIAHELVTAELIDGHDLVVVAANLQKLIDLAQKKAERRTITFALNSGVASNEIPDERSLTGFAQLSLLD

SEQ ID NO: 163921 - protein, 397 aa, Heterodera glycines
  Homolog annotation: Hit_ID=CAE74379.1; Match level="QueryCoverage =81%, HitCoverage=77%, E-value=1e-89, Identity=55%"; Hit description =Hypothetical protein CBG22107 [Caenorhabditis briggsae]
  Coding regions on vcDNA: vcDNA=SeqID_90344; Strand=+; Position=1-1191
EAVETVGTDGHRTSPPSWQEPSGHQPTSSASGAAHALPPSSSNRPIRSQRTPMKEIITLDDPTELDEFMARGEEQCIHAMRAFITQFSLRQTTVATMTGVSQPYISKLLNGNHRELSLRCRKNIYCWYLNCRRHPEKLAMFVQDPCTRLETSAEGELVPQRRERYVFRPVLLRVLETYFQKCPFPDIAKRVEIANACNAHLQVDKRGVQLMPKEVVTPQVIANWFANKRKEMRRRMGGTEAGRSRLNSLSAGRSNSPSSPNSAAHSREGPFELRQNNQQSGNVDEAVLAHCEQLQAMPMSVPTASNQQQMLLISDQPESVPSAADLALVLPPLGPPHHPNCCPPATPLLPPNVVQFCPSVDQQLLHLLQAQPVANQLLFLQQLLVGTSSADNDYLKQ

SEQ ID NO: 163922 - protein, 115 aa, Heterodera glycines
  Homolog annotation: Hit_ID=AAQ65559.1; Match level="QueryCoverage =93%, HitCoverage=15%, E-value=3e-19, Identity=44%"; Hit description =ATP-dependent DNA helicase RecG [Porphyromonas gingivalis W83] ref|NP_904660.1| ATP-dependent DNA helicase
  Coding regions on vcDNA: vcDNA=SeqID_90345; Strand=-; Position=3-347
MVDDFLSKEITLLEGIGLDKAQLLKEELGIHTFKDLLEYYPFRYEDKKTLFTVSTIASAPASTGIPLQGYIRNVQKIGRGKKRLTACFQDSTGQLELVWFQNFSWIIKKIKPKDI

SEQ ID NO: 163923 - protein, 256 aa, Heterodera glycines
  Homolog annotation: Hit_ID=CAE73007.1; Match level="QueryCoverage =92%, HitCoverage=35%, E-value=1e-104, Identity=75%"; Hit description= Hypothetical protein CBG20362 [Caenorhabditis briggsae]
  Gene Ontology: Mol. function=calmodulin-dependent cyclic-nucleotide phosphodiesterase activity; Biological process=apoptosis
  Coding regions on vcDNA: vcDNA=SeqID_90346; Strand=+; Position=41-808
MMIIGDQYGFYQLVLRKHACRLRYILHQLNGGQLSLEDLKRNIEYAALVLETAYMDETRRICDEDDDLAEVTPEAVPDEVREWLTATFTRQTVQSRKEKPKFKSVANAIRTGIFFEKIYRRTQSVLAPIPHEYLPFLRQVNNWNFDSFDLNEATNGNSLKYIGFELFNRYGFFERFKVNVQVLENFLLALELGYSKHNNPYHNTIHAADVTQTSHWMLSQTGLASTLTDLEILGVLFGALIHDYEHTGHTNNFHIQ

SEQ ID NO: 163924 - protein, 322 aa, Heterodera glycines
  Homolog annotation: Hit_ID=NP_502691.1; Match level="QueryCoverage =100%, HitCoverage=64%, E-value=6e-56, Identity=39%"; Hit description= selenium binding protein like (52.4 kD) (4O819) [Caenorhabditis elegans] emb|CAA19490.1| Hypothetical pr
  Coding regions on vcDNA: vcDNA=SeqID_90347; Strand=+; Position=40-1005
MFVALPNCSSPRNPLATYPDCIASLDINPDSQTYGKLISVLEMPNEGDELNNLCCCSSDRLIVTSIGSGRIYVVDTSDPKELKLEKTIEPSTLTSLGVSCPGRVCCASDSVIVGTMGDDRMENNGNFLLLDRLTFEPIGFWAEKEGQKGTKFGGTDFCIQTKQNVLLSVGWGTPAKFRGGLRPRDVTNGHYSNEVNVWEWRQRRLIQTIALEADCGWMPMAVRFLHNADKCHAFVCTLLGSAIYHLWREEGEESFRHCLAAHIPPKKVDGWQCPSFVPQFVQDLLVSMNWALPKMPAFISDLVISSDDRFLFSSNWLHGDVR

SEQ ID NO: 163925 - protein, 39 aa, Heterodera glycines
  Coding regions on vcDNA: vcDNA=SeqID_90348; Strand=+; Position=501-620
MRIERARFDEVLVSQKKKSKHLKIYKKFKNENSCEIFWK

SEQ ID NO: 163926 - protein, 384 aa, Heterodera glycines
  Coding regions on vcDNA: vcDNA=SeqID_90349; Strand=+; Position=32-1183
MIILSLKLLTLPVLLSILLCIAKGQSVEELCEKHENEFNELFVEKKGGAVPEVLWEESLEKKEDKEEEKERLEEQKKTEKAKEKDANAKNVSWLRTLLGNYLCQKLRKKDGEQKKSQNVPKKLSSKTPKVSVPLITKKDTDDKSDKRYEAKFAVKSEEEIFEKIRDKFNISDEQLLLSLSELVPLNGRGGSGGVFYKTKDDKFILKSLNPDHDEPAKIDEVLDNYSKHVLGQQPEKGKQSTDSRSMMNTFFMYFEMNVYAKLKEGKGKERKKKLRLHMLQFVVLNNVFEGIDEQTLLKFDIKGTFAPGSAVQHDQKQKWYTGETGWQKSLYREYDFIGISREGREISAFFPEGIQLLPEAYRQLADGVKNDTSYLTENGVNDYS

SEQ ID NO: 163927 - protein, 217 aa, Heterodera glycines
  misc_feature (213)..(213): Xaa can be any naturally occurring amino acid
  Homolog annotation: Hit_ID=CAE61812.1; Match level="QueryCoverage =94%, HitCoverage=6%, E-value=2e-48, Identity=47%"; Hit description =Hypothetical protein CBG05779 [Caenorhabditis briggsae]
  Gene Ontology: Mol. function=ubiquitin-protein ligase activity; Cellular component=cytoplasm; Biological process=embryogenesis and morphogenesis
  Coding regions on vcDNA: vcDNA=SeqID_90350; Strand=+; Position=15-665
MTNNLDETNPLVEQALNVIKILHELSRSISNFDQIIGVEVTFPTLPEESFHSTKLSQKLCQELTDPLVVSAKALPNWCNYLVHNFPCLFSMDIRTSFMNTTAFGTSRAIAYLQSRRDHLLDQNRSATSSAASNMAGLRREDHYPEYRIGRVKHERIKVHRSAELFLENAVKVLKFHALRKAILEIEYFGEEGTGLGPTLEFFSLVAAEFQRRXLCMW

SEQ ID NO: 163928 - protein, 95 aa, Heterodera glycines
  Homolog annotation: Hit_ID=EAL17841.1; Match level="QueryCoverage =96%, HitCoverage=39%, E-value=5e-16, Identity=44%"; Hit description =hypothetical protein CNBL1030 [Cryptococcus neoformans var. neoformans B-3501A]
  Gene Ontology: Mol. function=general RNA polymerase II transcription factor activity; Cellular component=transcription factor TFIID complex; Biological process=transcription from Pol I promoter
  Coding regions on vcDNA: vcDNA=SeqID_90351; Strand=+; Position=1-288
YEARIHQFAVKNLIATADVGFHIRLGPLSDFLGAKCCSFTPELFPGLVYRNQNPKISIIVFSSGKLNLTGSRSKEEIDFVFNQFYQIICNFKYSP

SEQ ID NO: 163929 - protein, 116 aa, Heterodera glycines
  Coding regions on vcDNA: vcDNA=SeqID_90352; Strand=-; Position=3-350
RTTASSITTTAVSSSIVSTSSSGERGADNERGESGDGLSGPSSSASSAVAKVSSHSMMAFPSQSSPTDSSTKSNSKRSVNSFSSAFSFICFGDDASVLTFADIFNGKAMGTFNQTE

SEQ ID NO: 163930 - protein, 253 aa, Heterodera glycines
  Homolog annotation: Hit_ID=CAE59783.1; Match level="QueryCoverage =57%, HitCoverage=31%, E-value=2e-15, Identity=35%"; Hit description =Hypothetical protein CBG03235 [Caenorhabditis briggsae]
  Gene Ontology: Mol. function=microtubule binding; Cellular component =nucleus; Biological process=mitosis
  Coding regions on vcDNA: vcDNA=SeqID_90353; Strand=+; Position=57-815
IKTQKGHLSNRGFGFIQMADLEAQKRVLKHKVCVSIAFFDLIILLQFPLQSHIIGDRECQVKVPFSKNALSSKIFVGRLQEGVTPIELKKRFMEEAQRIDPDSSVTDVYIPRPFRSFAFVTFSTPIVAKELIKIGQVDFKDTSVSISSAHSTRPQDSTVHSVHHHSSFIPPHPHNFVPEDDSYSTSELYSNYGTNTKWEFDEMASMAMPKHQLITSTPGIQQSRTAGPMFSGSVQQHLNQPFSAHNQQHPPIA

SEQ ID NO: 163931 - protein, 260 aa, Heterodera glycines
  Homolog annotation: Hit_ID=NP_506599.1; Match level="QueryCoverage =80%, HitCoverage=45%, E-value=3e-79, Identity=64%"; Hit description =histone deacetylase, abnormal GONad development GON-10 (52.1 kD) (hda-1) [Caenorhabditis elegans] emb|CAB
  Gene Ontology: Mol. function=apoptosis inhibitor activity; Cellular component=cytoplasm; Biological process=chromatin modification
  Coding regions on vcDNA: vcDNA=SeqID_90354; Strand=+; Position=2-784
PSIYGITDETYQLIFQPIMRKVMEVFQPSAVVLQCGADSLNGDRLGPFNLTLKGHGKCVKFFRDCNLPLMLLGGGGYTPRNVARCWTYETSLAVDIDISDELPYNDYFEYFAPNYRLHIDASNETNHNTEEYLRTVQNSVLENLSNLSHVPSVQMQPIPRDGMQIDESVEHDRANPDRRLPAEVSDHMTAHPGEFYEGENEGEDRRNRQEYKRRGGNTTGEPSDSREDKQDNSKRIKIEKQPKAEQQEDGELLEEDANTN

SEQ ID NO: 163932 - protein, 235 aa, Heterodera glycines
  Homolog annotation: Hit_ID=CAE70389.1; Match level="QueryCoverage =88%, HitCoverage=61%, E-value=1e-103, Identity=76%"; Hit description= Hypothetical protein CBG16954 [Caenorhabditis briggsae]
  Gene Ontology: Biological process=establishment of ommatidial polarity (sensu Drosophila)
  Coding regions on vcDNA: vcDNA=SeqID_90355; Strand=+; Position=619 -1323
KSRNTCLRLAITNRIRIFNHFCRLFYQLPNHMIPRLNSIGEKNREKQLMIQLPRQDLSIAYCKHLKTPQERRLYDEFVNARNEVALDIGFINSNVPKAMECRKCRGVIERNEMAIIAPKLGESTGWHAACFTCNTCDQLLVDLTYCVRDEKVFCERHFAELHKPRCSACDELIFAGEYTKAMNKDWHGDHFCCWQCDSQLTGQRYILRDDHPYCIKCYEEIFANVCDECQKHIGI

SEQ ID NO: 163933 - protein, 270 aa, Heterodera glycines
  Coding regions on vcDNA: vcDNA=SeqID_90356; Strand=+; Position=2-811
LRDCYVIFLSKFLCLENDKKISVNNRSLPQQNDTFLQIEQCVREMLLEKESRRDLFHCSLRPALGHFVALLLHSFGNDSDVNLRLRSGEFLCLLTQLDFADESADFVAFVLPGVFSGCRQILLNVLPNLHSIDLVRCACELVTNSICISFSKINVTDCLSVSVGKCVKSPSSENVLSFRRDSNWLQTAAQRILPQICSLLSHLSAHSVDSVRYESANILSKIQRQIPSDYFGSSFVKMTIDVSLLLYSDTMPKTRHLAHRIIDDVRLQQK

SEQ ID NO: 163934 - protein, 222 aa, Heterodera glycines
  Homolog annotation: Hit_ID=CAE72569.1; Match level="QueryCoverage =98%, HitCoverage=13%, E-value=1e-45, Identity=44%"; Hit description =Hypothetical protein CBG19756 [Caenorhabditis briggsae]
  Gene Ontology: Mol. function=protein carrier activity; Biological process=intracellular protein transport
  Coding regions on vcDNA: vcDNA=SeqID_90357; Strand=+; Position=5-670
MKSGYQRELTYRRPDNSFSAFGESDQHGSTWLTAFVLRSFKQAQAYIFVDDRVLEDSIAFLISQQLDNGAFVERGEVHHKLMQGGASEGGFTLTAYVLIALVENHVQNKVTELARSYLESHLTDFKEDPYALEVCTYVLHLTNSPKKGDVLKMLEGLQITGATDGMVHWTTKVSNGAKDGTGGAAKNGGGAARDTNQYFFQPQPADVEMSAYALLTYMLLDN

SEQ ID NO: 163935 - protein, 144 aa, Heterodera glycines
  misc_feature (42)..(42): Xaa can be any naturally occurring amino acid
  misc_feature (114)..(114): Xaa can be any naturally occurring amino acid
  Homolog annotation: Hit_ID=NP_509098.1; Match level="QueryCoverage =90%, HitCoverage=95%, E-value=6e-31, Identity=50%"; Hit description =esophageal gland cell secretory protein 11 like family member (XH131) [Caenorhabditis elegans] gb|AAA8319
  Coding regions on vcDNA: vcDNA=SeqID_90358; Strand=+; Position=660 -1090
MSKVLSPAFRWRHLSLITFALLIAAHSLLAFRTQSAGARGQXLCGGRPARGVLVKLFDEDDGPDPDDELDTVYTDLDGRFEVSGSTMELTNIDPELRIYHDCNMHIPLCKRRMXVLAFPDKYIASGTLAKKLMNLGSVELEAEL

SEQ ID NO: 163936 - protein, 244 aa, Heterodera glycines
  Coding regions on vcDNA: vcDNA=SeqID_90359; Strand=+; Position=13-744
ISHFIRGLFSPFRAQITFCVSLLKLPTYNKMPMPSFPSASSPCTSSSSSSRSVDEHPLQSSSSSPLSSPFSATMPSTPFKQSTFGTSYKSTTKGQNAKKEMPLAKDKKAVGGADKERQLDEQSEFCGIFCPRSFGRAIGKFLDFVMGSAHSSANPSSSVSSCSSPTNFREKHTPDSLEDKIELIFELLEKKPTRLGYSIQWAVQLLANATEEEKLEMLRCRVLSRICALITRYSNVEVAAPPGT

SEQ ID NO: 163937 - protein, 209 aa, Heterodera glycines
  Homolog annotation: Hit_ID=NP_492659.1; Match level="QueryCoverage =95%, HitCoverage=98%, E-value=4e-33, Identity=38%"; Hit description =putative protein (24.8 kD) (1K653) [Caenorhabditis elegans] emb|CAB05896.1| Hypothetical protein B0379.1
  Coding regions on vcDNA: vcDNA=SeqID_90360; Strand=+; Position=86-715
MDSLNREIKDRVRDSHWLGSYGDSPHATFSDIVMRSFDEVKKSGRNASACRFYDMYHPEIGILRKSKSYSALAPTNAMRLKDRLVAPDLRPFHPYKPKRNEWKTELEKLHHGTHAKLNIAPSPFLPPLPPTSRRPFQVPADATRFENFCMYWGGRARGLDYSEPFLYEPQRDNYSIMEDRRYHRLYWAQHMIPSQPSARHGRQIMLSAY

SEQ ID NO: 163938 - protein, 138 aa, Heterodera glycines
  Homolog annotation: Hit_ID=NP_501697.1; Match level="QueryCoverage =89%, HitCoverage=5%, E-value=2e-17, Identity=37%"; Hit description =predicted CDS, integrase, catalytic domain containing protein family member (4K310) [Caenorhabditis elegan
  Coding regions on vcDNA: vcDNA=SeqID_90361; Strand=-; Position=1-414
MLTSTFPFIHFCCCPSLNSCLFRGPVLLPDLAGMLLRFRCVVSSPFILAATLRHHLQQFDSPLSREISESIYVDNVLIECETVQEALEKYKFSKDFLQQGCFNLREFISNSKVLMKQIPQEDQLDKPKAKVLGLPWDT

SEQ ID NO: 163939 - protein, 270 aa, Heterodera glycines
  Homolog annotation: Hit_ID=XP_217194.2; Match level="QueryCoverage =77%, HitCoverage=16%, E-value=3e-20, Identity=34%"; Hit description =similar to hypothetical protein MGC38960 [Rattus norvegicus]
  Coding regions on vcDNA: vcDNA=SeqID_90362; Strand=+; Position=488 -1297
MPILRPNKKNGPSLDELHLADGIGAECFADGTHGERRRTSRHQIPSVSMEKSNLPSNKNTWRTPSRLICNFEESILNGRIPANSVVSGFRLQLTVIGNGVSTDNRLSFPASKRLTLPVLTYFFNDLMSQHSGRFPVAVPPSPLHLARCELAAETVPIPKRCTLQIVLLRPCGSVVKLFMVAVNVLDMPSNSRTFIRQRVFSGDSAKGTGEKERSGNENKTGGSTNVPNAKPCSNSLRFLIHLRLASDSSGKVYLHSDIRILFSNKSKDLE

SEQ ID NO: 163940 - protein, 232 aa, Heterodera glycines
  Homolog annotation: Hit_ID=NP_956279.1; Match level="QueryCoverage =86%, HitCoverage=43%, E-value=1e-40, Identity=46%"; Hit description =Similar to DNA segment on chromosome 10 (unique) 170 [Danio rerio] gb|AAH65606.1| Similar to DNA segment
  Gene Ontology: Mol. function=transporter activity; Cellular component= Golgi transport complex; Biological process=intra-Golgi transport
  Coding regions on vcDNA: vcDNA=SeqID_90363; Strand=+; Position=46-744
MLSTADDLSASSSSSAASLESKDYWVKKCLDLAAAKNAAEARVEQLKQRNAELELENRQIRESKVRMQVRVEQEEEYISNMLLKRIQKLKTDKEQLAQKYEQEEEYLINDLMRKLTQLEGERDELANRLSTDQSWVVANLLQKIRKLEAEIQNNHKSLEQLRREKVDLENSLEHEQEALFNTLGKRMDSLEAEKRRLQGRLDELEGGGTAATVATTTTTVADGGGGVPTNAA

SEQ ID NO: 163941 - protein, 88 aa, Heterodera glycines
  Homolog annotation: Hit_ID=AAG00551.1; Match level="QueryCoverage =89%, HitCoverage=34%, E-value=2e-11, Identity=48%"; Hit description =retinitis pigmentosa GTPase regulator [Homo sapiens]
  Coding regions on vcDNA: vcDNA=SeqID_90364; Strand=-; Position=178-444
SRSWSRKVRGIGKDEKEEKLEGKSADEEGEEEEKPEGNGAGEEEKPEGNGAEVDGEEEEKSDGNGAGEEEKPEGNGAEGGGVEGTNGG

SEQ ID NO: 163942 - protein, 111 aa, Heterodera glycines
  Homolog annotation: Hit_ID=NP_778174.1; Match level="QueryCoverage =83%, HitCoverage=92%, E-value=4e-12, Identity=34%"; Hit description =e(y)2 protein [Mus musculus] ref|NP_064574.1| e(y)2 protein [Homo sapiens] gb|AAH48361.1| E(y)2 protein [
  Coding regions on vcDNA: vcDNA=SeqID_90365; Strand=+; Position=14-349
MQGSSARSFLNPKKKLQRKEDLEKEFVESGEKDRVQEVVERRLHESGWAKRVESMCEEYIAKKGYERVELQAMVDELKDASRRIVPDEVKRELMQLIQEFVNSRTSTGEGW

SEQ ID NO: 163943 - protein, 85 aa, Heterodera glycines
  Homolog annotation: Hit_ID=CAE74118.1; Match level="QueryCoverage =68%, HitCoverage=93%, E-value=2e-17, Identity=68%"; Hit description =Hypothetical protein CBG21781 [Caenorhabditis briggsae]
  Coding regions on vcDNA: vcDNA=SeqID_90366; Strand=+; Position=2-259
ALTVPFYGQCSDNPHHQSFGGGTAPTRASTGGGIGTVSLGTVTYICGDCHKENEIRPKDPIRCRECGYRILYKKRSRKMMVYDAR

SEQ ID NO: 163944 - protein, 86 aa, Heterodera glycines
  Homolog annotation: Hit_ID=CAE71709.1; Match level="QueryCoverage =96%, HitCoverage=98%, E-value=1e-25, Identity=66%"; Hit description =Hypothetical protein CBG18686 [Caenorhabditis briggsae]
  Gene Ontology: Mol. function=RNA binding; Cellular component=nucleus; Biological process=mRNA cleavage
  Coding regions on vcDNA: vcDNA=SeqID_90367; Strand=+; Position=62-322
MASTGFSVYVGNIPYNTTEADIGSMFSSCGVVTNVRIVYDRETNRPKGFAFCEFQDQQGAQNAVTNMNGIELNGRPLRVNWANTNK

SEQ ID NO: 163945 - protein, 255 aa, Heterodera glycines
  Coding regions on vcDNA: vcDNA=SeqID_90368; Strand=+; Position=73-837
PLRPGDFCTSAINERLANSLLAYEMDADSFLLFYIKQRIERGEDGLQWYNPPYCGEDEEGHVPDNWRTIQQAVLYFEKDNSDEIEHQLIDQLVQHSAVKFSAFKYLVDAYFGLLQRRIERKADNFGCPSVTNLCVPFLAMIAFTGLFARRLAEMDASARVTEEQQDRRDFRREIYQVSIYGSTMLRYKLYTFANNEDSTAAYSWDRFCADSLQLVEHISSLKERETSIALPSASPLLGVVLCGIAAAAVVYFLIA

SEQ ID NO: 163946 - protein, 274 aa, Heterodera glycines
  Homolog annotation: Hit_ID=CAE72597.1; Match level="QueryCoverage =97%, HitCoverage=91%, E-value=1e-107, Identity=69%"; Hit description= Hypothetical protein CBG19786 [Caenorhabditis briggsae]
  Gene Ontology: Mol. function=chloride channel activity; Cellular component=nuclear membrane; Biological process=chloride transport
  Coding regions on vcDNA: vcDNA=SeqID_90369; Strand=+; Position=41-865
MSAKPLLELYVKASGIDSRRIGACLFCQEFWMELYALYEVGCVRVEVKTVNVNSEGYKKHFSGAQPPIMVEQDKGTANADNTDIERRIFQLCNEFHVPLFEKDPEVAKTIQDLYRNFKIFLQAKTNLDKGKQQPSSIEGLPPQVASSHSKLVEQLANINQLLAERGNTRYLLGETMTEYDCELMPRLHHLRVVGERLLGFTIPHQLTHLWNYVLTSYRTAAFIESCPADQDILHHYKEQLNLSIDVRVTLEAATKTLTIPEGVLNDIRRITNGN

SEQ ID NO: 163947 - protein, 254 aa, Heterodera glycines
  Homolog annotation: Hit_ID=BAC67663.1; Match level="QueryCoverage =100%, HitCoverage=77%, E-value=1e-116, Identity=81%"; Hit description=elongation factor-1alpha [Pleodorina sp. 2000-602-P14]
  Gene Ontology: Mol. function=translation factor activity, nucleic acid binding
  Coding regions on vcDNA: vcDNA=SeqID_90370; Strand=+; Position=60-821
MSQGKPHLSIVICGHVDSGKSTTTGRLLFELGGIPEREMEKLRAEADALGKSSFAFAFYMDRQKEERARGVTIACTTKEFFTDKWHYTIIDAPGHRDFIKNMISGAAQADVALLMVPADGNFTTAIQKGDHKAGEIQGQTRQHARLLNLLGVKQLIVGVNKMDSDPAGPYKKERYDEISAEMKDMLIKTGWKKEFVEQSVPVIPISGWMGDNLLKQSTNMTWWKGQEVVHPNGSKHTIVTLLNALNEFADLPSR

SEQ ID NO: 163948 - protein, 154 aa, Heterodera glycines
  Homolog annotation: Hit_ID=AAG21338.1; Match level="QueryCoverage =23%, HitCoverage=43%, E-value=1e-13, Identity=86%"; Hit description =hypothetical esophageal gland cell secretory protein 9 [Heterodera glycines]
  Gene Ontology: Mol. function=chaperone activity; Cellular component =nucleolus; Biological process=nucleocytoplasmic transport
  Coding regions on vcDNA: vcDNA=SeqID_90371; Strand=+; Position=2-466
FVEGSCTTCGYTSYHLERAAPAPPPPPPPPPPPAPVYSQSSYSSCSTCGGSSYSSYPSSSYSSYPASSSSYSSYPASSSSYSSYPASSSSYSSYPSYSSSSSCSTCGLSGYSNSWNNGGSSSNTWSSGGSSMSAGNGGGYGYGGGSCSVCGKRK

SEQ ID NO: 163949 - protein, 165 aa, Heterodera glycines
  Homolog annotation: Hit_ID=NP_497227.1; Match level="QueryCoverage =84%, HitCoverage=77%, E-value=1e-50, Identity=66%"; Hit description =cysteine-rich hydrophobic protein similar to CHIC1 and CHIC2 (19.8 kD) (3B256) [Caenorhabditis elegans] g
  Coding regions on vcDNA: vcDNA=SeqID_90372; Strand=+; Position=67-564
MEVGIERMESDENLENLPKVDWTITPEPIVIRGVGHLTLFGLNSHFPTEFPSALIGKLAPEEFDDTLRRVNYVLQRNVSRNLRWLICGLLFCCCSFGISLWPVVCLNRRTISALEKTLDHENQQLYDKLGLHWKLARLPVEPSNRLTEYVLLLETLPRIPLSMPD

SEQ ID NO: 163950 - protein, 242 aa, Heterodera glycines
  Homolog annotation: Hit_ID=NP_741153.1; Match level="QueryCoverage =99%, HitCoverage=51%, E-value=3e-78, Identity=60%"; Hit description =chaperonin Containing TCP-1 (58.9 kD) (cct-6) [Caenorhabditis elegans] gb|AAC46642.1| Chaperonin containi
  Gene Ontology: Mol. function=chaperone activity; Cellular component =actin filament; Biological process=protein folding
  Coding regions on vcDNA: vcDNA=SeqID_90373; Strand=+; Position=2-925
VSLQAEREYITRRVLTFVELKETVCAGGDQGFVVINQKGIDPPSLDLLAQHGILALRRAKRRNMERLQLACGGEAVNSVDDLTPDVLGWAGSVYEHVLGEDKYTFVEECTNALKDGAVLPGAGAFEIAGYCALKKLADNVKGRAKLGVLAFAEALLVIPKTLAVNAGFDAQEAIVKLVETFSAAGELVVLDLESGEPCVPQVVWDNVCVKQASLNACQNIASNLLEVDEVMRAGMRDLKGGQ

SEQ ID NO: 163951 - protein, 238 aa, Heterodera glycines
  misc_feature (16)..(16): Xaa can be any naturally occurring amino acid
  Homolog annotation: Hit_ID=CAE68996.1; Match level="QueryCoverage =73%, HitCoverage=38%, E-value=1e-36, Identity=48%"; Hit description =Hypothetical protein CBG14983 [Caenorhabditis briggsae]
  Gene Ontology: Mol. function=snRNA binding; Cellular component =nucleolus; Biological process=growth
  Coding regions on vcDNA: vcDNA=SeqID_90374; Strand=+; Position=1-715
FVKGAGSLMALAKCPXKTVQILGAEKALFRALKTKKDTPKYGIIYHAQLVTQAGQKSKGKIARKLAAKVSLATRVDALCDESLGNGQGIEARVYIEQAIKKADARGGPKKQRFSGVKQAPKGAYTFKKGEVHHYDAKFDMTLKKGTEQAEEPQQEEQQSGKSKKGDQTKWRSEGETGGRGGRNGKNTQQKGKGAKRRSNWKKTAGGRGGTQPRKRQGKKAGPTPQKSRQEGPKNKTTK

SEQ ID NO: 163952 - protein, 276 aa, Heterodera glycines
  Homolog annotation: Hit_ID=NP_999822.1; Match level="QueryCoverage =91%, HitCoverage=62%, E-value=7e-22, Identity=32%"; Hit description =Nf-Y-A subunit [Strongylocentrotus purpuratus] gb|AAC37172.1| Nf-Y-A subunit prf||1922373A CCAAT-binding
  Gene Ontology: Mol. function=transcriptional activator activity; Cellular component=CCAAT-binding factor complex; Biological process =transcription from Pol II promoter
  Coding regions on vcDNA: vcDNA=SeqID_90375; Strand=+; Position=20-847
MASVANSTNSLCSQSLALPQKIRISAHGKEDQQQKRQQIPPSGPVEDGAYKISQQQHFVLHLPAESASFDSTGQQTLAVDASSSDSVPLFYLFDQQQNHPLFSAGISSPSAVQHSQTVPVQLLDVNDETVVPVNGAVIPSPSFIQLSNDNRPLLQMSNGQTIELVSANGFHFSDGVQNVEEVSSEGTSSSCGGSRLTHNYPPTTLLSTAKVFSPQQSEPVYVNEKQYARILKRRAARAKLEMEGRIPKQRRKYLHESRHRHAQNRARRAGGKFDSG

SEQ ID NO: 163953 - protein, 176 aa, Heterodera glycines
  Homolog annotation: Hit_ID=CAE56164.1; Match level="QueryCoverage =58%, HitCoverage=53%, E-value=1e-18, Identity=40%"; Hit description =Hypothetical protein CBG23784 [Caenorhabditis briggsae]
  Coding regions on vcDNA: vcDNA=SeqID_90376; Strand=+; Position=33-563
MALSILALLCLALAHFGTGQEKKTEPLDHKWTCGTTWKYENTGLTVSWSLPEFLAETSVDVDCPSRKNRMNNCCFDHDDCYSKQLGQTKCDDVFCDCLERATKGSSRCETYEGPGFCHLVRTYGASAYRASAPPFWSSCGTVLNSAKYLGCPCGTYKTWERCGFLYMGYRYLCYAC

SEQ ID NO: 163954 - protein, 229 aa, Heterodera glycines
  Homolog annotation: Hit_ID=EAL22901.1; Match level="QueryCoverage =77%, HitCoverage=52%, E-value=2e-42, Identity=48%"; Hit description =hypothetical protein CNBA6700 [Cryptococcus neoformans var. neoformans B-3501A]
  Gene Ontology: Biological process=mRNA splicing
  Coding regions on vcDNA: vcDNA=SeqID_90377; Strand=+; Position=69-755
MSMSSTSAASASATDAEAQVEFPIVCEPCLGTNPYMRMTRQPQGAQCKSCSRPFTTFRWSPGPGQRTRRTEICTSCAKLKNACQSCILDLEFGLSTRVRDAVLGLDSGANTSNDHNRQWLLRAAEQNLAKTGSGMVDYGKVESVAKETMRKMAKEAASPYGGGSGGSKRPPICSLWLKGKCPRGKECSYRHELPKNKEKLAEFLAKHQSTSPASTPAPLAPAAPGARAI

SEQ ID NO: 163955 - protein, 150 aa, Heterodera glycines
  misc_feature (73)..(73): Xaa can be any naturally occurring amino acid
  Homolog annotation: Hit_ID=NP_493364.1; Match level="QueryCoverage =91%, HitCoverage=27%, E-value=9e-36, Identity=51%"; Hit description =mitochondrial substrate carrier (55.1 kD) (1O25) [Caenorhabditis elegans] emb|CAA21607.2| Hypothetical pr
  Coding regions on vcDNA: vcDNA=SeqID_90378; Strand=+; Position=26-476
MIASNSAGAPYRGDPMASAALGFSNFVNGALIRHPFVVLRRQCQVHDHATPKHLTPITLLPVVVNLAGKDGTXRFWKGAIGSGVLWVVSHASEFLIAQLFNLPKSFVPQGSSERFWRHVFLKTASFLACTPFIGSSFIETVRSGGRLSDE

SEQ ID NO: 163956 - protein, 234 aa, Heterodera glycines
  Homolog annotation: Hit_ID=NP_510647.1; Match level="QueryCoverage =98%, HitCoverage=54%, E-value=4e-84, Identity=62%"; Hit description =serum and Glucocorticoid inducible kinase homolog (sgk-1) [Caenorhabditis elegans] emb|CAB03485.1| Hypoth
  Gene Ontology: Mol. function=sodium channel regulator activity; Biological process=protein amino acid phosphorylation
  Coding regions on vcDNA: vcDNA=SeqID_90379; Strand=+; Position=2-703
FHIHLQKERSFAEPRPRGYAAQVASALGYLHAKDIIYRDLKPENLLLDRNGHVILTDFGLCKEHVKMRQTTSTFCGTPEYLAPEVIQKKPYDRTVDWWCLGCVLFEMLFGLPPFYSKNQNEMYHKTLTQPLCVPSSASTLVRKLLVEILHKDRSERLGAKSDFEEIRSHPFFAPIDWDKLLNKEVKAPFVPKVRAETDTLNIAREFTDIEPNPASLVPLQTFVNRETEFAGFTY

SEQ ID NO: 163957 - protein, 223 aa, Heterodera glycines
  Homolog annotation: Hit_ID=NP_741361.1; Match level="QueryCoverage =99%, HitCoverage=59%, E-value=4e-46, Identity=42%"; Hit description =cytoplasmic protein of ancient origin precursor family member (4E502) [Caenorhabditis elegans] gb|AAM9796
  Coding regions on vcDNA: vcDNA=SeqID_90380; Strand=+; Position=38-706
MADEFAKPKFDGKIFQNPDSFTTWKNPPSAGDPRSWRDFIKWKWDAKSTKLPNLKVLDQTLPVLKPRFQTDSRLSATWLGHATLFVRIDGISVLTDPVWAMFATPSFLPFFKFCPRFRPPPCKIEELPKIDIVLISHNHYDHLDVVAVRELAQHFPHIIWVVPLGLKQLVQHETNSKAVHEMNWGDRLELQLNERTFEVFSVPAQHWSQRNLIDRNTSLWSGW

SEQ ID NO: 163958 - protein, 66 aa, Heterodera glycines
  Coding regions on vcDNA: vcDNA=SeqID_90381; Strand=-; Position=22-222
GIFVTGVVTCSVNAWSGVRGLAANSEYWSNRPKRRLSRCLMSDFVFNGSQSFFIICLFNAMAQNPS

SEQ ID NO: 163959 - protein, 283 aa, Heterodera glycines
  Homolog annotation: Hit_ID=CAE72234.1; Match level="QueryCoverage =95%, HitCoverage=98%, E-value=5e-68, Identity=45%"; Hit description =Hypothetical protein CBG19349 [Caenorhabditis briggsae]
  Gene Ontology: Cellular component=integral to membrane
  Coding regions on vcDNA: vcDNA=SeqID_90382; Strand=+; Position=65-916
MANFGYGQQQGQAYHPQGANPYQQQPGWNVPPPPQGQQPYNAQHFAEQGQAGMPKNELGFNDQTIRSQFVRKVFSTVGIMLAVVAVMSAFPFMHPPMMAFVRHNVGLYLLGYITFFVVYIALICCEGVRRSFPANIILLGILTLSIGFMTMMITAQYAVHSVFMAFAITSLSCFGVALFATITKRDLTSMLGIVFIATMCLALFGLVVIIVGMFTNVRILFVVYAAIGAFLFMIWLAIDIQMGMGGRTYEISPEEHIFASITLFLDIIQIFWFLLAIFGDRRN

SEQ ID NO: 163960 - protein, 93 aa, Heterodera glycines
  Coding regions on vcDNA: vcDNA=SeqID_90383; Strand=+; Position=10-291
MASAVNPLKAFGQIGARLGIREKKNQFVQKAWPYIDPGTHFGKKNFGYLVSAVSFLVFYKVSSNIKSKKAIEAKQKLEMKPYVVQDAMTRSGI

SEQ ID NO: 163961 - protein, 99 aa, Heterodera glycines
  Coding regions on vcDNA: vcDNA=SeqID_90384; Strand=-; Position=185-484
CLLLVEWAFQGFIYQKLMQGRDSTYRYFGKAYYIKFILNVLCHLVGWAFTIHSVLYPKFETQLVRHLRLKITGTVRLERLETRSSHVIQLQKQNRWLIT

SEQ ID NO: 163962 - protein, 377 aa, Heterodera glycines
  Coding regions on vcDNA: vcDNA=SeqID_90385; Strand=+; Position=8-1138
MTFFLQYNFYLIWQSDGEKNMNKSQLDPSQRKGLDIDGHSYGVHFYSLPGMSSLTSFDWHPTISDRLALLPVQEKPMAFAHSIASTKRIAIIKLRDDVNSVIGPSGDFCISAGPQLNFENGEKLLAKPNCTSDIDTETLFKRRVLAGYGYGNSLNALATLLEYSKKAIERDQFASDDLRFCWDWLWMQFQSADANEIKKNYGTMFAGVKHILKGTKSNSTIKQDEITYRNRIFVNEKRLKILRMCNWPNCAVRDECKARLDEIAAQNGVFGITRAAALALFSVHGMLSKEYLTHLSEFTHSREFAETWCRSPSFVTNYQRMADTVLNILQKYDGVRVPNYESVCEGLTGDDYLLAIVKFLARRDKIYNRIYNEIFES

SEQ ID NO: 163963 - protein, 247 aa, Heterodera glycines
  Homolog annotation: Hit_ID=CAE63635.1; Match level="QueryCoverage =33%, HitCoverage=44%, E-value=7e-10, Identity=40%"; Hit description =Hypothetical protein CBG08131 [Caenorhabditis briggsae]
  Coding regions on vcDNA: vcDNA=SeqID_90386; Strand=+; Position=57-797
MLHPSTHCARKISRKQYSNAPDGAEECGGNADALLRKASRKLSQLSELGDFQQRCNTATSRRRCSSTESLLAALNGHGSVVSAGADSSTASHRSSTDDLTVLDCSNLSLGQLPIELLTEHSEEIEHLILDENELDEQALEDIPRLDKLETLSLNGNKIKNIGVFLQYLKRKCPNLKFLSLIGNPGWPHPILNNNLQLYRTYALSAVRLFPSLQFLDTARVSSPASIAILGEQCQQRHHQQPNAGNKK

SEQ ID NO: 163964 - protein, 158 aa, Heterodera glycines
  Homolog annotation: Hit_ID=CAE56103.1; Match level="QueryCoverage =69%, HitCoverage=31%, E-value=1e-27, Identity=55%"; Hit description =Hypothetical protein CBG23701 [Caenorhabditis briggsae]
  Gene Ontology: Mol. function=cytoskeletal adaptor activity; Cellular component=plasma membrane; Biological process=EGF receptor signaling pathway
  Coding regions on vcDNA: vcDNA=SeqID_90387; Strand=+; Position=274-747
MGEEMDDDLSILHEMNCRSKQNGSSELDSKLFELSDEQLNYYTNCFLFLMQKSQGFFSLQGALQGNDRTILDFFRKSSLDDSILSKIWSLSDVNEDGFLNLTEFILAMHLVVLHTKGSVPIPSRLPSSVLPPTTPTRTLVHAEDDFAASLSNHSLSNS

SEQ ID NO: 163965 - protein, 138 aa, Heterodera glycines
  Homolog annotation: Hit_ID=AAO33474.1; Match level="QueryCoverage =100%, HitCoverage=100%, E-value=2e-72, Identity=99%"; Hit description=gland-specific protein g4g12 [Heterodera glycines]
  Coding regions on vcDNA: vcDNA=SeqID_90388; Strand=+; Position=36-452
MPNTFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 163966 - protein, 143 aa, Heterodera glycines
  Homolog annotation: Hit_ID=NP_788401.2; Match level="QueryCoverage =58%, HitCoverage=81%, E-value=7e-14, Identity=41%"; Hit description =CG33198-PA [Drosophila melanogaster] gb|AAO41356.2| CG33198-PA [Drosophila melanogaster] sp|Q86BE9|PEN2_D
  Coding regions on vcDNA: vcDNA=SeqID_90389; Strand=+; Position=42-470
LLSDLQKLSGADRLLLCRRYFHVGFVCLPLLWAVNAIWFFRYAFPSGANATAETAQIRRYVCWSATGALCWGLLLTGWLLFYNIQRSYGLFEWARENHRRFSPGLCLIRMKKNTMFFLILIVYGIFQNTENWQQSKKGNDKKK

SEQ ID NO: 163967 - protein, 206 aa, Heterodera glycines
  Homolog annotation: Hit_ID=CAE60650.1; Match level="QueryCoverage =93%, HitCoverage=78%, E-value=3e-49, Identity=43%"; Hit description =Hypothetical protein CBG04296 [Caenorhabditis briggsae]
  Gene Ontology: Mol. function=histone binding; Cellular component =chromatin assembly complex; Biological process=loss of chromatin silencing
  Coding regions on vcDNA: vcDNA=SeqID_90390; Strand=+; Position=26-646
MSSRINVVSVQLLENPATPSDHIKLEIVFEIFENIKEDVEWELVFVGTDGREEHDQVLDSVLIGPIQEGRHKFLFEAPPPQIHNLRPEDFMDVTLLLLKCKYREQLFMKIGWFVTHTYTDPELVENPPSQPVIEKLKRTIVGEDVRVTSYPIKWDEEAEQPMDDDEEPNAGNEVSYGVAAIELTSNGNSQQMNMSQQEQTPMAAVN

SEQ ID NO: 163968 - protein, 225 aa, Heterodera glycines
  Homolog annotation: Hit_ID=CAE57570.1; Match level="QueryCoverage =100%, HitCoverage=53%, E-value=9e-85, Identity=66%"; Hit description= Hypothetical protein CBG00548 [Caenorhabditis briggsae]
  Gene Ontology: Mol. function=RNA binding; Cellular component=nucleus; Biological process=mRNA cleavage
  Coding regions on vcDNA: vcDNA=SeqID_90391; Strand=+; Position=24-698
MKPDLKDPYFMYKLIVGQLFYDGHQQLALNLAQTLGLSLRPPPPSDKLFRLVAIAKQFVEDPEYKERETILQVGGFESAGLDLEFDADVVPTSPEPSLYETVYLTTHKAPCRAAAFSPDGALVATASNDCSIKILDVDKIISRIDVTLSESGPDAHHPVIRTLYDHLDETTCVAFHPRESVLLSGSNDFTLKMFDYSKTAGKRAMKTITEVKAIPAVSFHPSGEF

SEQ ID NO: 163969 - protein, 180 aa, Heterodera glycines
  misc_feature (3)..(3): Xaa can be any naturally occurring amino acid
  Coding regions on vcDNA: vcDNA=SeqID_90392; Strand=+; Position=1-540
GRXRRLCQFQCPFFPLQSNRHPSSRTTSSAALLMFPYNSFSTVRPHSISSQSSTTFSSRNFTQSDTEAEEEKKFQKRIVHRREVLTPSRMKWDWDRREMLASCSTPKSSQEDLLCHFRLLDKTSVYFRPKPSDDNQQQRHGNNKQRQKRAKCQQKQQQLQIDDYFNAIRRPKHLRGAKRH

SEQ ID NO: 163970 - protein, 57 aa, Heterodera glycines
  misc_feature (8)..(8): Xaa can be any naturally occurring amino acid
  Coding regions on vcDNA: vcDNA=SeqID_90393; Strand=-; Position=208-381
FFFFFFFXTISNYVCHLLLSLAHKLVIPITVVPFFSLSLSLSLLHPLPSLRPFRSLL

SEQ ID NO: 163971 - protein, 58 aa, Heterodera glycines
  Coding regions on vcDNA: vcDNA=SeqID_90394; Strand=+; Position=76-252
GSIHTHLFIDLFFFLNDLPHPSRKLFFLPPSVNLYPLHIFPILVTLVRSIQQQCFLIS

SEQ ID NO: 163972 - protein, 153 aa, Heterodera glycines
  Homolog annotation: Hit_ID=NP_477414.1; Match level="QueryCoverage =99%, HitCoverage=98%, E-value=5e-53, Identity=62%"; Hit description =CG5788-PA [Drosophila melanogaster] gb|AAF57787.1| CG5788-PA [Drosophila melanogaster] gb|AAS93730.1| RE4
  Gene Ontology: Mol. function=ubiquitin-protein ligase activity; Cellular component=proteasome complex (sensu Eukarya); Biological process=protein modification
  Coding regions on vcDNA: vcDNA=SeqID_90395; Strand=+; Position=136-597
MTASSRRLQKELSEMRGNNSGAVRVLEVDESNLLRWSLMLYPDREPYNKGAFRVNVDFPTEYPFKPPSVTFATKIYHPNIDDKGQVCLGIILAENWKPATRAEQVMNALLSLIAEPEIAHPLRSDLAEEFQRDKKKFFKNAEDYTKKYAERRD

SEQ ID NO: 163973 - protein, 102 aa, Heterodera glycines
  Coding regions on vcDNA: vcDNA=SeqID_90396; Strand=+; Position=74-382
KKRWPRQLRMPPIAWAECFRQRLARVMGFTRHWRQLPDWPIVTATVLDLKSEWTDGGTDWSPTILMREGAILNSDCSKVHKFYGQWSDLFSFDAFWFLFTVK

SEQ ID NO: 163974 - protein, 72 aa, Heterodera glycines
  Coding regions on vcDNA: vcDNA=SeqID_90397; Strand=-; Position=114-332
LCFMCILFFRDFQIYNHCPIRPIPCSTKVRMLSLSMNVLITSLPFGFVFTLWCTISSNTANSIHSFVSCNIC

SEQ ID NO: 163975 - protein, 218 aa, Heterodera glycines
  Homolog annotation: Hit_ID=CAE73917.1; Match level="QueryCoverage =88%, HitCoverage=82%, E-value=8e-49, Identity=51%"; Hit description =Hypothetical protein CBG21526 [Caenorhabditis briggsae]
  Coding regions on vcDNA: vcDNA=SeqID_90398; Strand=+; Position=108-761
MLLRPCPSLPLLSNALSFVVHLPFHQQKTISTSVFALTVFDPRIFTEPIVSTEELNKPLPPNDKRNYMYLKPMLFDQTPVFYRDEIVDKMVRVFLMEGKKELSRVNVLSALEIVKRTQYEKWLNEKDEKRRAEIILDPIEVANRAILNCRPLMKLEKTIKAGTLYLVPMPISEKVAIFKAIKTMRDICRLKAGKKRNEKRPHYPHFKDVLASELLAAM

SEQ ID NO: 163976 - protein, 310 aa, Heterodera glycines
  Homolog annotation: Hit_ID=CAE70020.1; Match level="QueryCoverage =82%, HitCoverage=87%, E-value=8e-25, Identity=31%"; Hit description =Hypothetical protein CBG16435 [Caenorhabditis briggsae]
  Coding regions on vcDNA: vcDNA=SeqID_90399; Strand=+; Position=21-953
MDESLGNKRPNSTVKEDDSVSLCGSVATTAAGDGSLLDFGLDEETLAVESDTEFERKFFVMKEGSFPGKVFALPHPASRERALYLLNEHGELFELLRLDNGKRSFFFFDSVVANGSVHLFFPVHPFFLAIECLQRNASEHFLTASELLEDDDFPSLKELAKSVKLIDTLKIAANFENDNSTDSPTKNFKFRHNEQRLFIWLEERFRILKESLAANCDENDNCAEDEQCFGILADYLPELVAQRLKERLGIKMPKNKNQQKTKRILAEPIKGTEAKGARTFKRKLTKVLAEASKGSHSIASLFGSNKTDKK

SEQ ID NO: 163977 - protein, 170 aa, Heterodera glycines
  Homolog annotation: Hit_ID=NP_509847.1; Match level="QueryCoverage =78%, HitCoverage=62%, E-value=1e-13, Identity=29%"; Hit description =CLaudin-like in Caenorhabditis (19.9 kD) (clc-1) [Caenorhabditis elegans] emb|CAB01719.1| Hypothetical pr
  Coding regions on vcDNA: vcDNA=SeqID_90400; Strand=+; Position=75-587
MGLMFCKGPTMGVNGSASADGASVAHNEKELVDVCKEWFLNKPDWEKFVVGAMVVSLVLACLAFIWNLVTFCACFCHSHVMKPLPGLAGLTAMCLAVALTVFYMKNQQYIPMMKDKQFDNTEEFRKFIQKLDNDGNHVGYSFYMGCGAAIVALANSVVGAFMVCLADKYL

SEQ ID NO: 163978 - protein, 194 aa, Heterodera glycines
  Homolog annotation: Hit_ID=NP_871701.1; Match level="QueryCoverage =98%, HitCoverage=72%, E-value=2e-27, Identity=37%"; Hit description =RanBP1 domain containing protein, Nuclear Pore complex Protein NPP-9 (95.6 kD) (npp-9) [Caenorhabditis el
  Gene Ontology: Mol. function=RAN protein binding; Cellular component =cytoplasm; Biological process=embryogenesis and morphogenesis
  Coding regions on vcDNA: vcDNA=SeqID_90401; Strand=+; Position=2-586
ALTTANTRTTISSADVSKAGKVTDKGGDSDDEAAEEFVPTGTFKPIVPLPSKVDVKSGEENEEVLFSARCKLFRYDPMDKKNKERGIGELKLLHNKETGRYRCVIRSDDQLCKLFANFPVLATMISRITGQKPNVRTLQCRDFSESSEGIDEVFLLKFRDQTTAEEFANKLEETGKRLGETPKEKEAAEKEPRQ

SEQ ID NO: 163979 - protein, 115 aa, Heterodera glycines
  Coding regions on vcDNA: vcDNA=SeqID_90402; Strand=-; Position=5-352
FELKMNVYFFGIHPEFFFFFFFTHSLHSLFTTAQNALIPSAATGTDVERCFGFLPAFVHFLVVPTGHLFIPISRNKIGANEKADNYQQKKHNETQMEHLEKAENYLKLLKAENYL

SEQ ID NO: 163980 - protein, 171 aa, Heterodera glycines
  Coding regions on vcDNA: vcDNA=SeqID_90403; Strand=+; Position=171-683
LYGREDGIYSVLRGCLSDFFDFPPSNGEEGCTWGLSSENALIATSEKGELVQNVRVGVNLCPAKEGTQCNSLLRPSVEYAQGKQQTDASTSAAGNAWPYSCRKSTSMVQCLQCSRYDWDGDCHWNYREYCTGAWCTKTIGYVNGRWLEQRGCAPFNPLNSQICTKVETNAA

SEQ ID NO: 163981 - protein, 153 aa, Heterodera glycines
  Homolog annotation: Hit_ID=NP_500890.1; Match level="QueryCoverage =90%, HitCoverage=57%, E-value=4e-20, Identity=39%"; Hit description =putative nuclear protein (26.9 kD) (4G697) [Caenorhabditis elegans] gb|AAD12800.1| Hypothetical protein H
  Coding regions on vcDNA: vcDNA=SeqID_90404; Strand=+; Position=40-501
MATTSQMALEPPIMVTQDTGMKVTVFICIPGMRKKGGLIVLLKRLFRVKSRDPFTLVSNVKFGQYMLTDQSISLLAEVYTDKTAMDKRSEDRKRYEWSVTKFPSQINSESAEFTVEQNGDNCYIVMSCMKTDNYSTNWKDFLSANGTLDMTKA

SEQ ID NO: 163982 - protein, 137 aa, Heterodera glycines
  Coding regions on vcDNA: vcDNA=SeqID_90405; Strand=+; Position=1-414
PLAEFGTRVLKVEMPFSAPRQVLKYFYKRTNAFWDKSMLHKERVAYAKLRLKLYGALVLSMWYMYEFATPPPDVRFDIRWFFSSSFANYVQTKGAGGLDIADETMYKQFSFSKGRLLENALETPEGQAMGLSERFHS

SEQ ID NO: 163983 - protein, 118 aa, Heterodera glycines
  Homolog annotation: Hit_ID=NP_508656.1; Match level="QueryCoverage =38%, HitCoverage=69%, E-value=7e-09, Identity=54%"; Hit description =putative endoplasmic reticulum protein, with a transmembrane domain (XE407) [Caenorhabditis elegans] gb|A
  Coding regions on vcDNA: vcDNA=SeqID_90406; Strand=+; Position=74-430
METKRNNYNNIDSLWSTLCDLGYQTSQGLAYSVGMPNFSFGAFILLSVMTWCCFFMPPVAVFFRGYLRDGNACTEHVIYNIILCFFLWVPGMVHAFWYCFSDMFSGPKKEGAGYSKNA

SEQ ID NO: 163984 - protein, 121 aa, Heterodera glycines
  Homolog annotation: Hit_ID=NP_497618.1; Match level="QueryCoverage =96%, HitCoverage=97%, E-value=9e-44, Identity=66%"; Hit description =cytochrome C oxidase (14.8 kD) (3D877Co) [Caenorhabditis elegans] gb|AAK29974.1| Hypothetical protein Y71
  Coding regions on vcDNA: vcDNA=SeqID_90407; Strand=+; Position=55-420
MAESEMEIPDTMGERMEKHKNSGQPMMLHPDHPDNWDPRYHEKAAHLLWSAPYDARYPQVRKQRQCFEYYVDFFRCKELMGEDYKPCKFFQNVYKDICPSFWTEKWDELREEGRFPAKFDR

SEQ ID NO: 163985 - protein, 138 aa, Heterodera glycines
  Homolog annotation: Hit_ID=CAE65087.1; Match level="QueryCoverage =78%, HitCoverage=73%, E-value=5e-10, Identity=36%"; Hit description =Hypothetical protein CBG09945 [Caenorhabditis briggsae]
  Coding regions on vcDNA: vcDNA=SeqID_90408; Strand=+; Position=12-428
MRLGILLFVFRFSLNLIAKTNATYFYVRGELWCQGEPYVGAKIFLMEADTLDPDDLLGEERSAPDGRFEVRGGESEIGDEEPYLMVGHTCPQRGVPPDPACHFLTRVDLPNFLTHIEVPPIHLDGQYEFQHICGEDDV

SEQ ID NO: 163986 - protein, 104 aa, Heterodera glycines
  Homolog annotation: Hit_ID=AAH79755.1; Match level="QueryCoverage =77%, HitCoverage=84%, E-value=2e-20, Identity=60%"; Hit description =Unknown (protein for IMAGE:6951677) [Xenopus laevis]
  Gene Ontology: Mol. function=structural constituent of cytoskeleton; Cellular component=intermediate filament; Biological process =cellular morphogenesis
  Coding regions on vcDNA: vcDNA=SeqID_90409; Strand=+; Position=65-379
MNSATMFTLLLIIGTVLALTIGMPTPGGSDESVSSMRQKRGYGMSNGGGMGNGFGGGMGNGFGGGMGNGFGGGMGNGFGGGMGNGFGGGMGGGSGGGYGYGKRR

SEQ ID NO: 163987 - protein, 210 aa, Heterodera glycines
  Coding regions on vcDNA: vcDNA=SeqID_90410; Strand=+; Position=1-633
HRQGGTGQRRAVERALRMPRRRLENFWRSIGMHSRSAKRQQCVRVAEQRIVRIAQSMHFLVFPTTNAEQTAVDKMGEVQLSKCAEQTAKIVDRVRVHRHSLCAGGAAGPSSFCCPSSFSSLSISNPPIAHNHNHHQQPKQHFHQQQQQQLSFISAPCALHSSHGPSTTTANAIPAQLFMLSKNGRECSKLREMVSSLGEQLNVPSTTKIS

SEQ ID NO: 163988 - protein, 242 aa, Heterodera glycines
  Homolog annotation: Hit_ID=CAE73013.1; Match level="QueryCoverage =99%, HitCoverage=61%, E-value=4e-99, Identity=73%"; Hit description =Hypothetical protein CBG20369 [Caenorhabditis briggsae]
  Gene Ontology: Cellular component=cytoplasm
  Coding regions on vcDNA: vcDNA=SeqID_90411; Strand=+; Position=11-736
MKDQAYLVGALDKVEKLAVRANDKTKKLEHDTLLKVKELLETKFVRQHEWNEKEIEVLNKHLFLTAKPIVYLVNLSEQDFIKKKNKWLPKIKAWIDENDPGAVLIPFSGAFELKSVELDPEARAQFFKDTGACSALDKIIKTGYKTLCLEYFFTAGKDEVRAWTIQKGTKAPQGAGRIHTDFEKGFIMAEVMKVADLVELGNENAVKGAGKYRQQGRNYVVEDGDIIFFKFNAGAGLTAAKK

SEQ ID NO: 163989 - protein, 289 aa, Heterodera glycines
  Coding regions on vcDNA: vcDNA=SeqID_90412; Strand=+; Position=19-885
RIWLRPKILYHNNDNLITFTHFDVDMALLVFSEAVDATSVMSLIGTTAHSLLAISPFSMAPQSSKWCRAKVWLASGGISFSPSAGVFRAGSPRFVNTDFLTKYFSSSPSCTRTLPRKALTSLVSMCEELIAEENNPWEVSALTSARLALDGITQETFKLTEQNCEKLKQFDPQRSAMYDEMFDKVRIIHELTKNTSDTPEQSQLDLLMEAKSDRLNLNGIGLISLLHLRPLSGLVQELNLQNNRVTSDQITQLCSFAALTSLTLDGNPIDRLPLINPRWFPRLEFLSLA

SEQ ID NO: 163990 - protein, 227 aa, Heterodera glycines
  misc_feature (221)..(221): Xaa can be any naturally occurring amino acid
  Homolog annotation: Hit_ID=CAE69821.1; Match level="QueryCoverage =78%, HitCoverage=56%, E-value=8e-33, Identity=42%"; Hit description =Hypothetical protein CBG16139 [Caenorhabditis briggsae]
  Gene Ontology: Mol. function=enoyl-CoA hydratase activity; Cellular component=mitochondrion; Biological process=growth
  Coding regions on vcDNA: vcDNA=SeqID_90413; Strand=+; Position=110-790
MIGGILEDIWTRFIDLVEDISDQYDDSEQPTIIHHEPATPTTMFDNYGPIEKIVVVGTGLMGSGIAQIAVESGVKVCLVGRSQEKCDQTRLKINTGVQKSIKKRMANETAEAQQQLVEATMESLELVTNLDEAGLSDADIVIEAVVENLKVKQKLFTELEAKVSEKCLLVTNTSSFLLEDVSCKMGAAKREQFGGLHFFNPVPAMKLVEVVPGNGTSDAAXEVLANF

SEQ ID NO: 163991 - protein, 231 aa, Heterodera glycines
  Homolog annotation: Hit_ID=CAE75428.1; Match level="QueryCoverage =95%, HitCoverage=73%, E-value=8e-36, Identity=37%"; Hit description =Hypothetical protein CBG23421 [Caenorhabditis briggsae]
  Coding regions on vcDNA: vcDNA=SeqID_90414; Strand=+; Position=43-735
MTYDEDYMSSAFLAKVEDVKPGVGTGREGRRILRINANREEAIERQRVEKPKSKAELERDRLMEGLNNPIRAESKGFQLLAKMGYKEGMRMGRSAADEQQMDSRTKEPILIQLRIDRSGVGMDEHRKEKQRDLCEAHMERMKRQADNEEELAIDFRRRKRAAMEMKQLISEIQKLRKTCQEMDMRMGKTIPDEFWFWPIYSNNNELVDMVEVVDKSNQSMDENKRTKREPS

SEQ ID NO: 163992 - protein, 318 aa, Heterodera glycines
  misc_feature (16)..(16): Xaa can be any naturally occurring amino acid
  Homolog annotation: Hit_ID=AAD27589.1; Match level="QueryCoverage =98%, HitCoverage=51%, E-value=1e-135, Identity=77%"; Hit description= chaperonine protein HSP60 [Onchocerca volvulus]
  Gene Ontology: Mol. function=heat shock protein activity; Cellular component=mitochondrion; Biological process=mitochondrial translocation
  Coding regions on vcDNA: vcDNA=SeqID_90415; Strand=+; Position=2-957
PQKLQLANKYRRPVLXIAEDVDGEALTTLVLNRLKVGLQVCAVKAPGFGDNRKNTLKDMAVSTGGTVFGEEASLIKLEDIQIQDFGEADEVTVTKDDTLILRGKGSQEDVEKRIASIQDELDASTSDYEKEKLNERLAKLSTGVALLKIGGASEVEVNEKKDRVTDALCATRAAVEEGIVPGGGVALLRALKKLDTLKPDNDDQKSGIKIVQKAIRQPISTIIANAGLEPSAIVEKVLANAETNYGYDAMNDKFVNMLEAGIIDPTKVVRTALQDAAGVASLMATTECVVTEIPKEEPPMPAGGGMGGMGGGMGGGMF

SEQ ID NO: 163993 - protein, 121 aa, Heterodera glycines
  Coding regions on vcDNA: vcDNA=SeqID_90416; Strand=+; Position=12-377
LIMSLLFSLFSSLVSDLLKGLMKLLLFFEQWAGQCQYGAEKTVTFVGVSLRSFVCPSNNRWVSILERRELKTRRNNLLIFSIVLLLWTFQSFCYDSFQISKLSPKILKHKLFSNCTLTQIN

SEQ ID NO: 163994 - protein, 368 aa, Heterodera glycines
  Coding regions on vcDNA: vcDNA=SeqID_90417; Strand=+; Position=2-1108
SITNSQNSPAYCVLAYDHGDGVLREIIDHLGLLESGGLGAQQKKIGSETLPCHTLHLDTKYYTCDVPLLSCHSFVRLKSICAAERRSNLSVFAVLFCVTRQQLTEDFLALVSQYSASLEKAEVKALVLRDDQTEEATTSMNTNDEVLNKFALSRRIEIIKIGRKTTNVVDDDEEEGLVGIPRIVESIETVCWPNMKLKPNPVKQREHPTRLEKYINSEACADDTAVFDMFPHCADDFAPGIASHRVNQMPPEKDKAANIEPTGSDYPDSEDEMAILEWFDKPISEDILNLSNIPPPQNKITNLQPARENDDDDLDINAYICKNMNELRIGNTQRPLMARVDVNEGITYDLLKAISSSCNNNKRGDSNK

SEQ ID NO: 163995 - protein, 325 aa, Heterodera glycines
  Homolog annotation: Hit_ID=NP_057227.2; Match level="QueryCoverage =92%, HitCoverage=77%, E-value=5e-41, Identity=35%"; Hit description =p47 protein isoform a [Homo sapiens] emb|CAB96827.1| NSFL1C [Homo sapiens] gb|AAH02801.1| P47 protein, is
  Gene Ontology: Biological process=sporulation (sensu Saccharomyces)
  Coding regions on vcDNA: vcDNA=SeqID_90418; Strand=+; Position=57-1034
MSNIHTLGGDDDNKSRQRSNSSDDENSDEGRQGFFVGGSDHSGQEVLGPNRNENISADHFFDAIRRAGAERITQEQNEALNMPRQTGGGAGQSQVAFRLGGHGMESERIGGTSATAGGTTRQQAPVVVRLVFWNNGFTVDDGPLRQFQDPQNREFLQAVVTKRIPAELTMAAPGREIDLRIEKKGTEYEQPKTKAFSGQGNQLGTITPNVGGSADVVFVDAPPKLSAEETAKLVEQAQAELKVDDNLPTTRIQIRIPDTARPIVARLNQGHTVNQLRIFIVTADPSLAYRPFRLMTSYPTQPIDDEGLSVKDAGLLNATVLVKFE

SEQ ID NO: 163996 - protein, 74 aa, Heterodera glycines
  Coding regions on vcDNA: vcDNA=SeqID_90419; Strand=-; Position=3-227
ESGAVRRNLKNSSNRKIIFFFFRGESIFCGQVGAEPSFFRRRGRFLRRVRRVGTCEFRTLWRTSKFYINGVMSD

SEQ ID NO: 163997 - protein, 245 aa, Heterodera glycines
  misc_feature (13)..(13): Xaa can be any naturally occurring amino acid
  misc_feature (141)..(141): Xaa can be any naturally occurring amino acid
  Homolog annotation: Hit_ID=NP_501684.1; Match level="QueryCoverage =93%, HitCoverage=94%, E-value=3e-70, Identity=57%"; Hit description =glyoxalase II (26.4 kD) (4K272) [Caenorhabditis elegans] emb|CAA92800.1| Hypothetical protein C33A12.7 [C
  Gene Ontology: Biological process=sulfur metabolism
  Coding regions on vcDNA: vcDNA=SeqID_90420; Strand=+; Position=8-741
MFRQLFEAKSFTXSYLLGCTKTRQALVIDPVIETVERDASLVHELGLDLKYVVNTHIHADHVTGSGELKRNKYFPKAISILSGKAGGRADLLVKHSDLIRWGDGLELEVRETPGHTNGCVTLVCHSNQMAFTGDALLIRGXGRTDFQHGNARTLFRSVKSQIFTLPPDYLIYPAHDYAGRMVSSVWEEKKFNPRLTKSEEEFAAIMENLGLPYPKQIEKSEPANLLCGISELMDDALRRKVFGEK

SEQ ID NO: 163998 - protein, 207 aa, Heterodera glycines
  Coding regions on vcDNA: vcDNA=SeqID_90421; Strand=+; Position=10-630
GNLFIHSPSMISFRHSVNKCLLPQITNRLTSNLSAMCLSTAAADNKVVSKYDDYQKEMRLKQIERAFDEAMPKLLHGSYNNLMAFLDTNSFRFEDKVWLFESDSIHKTVFRMAKVRLYLAFKSPHNRFETLGTHICLDENLVTLIWQLSWPKDAKSAYLLSPKSLAANFSATFTGGPRSQIGRIEHKLATSESSDRPPSNATTQNGR

SEQ ID NO: 163999 - protein, 184 aa, Heterodera glycines
  Coding regions on vcDNA: vcDNA=SeqID_90422; Strand=+; Position=10-564
GCFFMYPPKDSDSNFFPNRMLSVDRSRSSSSHLVGLNAALQGCRSDIPFMLQRVSFSKDIKLHRMLRYLRACFVRDIREHNRGFNNGTQQTTKCQPEMIDQTNGVLNKRSWLEQNAYFAENNCFYPFYGQAVFYASFGQHSEGRVVCCSDGRIDEEESFKENCKKMTDHIYAAKAGWRKGKDAQ

SEQ ID NO: 164000 - protein, 89 aa, Heterodera glycines
  Coding regions on vcDNA: vcDNA=SeqID_90423; Strand=+; Position=539-805
THLKMVVLFRVGGFRCKGKDVARCSLCLIVHAFVGARLPSRPPFFSLISFVLQCHQILRVLLKFDVSLLLRVSSMCSPSSTSSSESFNS

SEQ ID NO: 164001 - protein, 307 aa, Heterodera glycines
  Homolog annotation: Hit_ID=CAE69544.1; Match level="QueryCoverage =88%, HitCoverage=58%, E-value=8e-92, Identity=58%"; Hit description =Hypothetical protein CBG15756 [Caenorhabditis briggsae]
  Coding regions on vcDNA: vcDNA=SeqID_90424; Strand=+; Position=19-939
MTRKRNRLKRKSKSVADYSGSNGFVPANGGGAVQKNRPDRRQILFWRSPFRTLLYFVLELVHIVWDFGGRLFVLRFLLPFLLAFGSLLFLFFVPGAHSSYVRHFEKKLLWCFYWLGLGVLSSIGLGTGLHTFLLYLGPHIARVTLAAFECNSLDFPEPPYPDDVTCSTDAMGHSSLVTLWTIIAKVRLESLMWGAGTALGELPPFFMARAARLSGHEPDSEEYREFIAIVERDATNQMNLMERIKLWMERAVTRMGFPAILLFASIPNPFFDLAGITCGHFLIPFWTFFGATLIGKALVKMHMQMLF

SEQ ID NO: 164002 - protein, 229 aa, Heterodera glycines
  misc_feature (138)..(138): Xaa can be any naturally occurring amino acid
  Homolog annotation: Hit_ID=CAE64112.1; Match level="QueryCoverage =99%, HitCoverage=88%, E-value=1e-45, Identity=42%"; Hit description =Hypothetical protein CBG08721 [Caenorhabditis briggsae]
  Gene Ontology: Cellular component=cytoplasmic vesicle; Biological process=signal transduction
  Coding regions on vcDNA: vcDNA=SeqID_90425; Strand=+; Position=36-724
MTTFLSFSVDLEQLEKEIQAKEAASKRDNVTDTKVQPDLKGNIGSGTSAQTKRKSNVVGLEEDFDTLDEPIWETINRDLKILYGKFSQVLFPAKSEQNVLTDWDLWGPLFICVALSILLQGADRGAQFTQIFSLAFFXSFFQALCVIGYCLLPYVFASVAIKSLSLLFWHKSSANLLLRALATVSGFAWALYASTLFLAGSEPPNRRFLFYYPLVLFYFVFSWLVISFA

SEQ ID NO: 164003 - protein, 263 aa, Heterodera glycines
  Homolog annotation: Hit_ID=NP_871910.1; Match level="QueryCoverage =83%, HitCoverage=48%, E-value=1e-19, Identity=29%"; Hit description =abnormal OOCyte formation OOC-3, putative protein, with at least 2 transmembrane domains (50.7 kD) (ooc-3
  Coding regions on vcDNA: vcDNA=SeqID_90426; Strand=+; Position=4-795
MRRYLDTEKAVEEFGLREDLRAALENFLVESDIRSDHSLFTFLHNLLPYIMLLNVILLIPAALFFLRSTVSTRKLVTFLLLSTFCWSCYATYMRKYQEILAERFLRTDAVFRRGGGVCSPQGLLSEAFDVMLSYVRIKQKSECLKAYEDELIAPLWQVDPLQVIAEVLSNFFLGGLPASGTHLNLFFNNFFVDTPFHLALVKMLFAIAFPLAIAYAIYLYANCYTRKQQKNSEKEQRRIKPKETTRTAISRSNSQAELIVSSV

SEQ ID NO: 164004 - protein, 183 aa, Heterodera glycines
  Homolog annotation: Hit_ID=CAE72800.1; Match level="QueryCoverage =94%, HitCoverage=96%, E-value=3e-19, Identity=34%"; Hit description =Hypothetical protein CBG20077 [Caenorhabditis briggsae]
  Coding regions on vcDNA: vcDNA=SeqID_90427; Strand=+; Position=4-555
MIWLAMPKMDMTFPFHTSEFILLKEWLPQSIFAYLFSLLAVLALSVAYELLRVFRAILFQIAERRQSEECCSPVASAAPSSGAITASSSSVAACNCLSPQLFYNVPQWSFSSQLVSHFHLFQSLLHFIQFFLGFSLMLVAMTYNVPIFVALLLGHSLGYFLTAPLYRHGLAEENRTGGDCCCS

SEQ ID NO: 164005 - protein, 209 aa, Heterodera glycines
  Homolog annotation: Hit_ID=AAT02161.1; Match level="QueryCoverage =93%, HitCoverage=92%, E-value=3e-40, Identity=44%"; Hit description =hypothetical protein L3ni22 [Dictyocaulus viviparus]
  Coding regions on vcDNA: vcDNA=SeqID_90428; Strand=+; Position=1-630
HLRALIPTYVLLFSHFYLLLVLAKGFEGYTFSCLDGCECDTDDEAIHCHNRPDRHFVQLPPSRLRGFTVLALTRNNIDVLPSEEVLLEKLPDLKAVDVEGNEHFDCSTLDHYRTLMVMSDCGKTPEQLEADRAKLPTDTQPNEDCDFECVANRRSRELREYVKHLWEMVKEKVSRLAKKHGLDKVVDDVGNFFNDVGERISNIKLKKKK

SEQ ID NO: 164006 - protein, 140 aa, Heterodera glycines
  misc_feature (98)..(98): Xaa can be any naturally occurring amino acid
  Homolog annotation: Hit_ID=C88618; Match level="QueryCoverage=97%, HitCoverage=17%, E-value=1e-35, Identity=52%"; Hit description =protein ZK520.4 [imported] - Caenorhabditis elegans
  Gene Ontology: Mol. function=protein binding; Cellular component=SCF ubiquitin ligase complex; Biological process=induction of apoptosis by intracellular signals
  Coding regions on vcDNA: vcDNA=SeqID_90429; Strand=+; Position=48-470
SVPAVIRASRSLVDISILTTEEKGEELTDKTMLHLNTEFTWKRQKFKVMLPLPSKPQEKEAEATCNTVQQDRKYYTECAIVRIMKSRKVMKHGALVEXVIKQSQLRFVPDVQFIKKNIESLIDKYYLQRTDQNDEYEYIS

SEQ ID NO: 164007 - protein, 270 aa, Heterodera glycines
  Homolog annotation: Hit_ID=CAE75135.1; Match level="QueryCoverage =95%, HitCoverage=61%, E-value=5e-81, Identity=58%"; Hit description =Hypothetical protein CBG23064 [Caenorhabditis briggsae]
  Coding regions on vcDNA: vcDNA=SeqID_90430; Strand=+; Position=447 -1256
ISLPSKLNQKKSEKVVVSSVRMDRLSWYQTGESMEEILCQAGSVGIYDGDLKQTSFEQGTASLTYQRIIWADSTDPDCRLVLHHSMVHKIEKQHKTMFGRGGKIIVTVKPVTPGHAQGPIAASGTNSLRFVFRNGGEEEFYKRFLDALNKQMWQRTSSTSSSASSSRNSAQQTQTIVGSAGGTVAPPRSVGILGIEKRLAEQHQRTHEHISEAFEDMSKLMEQAREMVVLSKNITERLRQKKGEITEDETVQLKSYLLSLGVNDPVTKSS

SEQ ID NO: 164008 - protein, 254 aa, Heterodera glycines
  Homolog annotation: Hit_ID=Q9GKU5; Match level="QueryCoverage=90%, HitCoverage=66%, E-value=4e-66, Identity=51%"; Hit description =Histone deacetylase 11 (HD11) (QccE-18183)
  Gene Ontology: Mol. function=transcription factor binding; Cellular component=cytoplasm; Biological process=chromatin modification
  Coding regions on vcDNA: vcDNA=SeqID_90431; Strand=+; Position=38-799
MCASAALSAFAFLDDSEAEIDWDERCPIVYSEDYNISFFGIEKCHPFDSNKWGNVFRFLIASGALVESAVLRPIEAKKEHLLLVHSKKYLRSLNGRFTLTRILEVGLVLLFPICLIDRRILRPMRIQTGGTVLAARVSLIRGWAINIGGGFHHASEGKGGGFCVYADVTLAIKLLFANELIKSAMIVDVDAHQGNGHETDFASDSRVYILDLFNASIYPGDSDALKSVSRAVPLPFGAEDDFYLRRLEMELDAA

SEQ ID NO: 164009 - protein, 268 aa, Heterodera glycines
  Homolog annotation: Hit_ID=CAE56797.1; Match level="QueryCoverage =97%, HitCoverage=50%, E-value=5e-51, Identity=43%"; Hit description =Hypothetical protein CBG24609 [Caenorhabditis briggsae]
  Gene Ontology: Mol. function=phospholipase inhibitor activity; Cellular component=plasma membrane; Biological process=skeletal development
  Coding regions on vcDNA: vcDNA=SeqID_90432; Strand=+; Position=41-844
MPLSPRIGHNPSYHVVKEVEIIREVITSGGPTIQHDKIIHLLTSPNNAQRQELLHNYRTKYGGADLAQALKEKLPPSEVATNSLYLALLDTPAEHDAKYLAKAMKGLGTNEDMLIEILVTRSNAQLRAIKAAYQKLYGHGLEKDLAAETSGSFKTLLLDLVEANRDESYRTDLAKAKTDAEKLYKAGEGKWGTDEDAFIKVLANQNLSQLQLMFNEYEKLGKKHTIEQAIKAEFSGDELSALLAIVSFVRNGPIGEMAEMLHKSLTKG

SEQ ID NO: 164010 - protein, 106 aa, Heterodera glycines
  Coding regions on vcDNA: vcDNA=SeqID_90433; Strand=-; Position=53-373
FFFFFFFFLTVFIILQATKSTKERRIPVKNQRSQILRNYSIPLSQAQNAIIRLAHEAQLSTNGVLRRFAGNHSPSRLVHLDNLQLNRSVVFSRNDSRRRRTFPRDI

SEQ ID NO: 164011 - protein, 87 aa, Heterodera glycines
  Homolog annotation: Hit_ID=NP_495121.1; Match level="QueryCoverage =98%, HitCoverage=19%, E-value=6e-16, Identity=52%"; Hit description =tia-1 family member (45.2 kD) (2G2) [Caenorhabditis elegans] gb|AAK68191.1| Hypothetical protein C18A3.5a
  Coding regions on vcDNA: vcDNA=SeqID_90434; Strand=+; Position=60-320
MAYANYGYGSYGYGGEDFSAGAHNPRYHYAAAQNAGFDLKTDDGLPRTIYVGNLDVSVTEDFIATLFGQIGPVTKTKVIFDSGSEPF

SEQ ID NO: 164012 - protein, 318 aa, Heterodera glycines
  Homolog annotation: Hit_ID=NP_499001.1; Match level="QueryCoverage =92%, HitCoverage=93%, E-value=3e-56, Identity=41%"; Hit description =putative cytoplasmic protein of ancient origin (3K134) [Caenorhabditis elegans] emb|CAA78469.2| Hypotheti
  Coding regions on vcDNA: vcDNA=SeqID_90435; Strand=+; Position=59-1015
MSPIDPDKMALLKRLFPVLGKHLRKGDCGKIGVIGGSPDYTGAPYFASITPMKIGADLAFVYAHSDAAPVIKSYSPELIVYPSTDFATNRHSIERLDALVFGPGLGRQKHTQNLLADVVNFVRSKQNLCLVIDADGLFFVKECSQLFKGCTDKVIITPNHREFVRLYTQMFPNQQKGEDTDELKIQCEMAEQLAKHLEVTVMRKGEIDIISNGSAAQTRIVQAETSMRRCGGQGDILSGATALFAFWARKASDADIYSSEHLLDGAEAASLLVRNASLRTFQSVGRSMNAADVIDHIVPVVRDIDSELSAKAATITTR

SEQ ID NO: 164013 - protein, 221 aa, Heterodera glycines
  Coding regions on vcDNA: vcDNA=SeqID_90436; Strand=+; Position=16-678
MSDDLRKELEGLNLCAGRGRRQRATVVTESMIDDFCKIVYKAMLVTPEGYLYTSDIANNIYDDIGIDPYRRALDLGFNSFNAFLHSEHMKKYIEIDSTGNVLSYHAILTPELLLTIGHIQRERQTFLSMKRIYPSRRTNGFNQSQEMGPLQFLKERMQKRELQAQMGGQTQEEETQSETVQEPSFVMNEGQYGIEEEFFEEIGENEQLGLDRIKWVQNDSD

SEQ ID NO: 164014 - protein, 112 aa, Heterodera glycines
  Homolog annotation: Hit_ID=CAE73575.1; Match level="QueryCoverage =75%, HitCoverage=77%, E-value=5e-23, Identity=55%"; Hit description =Hypothetical protein CBG21048 [Caenorhabditis briggsae]
  Coding regions on vcDNA: vcDNA=SeqID_90437; Strand=+; Position=60-398
MFSTKIIVRSLSSSARMSQSHLGDFGGGAGKGGGSGGAVRDAGGTFGKMEAAREEEYFHKLKQQQLKLLKLQLKREQDHHEEQAKHHHDVVERHKKRIQELEEEAKDDAKSK

SEQ ID NO: 164015 - protein, 57 aa, Heterodera glycines
  Coding regions on vcDNA: vcDNA=SeqID_90438; Strand=+; Position=10-183
RNSFVFVLSFHLHRTTDWKMITDMQLGIMANVLGVSIFILVIFYHYIVANQKKQSPQ

SEQ ID NO: 164016 - protein, 165 aa, Heterodera glycines
  Homolog annotation: Hit_ID=CAB38312.1; Match level="QueryCoverage =90%, HitCoverage=22%, E-value=2e-30, Identity=47%"; Hit description =molybdenum cofactor biosynthesis enzyme [Arabidopsis thaliana] gb|AAA97413.1| molybdenum cofactor biosynth
  Gene Ontology: Biological process=establishment of synaptic specificity at neuromuscular junction
  Coding regions on vcDNA: vcDNA=SeqID_90439; Strand=+; Position=22-519
VIRLTRTTNIDKSGPLLVELLQNSLLIRRGQKVTVANYTIVPDEKSKIGEYLREYSTKVDCILTSGGTGFSKRDVTPEATKEVIERECPGIAVALLKKGLDITPFAALTRLTAGIAANCLIINLPGSPKAVREGFEVIEPILSHAIAIVKGDESETSVLHKRTAL

SEQ ID NO: 164017 - protein, 276 aa, Heterodera glycines
  Homolog annotation: Hit_ID=CAE59495.1; Match level="QueryCoverage =90%, HitCoverage=69%, E-value=1e-56, Identity=42%"; Hit description =Hypothetical protein CBG02880 [Caenorhabditis briggsae]
  Gene Ontology: Mol. function=protein tyrosine kinase activity; Cellular component=kinetochore microtubule; Biological process =protein amino acid phosphorylation
  Coding regions on vcDNA: vcDNA=SeqID_90440; Strand=+; Position=108-935
MLQAHQYQLQQGHRRVSARSILAHFGFEFSNDYRLGCGHYSKVYKGYFKEAQRTFAIKVTDLESVSEKFKQKFLPRELEVWRELDHPNLVYLYNDFQWSDYQFVVMELAVGGDLLSFLQKCGPVSETTCHNWMLQIVAALDYLHRKGIAHRDLKLKNVLLCENGVIKVTDYGFSKQSSDLSSTFCGSRSYSSPEILLGIAYDMFKSDIWSLGVTAFIMITNTMPFHEDLPNQQIVDSQRKRRYKYPSWLNITKQCRTAIDALLTYQPAFRPNISEC

SEQ ID NO: 164018 - protein, 157 aa, Heterodera glycines
  Homolog annotation: Hit_ID=CAE60387.1; Match level="QueryCoverage =99%, HitCoverage=99%, E-value=4e-49, Identity=55%"; Hit description =Hypothetical protein CBG03988 [Caenorhabditis briggsae]
  Gene Ontology: Cellular component=integral to membrane
  Coding regions on vcDNA: vcDNA=SeqID_90441; Strand=+; Position=52-525
MAGCLDALPHQAHFDWDTKRNTYSAVASGFLFFLAWWLMIDTAVTAQKAHWTNWYFALTVACTIAMFMVNSVSNSAIQGNYLDEGVLGVKGARLWLMFGFIGSFACIVAGVWVMFGDFVLKEGQNDNWPGIALFLHTFFIFVASLVYKFGRTEELWE

SEQ ID NO: 164019 - protein, 258 aa, Heterodera glycines
  Homolog annotation: Hit_ID=CAE68921.1; Match level="QueryCoverage =71%, HitCoverage=54%, E-value=1e-32, Identity=38%"; Hit description =Hypothetical protein CBG14900 [Caenorhabditis briggsae]
  Coding regions on vcDNA: vcDNA=SeqID_90442; Strand=+; Position=1-774
LQSTVLIRHLLLKSPSHDLCFVVPSSFSDPCPFFGDYQCPEGFHCAFDKCQDEQGMEPPGDCAKIRCGKESECRQGKCVLYVGRPCGRNVLVAEGLARAVVSDCGPQGKCIGGRCAIDRCADTVCEEMSELCRDGMCMQLSSMFCFSPFDCGPPSLFECHQNKCQRRRDTIVPVFSPSAQKCDPGETLSGDKCVTQEGCAQLVCSSGQSCFNGFCVPTSNSNCANSGECAEMNICREGPCVADICKANGGKCLPENAC

SEQ ID NO: 164020 - protein, 331 aa, Heterodera glycines
  Homolog annotation: Hit_ID=NP_498711.1; Match level="QueryCoverage =93%, HitCoverage=51%, E-value=2e-77, Identity=49%"; Hit description =tyrosinase and metridin-like ShK toxin family member (68.4 kD) (3I965) [Caenorhabditis elegans] gb|AAA279
  Coding regions on vcDNA: vcDNA=SeqID_90443; Strand=+; Position=1-993
MPSAHGGPTFLLWHREYLKRMEIALRAIDPSVAIPFWDSAMDQRLPNPADSVIWSSSFMGALSAAGTVADGPVAGWITPSGGPIRRSLGTRGGNLLTEQEVASLIGQPQIENVLAFTSRARSGACTQPTPNPLSVLEFIHNGVHAWVGGDMLPLTTSPQDPVFFLHHSFIDYIWEQWRLLHQNRQQRETQFPPDSQIVPCAGSQNYLLSATMFPFQDPVVLNRAGLSNSYTDSLYTYAPRPTCRAAGDCRSRYLFCDTTSGRPLCTSRIKPGGNCASFVQNADQPCFASTCVNGFCQAAGGAAVAAQPQQQQRIVRSTVSVPNGTAPAAAA

SEQ ID NO: 164021 - protein, 92 aa, Heterodera glycines
  Coding regions on vcDNA: vcDNA=SeqID_90444; Strand=-; Position=11-289
MIIFIFSLKCNKQAINTSGKKSSTEYGKARTKAFSSMPGLHNKTTIYSLSLAPNSSCCAGLREVGKKMLRMFSPQRKLSSIERKSRASSKIN

SEQ ID NO: 164022 - protein, 208 aa, Heterodera glycines
  misc_feature (188)..(188): Xaa can be any naturally occurring amino acid
  Homolog annotation: Hit_ID=NP_503146.1; Match level="QueryCoverage =100%, HitCoverage=67%, E-value=2e-85, Identity=77%"; Hit description= TFII(Two)B general transcription factor (33.1 kD) (ttb-1) [Caenorhabditis elegans] gb|AAG24202.2| Tfii(t
  Gene Ontology: Mol. function=general RNA polymerase II transcription factor activity; Cellular component=transcription factor complex; Biological process=transcription from Pol II promoter
  Coding regions on vcDNA: vcDNA=SeqID_90445; Strand=+; Position=2-626
THRQMTQAMMVIRETSEKINLTRTIQDRAAKLYKEVLESKALRGKNNEAQAAACLYIACRQEGVPRTFKEICAVSKVSKKEIGRCFKLIQKTMETNLDHITSADFMSRFCGNLSLPYPVQVAATRIAKKSVEHDLVAGRSPISIAAAAIYMASQASNDKRTAKEIGEIAGAAEVTVRQTYRLLLPKAXLELFPPDFRFETPIDQLPTS

SEQ ID NO: 164023 - protein, 163 aa, Heterodera glycines
  Coding regions on vcDNA: vcDNA=SeqID_90446; Strand=-; Position=4-495
FFFFFFFFFFFFYYALFLFVFPNIKHTFEIRLSVTDLFAITSLHLTIVFLSLSSLVLLLELELGSKERNAESARQIKKSADEPTPTFDLHERRKVVRPSVTDWAGRCCRLPIGDFHGFGVVNAGSAGQMHRAHRTRRNGDNKTFEKHLSRKCHKNSAKKDGEF

SEQ ID NO: 164024 - protein, 100 aa, Heterodera glycines
  Coding regions on vcDNA: vcDNA=SeqID_90447; Strand=+; Position=165-467
LFINANYKFKCPFASAQFSRFVQSLASRSVAKINSESNDRFSLFPLEVLSAKSQVVAGIQYQLRIKAERSNCSKNVSERANSATHVLEFPSNNKYFYFFY

SEQ ID NO: 164025 - protein, 202 aa, Heterodera glycines
  Homolog annotation: Hit_ID=NP_492140.1; Match level="QueryCoverage =85%, HitCoverage=43%, E-value=2e-28, Identity=36%"; Hit description =RalA binding protein 1 like (1I269) [Caenorhabditis elegans] emb|CAB03414.2| Hypothetical protein T23G11.
  Gene Ontology: Mol. function=protein serine/threonine kinase activity; Biological process=signal transduction
  Coding regions on vcDNA: vcDNA=SeqID_90448; Strand=+; Position=95-700
MNFFGRKGKKGPVVGKEGKEKGERPSHRRLRVLGVPLAQALRNDPSHDGVPVPAVVRECLDFISLYGLQVEGVFRVSSPKSRLDELERMANEGRTDEIVFQDAHEAAGLLKRFLRQLPENVLTTQLKGRFENEANVCRCVALCRCSAVIKLKELLLQLPPENFHLLAFVFRNVQLAIQKESANKMNLPAMGVLLHTILEMPR

SEQ ID NO: 164026 - protein, 268 aa, Heterodera glycines
  Homolog annotation: Hit_ID=CAE67769.1; Match level="QueryCoverage =86%, HitCoverage=17%, E-value=8e-85, Identity=64%"; Hit description =Hypothetical protein CBG13344 [Caenorhabditis briggsae]
  Gene Ontology: Mol. function=ubiquitin-specific protease activity; Cellular component=cytoplasm; Biological process=protein deubiquitination
  Coding regions on vcDNA: vcDNA=SeqID_90449; Strand=+; Position=51-854
MKKLTVHPDIMDIVRELDDKCLRSIEDSYFDRMGQGPTYHTDENAQRPELLDENGHRYVGLFNQAMTCYLNSLIQTLYMTPEFRNKVYSWKFVDTPTNEDNKNIPYQLQRLFLLLQTSEKASLETKELTTSFGWVSNEAFEQHDVQELCRIMFDALQQRWRKTENDESAVHKLYKGTMEDYVKCLHCKRENVRKDDFLDLSLAVRPFGASESFKSIEEALSAFIKPEILNGNNQYQCEVCASPQDAEKGLRIVEFPYLLTIQLKRFDF

SEQ ID NO: 164027 - protein, 215 aa, Heterodera glycines
  Homolog annotation: Hit_ID=NP_506179.1; Match level="QueryCoverage =82%, HitCoverage=78%, E-value=3e-46, Identity=50%"; Hit description =mitochondrial ribosomal protein L49 (5N209) [Caenorhabditis elegans] emb|CAA99906.1| Hypothetical protein
  Gene Ontology: Biological process=cell growth and/or maintenance
  Coding regions on vcDNA: vcDNA=SeqID_90450; Strand=+; Position=38-685
MFSLCYRRAIRKSLANPQTIEVSSFHFSRVLEQNLDAASKRDEKGEEVPLWKDPYKHAMPEQKNTFSEFREANVHWEYVRRLLPRRLIPEIPQNAAEGVTPSGWRAPPEKAPNLPYYIRRKANHLPSIFLERRRDELNPKTMDFEYVELVILTGIDGDVFACERDLRAYCEKRLGHPIATHVDELKGKIKISGADRTIAEQFVYDYETEFSLCRG

SEQ ID NO: 164028 - protein, 190 aa, Heterodera glycines
  Homolog annotation: Hit_ID=XP_319632.1; Match level="QueryCoverage =90%, HitCoverage=31%, E-value=5e-54, Identity=58%"; Hit description =ENSANGP00000013881 [Anopheles gambiae] gb|EAL38961.1| ENSANGP00000028136 [Anopheles gambiae str. PEST]
  Gene Ontology: Mol. function=Pol II transcription elongation factor activity; Cellular component=DNA-directed RNA polymerase II, holoenzyme; Biological process=cell cycle
  Coding regions on vcDNA: vcDNA=SeqID_90451; Strand=+; Position=1-573
PLLPITAGVAPSAMRQQHGPGQKRVSRVPIIIIPAGASSLITIYNAQEILQDLRYVSTEEKKQFSSKRENELLLQIPKNGVTVPYRVVDNPTRLKDEEWDRVVAVFVQGPAWQFKNWKWNGNPVEIFANIAAFHLQFDELPTDPNVKKWSVHVLKLSCTKRHLDRAELHKFWEMLDRHISKSNKREWLRY

SEQ ID NO: 164029 - protein, 265 aa, Heterodera glycines
  Coding regions on vcDNA: vcDNA=SeqID_90452; Strand=+; Position=1-795
VRYLAIFAKMNNAMDSVPARIVIIGTSKMRLSERFNKLQKAPPPPLPQAQQQKVFLKREGINGVAIGPVISRPRVIDERDRPDNRIQSSKSFLHDDYMDNDLYGDFVEPFLRRPQMGGFRSANLYEGFQPAPDPLKLTLDAYDQYSRFRPSHRRSIHSRITETSMSRFRNLPVYDESEDALYGDYDEPPRSRMYNQNDYNRRPIHQRLSFKPMRLSGYDFLRRPLHRHTTQFKRPFYNRGSHFSFNRWRTNDWNRRGASMPFGRR

SEQ ID NO: 164030 - protein, 227 aa, Heterodera glycines
  Homolog annotation: Hit_ID=NP_956668.1; Match level="QueryCoverage =79%, HitCoverage=97%, E-value=1e-22, Identity=31%"; Hit description =tumor necrosis factor, alpha-induced protein 8, like [Danio rerio] gb|AAH53238.1| Tumor necrosis factor,
  Gene Ontology: Biological process=anti-apoptosis
  Coding regions on vcDNA: vcDNA=SeqID_90453; Strand=+; Position=26-709
MASSDSDSSSFAFPQNSKCGATASGQKTTANASSSLAMRVQRKVLSKLSKRGMVRLLGDNRLIALMDALYEMLREFYDSKTAEKVVKNGIKLIVKVGLLCRENKLSEEQQRLLSAVESEFGRLALTIQSFRKVQFSYNRTFLLSSIDAIHRSILKIVEQTLSEKSAKRVENVFGHFSNGEFLDFVFTSSGAIHTEMVRQFAAELDNLLAIGTEEDGGETARDENSTP

SEQ ID NO: 164031 - protein, 199 aa, Heterodera glycines
  Homolog annotation: Hit_ID=AAH77441.1; Match level="QueryCoverage =97%, HitCoverage=99%, E-value=2e-12, Identity=26%"; Hit description =Unknown (protein for MGC:82284) [Xenopus laevis]
  Coding regions on vcDNA: vcDNA=SeqID_90454; Strand=+; Position=34-633
MKFHFNGGLDCPEWILSQIPEIAKTDTKMLQTLGSTIIEMAKVKQTEWHETDIKKFCFAEMSVDGLRALKAKTAALCFIFEKTTKNDCSCKDLEKELLQLGLPSDHVSVLVELYNSNRAALCDSLAGPAIKAPSLTVVCKEQVPTAADPSVKSDYFRLDTTSSDGSTATLLIHRDELVQLRTCMEDAVKVLESLVVNKE

SEQ ID NO: 164032 - protein, 217 aa, Heterodera glycines
  Homolog annotation: Hit_ID=CAC19673.1; Match level="QueryCoverage =68%, HitCoverage=22%, E-value=1e-20, Identity=36%"; Hit description =TAFII70 protein [Pleurodeles waltl]
  Gene Ontology: Mol. function=general RNA polymerase II transcription factor activity; Cellular component=nucleosome; Biological process =establishment and/or maintenance of chromatin architecture
  Coding regions on vcDNA: vcDNA=SeqID_90455; Strand=+; Position=1-651
GPLDVECHAPTPSTSPSNVNEPEILANLAAFESNFVSVISEQLGTDILPSSSSAVALHVSSLIRNVLRLARKFQRSARRKWLSSEDVEAALAYYGHTSLIGYEGVDDVKFRHVEKMGRDVFVREDPELDLNAVINTPPPKLTLEVTVKAHWLAINGVQPAVPENPLPPTPKDALPLANEEDSASTSAGPTSRTLLLNQYAKSMRKTEQVQIKSTTTH

SEQ ID NO: 164033 - protein, 162 aa, Heterodera glycines
  Homolog annotation: Hit_ID=NP_505165.1; Match level="QueryCoverage =55%, HitCoverage=61%, E-value=6e-10, Identity=38%"; Hit description =heat shock protein (17.6 kD) (hsp-17) [Caenorhabditis elegans] gb|AAB37035.1| Heat shock protein protein
  Coding regions on vcDNA: vcDNA=SeqID_90456; Strand=+; Position=48-536
MLSPFTYDPFNRRSLWPMTTIVGNVLSPFRQLERELDHFFDGMQPMLRDHVAQLNVSNKGDFTYKVDVSGFRPEEINVEVVGNEFIVNGEHREQNDSEFVHRQFLRRVLIPEGIQKESIKCELDGGRLLISGTKTAGKGGRTIPIEMKKAAVEQQKEEEKKQ

SEQ ID NO: 164034 - protein, 442 aa, Heterodera glycines
  Homolog annotation: Hit_ID=NP_510509.2; Match level="QueryCoverage =100%, HitCoverage=76%, E-value=1e-152, Identity=56%"; Hit description=laminin A (XP714) [Caenorhabditis elegans] emb|CAB05478.2| Hypothetical protein F09B12.3 [Caenorhabditi
  Coding regions on vcDNA: vcDNA=SeqID_90457; Strand=+; Position=1-1326
CTFYQTYCSKLKPYLTQNLDFVQQRLANSAADDPYWQGVKRAYLQMTGVWHGFSDAQFNVSIDFSLNPILMLNAHGDFYELETKFNRSKDPRDEATGGRCSGLVKIAPNNADILFSQVTMCGFESLLRVLKLYKFGYDRALYPGHTTTISSYPGLLYSADDFALMSSGLAILETTMKIFNNTLLNEIKPDGVLHCWVRAIVANQMARTAREWCHIFKRFNSGTYNNQWLIVDYNKFKPYTELPDHGLFYVLEQMPTIVLYQDMTQWLKQNGYFASYNIPFFKKTSLISGFEQKGNEFYWFSWKSCPRAKIFARDQHKVVDLDSLTKLMRYNDYTRDPYSRCNCTPPYTAEAAISARGDLNPANGTFEIPGMGHVNHAALDYKGTGYKMFKKLQFRAWSGPTYDDVPVFDWLESDLAPTVKHYGHPLRWEFLPVEYEWETVLN

SEQ ID NO: 164035 - protein, 65 aa, Heterodera glycines
  Coding regions on vcDNA: vcDNA=SeqID_90458; Strand=-; Position=72-269
FFFFFFFRKLMIYLYKLLLKLSVRVIDDSSIHPSFLSLSGKCYSFCRLNVSLTHCLSLIMPMARS

SEQ ID NO: 164036 - protein, 88 aa, Heterodera glycines
  Homolog annotation: Hit_ID=AAH73580.1; Match level="QueryCoverage =92%, HitCoverage=95%, E-value=8e-24, Identity=64%"; Hit description =MGC82877 protein [Xenopus laevis]
  Coding regions on vcDNA: vcDNA=SeqID_90459; Strand=+; Position=47-313
MADSTGNAAFIKAADEAKTLSYQPSNDELLELYALFKQGTVGDNDTPRPGMFDIKGKAKWDAWTAKKGTTKEDAQQKYIDLVEALKKK

SEQ ID NO: 164037 - protein, 170 aa, Heterodera glycines
  Coding regions on vcDNA: vcDNA=SeqID_90460; Strand=+; Position=1-513
VHIYHIPQLIMNKIFANDSKAVFEDDMHIGEAFDEVFKQIYEQENEMPFDRSREIWKEVEHSEKTLVHETNHLLKNQGLQNSIETEMKMLKDAEASLDALKKRELELVRHYKDKQSKILSSLDHVEHLTQMVDTDIENDQKTLNDILRSYEDELQEMKNLIMAKKRLLSD

SEQ ID NO: 164038 - protein, 113 aa, Heterodera glycines
  Homolog annotation: Hit_ID=AAC15708.1; Match level="QueryCoverage =100%, HitCoverage=35%, E-value=3e-61, Identity=100%"; Hit description=beta-1,4-endoglucanase-2 precursor [Heterodera glycines]
  Coding regions on vcDNA: vcDNA=SeqID_90461; Strand=+; Position=1-342
TLHFYASSHFVDGLGNKLKTAVNKGLPVFVTEYGTCEASGNGNLNSGSMSSWWSLLDQLKISYVNWSITDKSEACAALTGGTSAANVGTSSRWTQSGNMVASQHKKKSTGVKC

SEQ ID NO: 164039 - protein, 244 aa, Heterodera glycines
  Coding regions on vcDNA: vcDNA=SeqID_90462; Strand=+; Position=2-736
FGEGLVDFFRPLELIQILLACPQSCTCLKNNFGIHLEGFFESLCVIRCKFGELLMNNGWETKFDPRTLICAYETFNIVALITKRIEQPRRNSQGEEIGVNEAERGLSLTDRILYNEMKWFATVLNERTPSFSIIQMFLRCLSLHLCASQLSAVVLNETASLLNELRYRLENVYDARPVMSALKKCVNHLNEALEGCEERDQAERIIEHKVRPMEEYFEAEERGDTTQMAAEENDAYHEIDDGEL

SEQ ID NO: 164040 - protein, 152 aa, Heterodera glycines
  Homolog annotation: Hit_ID=CAE60405.1; Match level="QueryCoverage =90%, HitCoverage=26%, E-value=2e-20, Identity=34%"; Hit description =Hypothetical protein CBG04010 [Caenorhabditis briggsae]
  Gene Ontology: Mol. function=transcription factor activity; Cellular component=nucleus; Biological process=cell proliferation
  Coding regions on vcDNA: vcDNA=SeqID_90463; Strand=+; Position=65-520
MKQQSVDSFIPSSNSLQICGGCEMRIEERHSLCVHRPRHFANFDRETEAEYWHENCLKCCQCERRLGTGEKRFVRDGRVYCREDHSKSFGTSSCQPNCARCAIPIEPAELVFRSGLFNVFHTHCFKCSCCGNALAKGDQYTNTGGALICQRD

SEQ ID NO: 164041 - protein, 163 aa, Heterodera glycines
  Coding regions on vcDNA: vcDNA=SeqID_90464; Strand=-; Position=1-489
RRECREMPSIEMPPIRPTRFFVPRPFRHHLRPAAHFRSNVQKCPPFSPIRRPSLPHIAGDPGKCWRITSITSRTFLASFRPAKLLDCFPSVCVMSNTSSSVVGIAQLKNGQKPCLLTWAEGHGPWPMCWHFAYLAKPAASDVSHSGQMQADISKLLADVTELR

SEQ ID NO: 164042 - protein, 110 aa, Heterodera glycines
  misc_feature (51)..(51): Xaa can be any naturally occurring amino acid
  Coding regions on vcDNA: vcDNA=SeqID_90465; Strand=-; Position=2-331
IRLFRWYTSGCCWWSVAKFDFFAHPLKLVLVYLLCICELHRCIRFLLCFSXNLSFGSVGVFEDFPAAAPFCSSIPKTKSATNEAATSSKMSLAGTDIGTGTAKKKMICLV

SEQ ID NO: 164043 - protein, 115 aa, Heterodera glycines
  Homolog annotation: Hit_ID=NP_013086.1; Match level="QueryCoverage =81%, HitCoverage=6%, E-value=1e-29, Identity=65%"; Hit description =ABC type transmembrane transporter of MRP/CFTR family, found in vacuolar membrane, involved in the transpo
  Gene Ontology: Mol. function=bilirubin transporter activity; Cellular component=mitochondrion; Biological process=bilirubin transport
  Coding regions on vcDNA: vcDNA=SeqID_90466; Strand=+; Position=26-373
CGKLFHFCLGQRQLLCLTRALLRSSRILILDEATASVDMETDALVQETIRREFSDYTVLTIAHRLETILDSDRVMVLQQGKVEEFDSPKDLSDDLNSAFSAMLAGAKLTKSHENA

SEQ ID NO: 164044 - protein, 106 aa, Heterodera glycines
  Homolog annotation: Hit_ID=AAT92076.1; Match level="QueryCoverage =96%, HitCoverage=44%, E-value=6e-27, Identity=45%"; Hit description =Hypothetical protein F42H10.3 [Caenorhabditis elegans] sp|P34416|LAS1_CAEEL LIM and SH3 domain protein F42
  Gene Ontology: Mol. function=SH3/SH2 adaptor protein activity; Cellular component=sarcomere; Biological process=somatic muscle development
  Coding regions on vcDNA: vcDNA=SeqID_90467; Strand=+; Position=2-322
TNVEKPVGSIADYDPLAAEKQQQKAPAAGAAAPKANGGGFTVKALYDYTAADKDEVSFKEGDVIVNCQKVDDGWMTGTVQRTLLWGMLPANYVEQVKQPVGQFKLK

SEQ ID NO: 164045 - protein, 131 aa, Heterodera glycines
  Coding regions on vcDNA: vcDNA=SeqID_90468; Strand=+; Position=3-398
RRVGRTEQKWGGRNAREIGIFDARRIRRIGRANIGRAHSKGETERHSVRRIDTAQPRDVRGEQQLATERHSQRAVHLCALEFVDYKMFEQCLANDANTNDQIPAAIPLAIGGFAVPFLVTLSSILTLLLPF

SEQ ID NO: 164046 - protein, 126 aa, Heterodera glycines
  Coding regions on vcDNA: vcDNA=SeqID_90469; Strand=+; Position=65-445
MRKSGVESSADTLSPASSSAELSSRLLNANPVWSVYSSSNPYSYWPYRYLTDPNSHEVFWHDVHSQFSALRRLDLFGKHKPPVDYMANNHFWTYPYPYWARHRGYLFDYANPSFYSKEFDLHYYEH

SEQ ID NO: 164047 - protein, 323 aa, Heterodera glycines
  Homolog annotation: Hit_ID=NP_505849.1; Match level="QueryCoverage =93%, HitCoverage=40%, E-value=2e-83, Identity=47%"; Hit description =beta-galactosidase (5L700) [Caenorhabditis elegans] emb|CAA98542.1| Hypothetical protein T19B10.3 [Caenor
  Gene Ontology: Mol. function=beta-galactosidase activity; Cellular component=extracellular space
  Coding regions on vcDNA: vcDNA=SeqID_90470; Strand=+; Position=2-970
AAGLNAVQLYIPWNFHEQEIGRFNFGGDRNISRFIRIAKQNELYVLIRMGPYVCAELEFGGLPWWLIKDQAKVRLRSSETTYLRHVHRWLAALLSVLRPLLYKNGGPILMVQLEKEYGSVSVCDHDYMRWLRDFVRETLGEDVVLYTTDGPTEKMLSCGAIESTFATVDFGTQQTEANVKEMFELQRKYSKGGPPVNSEFYTTWFSMWGEKSMVRQEIGPVLKTMDYMWAENASFSLYMIHGGTSFGFWSGRETNGPVITSYDYAAPIDEAGQITPLYGAIRNWIGAKKDWSNPPLPLPKNRTGVSIQNVFAVKLGDFIALTN

SEQ ID NO: 164048 - protein, 152 aa, Heterodera glycines
  Homolog annotation: Hit_ID=NP_741446.1; Match level="QueryCoverage =94%, HitCoverage=96%, E-value=3e-46, Identity=62%"; Hit description =serine/aRginine rich pre-mRNA SPlicing factor, Serpin (20.5 kD) (rsp- 6) [Caenorhabditis elegans] gb|AAA82
  Gene Ontology: Mol. function=pre-mRNA splicing factor activity; Cellular component=nucleus; Biological process=spliceosome assembly
  Coding regions on vcDNA: vcDNA=SeqID_90471; Strand=+; Position=52-510
MSSRRNEYLDAKIYVGGLPEDATSEELDDAFHRFGRIRKIWVARRPPGFAFVEFEDARDAEDAVRALDGTRICGVKARVELSHGNGRGGGRGFRGGGGRYDDRYGRDRYDRDRDRRYRSRSRSRTPRRSRSRSPPLRERSRSPSYSRRSRSR

SEQ ID NO: 164049 - protein, 95 aa, Heterodera glycines
  Homolog annotation: Hit_ID=CAE62896.1; Match level="QueryCoverage =81%, HitCoverage=7%, E-value=1e-23, Identity=67%"; Hit description =Hypothetical protein CBG07084 [Caenorhabditis briggsae]
  Coding regions on vcDNA: vcDNA=SeqID_90472; Strand=+; Position=3-290
SSVPSLIMLGIFVATFFSSMSNLIGASRVLTRFAQDKLFGALLRPATIEVGSKRNPIISVIISWICVVMVLMIGAMNRIAKLSFPTNTGIISGKM

SEQ ID NO: 164050 - protein, 73 aa, Heterodera glycines
  Coding regions on vcDNA: vcDNA=SeqID_90473; Strand=+; Position=14-235
NMRHQFPIIFALFLILPILIGKTECQSDFWASLSQPLVSVGSDAKMPLKDFGMDFSRLNDYSSLFGRRKKRAH

SEQ ID NO: 164051 - protein, 43 aa, Heterodera glycines
  misc_feature (12)..(12): Xaa can be any naturally occurring amino acid
  Coding regions on vcDNA: vcDNA=SeqID_90474; Strand=-; Position=2-133
FALSDHSFFSPXLLISFLITFSPPPAFDHFFYCLSDHSNFCSF

SEQ ID NO: 164052 - protein, 181 aa, Heterodera glycines
  misc_feature (143)..(143): Xaa can be any naturally occurring amino acid
  Homolog annotation: Hit_ID=CAE58385.1; Match level="QueryCoverage =95%, HitCoverage=90%, E-value=2e-32, Identity=43%"; Hit description =Hypothetical protein CBG01514 [Caenorhabditis briggsae]
  Coding regions on vcDNA: vcDNA=SeqID_90475; Strand=+; Position=515 -1058
MSPFPPSATDIFSLLDAIDKLKHLKRTGWVLVGISEPETVASHMYPMATLAMTLSAHRTDLDVNKCIRMALVHDIGEAIIGDITPHCGVSNEEKFKIEKEAVETISNWLPETVGDEWKNLWREYDEGKSAEAKAVKQLDKLVXDMLAQAFSYEERLSIDLTEFFDATSNAFSEEPFASWAA

SEQ ID NO: 164053 - protein, 65 aa, Heterodera glycines
  Coding regions on vcDNA: vcDNA=SeqID_90476; Strand=-; Position=2-196
FLPPSSAHFVTTYQPQLLTSARSCCEISICSRLSMRSRHTLTRVPCTRCCSSISSRRTLIISSLF

SEQ ID NO: 164054 - protein, 68 aa, Heterodera glycines
  Coding regions on vcDNA: vcDNA=SeqID_90477; Strand=+; Position=1-207
GQFNGRIFNNKLNNLGFPTFITFAQLMDPSRGFYDKDGDKVTLAVDVAVKSKKGRSANYRMSKSHHIW

SEQ ID NO: 164055 - protein, 109 aa, Heterodera glycines
  Homolog annotation: Hit_ID=NP_492133.1; Match level="QueryCoverage =85%, HitCoverage=41%, E-value=1e-30, Identity=68%"; Hit description =dual specificity phosphatase 1 (25.6 kD) (1I234) [Caenorhabditis elegans] emb|CAB01700.1| Hypothetical pr
  Gene Ontology: Mol. function=protein tyrosine phosphatase activity; Cellular component=cytoplasm; Biological process=protein amino acid dephosphorylation
  Coding regions on vcDNA: vcDNA=SeqID_90478; Strand=+; Position=214-540
WNKNIIISFKINPMKLWVEDTTDEDLFPHFDIVADQIHAVIQDRGAVLVHCVAGVSRSAAICLAYLLKYRTRSLRAAYHLMCSKRPMVRPNLSFWRQLIHYEQVTRSIC

SEQ ID NO: 164056 - protein, 78 aa, Heterodera glycines
  Coding regions on vcDNA: vcDNA=SeqID_90479; Strand=-; Position=26-262
TCPSQAVGDRATQQHSSPSRMQPKKHDPSLSHPSPLGVHAPPHWPFAIMNMFMVMMVANKITAKISEKFFILFRVFWN

SEQ ID NO: 164057 - protein, 66 aa, Heterodera glycines
  Homolog annotation: Hit_ID=AAV38791.1; Match level="QueryCoverage =100%, HitCoverage=35%, E-value=3e-28, Identity=83%"; Hit description= glyoxalase I [Homo sapiens] gb|AAV38790.1| glyoxalase I [Homo sapiens] emb|CAI21586.1| OTTHUMP00000039715
  Gene Ontology: Mol. function=lactoylglutathione lyase activity; Biological process=carbohydrate metabolism
  Coding regions on vcDNA: vcDNA=SeqID_90480; Strand=+; Position=2-202
YHNGNSEPRGFGHIGIAVPDVDSACARFEQLGVKFVKKPNEGRMRGLAFITDPDGYWIEIFNPNNM

SEQ ID NO: 164058 - protein, 118 aa, Heterodera glycines
  Coding regions on vcDNA: vcDNA=SeqID_90481; Strand=-; Position=305-661
HIQNILTKMAFDSFDFQFHFAFSFFLCSSLFLFSVRRLFLQFSLFCAHLIKSFFWRSVDAFVINNDEGNQSDGKGAKSEGEQFATFHFVLHSLPMASDFVNFNSLIKITHRPQILVSA

SEQ ID NO: 164059 - protein, 90 aa, Heterodera glycines
  misc_feature (5)..(8): Xaa can be any naturally occurring amino acid
  Coding regions on vcDNA: vcDNA=SeqID_90482; Strand=-; Position=39-311
FFFFXXXXFFTTFFLMTNKEKQKILKWKTKIKSKERFEPCEHFHHQIPLTKTRIFWQQVEKHFQLQNLFHEAQLVPFDLLKLVPRVDFVH

SEQ ID NO: 164060 - protein, 106 aa, Heterodera glycines
  Coding regions on vcDNA: vcDNA=SeqID_90483; Strand=+; Position=23-343
MPRLLSSFAFFVLSIICSIVFFEPIHGQDVCRHQGKEYRNGDEWIVSNSFIMNCIVHYNRWETKIIACLSMLGERIPVNGQISDQHGVWKCEQKPNGSTRLVQQKQ

SEQ ID NO: 164061 - protein, 42 aa, Heterodera glycines
  Coding regions on vcDNA: vcDNA=SeqID_90484; Strand=-; Position=211-339
FFFFFFFFFFFFFFFLFFFFFFFPNSALNDYYHKKETNLRLN

SEQ ID NO: 164062 - protein, 79 aa, Heterodera glycines
  Coding regions on vcDNA: vcDNA=SeqID_90485; Strand=+; Position=62-301
RLNNEYLGISCFFFAFFLLELFFFLFSAAVANGAHLVDSSVDQIGRAQHNHNGDINIRRGIERFNDNRMAQNELDFLHI

SEQ ID NO: 164063 - protein, 114 aa, Heterodera glycines
  Homolog annotation: Hit_ID=NP_498300.2; Match level="QueryCoverage =94%, HitCoverage=95%, E-value=4e-49, Identity=78%"; Hit description =LIM protein (12.2 kD) (3H62) [Caenorhabditis elegans] gb|AAM97945.1| Mlp/crp family (muscle lim protein/c
  Gene Ontology: Cellular component=nucleus; Biological process =myogenesis
  Coding regions on vcDNA: vcDNA=SeqID_90486; Strand=+; Position=67-411
MPGFVPPVQSKCPKCGKSVYAAEKMVAGGYDWHKFCFKCEMCNKLLDSTNACPHEAQLYCKQCHGRKYGPKGVGFGIGAGCLTTDSGEKFGNKRVENRPLMAEAFTAPINPQQQ

SEQ ID NO: 164064 - protein, 97 aa, Heterodera glycines
  Homolog annotation: Hit_ID=AAC48326.1; Match level="QueryCoverage =98%, HitCoverage=30%, E-value=2e-13, Identity=39%"; Hit description =beta-1,4-endoglucanase-2 precursor [Heterodera glycines]
  Coding regions on vcDNA: vcDNA=SeqID_90487; Strand=+; Position=7-300
MLKKAIKSGLPVFVTESGAGSGGSNAPVNLPVMNQWWSLLEQLKISQIIWAVRGEGNLQNPLNKNTAPANIGQNWALTEYGNVVKNVFTKNAKPIGC

SEQ ID NO: 164065 - protein, 98 aa, Heterodera glycines
  Coding regions on vcDNA: vcDNA=SeqID_90488; Strand=-; Position=3-296
RFVFCRTPIRLRSRRHAHPSNCQTNRIGASYAAERRPPRSKETRTEAEEEGKRKRKKKRKKWNEMEPEEKEEGKRKRKKKRRKRNEKETEEKGEGKRV

SEQ ID NO: 164066 - protein, 131 aa, Heterodera glycines
  Coding regions on vcDNA: vcDNA=SeqID_90489; Strand=-; Position=255-650
ILYFRKTQKISNAFVLSKKQSPNFSSTFIYSKSFFTHVRSCSATPAAGACLGLLGSLGRSSFCCCRRRFSFGWRSGLNTTAHGHGSDQRNQQHHQEAERRHFCFLRDLLVFVFDSSDQNHLKYQQKSKSFL

SEQ ID NO: 164067 - protein, 136 aa, Heterodera glycines
  Coding regions on vcDNA: vcDNA=SeqID_90490; Strand=+; Position=3-410
CIATYETDGQAQLARERLHNVVWPVASDLALCVEFSTEEKLNRRKAEEEQEASANNSALGGGLGLTIVVDNRGRGPETVPNSGPTVLIQHDKKRQKDAENRKRKVEELEKSQKTLDEVFKKTKTLPAIYFLPLSDE

SEQ ID NO: 164068 - protein, 179 aa, Heterodera glycines
  Coding regions on vcDNA: vcDNA=SeqID_90491; Strand=+; Position=203-739
FIPASFLEKQSMNLRKKTKVEPIEDEIPENEQQINISTRSHNSSYNSDRVNENDLVKSLSQCLLANVSKRGFVRDADIGEMFSDRRERELRANVLKKSEKLLMDVLGYRLDRDEEGKRFYLSTNLCKGIAMAMEISDDTHRGLNEFADEDAFEEESTQTEQFTNCLLEMALMFIFMSKR

SEQ ID NO: 164069 - protein, 86 aa, Heterodera glycines
  Homolog annotation: Hit_ID=AAB07482.1; Match level="QueryCoverage =93%, HitCoverage=17%, E-value=1e-31, Identity=80%"; Hit description =beta-II tubulin sp|Q94571|TBB2_HOMAM TUBULIN BETA-2 CHAIN (BETA-II TUBULIN)
  Gene Ontology: Mol. function=GTP binding; Cellular component=tubulin; Biological process=microtubule-based process
  Coding regions on vcDNA: vcDNA=SeqID_90492; Strand=+; Position=2-262
TFIGNSTAIQELFKRVTEQFNAMFRRKAFLHWYTGEGMEEIEFTEAESNIGDLISEYQQYQDATADEDVMEEEKSETEGEKADEAN

SEQ ID NO: 164070 - protein, 56 aa, Heterodera glycines
  Homolog annotation: Hit_ID=AAL28797.1; Match level="QueryCoverage =75%, HitCoverage=75%, E-value=3e-11, Identity=76%"; Hit description =LD18683p [Drosophila melanogaster]
  Gene Ontology: Biological process=female meiosis chromosome segregation
  Coding regions on vcDNA: vcDNA=SeqID_90493; Strand=+; Position=2-172
FTHYRRTSLRWIDDGSRVYALPEDIVEVKSKMVMTVFACMMALDFMPNMKEVTNGN

SEQ ID NO: 164071 - protein, 132 aa, Heterodera glycines
  Coding regions on vcDNA: vcDNA=SeqID_90494; Strand=+; Position=3-401
SPPSKLLKQMNKTSVGRGGGKTSTDATTETSEDDECFEGTHSVSMHSMRQRVLQRMEDEHLFDSYSFVGLSELDDELEKCADDPDEQVRLIESRMRELSEIFHKYKGKLADLEKEHKKRSRQEKKRKMMTDK

SEQ ID NO: 164072 - protein, 200 aa, Heterodera glycines
  misc_feature (142)..(142): Xaa can be any naturally occurring amino acid
  Homolog annotation: Hit_ID=NP_001007926.1; Match level="QueryCoverage= 91%, HitCoverage=82%, E-value=3e-17, Identity=27%"; Hit description =similar to C3HC4-like zinc finger protein [Gallus gallus] emb|CAG31169.1| hypothetical protein [Gallus
  Gene Ontology: Mol. function=DNA binding; Biological process =regulation of transcription, DNA-dependent
  Coding regions on vcDNA: vcDNA=SeqID_90495; Strand=+; Position=83-683
YLSKSNTYYLKIYAFLNSKMGQKESRHAFVNCALIRREEFEDKIQELNKKCAECFEESTLNMLFATKSTEERGILWQRSVRIHCFTVFDEKIYRKVYSLFQFLKFYESFIQILEASEASKHRENSLNNKDLMSMSIFKGKLXEYSEDGRCIICFDSFPDSVLPCAHAYCSKCVDPFPAVHQPCCPLCRHPLKRDGQDQTW

SEQ ID NO: 164073 - protein, 64 aa, Heterodera glycines
  Coding regions on vcDNA: vcDNA=SeqID_90496; Strand=+; Position=2-196
ARPPPRAINVVANKEWMDGRVLIALVEMIAYGTINLLFFISSIPSKVLSLKALFCLLLVNKFHF

SEQ ID NO: 164074 - protein, 72 aa, Heterodera glycines
  Homolog annotation: Hit_ID=CAE74176.1; Match level="QueryCoverage =93%, HitCoverage=96%, E-value=2e-13, Identity=53%"; Hit description =Hypothetical protein CBG21849 [Caenorhabditis briggsae]
  Coding regions on vcDNA: vcDNA=SeqID_90497; Strand=+; Position=75-293
MRNLLLAALAIAVMLLCCAEAVPMENENQLVRHKRWGYGYGGGWGGGWGRGGWGGGWGGRGWGGGYGYGWGR

SEQ ID NO: 164075 - protein, 77 aa, Heterodera glycines
  Coding regions on vcDNA: vcDNA=SeqID_90498; Strand=+; Position=50-283
KLFWRETIREKRRGGQSDRRWRRNRGMSILDSPRIILNGKTNQFNVLKFVMYFHHSFTFILFCHHYQAYSYISGSCK

SEQ ID NO: 164076 - protein, 127 aa, Heterodera glycines
  Homolog annotation: Hit_ID=NP_494828.1; Match level="QueryCoverage =87%, HitCoverage=45%, E-value=4e-19, Identity=37%"; Hit description =predicted CDS, putative cytoplasmic protein (2E969) [Caenorhabditis elegans] gb|AAA81119.1| Hypothetical
  Coding regions on vcDNA: vcDNA=SeqID_90499; Strand=+; Position=38-421
MTTTNPNYDKPLCLNGLSQYEALPSSLCNLNLCNFIGRNLCELLQQPGNHTVREMEQKAAWNATVVMPDSPRIFGIPFVDLFAGEFNFEFLLETEGKEIAHLEVPTNLAFVPIGMQNEEDEDGEGQC

SEQ ID NO: 164077 - protein, 180 aa, Heterodera glycines
  Homolog annotation: Hit_ID=NP_509391.1; Match level="QueryCoverage =99%, HitCoverage=74%, E-value=7e-38, Identity=42%"; Hit description =placental protein 11 like precursor (62.8 kD) (XI865) [Caenorhabditis elegans] gb|AAF99995.2| Hypothetica
  Gene Ontology: Mol. function=serine-type peptidase activity; Cellular component=extracellular space; Biological process=proteolysis and peptidolysis
  Coding regions on vcDNA: vcDNA=SeqID_90500; Strand=+; Position=11-550
MAYDYLDRLGKVDGLDFDAFTRQLFDRWFGAYTRCGTCKNGKCSRHGGPLGSSGWEHVFSGEWRGEIVDGHHSWVRFYLQEKAGDIEYHGYYVKPRHGQFIGTIQYKWKQYLKRIGGFMIGTSPAFDFSLLTVCILTEPGDRKCKFQLKETPMFVSSFLEDCVIDGSFRHNFCIATAYPG

SEQ ID NO: 164078 - protein, 195 aa, Heterodera glycines
  misc_feature (189)..(189): Xaa can be any naturally occurring amino acid
  Homolog annotation: Hit_ID=AAL78216.1; Match level="QueryCoverage =100%, HitCoverage=58%, E-value=1e-108, Identity=96%"; Hit description=aspartic protease precursor Hgg-33 [Heterodera glycines]
  Gene Ontology: Mol. function=aspartic-type endopeptidase activity; Cellular component=extracellular space; Biological process=induction of non-apoptotic programmed cell death
  Coding regions on vcDNA: vcDNA=SeqID_90501; Strand=+; Position=3-586
DIVCMANICVQKQEFTEATSGPGLTFVAAKFDGILGMGFSEISVQKLPTVFDNMVTQQKVPEPVFAFWLNRDPTSEFGGEITIGGTDQRRFVAPITYTPVTHKAYWQFKMDSISGGNGKLACQNGCQAIADTGTSLLAGPKNDIEKIQKHIGAIPLFHGEYMISCERIPTLPDVTINIGGQAYTLKGQXLCAEND

SEQ ID NO: 164079 - protein, 153 aa, Heterodera glycines
  Coding regions on vcDNA: vcDNA=SeqID_90502; Strand=+; Position=3-461
LVMYIRELESPDEHSLVLFNPLRSCFRPTRDELFSAIACQRRSIVRLNTERARFVRQNGALLRMIVRLTGGIPPNFNHAHFAAAAQPAVNVTAVITNANPNGQNYNRLQRLHAELSETIDRFTEENSLLGYMNDQLTEQLEPLTEVPPNANFN

SEQ ID NO: 164080 - protein, 42 aa, Heterodera glycines
  Coding regions on vcDNA: vcDNA=SeqID_90503; Strand=+; Position=63-191
LVFLRKSLQRMSQHYLQLSIEITNCRVHLLYPIHLFFHFIKT

SEQ ID NO: 164081 - protein, 253 aa, Heterodera glycines
  Homolog annotation: Hit_ID=NP_827559.1; Match level="QueryCoverage =88%, HitCoverage=78%, E-value=6e-55, Identity=50%"; Hit description =putative secreted lyase [Streptomyces avermitilis MA-4680] dbj|BAC74094.1| putative secreted lyase [Strep
  Coding regions on vcDNA: vcDNA=SeqID_90504; Strand=+; Position=31-792
MSFLLFVTIAFANLAPNAFGQQWPKATSDETVSATIKVSGGTKDFGYKRLTASSALGTGDQSEGQKALIRAEKGAVIKNLIIGQNGADGIHCYDGCTLQNVWWEKVGEDAATFRSSSGCKEYNFLVTGGGVKNAKDKVFQMNGGGTLTIKDFVAENIGKLARSCGNCKSQCQKRKFVVENVKVTGLKTLLCGLNENYGDVATIKNVQVSGPSKKVCAEFEGNDKQKEPPMLRSFDVGSSGDGKNCIISSTTSG

SEQ ID NO: 164082 - protein, 32 aa, Heterodera glycines
  Coding regions on vcDNA: vcDNA=SeqID_90505; Strand=+; Position=1-96
IYSHKSSFCMIGIKHFCLTLSCNLIPKINKYV

SEQ ID NO: 164083 - protein, 80 aa, Heterodera glycines
  Homolog annotation: Hit_ID=NP_508537.1; Match level="QueryCoverage =100%, HitCoverage=3%, E-value=4e-28, Identity=71%"; Hit description =spectrin (spc-1) [Caenorhabditis elegans] gb|AAB53876.1| Spectrin protein 1 [Caenorhabditis elegans] pir|
  Gene Ontology: Mol. function=structural constituent of cytoskeleton; Cellular component=spectrin; Biological process=body morphogenesis (sensu Nematoda)
  Coding regions on vcDNA: vcDNA=SeqID_90506; Strand=-; Position=243-485
FMINKETENVRSSDEIEMAFRALSKEYRPYVFAEELFANLTQEQAQYCKQRMKPYVDAASGRTIENALDFEQFVHSMFMN

SEQ ID NO: 164084 - protein, 129 aa, Heterodera glycines
  Homolog annotation: Hit_ID=YP_054227.1; Match level="QueryCoverage =89%, HitCoverage=95%, E-value=3e-31, Identity=52%"; Hit description =hypothetical protein PTMB.298c [Paramecium tetraurelia] emb|CAH03496.1| hypothetical protein [Paramecium
  Coding regions on vcDNA: vcDNA=SeqID_90507; Strand=+; Position=21-410
MNVKGGGISQVNDSTSDEMRLFRGGLRHAGQTPSRLIYDTTSCIRNYHDKYSYERGFIAHSRSPSNQYLNFHFMYGGFKKFALERHVYQNWYRKNIRNWWLPAIICYTAGCLTMRMYDNAAYDYFYFSD

SEQ ID NO: 164085 - protein, 95 aa, Heterodera glycines
  Coding regions on vcDNA: vcDNA=SeqID_90508; Strand=+; Position=1-288
FAVLLILSLQIAEIIAKKPKYCGERFAKMRDKVCRWPGEQQPCLQLHHSIKERVRTKCCAEGCSLEEMKEEMCCMTDACLRRCYPGKGYRLGSVY

SEQ ID NO: 164086 - protein, 113 aa, Heterodera glycines
  Homolog annotation: Hit_ID=CAE66673.1; Match level="QueryCoverage =97%, HitCoverage=83%, E-value=1e-46, Identity=76%"; Hit description =Hypothetical protein CBG12012 [Caenorhabditis briggsae]
  Coding regions on vcDNA: vcDNA=SeqID_90509; Strand=+; Position=31-372
MVFQLVYPILPAFAKPAWNHPAGPKTVFFWSPTIKWVLVGAGLSDLARPANKLSIYQNTALMATGMIWTRYCFVIVPKNYYLASVNFFVGCTGLAQILRIAHYQYIHSEETSK

SEQ ID NO: 164087 - protein, 134 aa, Heterodera glycines
  Coding regions on vcDNA: vcDNA=SeqID_90510; Strand=+; Position=2-406
LKTQLKFVGFGKYFSFKALSWYFQSFLIGIDTLVVGIRDDNFKLTHVEYYPLENLQSFFKKSGFDTNKCLLFLHRFLSTVKNELNGVPEGSILVTERLKNTDQFVFTTIDVEDEMGQAEYAVISKEFRDHNWTH

SEQ ID NO: 164088 - protein, 161 aa, Heterodera glycines
  Homolog annotation: Hit_ID=CAE73459.1; Match level="QueryCoverage =96%, HitCoverage=46%, E-value=1e-30, Identity=36%"; Hit description =Hypothetical protein CBG20909 [Caenorhabditis briggsae]
  Gene Ontology: Mol. function=ligand-dependent nuclear receptor interactor activity; Cellular component=cytoplasm; Biological process=dauer larval development (sensu Nematoda)
  Coding regions on vcDNA: vcDNA=SeqID_90511; Strand=+; Position=2-484
PKNEFKALDAFALSAHLRPGRHRCDCQARLHSLVRNCIGCGRIVCAQEGSGRCFYCGRLVCTREEKTIIERKDGEGLRLLRCLLNDLQADYFSLEHNPYLTAAEREAIGNRKEELRQLSLSVKRNILVDLDISNGAMHQQKQKPIETVDDPILQAILLNSA

SEQ ID NO: 164089 - protein, 133 aa, Heterodera glycines
  Coding regions on vcDNA: vcDNA=SeqID_90512; Strand=-; Position=138-539
GAVPPNRCAQIYGETESFGNSFPIACTLILRWIFAPHNCLSTPNGHLKKSIFFVFGAVPPNRCAQIYGETESFGSSFPIACTLILRWIFAPHNCLSTPNGHLKKSIFLFSGQSPRTDAPRFMGRPNPSGVASL

SEQ ID NO: 164090 - protein, 176 aa, Heterodera glycines
  misc_feature (65)..(65): Xaa can be any naturally occurring amino acid
  Homolog annotation: Hit_ID=CAE70680.1; Match level="QueryCoverage =99%, HitCoverage=40%, E-value=9e-72, Identity=73%"; Hit description =Hypothetical protein CBG17397 [Caenorhabditis briggsae]
  Gene Ontology: Mol. function=isocitrate dehydrogenase (NADP+) activity; Cellular component=cytosol; Biological process=isocitrate metabolism
  Coding regions on vcDNA: vcDNA=SeqID_90513; Strand=+; Position=44-572
MQKIRVANPVVDLDGDEMTRIIWAGIKEKLILPYLDIDIKYYDLSIENRDATDDEVTVDAAEAIXKYNVGIKCATITADEARVKEFGLKKMWLSPNGTIRNILGGTVFREPIICKNIPRVVPGWKKEIVIGRHAFGDQYKATDIVVPKGSKFEINIIKSDGPVERDSVFNFADTGG

SEQ ID NO: 164091 - protein, 92 aa, Heterodera glycines
  Coding regions on vcDNA: vcDNA=SeqID_90514; Strand=+; Position=192-470
RNQNANELAKNGVKQSNVSVRTQKSAYMSGQDYSLNLVYQQFLFEEAQRFQGHFPTPCHFPQCNRKPSRCPTPSLLLLAPQPVHNNHFLQSE

SEQ ID NO: 164092 - protein, 179 aa, Heterodera glycines
  Coding regions on vcDNA: vcDNA=SeqID_90515; Strand=-; Position=2-538
MPRGDLRGLGGLLDSRGLLSSGTQFIVLSLSSASLAESLLSLPMLSRALVLIELLRNDRMECSDFSDGLKVETMSSENTSSAIESSVCCCCWCSATGSTATTIPFPDDMVETEEFGKDFAECEAIESSSGILSTSANVLCVKAELRTKLFAEITSTSSSSSSPLCRLPCTDCAFGVHSP

SEQ ID NO: 164093 - protein, 62 aa, Heterodera glycines
  Homolog annotation: Hit_ID=XP_392164.1; Match level="QueryCoverage =87%, HitCoverage=14%, E-value=8e-16, Identity=64%"; Hit description =similar to endoA-PA [Apis mellifera]
  Gene Ontology: Mol. function=protein binding; Cellular component =cytoplasm; Biological process=signal transduction
  Coding regions on vcDNA: vcDNA=SeqID_90516; Strand=+; Position=1-189
LYEFQALNPGELDFKEGQIIQLDSQIDEHWFEGTVDGRTGFFPITYVEVIVPIPSSSTTAQQ

SEQ ID NO: 164094 - protein, 175 aa, Heterodera glycines
  Coding regions on vcDNA: vcDNA=SeqID_90517; Strand=+; Position=38-562
MNCSFFLCLFTVQLILLNFAVEGREDDELKRKKRNTDVDVLGLVNIHAPSRKNVNVDVGGEERDRNDKLVNVNVQGHRKNVNVDVGGGHYNEGKVVKYERDGERGREVNVDVRVPKVKVDVDREDGYPKKKRVHLKVLDKLRKYDSEESGERRRHRVVKIERDGGRRHKTVYIER

SEQ ID NO: 164095 - protein, 97 aa, Heterodera glycines
  Coding regions on vcDNA: vcDNA=SeqID_90518; Strand=+; Position=201-491
IRPVNSQRFPSIHFLFFYADNFLIEFPADDNAMASDGQAVAKWLFTPRPDNVPKLFKCWLCKDDPNWRRKLKRSKRHLPMLLTTPISLSSSDDDCLL

SEQ ID NO: 164096 - protein, 78 aa, Heterodera glycines
  Homolog annotation: Hit_ID=NP_505873.1; Match level="QueryCoverage =70%, HitCoverage=8%, E-value=1e-09, Identity=58%"; Hit description =sodium:neurotransmitter symporter family member (snf-11) [Caenorhabditis elegans] emb|CAA98519.1| Hypothet
  Coding regions on vcDNA: vcDNA=SeqID_90519; Strand=+; Position=242-478
MFSISCKFCPGWFLSLSSMLCIPIYAIYLWVVTDGTVSEKFKKLFRPDVNLVPKSDKDREEEKELKRAAKLAGVGTAK

SEQ ID NO: 164097 - protein, 157 aa, Heterodera glycines
  Homolog annotation: Hit_ID=NP_505492.1; Match level="QueryCoverage =81%, HitCoverage=27%, E-value=3e-50, Identity=71%"; Hit description =putative nuclear protein (55.4 kD) (5K149) [Caenorhabditis elegans] emb|CAA94805.1| Hypothetical protein
  Coding regions on vcDNA: vcDNA=SeqID_90520; Strand=+; Position=65-535
MRTFLFIAVVGLMLAVILENVNATGKNSPTKGKQSLDSPNHEKDHKNEHEKYEAAYIYRGDFFHDSKNEPHVEEQLVAAIYDLISKYKVDLYEIVIFVSKSPCFHQDCEPKCEVVDECKCNKACAKLLGLLLSKVRKELSKVDVRMTVKFLYPHLNR

SEQ ID NO: 164098 - protein, 49 aa, Heterodera glycines
  Coding regions on vcDNA: vcDNA=SeqID_90521; Strand=+; Position=2-151
GFPQPHVPSDHIPIMSQYAVIPPNFQRSLPPIHHYGGSAHSGGFGAIGR

SEQ ID NO: 164099 - protein, 112 aa, Heterodera glycines
  Homolog annotation: Hit_ID=AAO18686.1; Match level="QueryCoverage =89%, HitCoverage=13%, E-value=2e-10, Identity=30%"; Hit description =semaphorin 2a [Trichinella spiralis]
  Coding regions on vcDNA: vcDNA=SeqID_90522; Strand=+; Position=38-376
MPHFVHSMSGGLVLINATETMDGTYECATEESANGKVPLAIYSLRVDGADCARPKSVEQFRSAQREWCRRMDTYRSNLSKWESIRDANGQGKGLCDTNAETERRTDSGNFVA

SEQ ID NO: 164100 - protein, 119 aa, Heterodera glycines
  Coding regions on vcDNA: vcDNA=SeqID_90523; Strand=+; Position=67-426
HIFCMSAPNNSPSSISSTGTNGIRITRQRSSARINWLTELTTRDSTPVTTTQTSKDFSEISKHLALVEDEDNIKRIQAKREKEAHERALAFVKNQLLNSRKDDWLHQPIEELLGYAPKY

SEQ ID NO: 164101 - protein, 109 aa, Heterodera glycines
  Coding regions on vcDNA: vcDNA=SeqID_90524; Strand=+; Position=1-330
SKFHLENSINSILKWLHHRLNWFRFQCFCSSFALAWPLSRPKLIMAGVATAMSILTDFMANGKPVLAHPKMLALLVAVEKEIPTEEEEEEEDHHHQTIFERKKELQNQN

SEQ ID NO: 164102 - protein, 76 aa, Heterodera glycines
  Coding regions on vcDNA: vcDNA=SeqID_90525; Strand=+; Position=1-231
CEIKYASPISNYFCPFSHFTNFNWKGNFKLILNVEKCNFENVSADNCICFRRSAKVTFGPLFPSLWFPWAVMRKCH

SEQ ID NO: 164103 - protein, 94 aa, Heterodera glycines; identical to SEQ ID NO: 131070
  Coding regions on vcDNA: vcDNA=SeqID_90526; Strand=-; Position=44-328

SEQ ID NO: 164104 - protein, 140 aa, Heterodera glycines
  Homolog annotation: Hit_ID=CAG83924.1; Match level="QueryCoverage =52%, HitCoverage=4%, E-value=4e-09, Identity=49%"; Hit description =unnamed protein product [Yarrowia lipolytica CLIB99] ref|XP _499995.1| hypothetical protein [Yarrowia lipoly
  Coding regions on vcDNA: vcDNA=SeqID_90527; Strand=+; Position=32-454
MRSLLFLAFVALFVVKCSADESMQNDENDEQFPPGPPPSNEMSEESNDRRKRSPFFNFFGGFKKGGRGGRQKGEKPNGVPPTGSPPAEREKRSLSRGNAKMGGRGPMGGRGGQKGGRGGQKGGRGGRPKGPPPTSPAPTE

SEQ ID NO: 164105 - protein, 175 aa, Heterodera glycines
  Coding regions on vcDNA: vcDNA=SeqID_90528; Strand=+; Position=3-527
RFDLSMILVTATLASDSTPGTHVLDNSDVGFLSNGNANCTLFERWASYVGNMNSVSIMDCVAAARQGDMGQDIPNTALGLFKWCTACFGKSVGPGHSAGTATAGRKLADAAYADEAAINEHRVGKHLLKRVHLTPRSVVKQLVATTVRGTWKMYVVCVSAVFDLDDPNGSWNWRQ

SEQ ID NO: 164106 - protein, 70 aa, Heterodera glycines
  Coding regions on vcDNA: vcDNA=SeqID_90529; Strand=+; Position=232-441
LYLDPTRPQISFPFWPFLPYDSFMFSFLAQVKLILGSIFALFSLLCQFLLLFCVFVFAFYQKPAMDSKKV

SEQ ID NO: 164107 - protein, 141 aa, Heterodera glycines
  Homolog annotation: Hit_ID=NP_965735.1; Match level="QueryCoverage =95%, HitCoverage=76%, E-value=7e-35, Identity=55%"; Hit description =hypothetical protein LJ0520 [Lactobacillus johnsonii NCC 533] gb|AAS09701.1| hypothetical protein LJ0520
  Coding regions on vcDNA: vcDNA=SeqID_90530; Strand=+; Position=3-428
IHRAAGPQLLEECRTLKGCEVGEAKITKAYNLMPNIKAIIHTVGPQIGTEVSDEQCRQLRDCYANSLSLARDNKLRSIAFPCISTGVYNFPKKEASEIAIKTVRDWLTEGQNNEKLDTVIFCVFGDDDLGFYEKNIPQFIL

SEQ ID NO: 164108 - protein, 43 aa, Heterodera glycines
  Coding regions on vcDNA: vcDNA=SeqID_90531; Strand=+; Position=1-132
QRKLTGMVRDGVNSASRYYYSQICDANKQNVIDILLGQQRTAE

SEQ ID NO: 164109 - protein, 195 aa, Heterodera glycines
  Coding regions on vcDNA: vcDNA=SeqID_90532; Strand=+; Position=3-587
FEQREPRSGGIGRITNGHGEKKYKSAVRRENGRIDAKRADANWDIKRRRRRGEGRQNERTKHKWEEDDSQGTLFVQIEIHARAKKQRLVQSLGGHQSKGNRTTVATERRQTNDGRRNPFVGSGYVPSFGAPRQQPPNANSNANSLGNSSSSISIGGGPADNAKTNNAFSTIGGRTNWAAKYQRKKKKKNSRLVLS

SEQ ID NO: 164110 - protein, 59 aa, Heterodera glycines
  Coding regions on vcDNA: vcDNA=SeqID_90533; Strand=-; Position=10-189
QLFVPVSKANGFAASSFLSFSSGSSLSSRSNILTWYIEMARIGQSVYPDTVHSDSNSIN

SEQ ID NO: 164111 - protein, 80 aa, Heterodera glycines
  Coding regions on vcDNA: vcDNA=SeqID_90534; Strand=-; Position=130-372
KNSKTPFVGHYFKKRKKVDIDHGPATSSHMTSSPVNSIAILMVEPKRFDSNFSHSLVVMGDFFLVNLATYRLNQCDTSRV

SEQ ID NO: 164112 - protein, 115 aa, Heterodera glycines
  Coding regions on vcDNA: vcDNA=SeqID_90535; Strand=+; Position=40-387
MDDGEIVGDNQNDSGGDNECDRRAIVSQQQKSKEFSSVQAEESEGNDDDAFVPEPMTPPRPTTPADCETGIPSPKTPPPVASSHPTRIKEVIEMRENERTVRLLDIITLDCDDEW

SEQ ID NO: 164113 - protein, 178 aa, Heterodera glycines
  Homolog annotation: Hit_ID=AAH56771.1; Match level="QueryCoverage =100%, HitCoverage=20%, E-value=2e-68, Identity=67%"; Hit description= Xab2 protein [Danio rerio]
  Gene Ontology: Mol. function=protein binding; Cellular component =nucleus; Biological process=transcription-coupled nucleotide -excision repair
  Coding regions on vcDNA: vcDNA=SeqID_90536; Strand=+; Position=1-534
NYELATALLRRATTPPPVRRDSYFDDSAKVQNRVFRSLKLWSLYADIEESMGSLESCKAIYERMLELRIATPQIVINYALFLEDNQYFEDAFKAFEKGIGLFRWPLVFDIWNVYLTKFIQRYGGKKLERARDLFEQCLDKCPPKYAKNIYLLYAKLEEEHGLARHAMDIYNRANGAVE

SEQ ID NO: 164114 - protein, 186 aa, Heterodera glycines
  Homolog annotation: Hit_ID=AAU84946.1; Match level="QueryCoverage =100%, HitCoverage=33%, E-value=2e-95, Identity=95%"; Hit description= putative mitochondrial ATP synthase alpha subunit precursor [Toxoptera citricida]
  Gene Ontology: Mol. function=hydrogen-transporting ATP synthase activity, rotational mechanism; Cellular component=extracellular space; Biological process=morphogenesis
  Coding regions on vcDNA: vcDNA=SeqID_90537; Strand=+; Position=1-558
YTIIVSATASDAAPLQFLAPYSGAAMGEFFRDNGKHALIIYDDLSKQAVAYRQMSLLLRRPPGREAYPGDVFYLHSRLLERAAKMNETHGGGSMTALPIIETQAGDVSAYIPTNVISITDGQIFLETELFYKGVRPAINVGLSVSRVGSAAQTKSMKQVAGSMKLELAQYREVAAFAQFGSDLDAS

SEQ ID NO: 164115 - protein, 114 aa, Heterodera glycines
  Coding regions on vcDNA: vcDNA=SeqID_90538; Strand=+; Position=169-513
SLVKLPKQFFSCLSPFFATETNGRQLTTKNCRKCAKEILWSFFLLRRRFWVISFSRGAPGTTERKGSRGKGGQCQRGKVGKWTCRAVTRREFNSRNIYCICFCYHPFCNYKPYQ

SEQ ID NO: 164116 - protein, 176 aa, Heterodera glycines
  Homolog annotation: Hit_ID=CAE57311.1; Match level="QueryCoverage =93%, HitCoverage=33%, E-value=1e-35, Identity=48%"; Hit description =Hypothetical protein CBG00233 [Caenorhabditis briggsae]
  Coding regions on vcDNA: vcDNA=SeqID_90539; Strand=+; Position=3-530
LIVWRLIARSLGCFSKKLERKLTIEPKDNNEDEIETETRASRETLSTESDEGNDELLQFPVWFLIAVTIIWILLCAYLFLLWEDTWDYGLSLYFVLVSFLTIGFGDVIPSKPDYIILVGIMILIGLALVSTVLTIIQKQIHALADNMKSTIDKDYQAALEELDEDQIEPIDGQRKE

SEQ ID NO: 164117 - protein, 103 aa, Heterodera glycines
  Homolog annotation: Hit_ID=XP_309756.1; Match level="QueryCoverage =94%, HitCoverage=36%, E-value=2e-15, Identity=43%"; Hit description =ENSANGP00000012467 [Anopheles gambiae]
  Gene Ontology: Cellular component=cytoplasm; Biological process =autophagy
  Coding regions on vcDNA: vcDNA=SeqID_90540; Strand=+; Position=2-313
QTTPWPITVHLKNFPDELIRCRTKETLKFCFLQSLKEACQLKLGSNIAASMTKDEHGRLFDGLCNDRFNDFWMVNDKLMGLRSSSGEEQFSTIPARFYEVLIY

SEQ ID NO: 164118 - protein, 85 aa, Heterodera glycines
  Coding regions on vcDNA: vcDNA=SeqID_90541; Strand=-; Position=0-254
NFKIKINSLRMCSWARTHRWVTHAFQRKGTTANKCKKHCVLLFQIVSVEFVKQRCLRCHSPLVHLLRHQIERHVPGIISNCLKNG

SEQ ID NO: 164119 - protein, 142 aa, Heterodera glycines
  Homolog annotation: Hit_ID=NP_965735.1; Match level="QueryCoverage =95%, HitCoverage=77%, E-value=3e-35, Identity=56%"; Hit description =hypothetical protein LJ0520 [Lactobacillus johnsonii NCC 533] gb|AAS09701.1| hypothetical protein LJ0520
  Coding regions on vcDNA: vcDNA=SeqID_90542; Strand=+; Position=1-467
AIHRAAGPQLLEECRTLKGCEVGEAKITKAYNLMPNIKAIIHTVGPQIGTEVSDEQCRQLRDCYANSLSLARDNKLRSIAFPCISTGVYNFPKKEASEIAIKTVRDWLTEGQNNEKLDTVIFCVFGDDDLGFYEKNIPQFIL

SEQ ID NO: 164120 - protein, 185 aa, Heterodera glycines
  Homolog annotation: Hit_ID=CAE66444.1; Match level="QueryCoverage =97%, HitCoverage=46%, E-value=4e-62, Identity=59%"; Hit description =Hypothetical protein CBG11719 [Caenorhabditis briggsae]
  Coding regions on vcDNA: vcDNA=SeqID_90543; Strand=+; Position=2-556
GDNGMYLNIILGSNLNITLPSPDERYRYKKEYESFKLSVAFVILAVFFVVIWLPPTLRPLDALCNFLLVWYYCTLTIRESILRLNGSRIKGWWVLHHYITCVLCCITLTWSGGDCYEHMRPTFVVLVCYVSSVQIIQYKYQTGCLRRLHALGQRHSMDITVEGFSNWMFKGLTFLMPFLIIGYFL

SEQ ID NO: 164121 - protein, 83 aa, Heterodera glycines
  misc_feature (33)..(33): Xaa can be any naturally occurring amino acid
  misc_feature (58)..(58): Xaa can be any naturally occurring amino acid
  Coding regions on vcDNA: vcDNA=SeqID_90544; Strand=-; Position=196-447
NYNRKFFLFLKKCFESLKFFFLFFFNFFYFFFXFIKKKKIFLLLFFLIFFIFLIFFIXFFFLKFFFRIIGNFFFNFFKLPLDY

SEQ ID NO: 164122 - protein, 175 aa, Heterodera glycines
  misc_feature (60)..(60): Xaa can be any naturally occurring amino acid
  Homolog annotation: Hit_ID=CAE60451.1; Match level="QueryCoverage =100%, HitCoverage=34%, E-value=6e-62, Identity=63%"; Hit description= Hypothetical protein CBG04059 [Caenorhabditis briggsae]
  Gene Ontology: Mol. function=transaminase activity
  Coding regions on vcDNA: vcDNA=SeqID_90545; Strand=+; Position=1-526
LRGGYVQFDNIDPTVYVHFKKMISAKLCSTVLGQVAMDCVVDHPKPGDPSYDQWLKEKNXVLDSLHKRAQLVTKAYNQVEGVHCQQVQGAMYAFPRFLLPDKAIAEAKASGVQPDFFYVKQLLEETGVCVVPGSGFGQRPGTFHFRTTILPPIDIFEDMLNRFGAFHKRFLAKYK

SEQ ID NO: 164123 - protein, 179 aa, Heterodera glycines
  Coding regions on vcDNA: vcDNA=SeqID_90546; Strand=+; Position=2-538
RKINENSELHSKLFDVERRFDEAVTAFTRRIDELEKENDALKSLVSIPFDAEQRKEFGESENTAPGQTLQQTEANSEEKNAPSAVVPKTDSADDLLGCSSAFANESADLCSRKPSAIAKDEAVEEMAAEKYSTERIATLGESLRHAKGRATYYKQECEELLRKAICDQQRIEALEQNIF

SEQ ID NO: 164124 - protein, 182 aa, Heterodera glycines
  Coding regions on vcDNA: vcDNA=SeqID_90547; Strand=+; Position=3-548
NSFFLKMLSAAFFMPLFFIAIGQFLQISDAIDCFSCASPALHNQWEATGLPEIPPPDRFAFHACDGTGTDYKPCADVCMEMLVAAGNEYGVVRGCMSDFYHGQTTSTNTDKCYFGGYPHNVTIYDPTNGAKTYSQLYVGVRYCSTVNGACNNKFMPKKEAAEGSGLLPKHFVVRPNKCQQRL

SEQ ID NO: 164125 - protein, 168 aa, Heterodera glycines
  Homolog annotation: Hit_ID=CAG59394.1; Match level="QueryCoverage =92%, HitCoverage=72%, E-value=7e-20, Identity=40%"; Hit description =unnamed protein product [Candida glabrata CBS138] ref|XP_446467.1| unnamed protein product [Candida glabra
  Gene Ontology: Mol. function=chaperone activity; Cellular component =nucleolus; Biological process=invasive growth
  Coding regions on vcDNA: vcDNA=SeqID_90548; Strand=+; Position=16-519
MKLFSMFLLLTLAFAAFAESSSSSSSESSESSEECSSEEGNPGTEPETTTVVDSDENCNATSDSPNDESSPVPSSDSPNDESSPVPSSDSPNDESSPVPSSDSPNDESSPVPSSDSPNDESSPVPSSDSPNDESSSVPSSDSPNDESSPVPSSDSPNDESSSAPSSDS

SEQ ID NO: 164126 - protein, 138 aa, Heterodera glycines
  Homolog annotation: Hit_ID=CAE64449.1; Match level="QueryCoverage =90%, HitCoverage=90%, E-value=5e-32, Identity=50%"; Hit description =Hypothetical protein CBG09156 [Caenorhabditis briggsae]
  Coding regions on vcDNA: vcDNA=SeqID_90549; Strand=+; Position=2-418
RLTPSSFGYDDDDLFDIGTAQSVAVTGILTCNGRPSGGTKVKLYDVDTFDPDDLMAEGFTDEKGHFLLEGFEMEISDIDPKLNIYHNCNDEHFPCLQKFSIEVPDNYITEGKRPQKIFDIGKLNLEGKFSGQHRDCIN

SEQ ID NO: 164127 - protein, 122 aa, Heterodera glycines
  Coding regions on vcDNA: vcDNA=SeqID_90550; Strand=-; Position=74-442
NAFIRIKRRFVCQSLVPFASELSNSMNIFWQAPSDGEVQCCNEFNVSNSTHICFRYLAPPQLAQGGKRKQRIRSVGPAGQKTIGQWQRRSPYSLNFPTLTRSLASGRTQKARSSNNFKQYTI

SEQ ID NO: 164128 - protein, 110 aa, Heterodera glycines
  Homolog annotation: Hit_ID=NP_495956.1; Match level="QueryCoverage =90%, HitCoverage=21%, E-value=1e-19, Identity=44%"; Hit description =integral membrane protein (2J458) [Caenorhabditis elegans] pir||T25203 probable membrane-bound phosphoest
  Coding regions on vcDNA: vcDNA=SeqID_90551; Strand=+; Position=12-344
MDVSVINYCPKNATTIVLAHNPSAARKIFEFSQSNDHPVDLILSGHTHNAQYLVLMPFAYFILPYLYGLYVLSDGATKLFVSAGTLFQNAPMKIPFMSEIWSIEIEPRKQ

SEQ ID NO: 164129 - protein, 63 aa, Heterodera glycines; identical to SEQ ID NO: 133893
  Coding regions on vcDNA: vcDNA=SeqID_90552; Strand=-; Position=328-519

SEQ ID NO: 164130 - protein, 287 aa, Heterodera glycines
  Homolog annotation: Hit_ID=CAE58975.1; Match level="QueryCoverage =91%, HitCoverage=43%, E-value=2e-58, Identity=43%"; Hit description =Hypothetical protein CBG02248 [Caenorhabditis briggsae]
  Gene Ontology: Mol. function=protein kinase activity; Biological process=protein amino acid phosphorylation
  Coding regions on vcDNA: vcDNA=SeqID_90553; Strand=+; Position=36-899
MENDQQQSPEDQISAEAAINLLAVTTTHQHIFGGRNGALFVEIRRIAEQQLEHALAPVDVAGGKWELFVKDGELRMYSRELEVENGIAADPLKALHVIDGVSAHEFIDLFFRPELKKEWDDTLELGKVVETLSPHTAVIHQIHRRVWPAAQRESLFWSQRLNVLSECSSVTDHVPGELLGAWMVCNQSVERDDVPLSDPSAVRVRLTIAMLCRTVLKPGADRTKPREQITREDIRCKITYVAQIHPGGWVPKIGIRQIYKREYPKFLRSFSKYVLDKANGTALALPL

SEQ ID NO: 164131 - protein, 231 aa, Heterodera glycines
  misc_feature (201)..(201): Xaa can be any naturally occurring amino acid
  Homolog annotation: Hit_ID=NP_508515.1; Match level="QueryCoverage =91%, HitCoverage=69%, E-value=1e-39, Identity=41%"; Hit description =MIP family (XD645) [Caenorhabditis elegans] pir||T16635 hypothetical protein M02F4.8 - Caenorhabditis ele
  Gene Ontology: Mol. function=water channel activity; Cellular component=integral to plasma membrane; Biological process=transport
  Coding regions on vcDNA: vcDNA=SeqID_90554; Strand=+; Position=63-757
MSMNSLNMGKEVAKRWMGINNRRMAPFSLSPVDRMRQSVFRVRSRLAVNLLSEGLATFLLLLVGNGIGAQHILGGGKLDNYMQVCFGWGMLIALLVFATYHTSGGHLNPAVSLAFVSLGKLPFAHFLLYSLVQTVGAFFGSALCLHIYRESFEKFDAGIRTVGGPSGTDTIICSFPDEHIGHLPAFVDEIVGTGLLLLFAXALIGPANQPPKWVPPIRFGVAIVPTTPSFG

SEQ ID NO: 164132 - protein, 227 aa, Heterodera glycines
  Coding regions on vcDNA: vcDNA=SeqID_90555; Strand=+; Position=134-814
MLKSNILCVEVFKVKFCCRMDIGNCCICLGGFGVAQMGVLPCLHTFHHSCIQRALGQNAQCPLCRRHAIDTQIVRPKYEGSCREAGDLPRKAMRAALAFYDRTVRHRFADGSSGGEAQREELKLCLNSLVSTLESADAEREAKWERLKQFLRVCGTAAIFAVLAFLFTLYWPLISSLAVGVVRTVWTLISSLRDLLVAHWPDLLFGGLLLSTFVDMESSDSQQQQAE

SEQ ID NO: 164133 - protein, 79 aa, Heterodera glycines
  Homolog annotation: Hit_ID=EAA62187.1; Match level="QueryCoverage =54%, HitCoverage=21%, E-value=2e-14, Identity=86%"; Hit description =predicted protein [Aspergillus nidulans FGSC A4] ref|XP_409382.1| predicted protein [Aspergillus nidulans
  Coding regions on vcDNA: vcDNA=SeqID_90556; Strand=-; Position=54-293
IRDCRKWFPICSSSSEQFVKLVLNSLQKVHLYVRVVSPRSGMDSDLEAFSHYPAHGSFAALPGRTAAKTNYVNERFLSY

SEQ ID NO: 164134 - protein, 157 aa, Heterodera glycines
  Homolog annotation: Hit_ID=NP_498785.1; Match level="QueryCoverage =99%, HitCoverage=6%, E-value=2e-72, Identity=76%"; Hit description =yeast splicing factor PRP related (prp-8) [Caenorhabditis elegans] gb|AAA27977.1| Yeast prp (splicing fact
  Gene Ontology: Mol. function=pre-mRNA splicing factor activity; Cellular component=nucleoplasm; Biological process=mRNA splicing
  Coding regions on vcDNA: vcDNA=SeqID_90557; Strand=+; Position=1-474
HTQPNELPQLSPQDITMHSKIIHQNQWDGERSVIITCSFTPGSVSLTSYRLTPSGYEWGRNNTDKGNNPKGYLPSHYEKVQMLLSDRFLGYFMVPSAGVWNYNFMGVRHDANMQYDVCLSAPKEFYHEDHRPLHFHNFNVFEDPLGVSTADREDIFE

SEQ ID NO: 164135 - protein, 178 aa, Heterodera glycines
  Coding regions on vcDNA: vcDNA=SeqID_90558; Strand=+; Position=156-689
NPSLNLKKESVLKKTFSVEAGDSLTNAILGILPQQSADNAEADSTGNGPMHSAEHHQHETDQQQQMISSGTGAASVEGNAIAAGVRRHSLLGPIPIRSQQQQSVEGQQSTIGQPMVRNLPPATVRTANFAQNHPQSLVNSQHPTVANNCHSEQHFAGRKRRAFPPAAAVVGTAAERLL

SEQ ID NO: 164136 - protein, 177 aa, Heterodera glycines
  Homolog annotation: Hit_ID=EAL28191.1; Match level="QueryCoverage =86%, HitCoverage=47%, E-value=5e-27, Identity=44%"; Hit description =GA11580-PA [Drosophila pseudoobscura]
  Gene Ontology: Mol. function=glyoxylate reductase (NADP) activity; Biological process=metabolism
  Coding regions on vcDNA: vcDNA=SeqID_90559; Strand=+; Position=3-536
QFRPQNDGFFSEDEQQKWVKEHIGEAEIIYTMGPIKVDASLLVVAKALKAVVTISAGHENIDTVECARRGIRMGFGGAILTEATAETAMALLLTVSRRLVEAVQIAKEGKWPNNWSPKFCVGKALEGSTVGIFGMGRIGRSIADKLSAFRPLEIIYHNRKANSEYGRIDGRLNDFAN

SEQ ID NO: 164137 - protein, 97 aa, Heterodera glycines; identical to SEQ ID NO: 160047
  Coding regions on vcDNA: vcDNA=SeqID_90560; Strand=+; Position=27-320

SEQ ID NO: 164138 - protein, 173 aa, Heterodera glycines
  Homolog annotation: Hit_ID=EAA49399.1; Match level="QueryCoverage =68%, HitCoverage=14%, E-value=1e-10, Identity=33%"; Hit description =hypothetical protein MG01057.4 [Magnaporthe grisea 70-15] ref|XP _368187.1| hypothetical protein MG01057.4
  Gene Ontology: Mol. function=potassium channel activity; Cellular component=integral to membrane; Biological process=potassium ion transport
  Coding regions on vcDNA: vcDNA=SeqID_90561; Strand=+; Position=18-536
MFGAGPPSAQPSDIVKFPTVTVVEAAKNEHDDAVEPIPTSLGTEQPAAPPAQPTPAAATPQVQAAGAAVAPSQTEHQQEKKEQSADELVEVDAPPQPIVPQQNNQPAQPQQQQPQQQQQEEMTKTEQEQPQLNQQQQPSPPGISPFQQKWFPEVPSVFLQVDDPNGGNAGGTD

SEQ ID NO: 164139 - protein, 251 aa, Heterodera glycines
  Homolog annotation: Hit_ID=CAE72912.1; Match level="QueryCoverage =86%, HitCoverage=95%, E-value=3e-84, Identity=67%"; Hit description =Hypothetical protein CBG20230 [Caenorhabditis briggsae]
  Gene Ontology: Mol. function=protein transporter activity; Cellular component=endosome; Biological process=two-component signal transduction system (phosphorelay)
  Coding regions on vcDNA: vcDNA=SeqID_90562; Strand=+; Position=127-882
LIFDSNPVAFPPLTSLPFAIIIVVPFKEFPTSTFPMYHYQYRIIVIGDSTVGKSSLLRYFTEGKNAEISDPTVGVDFYARMIEIKPNYRIKLQLWDTAGQEKFRSITRSYYRNSVGVIVVYDITNRRTFEHVVDWMTEAEANLGGPDPAQLVFLLVGHKADLEEQREVLYEEGEYFAKHRRIKFIETSALTGENVNEAFLIVSREINARFETGALRICDGWDGIKSGLLRTQSITLSDIQETTKENSQCYC

SEQ ID NO: 164140 - protein, 170 aa, Heterodera glycines
  Homolog annotation: Hit_ID=NP_508848.2; Match level="QueryCoverage =51%, HitCoverage=3%, E-value=1e-13, Identity=43%"; Hit description =major antigen like (273.8 kD) (XF611) [Caenorhabditis elegans] gb|AAM69078.1| Lin-5 (five) interacting pro
  Coding regions on vcDNA: vcDNA=SeqID_90563; Strand=+; Position=1-510
TGTTTDGGGGGTTTISSEAEEGGTAPAETETELYDAELVERKVREIEGKWKVEVEKSENENKEKLKRTTWKWKGGKSTGTTTDGGGGGTTTISSEAEEGGTAPAETETELYDAELVERKVREIEGKWKVEVEKLENEKEILERNIRELEEKLAQMDRGDQRAKEEIEDTK

SEQ ID NO: 164141 - protein, 148 aa, Heterodera glycines
  Homolog annotation: Hit_ID=AAP41028.1; Match level="QueryCoverage =100%, HitCoverage=36%, E-value=3e-80, Identity=100%"; Hit description=arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_90564; Strand=+; Position=3-449
GIFHNAKKTFLVWVNEEDHLRIISMQKGGDVGNVLKRLIRGVKGIEKQVPFARDDRLGYLTFCPSNLGTTIRASVHIRLPKISAKPEFKKICEDLKLQVRGIHGEHSESEGGVYDVSNKARLGLTEFEAVKQMYDGVKKLIELEKASK

SEQ ID NO: 164142 - protein, 112 aa, Heterodera glycines
  misc_feature (3)..(3): Xaa can be any naturally occurring amino acid
  Coding regions on vcDNA: vcDNA=SeqID_90565; Strand=-; Position=2-337
FFXYRQILLFICFRQEIDRKCMQIGEKTNKICERIRENAKLKNGRKVRKTKSGKVKIKKRKKDKATNGKVKKGRGDRGQMIHVFSRMNELFCENGEGYVVLLSFAFSDISLP

SEQ ID NO: 164143 - protein, 26 aa, Heterodera glycines
  misc_feature (14)..(16): Xaa can be any naturally occurring amino acid
  Coding regions on vcDNA: vcDNA=SeqID_90566; Strand=-; Position=305-385
FFFFFFFFFFFFFXXXFNQTSLLSKK

SEQ ID NO: 164144 - protein, 119 aa, Heterodera glycines
  Coding regions on vcDNA: vcDNA=SeqID_90567; Strand=-; Position=73-432
FFFFFLKIQKNLFLFLKFNILNAAKNKRLKALCARSFLSSILCFFFLAMASNHHLRRCCHFLLRVSLFLVPYLLFCCFLFLLPFLHFRFSFFHLLFLHFRFFVVSFKIFTISRWICIDD

SEQ ID NO: 164145 - protein, 157 aa, Heterodera glycines
  Homolog annotation: Hit_ID=AAB38546.1; Match level="QueryCoverage =98%, HitCoverage=96%, E-value=6e-52, Identity=60%"; Hit description =globin gb|AAB38545.1| globin gb|AAA89171.1| globin gb|AAA89170.1| globin
  Coding regions on vcDNA: vcDNA=SeqID_90568; Strand=+; Position=31-504
MSTREEIQAVCVQSLKQLKIGVGEEELQNGKDFYKFFFTNYPTLRVYFKGAEKYEAEDVQKSERFEKQGQRILVAMHLIANVYSNEMLFNAYVRETVNRHRQFKMEPSLWKAFWTVWTGFLETKVDLTEQAKSAWMSLGEDFAKEALAHLKRLGIPH

SEQ ID NO: 164146 - protein, 138 aa, Heterodera glycines
  Homolog annotation: Hit_ID=XP_315595.1; Match level="QueryCoverage =64%, HitCoverage=11%, E-value=4e-14, Identity=35%"; Hit description =ENSANGP00000017704 [Anopheles gambiae]
  Gene Ontology: Cellular component=integral to membrane
  Coding regions on vcDNA: vcDNA=SeqID_90569; Strand=+; Position=2-418
TSAASSVFNDASSVSSGGIVERLWGDTETPEEGAGTSSPETLATMAMEFRRDIVMGAIVRLILRAFCDFVRVQKFSRHGFEQLQVDFAYVRQKLWYFVADEHMLNTCIEDIVTAAVNQCAQPKLLDPSVVRRICEEMQ

SEQ ID NO: 164147 - protein, 27 aa, Heterodera glycines
  Coding regions on vcDNA: vcDNA=SeqID_90570; Strand=-; Position=114-197
FNFFFFFFFFLFFFFFFFFFFFFFFRT

SEQ ID NO: 164148 - protein, 56 aa, Heterodera glycines
  Coding regions on vcDNA: vcDNA=SeqID_90571; Strand=+; Position=2-172
RRQNILMMQLRKISRQNREMREVIAKYQQIPNLLQAIKSVFYLPTNFINKFKIKII

SEQ ID NO: 164149 - protein, 116 aa, Heterodera glycines
  Coding regions on vcDNA: vcDNA=SeqID_90572; Strand=+; Position=265-615
VSLAIFYSAVFSAIGAPVEPSTKEREKHGVAAHYLKAEDEKLEKIKQMLEEQSPKMSPKGKQIATKFVEILLNKKLTYEEFRKEILKLDNETDAKTNDEFAKSEFAKQMSLIEKHS

SEQ ID NO: 164150 - protein, 175 aa, Heterodera glycines
  Coding regions on vcDNA: vcDNA=SeqID_90573; Strand=+; Position=387-914
NLAFQSIQMGCYSCVDKWMCCCGFHMTAAALVIAWIWLISAISMVPSVLISIYYQAFNWFAFVSMILLFAQSVPIIEGEMSGKRTHQMYLPFLVISCIQLAFTMIGGVVMFFTLDQMRQQMGGYSTGIILGYLFGLLLPLFIFFWCYSIVFRAYKFVKEKNDEKNRHNAKKDIQI

SEQ ID NO: 164151 - protein, 276 aa, Heterodera glycines
  Homolog annotation: Hit_ID=NP_510032.1; Match level="QueryCoverage =98%, HitCoverage=97%, E-value=1e-104, Identity=68%"; Hit description= reductase (29.2 kD) (XM767) [Caenorhabditis elegans] emb|CAA91943.1| Hypothetical protein M153.1 [Caenor
  Gene Ontology: Mol. function=pyrroline 5-carboxylate reductase activity; Cellular component=cytoplasm; Biological process=proline biosynthesis
  Coding regions on vcDNA: vcDNA=SeqID_90574; Strand=+; Position=35-862
MLSETVKIGFIGAGKMAQALARGLINSGRYPAENLMASCPKTDESLLEQCKKLGIGTTSDNTRIARENDVIILAVKPMNISKVTSEIAPNFRREHLLISIALGITLRYIEQLLPSKSRVVRVMPNTPAVVGAGASAYSMGSACQDGDSKVVQDLFSTVGYSVEVPEIHLDPITGLSGSGPSYGFSMIEGLADGGVKMGLPRELSLKLAAMSLYGAAKMFLETGEHPAVLKEAVQSPGGSTSVDIHELEKGGMRGLLINAVEAASERSRRTGEAALP

SEQ ID NO: 164152 - protein, 209 aa, Heterodera glycines
  Homolog annotation: Hit_ID=NP_740792.2; Match level="QueryCoverage =49%, HitCoverage=23%, E-value=8e-29, Identity=54%"; Hit description =putative endoplasmic reticulum protein family member of ancient origin (1C405) [Caenorhabditis elegans] g
  Coding regions on vcDNA: vcDNA=SeqID_90575; Strand=+; Position=3-632
KHISRVARMAKEEFGFEQVLVWNDMFEKIPVALLEEYKLGSLIVPVVWGYKTDVARPGYFPDGLFERFSQVFDNIYFAGAFKGADGISQQFVHIERYMQNLRSYQKLYHQNEMYLKDRLTGLILTGWQRYSHTTPLCELLPAGIPSLARQAIFVSQWMNKREERTDQFMQEFLNCSGRHSTSATKFVRKGFTFPFVFEFKFCDCQFPGC

SEQ ID NO: 164153 - protein, 171 aa, Heterodera glycines
  Homolog annotation: Hit_ID=CAE63438.1; Match level="QueryCoverage =84%, HitCoverage=20%, E-value=9e-53, Identity=68%"; Hit description =Hypothetical protein CBG07886 [Caenorhabditis briggsae]
  Gene Ontology: Mol. function=carnitine O-octanoyltransferase activity; Cellular component=peroxisome; Biological process=fatty acid beta-oxidation
  Coding regions on vcDNA: vcDNA=SeqID_90576; Strand=+; Position=1-513
LQLTYFRNQGSFSLTYEASITRLFREGRTETIRSCTNESCDFVRAMLDPQQKNEERLRLLRLAAERHQNLTRDAMCGKGVDRHLFALYVVMRHLEESSPFFDKIFPPQYLLSTSQTPLNQFDSEQEGISMAQKLKLVSAGGGHGRYLTVAAMFRGRMSMREVDDQMMSVQN

SEQ ID NO: 164154 - protein, 58 aa, Heterodera glycines
  Coding regions on vcDNA: vcDNA=SeqID_90577; Strand=+; Position=134-310
AAVPIEFFDISLIDFHQKLLFYGRSQKFRVIFWNFCEIGCGGVSTTTKKPRFLAAISL

SEQ ID NO: 164155 - protein, 170 aa, Heterodera glycines
  Homolog annotation: Hit_ID=CAE68478.1; Match level="QueryCoverage =100%, HitCoverage=84%, E-value=6e-56, Identity=56%"; Hit description= Hypothetical protein CBG14278 [Caenorhabditis briggsae]
  Coding regions on vcDNA: vcDNA=SeqID_90578; Strand=+; Position=45-557
MSSLPNLNHLHVSDAYRSSTLYKYRRDWDLLDSAISDHSHRGPGFHWVDRRFRARRFMNTDPIPDSLGLDYPNFWSRYKWYSDYLEPRHWRRHRDPNYDRPLWNSWKPYILDGKNQKQAIDMYRQGLVSFAYLDKNWITPWALGRKEKDWADIYPPAGKYGSRRYMYSWA

SEQ ID NO: 164156 - protein, 81 aa, Heterodera glycines
  Homolog annotation: Hit_ID=AAP30776.1; Match level="QueryCoverage =58%, HitCoverage=19%, E-value=4e-15, Identity=89%"; Hit description =putative gland protein G34B08 [Heterodera glycines]
  Coding regions on vcDNA: vcDNA=SeqID_90579; Strand=+; Position=157-491
MDCCHIINCQPYKSHFFKEEMDRDDDKTVERAVRESPIVVSESSATDEDDSAAVSAYNKNNRPASFTEIYGNELKGIKLQF

SEQ ID NO: 164157 - protein, 109 aa, Heterodera glycines
  Coding regions on vcDNA: vcDNA=SeqID_90580; Strand=+; Position=3-332
LMDNSVASSAGDSPYDTPLEPFLVNGPMSLSQFVQTMEDHHKQCVRKLYAGKHRGYLLMPVELPNPNDPNGDRFSGQGHVLMEDLVWQLRGKTRNATHGIIMFYVIRNL

SEQ ID NO: 164158 - protein, 181 aa, Heterodera glycines
  Coding regions on vcDNA: vcDNA=SeqID_90581; Strand=-; Position=2-544
FCTALFARWLEKRQRRKMRSSRSHSIIHSPRSPPGDGKNKRLFIFIKIISIYFSYSSSPGPPPLSYRIRTVSTSSRLYNTITVQPSVTTPFGPTRIVKRKDEETTPLAEATTPEQRKSRRRWSIRGLMRRVSRFPANAASFSDASTALMRSSRSHSIIHSPRSPPGDGKNKRLFIFIKIIS

SEQ ID NO: 164159 - protein, 44 aa, Heterodera glycines
  Coding regions on vcDNA: vcDNA=SeqID_90582; Strand=+; Position=2-136
KSLGTAPPTTLAMCLCWKSKPFKAKDDNCILKSDGRRSNGDGQN

SEQ ID NO: 164160 - protein, 83 aa, Heterodera glycines
  Coding regions on vcDNA: vcDNA=SeqID_90583; Strand=+; Position=145-396
VLLKVISPSVRCSMAPLVVVHTEPLLEEFRAPFCSAANFWRFLSIFFSISLSLLLCFASQARKNEISKDFKLLGSLASVQHFS

SEQ ID NO: 164161 - protein, 156 aa, Heterodera glycines
  Homolog annotation: Hit_ID=NP_741744.1; Match level="QueryCoverage =100%, HitCoverage=39%, E-value=8e-32, Identity=44%"; Hit description= o-fucosyltransferase 1 precursor (XD785) [Caenorhabditis elegans] sp|Q18014|OFU1_CAEEL Putative GDP-fuco
  Gene Ontology: Mol. function=fucosyltransferase activity; Cellular component=integral to Golgi membrane; Biological process=O-linked glycosylation
  Coding regions on vcDNA: vcDNA=SeqID_90584; Strand=+; Position=1-468
PFGPFWRYAGTHFVGEEYFGVKTGGFDTQRETIREKWATEFPAHSSPVLAFSSAPAAFPVRPDHRFIQRFVQWNDRIKQKAIEFASRNFGHGKAFVGIHLRNGRDWENVCQFLREENVMGKRQLFASGQCTGPEEENGPLTADACDPSMDIILEEV

SEQ ID NO: 164162 - protein, 18 aa, Heterodera glycines
  Coding regions on vcDNA: vcDNA=SeqID_90585; Strand=-; Position=5-61
FLAVQIYYIYILRTKQIQ

SEQ ID NO: 164163 - protein, 85 aa, Heterodera glycines
  Coding regions on vcDNA: vcDNA=SeqID_90586; Strand=-; Position=395-652
FNFFLLIFFFLLFLFLKISHSSSSSVATDGQCAHIQLPLFAFWLCEKAFVQAKSKLPQKRRENLVMRRQSKKINNLNSNGLRYFL

SEQ ID NO: 164164 - protein, 136 aa, Heterodera glycines
  misc_feature (43)..(43): Xaa can be any naturally occurring amino acid
  misc_feature (72)..(72): Xaa can be any naturally occurring amino acid
  Homolog annotation: Hit_ID=AAC15708.1; Match level="QueryCoverage =96%, HitCoverage=34%, E-value=2e-54, Identity=83%"; Hit description =beta-1,4-endoglucanase-2 precursor [Heterodera glycines]
  Coding regions on vcDNA: vcDNA=SeqID_90587; Strand=+; Position=1-406
TLHFYASSHFVDGLGNKLKTAVNKGNHMILYRPKPLLFATVLXGLPVFVTEYGTCEASGNGNLNSGSMSSWXWSLLDQLKISYVNWSITDKSEACAALTGGTSAANVGTSSRWTQSGNMVASQHKKKSTGLSDQLN

SEQ ID NO: 164165 - protein, 84 aa, Heterodera glycines
  Homolog annotation: Hit_ID=AAP30776.1; Match level="QueryCoverage =84%, HitCoverage=24%, E-value=4e-18, Identity=67%"; Hit description =putative gland protein G34B08 [Heterodera glycines]
  Coding regions on vcDNA: vcDNA=SeqID_90588; Strand=+; Position=65-319
MRTFLFIAVVGLMLAVILENVNATGKNSPSKGKPSPDSTNHKKDHKNEHPKYEAELIYEQGNLQNHATGNTFIQQSQNFYLKLT

SEQ ID NO: 164166 - protein, 148 aa, Heterodera glycines
  Homolog annotation: Hit_ID=AAO51812.1; Match level="QueryCoverage =62%, HitCoverage=10%, E-value=6e-11, Identity=37%"; Hit description =similar to Homo sapiens (Human). Hypothetical protein FLJ12697 (Fragment) [Dictyostelium discoideum]
  Coding regions on vcDNA: vcDNA=SeqID_90589; Strand=+; Position=3-449
LKRFNVYGGKNRLDVRPKPRVDLTQYTMKKESIIYDLNGIIEHIGGGINFGHYICAMRGFKGNWFKFDDSERRRVSLNDVVQNMDPYILFYTKISPSPINQQPHQRRSFGGFAPSTPKQARLNSFPSHNGGTSLPKRFNNTFHRSFIS

SEQ ID NO: 164167 - protein, 21 aa, Heterodera glycines
  Coding regions on vcDNA: vcDNA=SeqID_90590; Strand=-; Position=3-68
FFKLKHLLSTNIKINNKCGTI

SEQ ID NO: 164168 - protein, 103 aa, Heterodera glycines
  Coding regions on vcDNA: vcDNA=SeqID_90591; Strand=-; Position=41-352
FEYIIYSFENGESGANEINIIIIVHYYFINWLAPLTVHLLPNTHPPPKPAPRAPIELPNQSNWRFIRSGAKTPAEQRDTDRSRRRRSKTEGRRSERRKGIVFN

SEQ ID NO: 164169 - protein, 166 aa, Heterodera glycines
  Homolog annotation: Hit_ID=AAN32890.1; Match level="QueryCoverage =100%, HitCoverage=100%, E-value=6e-87, Identity=98%"; Hit description=secretory protein 4D09 [Heterodera glycines]
  Coding regions on vcDNA: vcDNA=SeqID_90592; Strand=+; Position=32-532
MAKFVAIALLSLTIVSMALAKTGKSQTADEVEGFRNMNIGDNNKVDAGKEPAADKATKKGKAQKAGTKPAAATNEPAAAKGTKNGKAPKTKAKQEVATNEPAAANEWNDQLMGMSVEKFNEELAVLLPKANTFMENALSFINEQMEKNGIATGAAGDSCSTGIPAN

SEQ ID NO: 164170 - protein, 80 aa, Heterodera glycines
  Coding regions on vcDNA: vcDNA=SeqID_90593; Strand=+; Position=88-330
MPSKRITVPLFLLLTVLVLALRASETKIKAMEEKVMEEQDKKENAEMKKFLREQKKEEQKGTNIIGQKVGPKRNFGGFLF

SEQ ID NO: 164171 - protein, 59 aa, Heterodera glycines
  Homolog annotation: Hit_ID=CAD22154.1; Match level="QueryCoverage =67%, HitCoverage=47%, E-value=4e-10, Identity=68%"; Hit description =pherophorin-dz1 protein [Volvox carteri f. nagariensis]
  Coding regions on vcDNA: vcDNA=SeqID_90594; Strand=-; Position=1-177
SSPPPLLSFPPPCPPPCPPPPCPPPPFPLPPLPHVPPPLPLFSFFPTSSSAAFFSFFPS

SEQ ID NO: 164172 - protein, 110 aa, Heterodera glycines
  Homolog annotation: Hit_ID=NP_498776.1; Match level="QueryCoverage =100%, HitCoverage=99%, E-value=5e-37, Identity=66%"; Hit description= heat shock protein (hsp-12.2) [Caenorhabditis elegans] gb|AAA27953.1| Heat shock protein protein 12.2 [C
  Gene Ontology: Mol. function=chaperone activity; Cellular component =cytoplasm; Biological process=muscle contraction
  Coding regions on vcDNA: vcDNA=SeqID_90595; Strand=+; Position=23-355
MENIEITHEWSGQQWDWPLQHNDGVVKVHNTPEKWEVGLDVAFFTPNEIEVKVVADHLNIHCKHEARSDVHGSVSREINRSYKLPNDVNTGTIKSHLTQNGVLRVSAQKK

SEQ ID NO: 164173 - protein, 182 aa, Heterodera glycines
  Homolog annotation: Hit_ID=NP_499298.1; Match level="QueryCoverage =87%, HitCoverage=25%, E-value=4e-09, Identity=29%"; Hit description =FtsH protease (3L509) [Caenorhabditis elegans] emb|CAA88955.1| Hypothetical protein M03C11.5 [Caenorhabdi
  Coding regions on vcDNA: vcDNA=SeqID_90596; Strand=+; Position=199-744
MNGQIINSDELKIVFTHKALHTLIAYYSDVAVPTGTTVNRDGCGLTKRRFLCPSVKTKEQMIFEIDFRISATIGEKIMFGKKHDGSTDDLREATRMILDMVNSGMFYDELGLREFTVAPPGPALKNKLDKFVDRKLNECVARGEKLVNNKKDEVKDLAEHLEASDGWHLNEEQIHQFFKRRN

SEQ ID NO: 164174 - protein, 188 aa, Heterodera glycines
  Homolog annotation: Hit_ID=NP_499625.2; Match level="QueryCoverage =98%, HitCoverage=35%, E-value=4e-36, Identity=41%"; Hit description =CD36 antigen family member (60.2 kD) (3N544) [Caenorhabditis elegans] emb|CAB11566.3| Hypothetical protei
  Gene Ontology: Mol. function=cell adhesion molecule activity; Cellular component=integral to membrane; Biological process=apoptosis
  Coding regions on vcDNA: vcDNA=SeqID_90597; Strand=+; Position=3-566
DHWYGERARMINGTDAELFGPNLMDAPKLQIFIGQLCRSFDLEVRQPALTAGLPVFRYAQPDSALDIAVQRSQGFCNPNSPLFFNESVQPVGCAPSGLLDMSSCFPGSPPIFFSASHFRNAHAALRHSLAGNFSSPTDSDDLSFFDIEPIVGAVVGVQQRYQLNLGMQRGNFRMTKNMSNLVVPMVWL

SEQ ID NO: 164175 - protein, 394 aa, Heterodera glycines
  Homolog annotation: Hit_ID=AAC48327.1; Match level="QueryCoverage =100%, HitCoverage=82%, E-value=0.0, Identity=99%"; Hit description =beta-1,4-endoglucanase-1 precursor [Heterodera glycines] gb|AAC15707.1| beta-1,4-endoglucanase-1 precursor
  Gene Ontology: Mol. function=glucosidase activity; Cellular component= cell wall (sensu Fungi); Biological process=cell wall organization and biogenesis
  Coding regions on vcDNA: vcDNA=SeqID_90598; Strand=+; Position=5-1186
MCRLQATHLLARLFLLLALCTALVSSLTAVAPPFGQLSVSGTNLVGANGQPVQLIGNSLFWHQWYPQFWNADTVKALKCNWNANVIRGAMGVDEGGYLSDANTAYNLMVAVIEAAISNGIYVIVDWHAHNPHPDEAVKFFTRIAQAYGSYPHILYEDFNEPLSVSWTDVLVPYHKKVIAAIRAIDKKNVIILGTPTWSQDVDVASQNPIKDYQNLMYTLHFYASSHFTNDLGAKLKTAVNNGLPVFVTEYGTCEASGNGNLNTDSMSSWWTLLDSLKISYANWAISDKSEACSALSPGTTAANVGVSSRWTSSGNMVASYYKKKSTGVSCSGSSSGSSSGSSSGSSGSSSGSSSGSSSGSSSGSSSGSSGSSSGSSSGSGSASISVVPSNTWNG

SEQ ID NO: 164176 - protein, 159 aa, Heterodera glycines
  Homolog annotation: Hit_ID=AAO85458.1; Match level="QueryCoverage =39%, HitCoverage=68%, E-value=9e-26, Identity=80%"; Hit description =putative gland protein G19C07 [Heterodera glycines]
  Coding regions on vcDNA: vcDNA=SeqID_90599; Strand=+; Position=37-513
MGFSKTIAFLSLLALFCATIAEENGATEGTEAEATTVPTLTAAAEGGKGGEEEVTTAKPTETSETAREEGEEKHKANEGKAIEGSGTRSLLQKVTCMLFGFFPFRAGCPGKNDIKAESSSHVSSTIMIIEEKEDSESDEQMDGAGGDEEKGAARDNQME

SEQ ID NO: 164177 - protein, 272 aa, Heterodera glycines
  Homolog annotation: Hit_ID=NP_498138.2; Match level="QueryCoverage =95%, HitCoverage=54%, E-value=5e-33, Identity=32%"; Hit description =putative cytoplasmic protein of bilaterial origin (50.0 kD) (3G415) [Caenorhabditis elegans] gb|AAA81060.
  Coding regions on vcDNA: vcDNA=SeqID_90600; Strand=+; Position=2-891
RVLDSSEADCIFLVGGDGTLSRALVGLSQNSAPLPIGLFPGGRKNIAFWRIFQSKNQSRDSKSVRMFCESAMALIEGENRLVYPVKCSITEEMNDSPSDHQTVNTPNTFWLLSDLCAGWFEHCEQKAPKLWWWGPLRYKFVYFWEFLKRKPIPLDLRISYEEFCPGCNRCVTPVKQKNLTTLWSFFSHLLWSSPNDSTKIKVNSDFALVENPNCGQRREANVSGANVRLNVEQTENGSKLKLRVGGAGDAFGRWAAMRFGWNSVGVANGESK

SEQ ID NO: 164178 - protein, 66 aa, Heterodera glycines
  Coding regions on vcDNA: vcDNA=SeqID_90601; Strand=+; Position=145-345
SFDQSNRCGKRESEPINVIRDYCFVSILSLFCYSIFVIRRTVIRNSCIIYHHFDKNCLRTNRQKPH

SEQ ID NO: 164179 - protein, 176 aa, Heterodera glycines
  Homolog annotation: Hit_ID=NP_650430.1; Match level="QueryCoverage =85%, HitCoverage=85%, E-value=1e-15, Identity=35%"; Hit description =CG4210-PA, isoform A [Drosophila melanogaster] gb|AAF55142.2| CG4210- PA, isoform A [Drosophila melanogast
  Coding regions on vcDNA: vcDNA=SeqID_90602; Strand=+; Position=2-529
ANDAEVLTSLIQELADSLKMPNGPKLNADHLRIFLKDGATRALIATATKDGETTVAGYAIYFIAPSTEFGKVFFLEDLYIRPDFRRQKLGSQFMTELKKFSNEMACDVFQWNVLANNVNAIRFYTSLGARNLTNVDGETGFSCWRIESNQFEAIIRNSKECLPHIKFAVFSLDAEN

SEQ ID NO: 164180 - protein, 107 aa, Heterodera glycines
  Coding regions on vcDNA: vcDNA=SeqID_90603; Strand=+; Position=2-325
SFLRQRPPSLPATILSKSLHTKPFLLTPTVTKFSKRNWKNIRLIRSNWRILEHLRRCKTFLSPAMTSPMNLACFSVPFVQIRRLIGHKIVTNNNLFSFIHFRKLFSL

SEQ ID NO: 164181 - protein, 69 aa, Heterodera glycines
  Coding regions on vcDNA: vcDNA=SeqID_90604; Strand=-; Position=341-550
IVLPKLNSVPDGFNMRTIIALSKALITCGNFPCNFPYRCFQILSTDESIPIEHEMRGQKRVAYYQVGKK

SEQ ID NO: 164182 - protein, 83 aa, Heterodera glycines
  Homolog annotation: Hit_ID=XP_510031.1; Match level="QueryCoverage =83%, HitCoverage=68%, E-value=1e-17, Identity=61%"; Hit description =PREDICTED: similar to enhancer of rudimentary homolog [Pan troglodytes] gb|AAH86103.1| Unknown (protein f
  Coding regions on vcDNA: vcDNA=SeqID_90605; Strand=+; Position=5-256
MEAVCKIYEEHLKKLNPDVPCIQYDISALFKFIDRLADLSCMVLDKSVYVPKGEDFIKEQIFILLRGQAASNAAKKCPAEGSL

SEQ ID NO: 164183 - protein, 29 aa, Heterodera glycines
  Coding regions on vcDNA: vcDNA=SeqID_90606; Strand=-; Position=1-87
FPFIKFIYIKFPKNKNPDNINCEVRSSLM

SEQ ID NO: 164184 - protein, 99 aa, Heterodera glycines
  Homolog annotation: Hit_ID=NP_493587.1; Match level="QueryCoverage =100%, HitCoverage=65%, E-value=5e-44, Identity=80%"; Hit description= ubiquitin conjugating enzyme (16.9 kD) (ubc-16) [Caenorhabditis elegans] emb|CAA21716.1| Hypothetical pr
  Gene Ontology: Mol. function=ubiquitin conjugating enzyme activity; Cellular component=proteasome complex (sensu Eukarya); Biological process=histone ubiquitination
  Coding regions on vcDNA: vcDNA=SeqID_90607; Strand=+; Position=1-300
IFQLQFRFDDQYPFSSPEVMFMGENIPAHPHVYSNGHICLSILSDDWTPALSVSSVCLSIQSMLSSCKEKKRPPDNDLYVRTCSKNPNKTRWWFHDDKV

SEQ ID NO: 164185 - protein, 141 aa, Heterodera glycines
  Homolog annotation: Hit_ID=NP_701754.1; Match level="QueryCoverage =63%, HitCoverage=4%, E-value=2e-14, Identity=49%"; Hit description =erythrocyte membrane protein 1 (PfEMP1) [Plasmodium falciparum 3D7] gb|AAN36478.1| erythrocyte membrane pr
  Gene Ontology: Mol. function=structural molecule activity; Cellular component=intermediate filament; Biological process=epidermal differentiation
  Coding regions on vcDNA: vcDNA=SeqID_90608; Strand=+; Position=1-423
TTAPPAVAYQRVAGVLAVLAELLQPIKVKDTHIEGITTEPNPNLNALEGGGDSDGGGDSNGAEGNGEEAGGPMKGSSSGGFKSAGAPHVRGGSFMRGGRGGSGPPGGRGGMANRGGFGSGRGRGTPGGSRGGGSRGGGQRG

SEQ ID NO: 164186 - protein, 141 aa, Heterodera glycines; identical to SEQ ID NO: 161711
  Homolog annotation: Hit_ID=AAH80970.1; Match level="QueryCoverage =96%, HitCoverage=93%, E-value=5e-28, Identity=46%"; Hit description =MGC79746 protein [Xenopus tropicalis] ref|NP_001008076.1| MGC79746 protein [Xenopus tropicalis]
  Gene Ontology: Cellular component=TRAPP; Biological process =intracellular protein transport
  Coding regions on vcDNA: vcDNA=SeqID_90609; Strand=+; Position=125-550

SEQ ID NO: 164187 - protein, 87 aa, Heterodera glycines
  Homolog annotation: Hit_ID=AAL78212.1; Match level="QueryCoverage =66%, HitCoverage=63%, E-value=7e-17, Identity=55%"; Hit description =putative esophageal gland cell secretory protein Hgg-25 [Heterodera glycines]
  Coding regions on vcDNA: vcDNA=SeqID_90610; Strand=+; Position=67-330
MRTFLFIAVVGLMLAVILENVNATGKNSPTKGKQSLDSPNHEKDHKNEHEKYEAAYFQSLLFFYMSKVTYRTMLPVTHLFSNHKIFI

SEQ ID NO: 164188 - protein, 402 aa, Heterodera glycines
  Homolog annotation: Hit_ID=NP_496505.1; Match level="QueryCoverage =100%, HitCoverage=76%, E-value=1e-174, Identity=70%"; Hit description=ALDH6A3, ALdehyde deHydrogenase (56.5 kD) (alh-8) [Caenorhabditis elegans] emb|CAA88946.1| Hypothetical
  Gene Ontology: Mol. function=methylmalonate-semialdehyde dehydrogenase (acylating) activity; Cellular component =mitochondrion; Biological process=pyrimidine nucleotide metabolism
  Coding regions on vcDNA: vcDNA=SeqID_90611; Strand=+; Position=2-1210
AEGDVFRGLQVVEFACNAASLLLGEHLPNIAKDMETYSLRLPLGVTAGICPFNFPAMIPLWMFPLALVSGNTMLMKPSEQDPGATMMLMELAKEAGIPDGCVNVIHGTRSAVTFICEQPDIKAISFVGSDQAGKYIYEHGSKFGKRVQSNMGAKNHGVILPDANREHTLNQVAAAAFGAAGQRCMALSTAIFVGDARGWVSDLVERARKLRVRPGWEAETDIGPVISQKAKERICELVESALEEGADVPLDGTNVTVKGFEKGNFVGPTVITGVKPEMLCYKEEIFGPVLCVLETETLDEAMDLINKNPYGNGTALFTRSGIAAHRFVSEIDVGQVGINVPIPVPLPMFSFTGSRGSFLGDANFYGKAGLNFYTQIRTVTQLWRSEDASTEAKPQLSFPQFK

SEQ ID NO: 164189 - protein, 25 aa, Heterodera glycines
  Coding regions on vcDNA: vcDNA=SeqID_90612; Strand=-; Position=25-102
IICCFFLFFVIVIEIPGCELLLPVG

SEQ ID NO: 164190 - protein, 134 aa, Heterodera glycines
  Homolog annotation: Hit_ID=AAP30835.1; Match level="QueryCoverage =100%, HitCoverage=88%, E-value=7e-49, Identity=60%"; Hit description= putative gland protein G33E05; Hg-G33E05 [Heterodera glycines]
  Coding regions on vcDNA: vcDNA=SeqID_90613; Strand=+; Position=75-476
MRTFLFIAVVGLVLAVIMERVNATGNNSPTKGQTPPGSPKGGHGNNKSPTTPHSAGSPHGTQHGNQQKNATGQTPPGSPKGGHGNNKSPTTPHSTKRETELIIEKGKPSPDSPNHKNDHENEISNLQNRATGQS

SEQ ID NO: 164191 - protein, 123 aa, Heterodera glycines
  misc_feature (39)..(39): Xaa can be any naturally occurring amino acid
  Homolog annotation: Hit_ID=BAA02166.1; Match level="QueryCoverage =51%, HitCoverage=8%, E-value=2e-19, Identity=76%"; Hit description =KIF3 protein [Mus musculus] sp|P28741|KF3A_MOUSE Kinesin-like protein KIF3A (Microtubule plus end-directed
  Gene Ontology: Mol. function=plus-end-directed kinesin ATPase activity; Cellular component=plus-end kinesin complex; Biological process=organelle organization and biogenesis
  Coding regions on vcDNA: vcDNA=SeqID_90614; Strand=+; Position=1-371
AGSERQAKINATGDRLKEASKINLSLSTLGNVISALADXESPHIPYRNSKLNRILQELLGGTAGPTVGAEQPLGKDDKINVSLNAFVGSWQWRRASEHSKQNSATLRSSTAHCRRSPRGWANG

SEQ ID NO: 164192 - protein, 66 aa, Heterodera glycines; identical to SEQ ID NO: 138838
  Coding regions on vcDNA: vcDNA=SeqID_90615; Strand=-; Position=50-250

SEQ ID NO: 164193 - protein, 171 aa, Heterodera glycines
  Homolog annotation: Hit_ID=NP_500001.2; Match level="QueryCoverage =98%, HitCoverage=27%, E-value=1e-19, Identity=35%"; Hit description =ankyrin (4B602) [Caenorhabditis elegans] gb|AAF59601.3| Hypothetical protein Y55F3BR.8a [Caenorhabditis e
  Coding regions on vcDNA: vcDNA=SeqID_90616; Strand=+; Position=1-513
EFRVAIEKGDAAKFDGLLRESPRFLVNTSNDLPTILHIGMRCNAMHIACRSSNVHAVRQMLALVQSGEWLRDAYGTDACVKERSDNLLDALLNTPDKIENNTPLHYACRQLCEPIFRELIGHEQCHRSPVNSHNERPIDVLGRGTRGSGGAGRQENKKVFDRMYVALEGSL

SEQ ID NO: 164194 - protein, 80 aa, Heterodera glycines
  Coding regions on vcDNA: vcDNA=SeqID_90617; Strand=+; Position=5-247
LSQDSRAKGVTLQNDGLSPIRTDRHPSGQQPRRIGTKCEQCRPRTAIVKTLQWNFSLKNKNDLNGRMKTLKIIKKFILNI

SEQ ID NO: 164195 - protein, 145 aa, Heterodera glycines
  Homolog annotation: Hit_ID=NP_741899.1; Match level="QueryCoverage =98%, HitCoverage=84%, E-value=1e-52, Identity=68%"; Hit description =leftover like (XL616) [Caenorhabditis elegans] emb|CAD36494.1| Hypothetical protein F59F3.6 [Caenorhabdit
  Coding regions on vcDNA: vcDNA=SeqID_90618; Strand=+; Position=3-504
TDLLADPRSKLADWFRPGTNRPPIPTDKGGNLFLDRDPKMFRHIIGYLRLKKERCAASLALPAKPDDLAKLIGECEALNLVELRELALEMLQKYVRTEEQHYVTSYVQMALRDYEAWQFEQEQKNENGTDDGEKPKRSEFDEWVE

SEQ ID NO: 164196 - protein, 78 aa, Heterodera glycines
  Coding regions on vcDNA: vcDNA=SeqID_90619; Strand=+; Position=122-358
FILKDGKSIRSYFTNSDKNLLKNGMKLRKCGLAKGKKKIQMRSEFNLLIAEFFESVGIIPGVYRKGEARNIFYTNTIH

SEQ ID NO: 164197 - protein, 100 aa, Heterodera glycines
  Coding regions on vcDNA: vcDNA=SeqID_90620; Strand=-; Position=74-376
FFIETLFDLRVQHFFFYHKLFFLVFHRLSLLPFSIFHYLSHHFLQPQWPPPPWPQRRSRIIGDAMFGPPSTEFSTVPWVPAKIAKVIRKRATKKRRGDIL

SEQ ID NO: 164198 - protein, 91 aa, Heterodera glycines
  Coding regions on vcDNA: vcDNA=SeqID_90621; Strand=+; Position=13-288
QGPIAGPNGIFPCVNRPGIKCDMDAAYIAAEAIVCFIEDAGQTYVEFSFERRCPVQQRKWAQPDAEQAECRRYFAYLLHGPQKMETPKTGK

SEQ ID NO: 164199 - protein, 52 aa, Heterodera glycines
  Coding regions on vcDNA: vcDNA=SeqID_90622; Strand=+; Position=21-179
EKRRMTRHLQPAHCDGPFRCFANFNFKIAYIPFSFQMICLSFLILIFCFLSS

SEQ ID NO: 164200 - protein, 175 aa, Heterodera glycines
  Coding regions on vcDNA: vcDNA=SeqID_90623; Strand=+; Position=3-527
PSNQGMNQLALPRKAKKTNKTNAIVPVQNAASFGDRGYIPSSEIILKTKQKRRPEASAEEYIKFVKNAVNSLNKSDNVHFLTNGFSLVGKNAQQELQRYHIYPRNRLMIGGLMELIANRKMKSADELEYMVLEKVHMMEVELNGGRLQLEPLGVTFVTGVQIYINLQTMEQQFAS

SEQ ID NO: 164201 - protein, 216 aa, Heterodera glycines
  Homolog annotation: Hit_ID=CAE74460.1; Match level="QueryCoverage =56%, HitCoverage=21%, E-value=8e-14, Identity=37%"; Hit description =Hypothetical protein CBG22204 [Caenorhabditis briggsae]
  Gene Ontology: Mol. function=transcription co-repressor activity; Cellular component=nucleus; Biological process=DNA replication dependent nucleosome assembly
  Coding regions on vcDNA: vcDNA=SeqID_90624; Strand=-; Position=99-749
FLDDKEKENGTKNCEAEAKKVELEDERKQKEVEQNNAGKRSIAVPQNQLSVEFLANIEGHRGTTNIVRFSPNGTYIASGDADGFLFVWKLEQEVLECEVQMLEEPATVRQRDADPEMDIPPNKENWARAFRSPIRHDGDVTGISWSPDSQMLASVSMDDSVAVHRADNGSSNGYFGRNERHKTSLLPPNRISINSPSSGRQFRNSSKSKTCHNYSY

SEQ ID NO: 164202 - protein, 80 aa, Heterodera glycines
  Coding regions on vcDNA: vcDNA=SeqID_90625; Strand=-; Position=309-551
SLHNFFVAFFVGMFAITGVGICLSVCALIAAGVSIVSAARRLMPVVIFCAMTFVFEFFIFSLRFNFSIFHFRSAKILMVL

SEQ ID NO: 164203 - protein, 49 aa, Heterodera glycines
  Coding regions on vcDNA: vcDNA=SeqID_90626; Strand=+; Position=9-158
ECQIANWRNFTRYFKKYTGNAFFVWFIMSLHNSHAFPTNPNILLSKKRF

SEQ ID NO: 164204 - protein, 149 aa, Heterodera glycines
  Coding regions on vcDNA: vcDNA=SeqID_90627; Strand=+; Position=3-452
TNFEPNRTYTLTGIYEQSTKIDPPQFETNFVIMHKSEQTRQIMKWALLCAAEPDCMVPIGQTKACIYTATAPNLTCHRQDQGLMEILRYNMEYRQEIENPSFLTQLNPAHPRSSNRPLQSSGISGFFDLLRGKHFGGSQSEWLQRVQCC

SEQ ID NO: 164205 - protein, 123 aa, Heterodera glycines
  Homolog annotation: Hit_ID=CAE66579.1; Match level="QueryCoverage =85%, HitCoverage=14%, E-value=9e-44, Identity=79%"; Hit description =Hypothetical protein CBG11896 [Caenorhabditis briggsae]
  Gene Ontology: Mol. function=calcium ion binding; Cellular component =mitochondrion; Biological process=glucose catabolism
  Coding regions on vcDNA: vcDNA=SeqID_90628; Strand=+; Position=2-373
REARMQSVSDVPLNLTKEEMQMAKERFNQLDKDKKGHITVNDIRRHFREHNNKIDERLLHELLNEVDLNKNGELELAEFFQLYSGLKSGQITQNRLVRYLDELGGEKDKTKPVLDVVRSGGGF

SEQ ID NO: 164206 - protein, 166 aa, Heterodera glycines
  Homolog annotation: Hit_ID=AAC48327.1; Match level="QueryCoverage =100%, HitCoverage=57%, E-value=3e-47, Identity=81%"; Hit description= beta-1,4-endoglucanase-1 precursor [Heterodera glycines] gb|AAC15707.1| beta-1,4-endoglucanase-1 precurso
  Coding regions on vcDNA: vcDNA=SeqID_90629; Strand=+; Position=3-500
CRLQATHLLARLFLLFALCTAFVSSLTAVAPPFGQLSVSDTNLVGANGQPVQLIGNSLFWHQWYPQFWNADTVKALKCNWNANVIRGAMGVDVASQNPIKDYQNLMYTLHFYASSHFTNDLGAKLKTAVNNGLPVFVTEYGTCEASGNGNLNTDSMSSWWTLLDSL

SEQ ID NO: 164207 - protein, 240 aa, Heterodera glycines
  Homolog annotation: Hit_ID=CAE59908.1; Match level="QueryCoverage =92%, HitCoverage=31%, E-value=6e-75, Identity=64%"; Hit description =Hypothetical protein CBG03392 [Caenorhabditis briggsae]
  Gene Ontology: Mol. function=NAD+ synthase (glutamine-hydrolyzing) activity; Biological process=nucleobase, nucleoside, nucleotide and nucleic acid metabolism
  Coding regions on vcDNA: vcDNA=SeqID_90630; Strand=+; Position=2-724
DLREGMALQNVQARARMVLAYLHAQLTLTKERRKGSLLILGASNVDESLVGYVTKYDCSSADINPIGATSKDDLREFLCHANANHKFPHLQSVIHSVPTAELRPLKDGQIVQTDEAEIGLTYRELSTFGKLRRPGCSGPYRMFQELVHIWHPARSYDEIADKVRIFFRRYAMNRHKATVATPAYHANTYSNEEHRNDHRSFLYPDMAHQFHRISELVEMLKKRDQTLQQKNSNGQRTTAD

SEQ ID NO: 164208 - protein, 107 aa, Heterodera glycines
  Homolog annotation: Hit_ID=AAP30776.1; Match level="QueryCoverage =86%, HitCoverage=34%, E-value=4e-20, Identity=59%"; Hit description =putative gland protein G34B08 [Heterodera glycines]
  Coding regions on vcDNA: vcDNA=SeqID_90631; Strand=+; Position=67-390
MRTFLFIAVVGLMLAVILENVNATGKNSPSKGKPSPDSTNHKKDHKNEHPKYEAELIYEQGKPSPDSPKYDSPILAGSSGSPKKGKSPNADPKKAASHLVPVTPGKV

SEQ ID NO: 164209 - protein, 64 aa, Heterodera glycines; identical to SEQ ID NO: 139695
  Coding regions on vcDNA: vcDNA=SeqID_90632; Strand=-; Position=1-192

SEQ ID NO: 164210 - protein, 180 aa, Heterodera glycines
  misc_feature (165)..(165): Xaa can be any naturally occurring amino acid
  Coding regions on vcDNA: vcDNA=SeqID_90633; Strand=+; Position=2-541
SARNGVQKRTVSPSNSVGSSNGSGSVSSKFQSQDLISELSDRLSKRKMTVEASSNANGTPNQPNSQTLPVNNAKGSANPYGRIPSVSSLSSQDDATAGGGTPATAGAASAAQDSQLTCETVVKGPTQLTCEPMVKGPTSSAHNDIANSEARPKATTTSSDFERMXGELLELFSNELQNLK

SEQ ID NO: 164211 - protein, 86 aa, Heterodera glycines
  Homolog annotation: Hit_ID=NP_493587.1; Match level="QueryCoverage =63%, HitCoverage=36%, E-value=6e-21, Identity=78%"; Hit description =ubiquitin conjugating enzyme (16.9 kD) (ubc-16) [Caenorhabditis elegans] emb|CAA21716.1| Hypothetical pro
  Coding regions on vcDNA: vcDNA=SeqID_90634; Strand=+; Position=1-332
LGQLIANFYIHFRNTLYDSEIFQLQFRFDDQYPFSSPEVMFMGENIPVHPHVYSNGHICLSILSDDWTPVTLAVHKMTDNPQTGTL

SEQ ID NO: 164212 - protein, 152 aa, Heterodera glycines; identical to SEQ ID NO: 160444
  Homolog annotation: Hit_ID=CAE58634.1; Match level="QueryCoverage =86%, HitCoverage=95%, E-value=2e-51, Identity=68%"; Hit description =Hypothetical protein CBG01802 [Caenorhabditis briggsae]
  Coding regions on vcDNA: vcDNA=SeqID_90635; Strand=+; Position=52-510

SEQ ID NO: 164213 - protein, 181 aa, Heterodera glycines
  Coding regions on vcDNA: vcDNA=SeqID_90636; Strand=+; Position=3-548
NQKGKGSDQIATDQRGSDQKEWTDQRGIFINCEPGLAEYYDQSTIKFGFKPCQSQKTFSIDPNYLPLFNGNLLQMMEMERKQRDRSADDHDFVTVQTIRHILENNREAENIVFVTHMQNSGLLLELMGAEWAAVGQATISKLVKYEENVGIGKPSDVLQQFRLEYASGVTHLTERKDLRPR

SEQ ID NO: 164214 - protein, 193 aa, Heterodera glycines
  misc_feature (55)..(55): Xaa can be any naturally occurring amino acid
  Homolog annotation: Hit_ID=AAH45080.1; Match level="QueryCoverage =95%, HitCoverage=57%, E-value=1e-26, Identity=38%"; Hit description =MGC53836 protein [Xenopus laevis]
  Coding regions on vcDNA: vcDNA=SeqID_90637; Strand=+; Position=361-940
RSSILPFPLQVYYSLFTSLLSVFLAKTSINGLLHRGRMFIFSHSHLKVFLPIPDXGPPSGCQLLDIGARDGAVTAKVTSICVVEASKVMEWRLARRGFTVLPMDKWQRSGPYSLITALNLLDRHHDPKKLLNSLHELAIEHNCPILLSVVLPIRQFVEFDDKIVSAGRKLPASDIPTEGTTFEAQVNSIIQIG

SEQ ID NO: 164215 - protein, 176 aa, Heterodera glycines
  Homolog annotation: Hit_ID=NP_492045.1; Match level="QueryCoverage =88%, HitCoverage=16%, E-value=5e-16, Identity=34%"; Hit description =PAZ Piwi domain protein family member (105.4 kD) (1H813) [Caenorhabditis elegans] emb|CAA95839.1| Hypothe
  Gene Ontology: Mol. function=translation initiation factor activity; Cellular component=eukaryotic 48S initiation complex; Biological process=gametogenesis
  Coding regions on vcDNA: vcDNA=SeqID_90638; Strand=+; Position=291-821
NIHDEFPSYVKACKKYDPNWEPKFVYCIVDKNHNKRFFVKGQQQVENTAPGAVIDSKVVRVDIHEFWMQSHVPLKGTSKMPQYIFPVNDPKANNNELQGFLLALCCSWQIVTLAPALPTPVRQAKELAKRGRANFGELKRTPQYIPRAENQQIDYQQLNRRLCYNGHIFADTRFNA

SEQ ID NO: 164216 - protein, 117 aa, Heterodera glycines
  Homolog annotation: Hit_ID=XP_318627.1; Match level="QueryCoverage =94%, HitCoverage=10%, E-value=1e-33, Identity=62%"; Hit description =ENSANGP00000020973 [Anopheles gambiae]
  Gene Ontology: Mol. function=ATP dependent RNA helicase activity; Cellular component=nucleolus; Biological process=RNA localization
  Coding regions on vcDNA: vcDNA=SeqID_90639; Strand=+; Position=159-512
NQRKRSHRNKQGMAKKIAKISIECKLELDEEKYVESFCPAMMTVVSKWCSGATFAEILETSDIFEGSIIRCMRRLEELLQEMVNAARSMGDRPLEQKFEQARSLLKRDIVFSASLYL

SEQ ID NO: 164217 - protein, 62 aa, Heterodera glycines
  misc_feature (13)..(13): Xaa can be any naturally occurring amino acid
  Coding regions on vcDNA: vcDNA=SeqID_90640; Strand=-; Position=26-214
YNFFFFFFFFFFXYNFLIFIIVFYNSGFNIPIFQLICLANCAVARRLRPAGLNGPTPGSKAS

SEQ ID NO: 164218 - protein, 182 aa, Heterodera glycines
  Homolog annotation: Hit_ID=XP_311402.1; Match level="QueryCoverage =98%, HitCoverage=14%, E-value=3e-47, Identity=52%"; Hit description =ENSANGP00000000545 [Anopheles gambiae]
  Gene Ontology: Mol. function=phospholipase D activity; Cellular component=plasma membrane; Biological process=RAS protein signal transduction
  Coding regions on vcDNA: vcDNA=SeqID_90641; Strand=+; Position=2-547
FVLIPLLPGFEGDIGATSYSALLAVLHWTMLSIAKGDHSLIQNLQRAGVENVQNYITFCSLRTHSQLYGKSVTELVYIHSKLMIVDDVHTIIGSANINDRSQAGNRDSEVCLLITDHEFVDGRMNGQPFRAGKFASSLRMRLMREHLGLLEQSLPKTSPERAAEIDVIDPTCPSFYEDQWCQ

SEQ ID NO: 164219 - protein, 53 aa, Heterodera glycines
  Coding regions on vcDNA: vcDNA=SeqID_90642; Strand=+; Position=19-180
MKSFILAVLFSFLFMALMMPLVSSEESETKMKSPIMEKHGNGGDRLSDYLLKL

SEQ ID NO: 164220 - protein, 195 aa, Heterodera glycines
  Homolog annotation: Hit_ID=CAE62912.1; Match level="QueryCoverage =100%, HitCoverage=36%, E-value=1e-31, Identity=41%"; Hit description= Hypothetical protein CBG07104 [Caenorhabditis briggsae]
  Gene Ontology: Mol. function=protein kinase binding; Cellular component=cytoplasm; Biological process=regulation of JNK cascade
  Coding regions on vcDNA: vcDNA=SeqID_90643; Strand=+; Position=2-586
YYEDADGLNGNLSYGGTKGRKEWEENADPHSSDLSLYNIADGNKSSSGISSCCTTSSRSCEPPETNRFVLAKKQRHFKAGDEADPKMPTHRAQFPFMPRHSEQIELQKGDAIRILEKYEDHWCHGINLRSGKKGIFPEAHVVEIDLVDEICRSVLPDGTNHANKIERDTFYLTMLASIEGAHHRGNDVVMQAINK

SEQ ID NO: 164221 - protein, 65 aa, Heterodera glycines
  Homolog annotation: Hit_ID=CAE74863.1; Match level="QueryCoverage =83%, HitCoverage=7%, E-value=3e-09, Identity=53%"; Hit description =Hypothetical protein CBG22718 [Caenorhabditis briggsae]
  Coding regions on vcDNA: vcDNA=SeqID_90644; Strand=+; Position=317-511
GKVDGLDFDAFTRQLFDRWFGAYTRCGTCKNGKCSRHGGPLGSSGWEHVFSGEWRGEIVDGHHSW

SEQ ID NO: 164222 - protein, 181 aa, Heterodera glycines
  misc_feature (179)..(179): Xaa can be any naturally occurring amino acid
  Coding regions on vcDNA: vcDNA=SeqID_90645; Strand=+; Position=2-544
GDHKLKKMFFSSKSVLLLLVVIALDTFTSSQPIGEGNGNADKAVKKKSSSKGRVGTVAKGVFTGTLLATTGSFAQVADARPVVQINHVIATPSVPPPPSARMTPPVQESAMRRRANVVRKDGVPDPNAPSTGFEVPPLPPGGFNRSASCGTNGDGTPMGPCGYVPIGTTGLPDEYKVNXDE

SEQ ID NO: 164223 - protein, 246 aa, Heterodera glycines
  Homolog annotation: Hit_ID=AAL93203.1; Match level="QueryCoverage =100%, HitCoverage=36%, E-value=1e-20, Identity=30%"; Hit description= transposase [Bactrocera dorsalis]
  Gene Ontology: Mol. function=transposase activity; Cellular component= nuclear chromosome
  Coding regions on vcDNA: vcDNA=SeqID_90646; Strand=+; Position=1-738
IMSDSAANMKRAFVERDENENRILPIPNGPCAAHLLNLAVQEAFKRDESISSLLAKTRHIVGRFKHSNTAFSELKKIQKLLDAPSHTLLQMVYVRWNSALTMCERLTEQRTAITQYAVDNNEFELLLKNDEWEQIEELVGVLKCAEEATKRFTAEPISFVIPQARALHDELYEMKIVNRTVETIRTTLYFAVERRFFGLANLKEYALATFFDVRFKDKVLTENSATFRARVTVWIKNELKEWENDN

SEQ ID NO: 164224 - protein, 111 aa, Heterodera glycines
  Coding regions on vcDNA: vcDNA=SeqID_90647; Strand=+; Position=3-338
TIPKQHTLGPAPKWRKGNVPNGYSPLPAAAISFLRMGRCRRKFKRNVDHQPNEGIQIPFTFACSNKSFNKWRTLGFGFNVLNLSPPFDVHLFFVFSRNSSPTAISLFILYV

SEQ ID NO: 164225 - protein, 88 aa, Heterodera glycines
  Coding regions on vcDNA: vcDNA=SeqID_90648; Strand=+; Position=70-336
MNWCAVLCFLLLIEVAFVPIVNSAPLEREKRLTASQLGKGAVVGAGVGLVGAALYAGGKKFWNNRKANAAAADAGGADAANLKTKGRK

SEQ ID NO: 164226 - protein, 308 aa, Heterodera glycines
  misc_feature (132)..(132): Xaa can be any naturally occurring amino acid
  misc_feature (141)..(141): Xaa can be any naturally occurring amino acid
  misc_feature (248)..(248): Xaa can be any naturally occurring amino acid
  misc_feature (275)..(275): Xaa can be any naturally occurring amino acid
  Homolog annotation: Hit_ID=AAB66556.1; Match level="QueryCoverage =99%, HitCoverage=56%, E-value=2e-38, Identity=31%"; Hit description =cytochrome P450 30 [Mercenaria mercenaria]
  Gene Ontology: Mol. function=cytochrome P450 activity; Cellular component=membrane; Biological process=electron transport
  Coding regions on vcDNA: vcDNA=SeqID_90649; Strand=+; Position=1-925
FGRFLLDVIGRCGFSLDLDTFDEENIFVKQARTIFDFTRKGQKLRMILGVFFPCVSLLYENITGKSFAFAMDEEFFMEMMSDLYEKRRADPEAKEKYADIFQLLMNAVDDEEFTISADDAEIIHSELRSNEXSRNNRGKHXDQETELFAQSFIILIAGFETTGATLSFAAYMLAIESEIQEKLREEVIDVLGENEMITYEHLKRMNYLRAFVQETLRMFPVAPKMNRVCNSDCVINGVPFERGDLITXPIYVIQHDETFFPDPFKFDPTRLLPEXKAEIDSLAFLTFGLGPRNCIGMPCAEFQMQGAV

SEQ ID NO: 164227 - protein, 206 aa, Heterodera glycines
  Homolog annotation: Hit_ID=NP_510790.1; Match level="QueryCoverage =99%, HitCoverage=99%, E-value=1e-100, Identity=89%"; Hit description= RAB family member (23.4 kD) (rab-6.2) [Caenorhabditis elegans] gb|AAC69020.1| Rab family protein 6.2 [Ca
  Gene Ontology: Mol. function=ATP binding; Cellular component=Golgi apparatus; Biological process=embryogenesis and morphogenesis
  Coding regions on vcDNA: vcDNA=SeqID_90650; Strand=+; Position=83-703
MSSDFGNPLKKFKLVFLGEQSVGKTSLITRFMYDSFDNTYQATIGIDFLSKTMYLEDRTVRLQLWDTAGQERFRSLIPSYIRDSTVAVVVYDITNANSFHQTSKWIDDVRTERGSDVIIMLVGNKTDLADKRQVSTEEGEQKAKELNVMFIETSAKAGYNVKQLFRRIASALPGIEVEKAADAKQVVDIGPIKPRQIVTEEGSCWC

SEQ ID NO: 164228 - protein, 183 aa, Heterodera glycines
  Homolog annotation: Hit_ID=NP_650438.2; Match level="QueryCoverage =99%, HitCoverage=73%, E-value=3e-61, Identity=56%"; Hit description =CG4299-PA [Drosophila melanogaster] gb|AAF55155.1| CG4299-PA [Drosophila melanogaster] gb|AAM50782.1| LD2
  Gene Ontology: Biological process=cell proliferation
  Coding regions on vcDNA: vcDNA=SeqID_90651; Strand=+; Position=1-549
TESQKALEDLDKVQTELDTLNETASDEILKVEQKYNQMRKPFFEKRTHFIKQIPNFWVTVFINHPQISNILEEEEEECLHYLTKVEIEENEDIKAGYKLKFSFDPNPFFENSEIVKEFNWTAAEPNSVTTEIKWKQGKNKLANGTGSEEQTFFKWLCQNIEPVSDEIAEVIKDDIWPNPLQYF

SEQ ID NO: 164229 - protein, 116 aa, Heterodera glycines
  Coding regions on vcDNA: vcDNA=SeqID_90652; Strand=+; Position=26-376
MRTQSIFSIFFLLLIFEVINSFPSKSSESGEPPANGAEVAQSRKKRQAEEVTTEEPPSETNDAEGAEDHQSAAAGNGKAPKNKGKKNKSDSSDSSSSSSSSSESDEKKKLKKKNKH

SEQ ID NO: 164230 - protein, 91 aa, Heterodera glycines
  Homolog annotation: Hit_ID=AAN32884.1; Match level="QueryCoverage =100%, HitCoverage=27%, E-value=4e-48, Identity=98%"; Hit description= cellulase ENG-5 [Heterodera glycines] gb|AAP97436.1| cellulase ENG-5 [Heterodera glycines]
  Coding regions on vcDNA: vcDNA=SeqID_90653; Strand=+; Position=248-523
GLPMFVTEYGCYSADGNEKANLEELKKWMELLDGYGISYAAWHVADIGEQSSILTKTSEVNNICDPAHLTNYGKAIINKLKSQNNGVKCSG

SEQ ID NO: 164231 - protein, 85 aa, Heterodera glycines
  Homolog annotation: Hit_ID=NP_486061.1; Match level="QueryCoverage =97%, HitCoverage=11%, E-value=5e-10, Identity=33%"; Hit description =ABC transporter ATP-binding protein [Nostoc sp. PCC 7120] dbj|BAB73720.1| ABC transporter ATP-binding pro
  Coding regions on vcDNA: vcDNA=SeqID_90654; Strand=+; Position=3-260
ERQLISLLRLALSNPRIILIDEATAHMDENNHKLISQLIARMGCTVLAILHRTTGLAEFDWIIEMSNGQIARQGHPSEFFESEAQ

SEQ ID NO: 164232 - protein, 187 aa, Heterodera glycines
  misc_feature (129)..(130): Xaa can be any naturally occurring amino acid
  Homolog annotation: Hit_ID=CAE67560.1; Match level="QueryCoverage =100%, HitCoverage=35%, E-value=5e-65, Identity=64%"; Hit description= Hypothetical protein CBG13087 [Caenorhabditis briggsae]
  Gene Ontology: Mol. function=extracellular ligand-gated ion channel activity; Cellular component=integral to membrane; Biological process=synaptic transmission
  Coding regions on vcDNA: vcDNA=SeqID_90655; Strand=+; Position=3-564
LFVNSISAVSERNMEYVVQFRFQQEWLDDRLAYSRLGDERSFAHLFVARDQTIWIPDSFFQNERSGHYHMLDQENRFVKIRADGRVTYNRRLTLTLACNMNLLRYPMDVQSCLIDFASYAYTTNDIIYXXDQVGVEIAPTANGALPNFEIASLENNTCDSVTNTGTYSCLRVNLSLRRVFSFFLLQL

SEQ ID NO: 164233 - protein, 178 aa, Heterodera glycines
  Coding regions on vcDNA: vcDNA=SeqID_90656; Strand=-; Position=0-533
FFFFFFFFFFFFLYNFFFFFFFFFNAKEFISRERSLAFLCVVRLNCAFLVIHPSFVHSFLFVLPICSSVRPSFTTNIPNSTGKRGRSTTRRKGKRRPIRRMRRSNTDSNVWHAPPRLDVARLRTLALRAVPALQWRRDKRLPKRERRKREAEEKTFCEDGPREAVGLRVFGSFVLFGP

SEQ ID NO: 164234 - protein, 140 aa, Heterodera glycines
  Homolog annotation: Hit_ID=NP_501176.1; Match level="QueryCoverage =95%, HitCoverage=35%, E-value=8e-21, Identity=41%"; Hit description =membrane interacting protein of RGS16 family member (40.7 kD) (4I141) [Caenorhabditis elegans] gb|AAD1473
  Gene Ontology: Mol. function=glycerophosphodiester phosphodiesterase activity; Cellular component=integral to membrane; Biological process=lipid metabolism
  Coding regions on vcDNA: vcDNA=SeqID_90657; Strand=+; Position=85-504
MTQSPRPAYVSSLLLLFPIFLLPYAVIFFIVLSFFLFLHFRNLPSPANNVANFFRGFHLGGHPASPTNAPQNTIASFKQALAEGLNFLEFDIGLTADGVPVLMHDHTLERTTNMTGLLRDYNFPDLVAQCDCGAKFKRVS

SEQ ID NO: 164235 - protein, 135 aa, Heterodera glycines
  Homolog annotation: Hit_ID=XP_394559.1; Match level="QueryCoverage =100%, HitCoverage=73%, E-value=3e-42, Identity=56%"; Hit description= similar to ADP-ribosylation factor-like 2 [Apis mellifera]
  Gene Ontology: Mol. function=ATP binding; Cellular component =microtubule cytoskeleton; Biological process=small GTPase mediated signal transduction
  Coding regions on vcDNA: vcDNA=SeqID_90658; Strand=+; Position=43-447
GFNIETLEFMGWKLNCWDVGGQKSLRTYWRNYFERTDAVIWVVDACDVCRLDDCFNELHSLINEECLHGVTLLVLANKRDLPGSINAHEIEKILRLEKIKHHWRVYETSAYTGHGLLESLEWMVQDVNSRVLVPD

SEQ ID NO: 164236 - protein, 83 aa, Heterodera glycines
  Coding regions on vcDNA: vcDNA=SeqID_90659; Strand=+; Position=44-295
MASSLIKLLSLFLLVLCIGMAIEQTQAYYGWGGYGYGYPYGFYGKRQAGFGPSGNVGIFGGGGEGNANGGGEGRGGPSSPNNF

SEQ ID NO: 164237 - protein, 174 aa, Heterodera glycines
  Homolog annotation: Hit_ID=CAE65868.1; Match level="QueryCoverage =100%, HitCoverage=30%, E-value=2e-21, Identity=35%"; Hit description= Hypothetical protein CBG11012 [Caenorhabditis briggsae]
  Gene Ontology: Cellular component=integral to membrane
  Coding regions on vcDNA: vcDNA=SeqID_90660; Strand=+; Position=2-523
LEVLSLDKCDLKELEEDIFENLTSLRALSLSGNPLDRIPAALSPLHSLTHLAMSSTNLKELKEGDFQKTVPGLEKLYMRKMKYLWKIGENTFNGLANLKFIDFSTSAKLRLLEPNVFGKDPPQNLSELHLQQCNFSTLSAKTLPQIYWKSLDVLKLNGNPFLCDCKLKWMVDMK

SEQ ID NO: 164238 - protein, 89 aa, Heterodera glycines; identical to SEQ ID NO: 148232
  Coding regions on vcDNA: vcDNA=SeqID_90661; Strand=+; Position=1-270

SEQ ID NO: 164239 - protein, 99 aa, Heterodera glycines
  Homolog annotation: Hit_ID=XP_319808.1; Match level="QueryCoverage =85%, HitCoverage=4%, E-value=1e-30, Identity=72%"; Hit description =ENSANGP00000016536 [Anopheles gambiae]
  Gene Ontology: Cellular component=CCR4-NOT core complex; Biological process=reproduction
  Coding regions on vcDNA: vcDNA=SeqID_90662; Strand=+; Position=1-513
SHTHYFSCTLLYLFLGANSKHIQEQITRILFERLVALRPHPWGLLITFIELIRNQRYGFWKHEFVYCATEIERLFLSVANSCSVSGPKVITQTGFKLLL

SEQ ID NO: 164240 - protein, 150 aa, Heterodera glycines
  Homolog annotation: Hit_ID=NP_498534.1; Match level="QueryCoverage =98%, HitCoverage=33%, E-value=1e-26, Identity=42%"; Hit description =UBiquitin Activating enzme related, ectopic membrane RuFfLes in embryo RFL-1, CYtoKinesis defect CYK-5 (r
  Gene Ontology: Biological process=endomitotic cell cycle
  Coding regions on vcDNA: vcDNA=SeqID_90663; Strand=+; Position=1-453
PAVASTNAIIAGSCALEALKLASNISCSLNNYLNFANVEGICFNVVALERDPECLVCGQKSVQMYSVREDCTLSGFLDDLKDKYQLQNPSIRAGSTFLYEINTLMPEMETASRKNLCKTLKELHVTEDSELLVADEALTRSIVFRIKYSK

SEQ ID NO: 164241 - protein, 83 aa, Heterodera glycines
  Coding regions on vcDNA: vcDNA=SeqID_90664; Strand=+; Position=1-252
IAAVAQGFKVFVDGASVCDFTFRASAPPPTEANRLTIVGDVGVQKFIFRNQKKLIFSVHTIGKTFHFRIWLDHPIPCFVLCTL

SEQ ID NO: 164242 - protein, 123 aa, Heterodera glycines
  misc_feature (49)..(49): Xaa can be any naturally occurring amino acid
  Homolog annotation: Hit_ID=AAP30755.1; Match level="QueryCoverage =100%, HitCoverage=53%, E-value=4e-62, Identity=95%"; Hit description= putative gland protein 29D09 [Heterodera glycines]
  Coding regions on vcDNA: vcDNA=SeqID_90665; Strand=+; Position=30-398
MSSLLLSIFPIVFLVCCNAMPNFPCCPGSQQVVAVMSKYIDTFSSAADXSTVCSTAKSTVDGIKNELSSRGGCQNGGEAQIVDGIDRQLKNIAKMEINYEDECPYNLGFARAMFDLAAAAAGH

SEQ ID NO: 164243 - protein, 168 aa, Heterodera glycines
  Homolog annotation: Hit_ID=CAE72855.1; Match level="QueryCoverage =100%, HitCoverage=48%, E-value=3e-51, Identity=51%"; Hit description= Hypothetical protein CBG20154 [Caenorhabditis briggsae]
  Coding regions on vcDNA: vcDNA=SeqID_90666; Strand=+; Position=1-504
VVAQIILMLWKRRHFRSYQFATLVGLWLIPFMVSLKNGWWRFILSWTVFTSSIFYVWRRVNQPAISGSTPRLVYKYFLFMHKLSYIFGIVGYFSLVFTVIGINSVFGISSNLSLDFGVHLLFYGLYYGVLGRDLAHSLTDRLACKIGYFTHDGLPKRVLESDMCAVCG

SEQ ID NO: 164244 - protein, 115 aa, Heterodera glycines
  Homolog annotation: Hit_ID=NP_498711.1; Match level="QueryCoverage =63%, HitCoverage=11%, E-value=2e-13, Identity=47%"; Hit description =tyrosinase and metridin-like ShK toxin family member (68.4 kD) (3I965) [Caenorhabditis elegans] gb|AAA279
  Coding regions on vcDNA: vcDNA=SeqID_90667; Strand=-; Position=1-398
WLNSNSIPISGISSSPAQCSINGKSYGKALRMEYRMLSDEQRDRFHSALLKLKHLYNGCSEYDRFAFLHSGIDKMPSAHGGPTFPLWHREYLKRYKWGTAFIFQIYLQFGIRPSF

SEQ ID NO: 164245 - protein, 195 aa, Heterodera glycines
  Coding regions on vcDNA: vcDNA=SeqID_90668; Strand=+; Position=64-648
MKDIATEESIAQRRLNLKANFMRQLQIRRGVLPSEIPPVGVATNAVPTMGRKFRKPLESRFPPAKPRFGLGMTAADFEDKTDNCSSLAKGPSLTETNAPKGRNVRPKAINCYINPSQSVSTWPTSNDTDSDGQSPSPTSSASVTSFGSSLTTATDPLVAQHVDQNGTIFFPTSSTPSDHGQSYDETPASSVLTFD

SEQ ID NO: 164246 - protein, 247 aa, Heterodera glycines
  Coding regions on vcDNA: vcDNA=SeqID_90669; Strand=+; Position=9-749
NILSNYIINLISNKYCRFSQAVVACTAEDPQAQLVSIWDEAENRLISQIITRPLARSLQTYNLASPIFNTFWIGLRRVLVGNRYQSTWTNGSAAIFGNVPEITTAASRNTSPWAAGQPSGTNKYTDPTGAKEECVHMLNAEGRWNDARCEIQMTGAICKKAAQSVGSSGTVVSSAVVFPSSAFDLCNPSVSQCNGFGWTISSGKCYKVIEGLMNGTQAVVACTAEDPQAQLVSIWDEAENRLISQII

SEQ ID NO: 164247 - protein, 162 aa, Heterodera glycines
  Homolog annotation: Hit_ID=AAP30835.1; Match level="QueryCoverage =100%, HitCoverage=100%, E-value=7e-94, Identity=72%"; Hit description=putative gland protein G33E05; Hg-G33E05 [Heterodera glycines]
  Gene Ontology: Cellular component=extracellular space
  Coding regions on vcDNA: vcDNA=SeqID_90670; Strand=+; Position=82-567
MRTFLFIAVVGLVLAVIMESVNATGNNSPTKGQTPPGSPKGGHGSNKSPTTPHSAGSPHGTQHGNQQNHATGQTPPGSPKGGHGNNKSPTTPHSAGSPHGTQHGNQQKNATGQTPPGSPKGGHGNNKSPTTPHSAGSPHGTQHGNQQKNATGQTPPGSPKGG

SEQ ID NO: 164248 - protein, 185 aa, Heterodera glycines
  Homolog annotation: Hit_ID=XP_416078.1; Match level="QueryCoverage =100%, HitCoverage=12%, E-value=4e-42, Identity=47%"; Hit description= PREDICTED: similar to TIP120 protein [Gallus gallus]
  Coding regions on vcDNA: vcDNA=SeqID_90671; Strand=+; Position=1-555
LQKYLPFLLKEISREEGRRQFLFLHALKEVINSECGECGTVGDADEIFKKGVEQIWELLMKYCDSAEESIRNVVAECIGRLIMVNPQKYVEELLRHSADSQANVRATVVTALRFIIVEQPRPVDDFLRPVIGKFLATVRDSDMTVRRVAIVTLNSVAHNKPKLIKECLPNLLPALYEETKVKQEL

SEQ ID NO: 164249 - protein, 25 aa, Heterodera glycines
  Coding regions on vcDNA: vcDNA=SeqID_90672; Strand=+; Position=3-80
SEEWTVTINVVKIVKLLFFDGNKFY

SEQ ID NO: 164250 - protein, 118 aa, Heterodera glycines
  Homolog annotation: Hit_ID=NP_505062.1; Match level="QueryCoverage =98%, HitCoverage=69%, E-value=2e-52, Identity=75%"; Hit description =RNA polymerase II (5I492) [Caenorhabditis elegans] gb|AAK85514.1| Hypothetical protein Y97E10AR.5 [Caenor
  Gene Ontology: Mol. function=DNA-directed RNA polymerase activity; Cellular component=DNA-directed RNA polymerase II, core complex; Biological process=transcription from Pol II promoter
  Coding regions on vcDNA: vcDNA=SeqID_90673; Strand=+; Position=120-476
MSGYVGIKFCPECNNMLYPREDKQNRQLMYVCRNCEHSEPADNPCIYVNKLTHEVDELTQIVADVIHDPTLPKTEEHPCPKCKNAESVFFQAQSRRAEEEMRLYYVCTNSQCTHRWTD

SEQ ID NO: 164251 - protein, 197 aa, Heterodera glycines
  misc_feature (63)..(63): Xaa can be any naturally occurring amino acid
  misc_feature (104)..(104): Xaa can be any naturally occurring amino acid
  Homolog annotation: Hit_ID=CAB55573.1; Match level="QueryCoverage =100%, HitCoverage=49%, E-value=9e-69, Identity=61%"; Hit description= NADH-ubiquinone oxidoreductase subunit 4 [Globodera pallida]
  Gene Ontology: Mol. function=NADH dehydrogenase (ubiquinone) activity; Biological process=mitochondrial electron transport, NADH to ubiquinone
  Coding regions on vcDNA: vcDNA=SeqID_90674; Strand=-; Position=3-594
FFKVFFFFILRFIFFFIIFDFSIIPVVFLTLFFGVQIEKIISIFFLFFYSFFLGYFFSFYFFXDFNLNFIKFLVYFDSLLNKKIFFFMVLVFLIKFPVFFLHFXLPKIHVEASTVASILLAGILLKFGVHGFSRFLISFLFSNSFFFLFIAIIGLFFCSLICLIQRDLKSLVAFSSVFHISIILIIYLVFFQLGKNG

SEQ ID NO: 164252 - protein, 38 aa, Heterodera glycines
  Homolog annotation: Hit_ID=NP_493387.1; Match level="QueryCoverage =100%, HitCoverage=14%, E-value=4e-13, Identity=89%"; Hit description= protein YR-29 (29.7 kD) (1O220) [Caenorhabditis elegans] emb|CAB04941.1| Hypothetical protein W09C5.1 [C
  Gene Ontology: Cellular component=nucleus; Biological process =ribosomal large subunit biogenesis
  Coding regions on vcDNA: vcDNA=SeqID_90675; Strand=+; Position=2-118
NVSELGMVTQGGKVVWAKYAQVTNHPENDGCINAVLLL

SEQ ID NO: 164253 - protein, 100 aa, Heterodera glycines
  Homolog annotation: Hit_ID=CAE62276.1; Match level="QueryCoverage =99%, HitCoverage=10%, E-value=8e-40, Identity=80%"; Hit description =Hypothetical protein CBG06335 [Caenorhabditis briggsae]
  Gene Ontology: Mol. function=malate synthase activity; Cellular component=peroxisomal matrix; Biological process=glyoxylate cycle
  Coding regions on vcDNA: vcDNA=SeqID_90676; Strand=+; Position=1-303
GIGCVPLYNLMEDAATAENSRTQLWQWARHEARLEDGRTVDPQLVKMTIASETERRLVRAGSVVNRIPEASELLEKFVLEPELSDFLTLDAYDKLVSEGK

SEQ ID NO: 164254 - protein, 43 aa, Heterodera glycines
  Coding regions on vcDNA: vcDNA=SeqID_90677; Strand=-; Position=53-184
FLFFFLFFFFFFFFFFFSFVLFIFSRKSCQKFSKQLNFSHRVK

SEQ ID NO: 164255 - protein, 49 aa, Heterodera glycines
  Coding regions on vcDNA: vcDNA=SeqID_90678; Strand=-; Position=2-148
MHLFVFIFVSLSLFCPSHFALSLLDKYIVPTTSDTTVNNWAMIRYCMDC

SEQ ID NO: 164256 - protein, 84 aa, Heterodera glycines
  Coding regions on vcDNA: vcDNA=SeqID_90679; Strand=-; Position=3-254
LFGLFSVLVILMFCPLNPFDLIQRIKMSDQSIGKSIDHYSIPSDQSISVHQSKGDNLSFFRPFVIAVQFILFQNIPIESECWWM

SEQ ID NO: 164257 - protein, 45 aa, Heterodera glycines
  Homolog annotation: Hit_ID=ZP_00357698.1; Match level="QueryCoverage =80%, HitCoverage=22%, E-value=6e-10, Identity=77%"; Hit description =hypothetical protein Chlo02002738 [Chloroflexus aurantiacus]
  Coding regions on vcDNA: vcDNA=SeqID_90680; Strand=-; Position=146-283
QGGGHRVVVFFFFFFFFFFFFFLVFFFFFFFFFFFFVHIYLFVRL

SEQ ID NO: 164258 - protein, 154 aa, Heterodera glycines
  Coding regions on vcDNA: vcDNA=SeqID_90681; Strand=-; Position=18-482
HSLFAPFSPSFRSFFSIVPLPFLPFFAPFLPSFRSFSYHFSLLFLPISLFFLHHLFQSFCFALIDPLLKLHSQILAHSFCEPGSVAQFLKHLSLVQLRRLIRLCSFIRPLTSEGKALATAIWEGCSNERSTERRSRTAKKSFVNISKLKITGRV

SEQ ID NO: 164259 - protein, 63 aa, Heterodera glycines
  Coding regions on vcDNA: vcDNA=SeqID_90682; Strand=+; Position=34-225
FLADLKPSIACRFSAQQSTNTVFDSLQKNNSLPKSFLQPLIANIISCRFKAIHCLPVLGTAKH

SEQ ID NO: 164260 - protein, 58 aa, Heterodera glycines
  Coding regions on vcDNA: vcDNA=SeqID_90683; Strand=-; Position=11-187
PLINCLLSANCLAFQLFDAPLFFYGVAEVSFFSFRFGLLSLSDSVPICPSATAPHLRR

SEQ ID NO: 164261 - protein, 192 aa, Heterodera glycines
  Homolog annotation: Hit_ID=CAC84452.1; Match level="QueryCoverage =81%, HitCoverage=43%, E-value=2e-56, Identity=64%"; Hit description =polyglutamate synthase [Meloidogyne artiellia]
  Coding regions on vcDNA: vcDNA=SeqID_90684; Strand=+; Position=1-579
SAEEIARKIGKVRAKRGWRRSHLPNKAQSQKTHFNNQNRRPSGDVVVLSLHWGGNWGYEISKTERDFAHQLIDSGTVDILYGHSSHHPKAIEAHKGKLILYGCGDFLNDYEGISGHNEFHDELTLMYFPVVDGKNGIIIRLDAVPMKINKMRLNRANAEDSLWLYRTMARECAKFGVRVQRDEKTNVLSFLW

SEQ ID NO: 164262 - protein, 40 aa, Heterodera glycines
  misc_feature (32)..(34): Xaa can be any naturally occurring amino acid
  Coding regions on vcDNA: vcDNA=SeqID_90685; Strand=+; Position=2-121
CYNDTLLKLFKIVSKIIFSSNFCCRKLNCFFXXXKKKKKK

SEQ ID NO: 164263 - protein, 162 aa, Heterodera glycines
  Coding regions on vcDNA: vcDNA=SeqID_90686; Strand=+; Position=3-488
MNKIYATIHFLLLLTVIANKSTNCATNGQGTQTVKTADATHDEAGKISRDSSSSSDEDDSTTAASKMLLNEANNAFSKDNDEPINQQQKMRPEANFSVKYLPPRLNAAQIDNIAQQASSMITLRTLKHVKEVFSKFAPDSWLEALEDIPLPTIRCTVKVSAK

SEQ ID NO: 164264 - protein, 83 aa, Heterodera glycines
  Coding regions on vcDNA: vcDNA=SeqID_90687; Strand=+; Position=147-395
LHHPLLQKFTSFFSRILPHMFWSFFYNQWLRFSQQKFHLLLHDERLFLFLADFMLASALITFVTFTFFGMRASYGRYAALSFF

SEQ ID NO: 164265 - protein, 128 aa, Heterodera glycines
  misc_feature (14)..(14): Xaa can be any naturally occurring amino acid
  Homolog annotation: Hit_ID=NP_982285.1; Match level="QueryCoverage =85%, HitCoverage=29%, E-value=6e-39, Identity=66%"; Hit description =alcohol dehydrogenase 8b [Danio rerio] gb|AAP74382.1| mixed alcohol dehydrogenase Adh8b [Danio rerio] gb|
  Gene Ontology: Mol. function=alcohol dehydrogenase activity, zinc -dependent; Cellular component=cytoplasm; Biological process=retinoid metabolism
  Coding regions on vcDNA: vcDNA=SeqID_90688; Strand=+; Position=133-519
FQFSSTKFEWIPLXKTIKCRAAVAWEPKKPLVIEQIEVAPPKEGEVRIKIMFTAICHTDVFQVSGINPNVKFPTIVGHEGAGVVESVGPGVESVRAGDHVIPMPLCQCRKCEECADPRTNLCQKFLYL

SEQ ID NO: 164266 - protein, 118 aa, Heterodera glycines; identical to SEQ ID NO: 126470
  Coding regions on vcDNA: vcDNA=SeqID_90689; Strand=+; Position=28-384

SEQ ID NO: 164267 - protein, 146 aa, Heterodera glycines
  misc_feature (123)..(123): Xaa can be any naturally occurring amino acid
  Homolog annotation: Hit_ID=CAE59576.1; Match level="QueryCoverage =99%, HitCoverage=43%, E-value=3e-33, Identity=47%"; Hit description =Hypothetical protein CBG02976 [Caenorhabditis briggsae]
  Gene Ontology: Mol. function=protein phosphatase type 2C activity; Biological process=cell cycle
  Coding regions on vcDNA: vcDNA=SeqID_90690; Strand=+; Position=2-479
LYALFDGHAGRRAADYCAEHFARLFVAVFKKYVPPKSAMSVFEKSIRKVFVDTYKGIDDGFLVEARRQKPTLKDGTTATTIFLLDKTLYCANIGDSKAIVCRHKSEKSTNIPLQITVDHNPLXFDERMRIQKSGGTVKDGRVFGIL

SEQ ID NO: 164268 - protein, 147 aa, Heterodera glycines
  misc_feature (106)..(107): Xaa can be any naturally occurring amino acid
  Homolog annotation: Hit_ID=AAL78212.1; Match level="QueryCoverage =89%, HitCoverage=100%, E-value=2e-35, Identity=55%"; Hit description= putative esophageal gland cell secretory protein Hgg-25 [Heterodera glycines]
  Coding regions on vcDNA: vcDNA=SeqID_90691; Strand=+; Position=88-531
MRTFLFIAVVGLMLAVILENVNATGKNSPTKGKQSLDSPNHEKDHKNEHEKYEAAYFQKKPSPDSPKYDSPILAGSSGSPKKGKSPHADPKKAASHLVPVTPGKVXXASLKMVKKLCGTMMPTMNKPKAVVVDVEKKLWYHHAIIVV

SEQ ID NO: 164269 - protein, 166 aa, Heterodera glycines; identical to SEQ ID NO: 161714
  Coding regions on vcDNA: vcDNA=SeqID_90692; Strand=-; Position=31-531

SEQ ID NO: 164270 - protein, 40 aa, Heterodera glycines
  Coding regions on vcDNA: vcDNA=SeqID_90693; Strand=+; Position=1-123
DVLASELLAAMENEGLTIQAKQELHKMCEQNRSYSSMKKF

SEQ ID NO: 164271 - protein, 64 aa, Heterodera glycines
  Homolog annotation: Hit_ID=NP_498620.1; Match level="QueryCoverage =93%, HitCoverage=26%, E-value=4e-21, Identity=70%"; Hit description=- related (24.4 kD) (3I436) [Caenorhabditis elegans] gb|AAK68310.1| Hypothetical protein F08F8.7 [Caenorha
  Gene Ontology: Mol. function=ribulose-phosphate 3-epimerase activity; Cellular component=cytosol; Biological process=pentose-phosphate shunt
  Coding regions on vcDNA: vcDNA=SeqID_90694; Strand=+; Position=23-401
MASKIKPLICPSILNTDLSDLADECRRLMAAGADYLHLDIMDGHFVPNLTFGHPLIECLRNKLG

SEQ ID NO: 164272 - protein, 219 aa, Heterodera glycines
  Homolog annotation: Hit_ID=CAD38523.1; Match level="QueryCoverage =100%, HitCoverage=87%, E-value=1e-87, Identity=67%"; Hit description= secreted glutathione peroxidase [Globodera rostochiensis]
  Gene Ontology: Mol. function=electron transporter activity; Cellular component=extracellular space; Biological process=lipid metabolism
  Coding regions on vcDNA: vcDNA=SeqID_90695; Strand=+; Position=18-674
MKNFLTFLAFFLIVPCFKADNEKNKAAPRVFAEHPGPKLVDETTRWSKCQADQNLTIYDFEVETLDGKFTNLEKYKGQIVLLINVATFCAFTQQYLDFNPMLERNRANGVPLTILAFPCNQFHLQEPAENHEILNGVMHVRPGDGWKPHSNLHIHGKLEVNGANAHPLFDFLRDSCPQTVPVLGIKESMFYNPITVSDITWNFEKFMIDANGIPRFRIH

SEQ ID NO: 164273 - protein, 25 aa, Heterodera glycines
  Coding regions on vcDNA: vcDNA=SeqID_90696; Strand=+; Position=1-78
GSMFTEGISEGVIIRKIFINELKIN

SEQ ID NO: 164274 - protein, 149 aa, Heterodera glycines
  misc_feature (108)..(108): Xaa can be any naturally occurring amino acid
  Homolog annotation: Hit_ID=AAL78212.1; Match level="QueryCoverage =89%, HitCoverage=100%, E-value=3e-28, Identity=48%"; Hit description= putative esophageal gland cell secretory protein Hgg-25 [Heterodera glycines]
  Coding regions on vcDNA: vcDNA=SeqID_90697; Strand=+; Position=90-540
MRTFLFIAVVGLMLAVILENVNATGKNSPSKGKPSPDSTNHKKDHKNEHPKYEAELIYEQGKPSPDSPKYDSPILAGSSGSPKKGKSPNADPKKAASHLVPVTPGKVXEQSLKMVKKLCGTMMPTMNKPKAVVVDVEKKLWYHHAFIVV

SEQ ID NO: 164275 - protein, 223 aa, Heterodera glycines
  Homolog annotation: Hit_ID=NP_990258.1; Match level="QueryCoverage =91%, HitCoverage=28%, E-value=7e-27, Identity=35%"; Hit description =KU70 protein [Gallus gallus] dbj|BAA32018.1| Ku70 [Gallus gallus] sp|O93257|KU70_CHICK ATP-dependent DNA
  Gene Ontology: Mol. function=ATP dependent DNA helicase activity; Cellular component=nucleus; Biological process=DNA ligation
  Coding regions on vcDNA: vcDNA=SeqID_90698; Strand=+; Position=3-723
IVVIGFKPLHLLKDSHRMGAAVFVYPIESVISGSSALYRALLKRCMDKQLFVLVRYTHKTNTPPKLCALVPQSADRIPSGCTLAREYFYDGFHLVEIPFAEKSRSMEKRLLPPDGGIGTWQLANPDQVEAAKQFVKKLTNTKFSPDDFANPVLQQHYKAVEMVALDLPFDSEQFKKEAAENDKLIPYFKNPTFEQRVAKELEEFAGICETIAETREKGKRKSA

SEQ ID NO: 164276 - protein, 245 aa, Heterodera glycines
  Homolog annotation: Hit_ID=CAE69421.1; Match level="QueryCoverage =70%, HitCoverage=9%, E-value=6e-17, Identity=39%"; Hit description =Hypothetical protein CBG15585 [Caenorhabditis briggsae]
  Coding regions on vcDNA: vcDNA=SeqID_90699; Strand=+; Position=60-797
MMTRSISPLKGQSAMFRGGSTVPMLQCRAVDIHTSSPLAGLGQRAIAVMDDGDFGSVDDVQQKYRRTGSAGTNILYRIRREELAQGKHPTVRQMARAFESFEKLQQKGNSSEEPKRKRIKPTKGGLFGLLGKSSSMEVSSMSEKNLKTPKAFRKGEHVPSEKMPGSNERTRGGGGSPSPFPSSSLPRGGRNPFKGISSRIVERVRRSLSRSKKNLSRDGGQSRDGTPSQNTIGIKAGGEVREEVD

SEQ ID NO: 164277 - protein, 114 aa, Heterodera glycines
  misc_feature (91)..(92): Xaa can be any naturally occurring amino acid
  Homolog annotation: Hit_ID=CAE67529.1; Match level="QueryCoverage =75%, HitCoverage=16%, E-value=1e-09, Identity=40%"; Hit description =Hypothetical protein CBG13051 [Caenorhabditis briggsae]
  Coding regions on vcDNA: vcDNA=SeqID_90700; Strand=+; Position=53-398
MKLSIILLLSLAFCALIIDAYPSGNGKDLEADNEKTEVKEEKMEKREAEVEEGKKEKKAAEEEVGKKEKRGSGGGTWGNGGRGNEEGNGGXXHGGGGHGGGHGGGNDSSGGGDD

SEQ ID NO: 164278 - protein, 121 aa, Heterodera glycines
  Coding regions on vcDNA: vcDNA=SeqID_90701; Strand=+; Position=2-367
FEPGNAYNPQVVCEAKVKGQRLFDWCETEERKKRINGQIDLVQAEIEAVTRLRRSLPNKSGVDFERIEHRLQSNGNGPTWRTMPKGTLANMANCVSHFRRTIHPSLLLFLFKKQCIDPFCR

SEQ ID NO: 164279 - protein, 49 aa, Heterodera glycines
  Coding regions on vcDNA: vcDNA=SeqID_90702; Strand=+; Position=62-208
VANGIVANNKFFCCVKGVRFQNLPHFICLLYVFTPSFCCYGVFCCVFCF

SEQ ID NO: 164280 - protein, 17 aa, Heterodera glycines
  Coding regions on vcDNA: vcDNA=SeqID_90703; Strand=-; Position=2-55
APNYLLITHILKLVTSK

SEQ ID NO: 164281 - protein, 122 aa, Heterodera glycines
  Coding regions on vcDNA: vcDNA=SeqID_90704; Strand=+; Position=41-406
ICRGLALAHKMPQKCRHFGHFPKSLIDLPFLSPNYPNGSLTQRIITMPITEKRVPLRMKRRKSKIHSRNVFRTPLIIPELELMKKWRNSRRNDEKPRGELPSQGEDEAIKLLLLNDIGQSAE

SEQ ID NO: 164282 - protein, 78 aa, Heterodera glycines; identical to SEQ ID NO: 152412
  Coding regions on vcDNA: vcDNA=SeqID_90705; Strand=+; Position=57-293

SEQ ID NO: 164283 - protein, 123 aa, Heterodera glycines
  Coding regions on vcDNA: vcDNA=SeqID_90706; Strand=+; Position=1-372
FTFISIALLCKHHRSKHHINAGPLDAEKSPSNGEGIHKYEAEKLKIGEVAKLNHGETKTEMDEADGHRHSLPKDRGDIVHPKSQDGVCKIHEDVKLDFNDDIFGQHVSGEERPPVAEPMPMSA

SEQ ID NO: 164284 - protein, 80 aa, Heterodera glycines
  Homolog annotation: Hit_ID=NP_497426.1; Match level="QueryCoverage =86%, HitCoverage=45%, E-value=1e-23, Identity=72%"; Hit description =predicted CDS, putative cytoplasmic protein (3C697) [Caenorhabditis elegans] gb|AAK84595.1| Hypothetical
  Coding regions on vcDNA: vcDNA=SeqID_90707; Strand=+; Position=19-261
LVLCTFPHSQFGLHAGENIAGSVAVKDKRCFDRLVVQIERKSTTEKFDVLQCRKCVFNSCWLGSRTLHDQRTYLTNLRSY

SEQ ID NO: 164285 - protein, 113 aa, Heterodera glycines
  Coding regions on vcDNA: vcDNA=SeqID_90708; Strand=+; Position=81-422
MQSVLKRFLSTEAPTTKERLPSKYAWLFNIVFSEIIIFGGTYLSLLELRKNKQARLKLHKYWPSALKHFYWAEDQLSGGQLTGEKLKVADLKSWNIEGKVKTQQKEDAIYTCE

SEQ ID NO: 164286 - protein, 357 aa, Heterodera glycines
  Homolog annotation: Hit_ID=NP_508475.1; Match level="QueryCoverage =96%, HitCoverage=46%, E-value=9e-61, Identity=39%"; Hit description =putative protein, with 2 coiled coil-4 domains, of fungal and metazoan origin (XD302) [Caenorhabditis ele
  Gene Ontology: Cellular component=mitochondrial inner membrane
  Coding regions on vcDNA: vcDNA=SeqID_90709; Strand=+; Position=3-1076
DKGHRKAELANAQRIAELEQQLVTQKGMEKQKIAQAVEEQRKLDESLSKMALEIERRRNREMTTGATQTDHLVGSTRNESDEAELDAQLKRAALAHAEHLERVIRTQKQIHDMETQQIVQETIAIERDKFGKQIENGLVKLAAIEEMLKSRATKDLENRRAKIYWTICHSLTDALANGGTAQSQKTTYYKTQLLEQIAVLKKLVQNDAFAQSVCAHFPSDDAIGRGVPTEQGLVKRFDGVYKLARCTAQIGDEGGTLWRYITSWLQSLFTFELPYAYSADDRLDLNRYDPYELLARCRHFVQQRDLLNAVRVANLIRGKSARIFSDWLKDAKFHLEVRLLVELLLAHSQASGIRTTY

SEQ ID NO: 164287 - protein, 18 aa, Heterodera glycines
  Coding regions on vcDNA: vcDNA=SeqID_90710; Strand=-; Position=0-53
FFFFCQCHWMRWARFASR

SEQ ID NO: 164288 - protein, 61 aa, Heterodera glycines
  Coding regions on vcDNA: vcDNA=SeqID_90711; Strand=-; Position=1-183
FFFFFFFKYRFFYLTNLRISTSLSFSVSISFYTSSVGQIKPNQIDSSNFTSTAASLASVTI

SEQ ID NO: 164289 - protein, 213 aa, Heterodera glycines
  Homolog annotation: Hit_ID=NP_494893.1; Match level="QueryCoverage =92%, HitCoverage=58%, E-value=5e-80, Identity=70%"; Hit description =small glutamine-rich tetratricopeptide (36.5 kD) (2F192) [Caenorhabditis elegans] gb|AAA83170.1| Hypothet
  Gene Ontology: Mol. function=protein binding
  Coding regions on vcDNA: vcDNA=SeqID_90712; Strand=+; Position=32-670
MAANENMQTEDNKKGKVTNDERNLVVSFIQFLRHKVSSNQCTDEQIEGLEVAIQCLETAFFVSDRNYAFQPSKPLIEIFKAAEGLPDGDQEFPKPTQTDVEKSNALKEEGNELVKSNKFEEAILKYNEAIKLNRDPIFFCNRAAAYCRLEQYDLAIQDCRTALALDPKYAKAYGRMGVALSCQNRYDHAVEAYKKALELDPGNESYKNNLSIG

SEQ ID NO: 164290 - protein, 132 aa, Heterodera glycines
  misc_feature (66)..(66): Xaa can be any naturally occurring amino acid
  Homolog annotation: Hit_ID=NP_704944.1; Match level="QueryCoverage =87%, HitCoverage=55%, E-value=1e-19, Identity=42%"; Hit description =small heat shock protein, putative [Plasmodium falciparum 3D7] emb|CAD52179.1| small heat shock protein,
  Gene Ontology: Biological process=protein kinase cascade
  Coding regions on vcDNA: vcDNA=SeqID_90713; Strand=+; Position=2-401
QRLFPELQTLSRLSDPFESEFRSLRQFSQLPAIDVNETKEAFVVHADIPGFTREEIDISLNGPVLXLKGNKEKKEEKKDETQHIQERIQSSFYRSITLPETFAPENVKASLKDGILEITIPKNAVTKKITIS

SEQ ID NO: 164291 - protein, 163 aa, Heterodera glycines
  Homolog annotation: Hit_ID=NP_496560.1; Match level="QueryCoverage =97%, HitCoverage=66%, E-value=1e-28, Identity=36%"; Hit description =prevents mitotic catastrophe 2 homolog (30.3 kD) (2M315) [Caenorhabditis elegans] emb|CAA19458.1| Hypothe
  Gene Ontology: Mol. function=transcription factor activity; Cellular component=nucleus; Biological process=regulation of transcription, DNA-dependent
  Coding regions on vcDNA: vcDNA=SeqID_90714; Strand=+; Position=56-544
MTTNWEKLRKELNETEEKGKGNSKKRKRKVSENCNNKWKKMREEIEKNDQQKPEKAIETTISAKKILMAIDCEYVGVGLNGAENMLARVSIVDAEGIAVYDKYVKPTEEVVDYRTKVSGIRPGHLLRGVPFVQVQSEVRKLLSDNILIGHSLRNDLTVLGLTH

SEQ ID NO: 164292 - protein, 55 aa, Heterodera glycines
  Coding regions on vcDNA: vcDNA=SeqID_90715; Strand=+; Position=140-304
SFDQSNRCGKRESEPINVIRDYCFVSILSLFCYSIFVIRRTVIRNSCIIYHHFEK

SEQ ID NO: 164293 - protein, 171 aa, Heterodera glycines
  Homolog annotation: Hit_ID=CAE60078.1; Match level="QueryCoverage =78%, HitCoverage=49%, E-value=4e-28, Identity=47%"; Hit description =Hypothetical protein CBG03598 [Caenorhabditis briggsae]
  Gene Ontology: Mol. function=actin cross-linking activity; Cellular component=actin filament; Biological process=cell organization and biogenesis
  Coding regions on vcDNA: vcDNA=SeqID_90716; Strand=+; Position=19-531
MANAEEVCPTYSEAFSHGNDDGSFCTITEFKRNKLETEARKNWDRFYKRNSDNFFKDRNWTKREIEQMCAKDMELSAPLTLLDAGCGCGNTLFPLAKFFPNWTFCGVDFSSNALSLLQQRAVQIGTNIHTELVDLSGDTLGNFSSLPKADLITLIFVLSSISLEHHSKVVH

SEQ ID NO: 164294 - protein, 216 aa, Heterodera glycines
  Coding regions on vcDNA: vcDNA=SeqID_90717; Strand=+; Position=28-675
IRHNIMTGVCELSEKHSKVRLHLPLELHCELLSALPFEHAARLLLLSKAIAKNCNSLVQKQKKGWKVFSKNCIDKIMKVYHPLVSPTLKSIEEEHHSLEHSEAHQQDTYLNKRIQDSRAELSFFVGANLVRRLAKYETAGQVMTELLNSVVNMHQFIENFKKRMKEMDERFNEVKRLADRIKSDFLPRDIPSQMFPTATVWSAERLRRDYTDHLRA

SEQ ID NO: 164295 - protein, 95 aa, Heterodera glycines
  Coding regions on vcDNA: vcDNA=SeqID_90718; Strand=+; Position=3-287
KVSSTIGRKSPKAMEMKGKIGRRKSNRRRKRKRGNDQTDSLCCDGISYKYPNYPSPLFYGMPSTDRHFVHNFFTFTMKYTHIQYICIQNKQRIEK

SEQ ID NO: 164296 - protein, 139 aa, Heterodera glycines
  Homolog annotation: Hit_ID=CAE75284.1; Match level="QueryCoverage =74%, HitCoverage=45%, E-value=4e-23, Identity=49%"; Hit description =Hypothetical protein CBG23251 [Caenorhabditis briggsae]
  Coding regions on vcDNA: vcDNA=SeqID_90719; Strand=-; Position=1-435
IAFCFSTFIPFIHSIHLIIRPPPPPRQIETSRSLFPYRRYYYSDYISNPYYWSSSYSYWGRYRSYLSDYDWPSYYNRWYDPYYDSYSRTYRYRSWLLDSMEDSLSKGLAQYRQGTINYNQLYRYRSYLSDYDWPSYYNR

SEQ ID NO: 164297 - protein, 169 aa, Heterodera glycines
  Coding regions on vcDNA: vcDNA=SeqID_90720; Strand=+; Position=3-512
QMLNEWLQKKGVPSDEAAFFLETYFHEVTEKLSKQITAMEIFYQNEKQILNNFGRAFIACHETYGTNFTEKLAQIGITEKKLVQICQFLGYDDKIFDIQPIDSDVNFGLPDWKEFCPKLMANKIPKNSVVVMDKLNSVETVGMNKGQNILPKLLAKQSRGTGVFLPKNA

SEQ ID NO: 164298 - protein, 131 aa, Heterodera glycines
  Coding regions on vcDNA: vcDNA=SeqID_90721; Strand=-; Position=1-393
FFFFFSFHSLLQNDFSHNVINHYQIFKVSSSFRSSASSSLLLRLLQRISAGATFPPLRFFRSAAAPSADGGGGGTPSPAADGSAAARAAEGFSSAASEDGDESSAEHWTTKSAKRARDRTKRILNREMPIH

SEQ ID NO: 164299 - protein, 147 aa, Heterodera glycines
  Homolog annotation: Hit_ID=CAE63795.1; Match level="QueryCoverage =98%, HitCoverage=87%, E-value=4e-15, Identity=38%"; Hit description =Hypothetical protein CBG08337 [Caenorhabditis briggsae]
  Gene Ontology: Mol. function=metallocarboxypeptidase activity; Cellular component=extracellular space
  Coding regions on vcDNA: vcDNA=SeqID_90722; Strand=+; Position=54-494
MEELLEKVHSKCPNVTRLYSVGRSVQGRDLAVIEFSLHPGRHQILKPEMVSDARNGEPIANAVVWVRNVTDGDGQTAIKHPVTTWITGDYFRPLVSGCYQIAVEADGYEIGIKTLNISQKDVKERRPHIVNFQLRPIEVEVPEAQIG

SEQ ID NO: 164300 - protein, 221 aa, Heterodera glycines
  Homolog annotation: Hit_ID=AAC48326.1; Match level="QueryCoverage =99%, HitCoverage=68%, E-value=1e-124, Identity=98%"; Hit description= beta-1,4-endoglucanase-2 precursor [Heterodera glycines]
  Coding regions on vcDNA: vcDNA=SeqID_90723; Strand=+; Position=97-759
MFVQLVLLAIVGITFVDAAAPPFGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVISAIRAIDKKNVIILGTPKWSQDVDVAAQNPDQGFSNLMYTLHFYASSHFGDGLA

SEQ ID NO: 164301 - protein, 149 aa, Heterodera glycines
  Coding regions on vcDNA: vcDNA=SeqID_90724; Strand=+; Position=3-449
QMLEVRAVGTNIGKEQDGPSYEMLFRLTTTNRSKSAPFLAKIPTKTLKREVAIEAKTNNSTNDDERKEEEQFASLKNRCHTIASTSAPFASTKVQQNGVDSNHSPSAKQSSSSSPVASTKTFRRRTAFETSEAMREIFGAYSPFSSQKK

SEQ ID NO: 164302 - protein, 213 aa, Heterodera glycines
  Homolog annotation: Hit_ID=CAE65264.1; Match level="QueryCoverage =97%, HitCoverage=78%, E-value=8e-38, Identity=39%"; Hit description =Hypothetical protein CBG10155 [Caenorhabditis briggsae]
  Gene Ontology: Mol. function=ribonuclease H1 activity; Cellular component=extracellular space; Biological process=RNA catabolism
  Coding regions on vcDNA: vcDNA=SeqID_90725; Strand=+; Position=306-944
MRQASFYAVARGRAVGVFNTWQKCNDSINGFSGAKFKKFPTLEQANDFIGKHRETLNSGGKVISKKGPPVRTMIVKSAATTFAERRLTRNTAMFGVEASNSLAASNLVSVDDGFTTVVYTDGACSRNGFVGAKAGFGVFWSDGHPDNVSAPVNGPATNNRAEYLAVISALEKATARNIRRLVIRTDSALLIQSMTKWLPKWRTNGWETINGTD

SEQ ID NO: 164303 - protein, 96 aa, Heterodera glycines
  Coding regions on vcDNA: vcDNA=SeqID_90726; Strand=+; Position=289-579
SLSSGRQNVDAIIYDRIGELETRQNVFVVEREVKSALFKSPRTSPSLSRANSLFRNSQSPTMPVEEPRRSPSARRMLANGFARQMTIADTDFFPTK

SEQ ID NO: 164304 - protein, 171 aa, Heterodera glycines
  Coding regions on vcDNA: vcDNA=SeqID_90727; Strand=+; Position=2-514
GGNKSRIWQLGSMDPSGQRLDQLLGKESKSNEQKQRISSLFTSVHLFMPKPVVVLYGEELGLLSGKPTANKLANRIVYPWSNETFGNQSQGFFVFPQRTKNGDFESQKNDKHSPLALFKEIAKLREHSDFFSGVLSHSSSSDGLDFYKIKRSQGGFFVLVVNWGEKQKALD

SEQ ID NO: 164305 - protein, 222 aa, Heterodera glycines
  Homolog annotation: Hit_ID=CAE60904.1; Match level="QueryCoverage =92%, HitCoverage=61%, E-value=5e-53, Identity=52%"; Hit description =Hypothetical protein CBG04620 [Caenorhabditis briggsae]
  Gene Ontology: Mol. function=protein binding; Cellular component =nucleus; Biological process=induction of apoptosis
  Coding regions on vcDNA: vcDNA=SeqID_90728; Strand=+; Position=3-789
FVKEFNRDEPKLDILINNAGIMFYPRFTKTVDGHELTWQSNFLGHFLLTELLLPKLERSEEGGRIVNVSSSVHLHADSVDPEVVESPRRFGIIATYARSKLANVMHVVALTKRIRTNDSGSKVSANACHPGSVNTELIRNNFFRKYIKKAFAPIIWFVLKTDRDGAQTPLFLALSRQINGVSGKYYSDCKEAKVHQFAEDEIACEILYNNSLEQCGLDHSAI

SEQ ID NO: 164306 - protein, 122 aa, Heterodera glycines
  misc_feature (49)..(49): Xaa can be any naturally occurring amino acid
  misc_feature (81)..(81): Xaa can be any naturally occurring amino acid
  Homolog annotation: Hit_ID=AAN32884.1; Match level="QueryCoverage =100%, HitCoverage=36%, E-value=7e-59, Identity=93%"; Hit description= cellulase ENG-5 [Heterodera glycines] gb|AAP97436.1| cellulase ENG-5 [Heterodera glycines]
  Coding regions on vcDNA: vcDNA=SeqID_90729; Strand=+; Position=18-382
MSAWICPGFLLFFVLILITDHCPMTQAVTQPPYGQLAVSGKNLVQKSTXKAVALHGLSMYCSQCPPNFWVKQTVNKLKCSXCNDNDVRAAMASSFGGYISNPTAEYKKMTAIIDGAIDQGLY

SEQ ID NO: 164307 - protein, 150 aa, Heterodera glycines
  Coding regions on vcDNA: vcDNA=SeqID_90730; Strand=+; Position=84-536
MFGTLRFIATLFAVTALFLDDALAFGPRAFLKRQAPPSAEMAPPKAAMDQQVAMELQQQQKHFERFVMEPQRVVPFVPSPATAYYGGGVGGVSYSGAAFAPQQLQQKRFDYVPTDPYSYESFYPLVPAKRFDAGGFGAAYGSRGRFSGFL

SEQ ID NO: 164308 - protein, 100 aa, Heterodera glycines
  Coding regions on vcDNA: vcDNA=SeqID_90731; Strand=+; Position=2-304
SFSTFSLFIVKMCQNYFCCVFTLFFFLCVLFSLVDSRPQLLNSVSTSGLLIGKGSEVKSASVPLLSEPMIEIHSHSAPVSPSELNFSRRRRKRISNNKSN

SEQ ID NO: 164309 - protein, 113 aa, Heterodera glycines
  misc_feature (50)..(50): Xaa can be any naturally occurring amino acid
  misc_feature (54)..(54): Xaa can be any naturally occurring amino acid
  Homolog annotation: Hit_ID=CAD38523.1; Match level="QueryCoverage =100%, HitCoverage=44%, E-value=2e-54, Identity=88%"; Hit description= secreted glutathione peroxidase [Globodera rostochiensis]
  Gene Ontology: Mol. function=electron transporter activity; Cellular component=extracellular; Biological process=lipid metabolism
  Coding regions on vcDNA: vcDNA=SeqID_90732; Strand=+; Position=1-341
VRPGNGWKPHPRLHIFGKLEVNGANQHPLYEFLKDSCPQTVIQIGKREEXLCTXPIRTNDITWNFEKFLIDSEGRPRFRFHPTAWSHGEVVQKFSEQMAAEQVKEVQGEVKKS

SEQ ID NO: 164310 - protein, 170 aa, Heterodera glycines
  Homolog annotation: Hit_ID=NP_494804.1; Match level="QueryCoverage =95%, HitCoverage=73%, E-value=3e-59, Identity=64%"; Hit description =SIPL protein like (2E841) [Caenorhabditis elegans] gb|AAC46708.1| Hypothetical protein K07E1.1 [Caenorhab
  Coding regions on vcDNA: vcDNA=SeqID_90733; Strand=+; Position=1-513
LPFDNFFFLTMVQMWCMETYPCGDPRLPHHCFPPKLVNPDELTKRTGALYYKLDLEDQVALSKRIAIMKLERNFTKEDTYTLDAQTTNDFKEKIAELFEETESDEDQARMVLEGSAYYDVEAKDGVWIRIFCEYGDLLIIPKGIAHRMTTTPKNYVKVRRFFKSSDSDED

SEQ ID NO: 164311 - protein, 53 aa, Heterodera glycines
  Coding regions on vcDNA: vcDNA=SeqID_90734; Strand=+; Position=3-164
KSWPCADKLHKTDWKMQRQKCANHMTSPNIGLTDNSILFHFVISFKCFQILLL

SEQ ID NO: 164312 - protein, 140 aa, Heterodera glycines
  Coding regions on vcDNA: vcDNA=SeqID_90735; Strand=+; Position=1-423
HFVRLPKAPPIIHKPSTNNNNMEIPSSNYPPPPPYDSSVLIQQPNNPSPNSPMMEKGPLPQQQAYAQPQVQHQQAERRMVRDLVTMFFCFVIPPIAIALQNGPSMKLHILLSVLLCILGWVPAVLHAVWYCFFAMRHYNH

SEQ ID NO: 164313 - protein, 66 aa, Heterodera glycines
  Coding regions on vcDNA: vcDNA=SeqID_90736; Strand=+; Position=54-254
MATSAKIFVLLFVLLTVALLVEQATAQWGYYYPYYGKREAGFAPQGNANGNAEGPAAGGGHAMFRF

SEQ ID NO: 164314 - protein, 149 aa, Heterodera glycines
  Coding regions on vcDNA: vcDNA=SeqID_90737; Strand=-; Position=38-487
SLCNKSQVGNLNECLLLAIKHNAKSDQCVFLLIIPKSNQTSSAASSPSPSSPSFHLPLPSVRLCLVRFLFTHTIFPGPKPIGTVGKLHPLGIWRAVECPPSPDILDIFENFSSNLAPLSPAHRPKSGPIAADNRRGDGWKLTNLRCGTP

SEQ ID NO: 164315 - protein, 251 aa, Heterodera glycines
  Homolog annotation: Hit_ID=NP_827559.1; Match level="QueryCoverage =92%, HitCoverage=81%, E-value=1e-52, Identity=48%"; Hit description =putative secreted lyase [Streptomyces avermitilis MA-4680] dbj|BAC74094.1| putative secreted lyase [Strep
  Coding regions on vcDNA: vcDNA=SeqID_90738; Strand=+; Position=40-792
MHSFLVLTILFANLATNAFGQQWPKATSEETVKATIKVSGGVKDFGFKRLTASSALGTGDQSEGQKALIRAEKNAVIKNLIIGQNGADGIHCYDGCTLQNVWWEKVGEDAATFRSSSGCKEYSFTVTGGGVKNAKDKVFQMNGGGTLTIKNFVAEGIGKLARACGNCKTQCQKRKFVLENIKVTGLKTLLCGLNENYGDVATIKNVQITGSKKVCAEFQGNDQQKEPPMLRSFDIGSKGDGKNCIISGTTS

SEQ ID NO: 164316 - protein, 94 aa, Heterodera glycines
  Coding regions on vcDNA: vcDNA=SeqID_90739; Strand=-; Position=6-290
LIFVGILPFFFGCLFLFSPTATATASTTSIVTTASANNDEVRLNSSNIGTESDLAVFAFLAIGQPQIVEAEHGTDQQQNGEKTKRGHFVNLIIW

SEQ ID NO: 164317 - protein, 79 aa, Heterodera glycines
  Coding regions on vcDNA: vcDNA=SeqID_90740; Strand=+; Position=47-286
MRFSFPLLAISFLMLLLVAPIQIHGMFGSNGRGRQMSGGRGQMGSNGMGPGMGGGGGSIRRMQQGQGMGGNGGGGGGMF

SEQ ID NO: 164318 - protein, 89 aa, Heterodera glycines
  Coding regions on vcDNA: vcDNA=SeqID_90741; Strand=-; Position=1-267
MNAFSLFVPFSNAHSVRLSFYSFSVSITTAAAHWSHRPHLTHLRHFSLKQFFCVRSAEKDKRKGQNEQNNEKKMKQMGRHCQINWNNRN

SEQ ID NO: 164319 - protein, 176 aa, Heterodera glycines
  Coding regions on vcDNA: vcDNA=SeqID_90742; Strand=+; Position=3-530
YCFEMIKFVLVCFSLYIFVALTFGHPSLGSRGSVQQQNGNGNSAQQQQAQFGQMSVSDNGTASPPPAGNGSYRAKRSPCCDFGSYPFMEPPSRYGGFRYPFMGPPPRRGGFRRGGRRRGPTGSTASPSSTNSAALADQFIVNNETETTPTPTEGTESSRSTDGTTATNTDGTTAAN

SEQ ID NO: 164320 - protein, 242 aa, Heterodera glycines
  misc_feature (178)..(178): Xaa can be any naturally occurring amino acid
  misc_feature (215)..(215): Xaa can be any naturally occurring amino acid
  misc_feature (226)..(226): Xaa can be any naturally occurring amino acid
  Homolog annotation: Hit_ID=NP_493387.1; Match level="QueryCoverage =100%, HitCoverage=93%, E-value=1e-101, Identity=76%"; Hit description=protein YR-29 (29.7 kD) (1O220) [Caenorhabditis elegans] emb|CAB04941.1| Hypothetical protein W09C5.1 [
  Gene Ontology: Cellular component=nucleus; Biological process=protein biosynthesis
  Coding regions on vcDNA: vcDNA=SeqID_90743; Strand=+; Position=26-753
MPQNEHIELHRKRHGRKLDHEERTRKKLARAVHDRSKVAKKLRKGKAKLYHKKRYAEKVQMRKLIKQHEEKKQKGTTDTQTEGAVPAYLLDRQKETAGKALSTAIKQKRKEKAAKYQVPLPKVRAVSDAEAFKVVNTGKTRRKGWKRMVTKVTFVGETFTRKPAKFERFIRPMGLRFXKAHVTHPELKTTLCLPLVGVKKNSSSQLYTLPRVITXGTIIRMNVVEXGMVTQGRQVVGQDTAQ

SEQ ID NO: 164321 - protein, 159 aa, Heterodera glycines
  misc_feature (138)..(138): Xaa can be any naturally occurring amino acid
  misc_feature (149)..(149): Xaa can be any naturally occurring amino acid
  Homolog annotation: Hit_ID=AAL78229.1; Match level="QueryCoverage =100%, HitCoverage=86%, E-value=8e-84, Identity=96%"; Hit description= SCN esophageal gland cell protein [Heterodera glycines]
  Coding regions on vcDNA: vcDNA=SeqID_90744; Strand=+; Position=25-503
MNPNGFFFVLAVLFLVKVDFLHGVYNEPMARQVLQKHASQFQQHCKNARRGSAVAKCCSAIRSIMGRFTSQKKAMNQMLAKCKAGTTPSEAQQMRRKLEGSNKLKDCGQFKSQIQHKFSELKQYCNNGAENEEENDEXSEREREEERVXEREEQQNSNH

SEQ ID NO: 164322 - protein, 138 aa, Heterodera glycines
  Coding regions on vcDNA: vcDNA=SeqID_90745; Strand=+; Position=26-442
MSHNQRGNANANMGPPQGVGSGSSAENSDSSADNQPSNEQWEAAFNSIGDFSHFVRQVFHSVVHGMAVNDSSIFPPNSAQARNGFTANSRVTGFTPSIVNPPLSHESDELFMNIGAVQGLIAMPMPPRENAPQNQHHP

SEQ ID NO: 164323 - protein, 182 aa, Heterodera glycines
  Homolog annotation: Hit_ID=NP_490864.1; Match level="QueryCoverage =99%, HitCoverage=32%, E-value=2e-18, Identity=26%"; Hit description =transposase (1C5) [Caenorhabditis elegans]
  Coding regions on vcDNA: vcDNA=SeqID_90746; Strand=+; Position=3-548
LWQLIQVEAVELDKFLDLLQRLNYAQHPEATAAILVIIRNMEPDPDPAVMRSLLRNLFLRQPDRDLFTVDALKLIVDYSDNIPPMSDCISKMVKHAIHNDEIIAPFGQTKLGKARPRVPVVENILDHLDRFRRHCIDRESKGVENLLNNALTLELFRSLKSHPKLADIRSRFTELFALFDIL

SEQ ID NO: 164324 - protein, 220 aa, Heterodera glycines
  Homolog annotation: Hit_ID=AAH60393.1; Match level="QueryCoverage =96%, HitCoverage=45%, E-value=5e-26, Identity=34%"; Hit description =MGC68481 protein [Xenopus laevis]
  Coding regions on vcDNA: vcDNA=SeqID_90747; Strand=+; Position=2-661
ITKKQLEEKAQRLEREMSEFVEVAERAGSRGDLDKSQKYVKRAEEVNAELENVRKLLDPEARQREVYQAGYKDPNAPKPMRVCEVCGSFLIIGDVQQRIDDHMQGRQHLGYAKITATLAELKLKLRDEVTPERTVSSRSPMSATSGGGQRRQRRSRSKSHERKANRKRSRSNNSRAEGGGRRRMKRSHSRHRDDANNNEKHSAHGDASDDHRRRRVRNSA

SEQ ID NO: 164325 - protein, 200 aa, Heterodera glycines
  misc_feature (71)..(71): Xaa can be any naturally occurring amino acid
  misc_feature (138)..(138): Xaa can be any naturally occurring amino acid
  Homolog annotation: Hit_ID=NP_955136.1; Match level="QueryCoverage =78%, HitCoverage=93%, E-value=2e-35, Identity=45%"; Hit description =CNPV113 thymidine kinase [Canarypox virus] gb|AAR83459.1| CNPV113 thymidine kinase [Canarypox virus]
  Coding regions on vcDNA: vcDNA=SeqID_90748; Strand=-; Position=139-838
GPMFSGKTTELFRLAQRYILAGRKVAVVKYALDTRYDESHACTHDKRKMEAISATKMEDAFEEIWHFHLCXFKDIVKYAQELANNGKTVIIAALNGDYRQEPFQNVAMLIPLAEKIEKLSAVCRCGQSASFTFRMSEXHELEMIGGQELYRALCRTCVVEYNHVKQQLLNGLKKNGNVSLAKKRKASDATAHPTLRIDTV

SEQ ID NO: 164326 - protein, 33 aa, Heterodera glycines
  Coding regions on vcDNA: vcDNA=SeqID_90749; Strand=+; Position=2-103
GPMEPIGTDRKEMPTSGRDQLHFNTLIILLITL

SEQ ID NO: 164327 - protein, 137 aa, Heterodera glycines
  Homolog annotation: Hit_ID=CAE60401.1; Match level="QueryCoverage =91%, HitCoverage=34%, E-value=6e-27, Identity=45%"; Hit description =Hypothetical protein CBG04003 [Caenorhabditis briggsae]
  Gene Ontology: Mol. function=translation factor activity, nucleic acid binding; Cellular component=eukaryotic translation initiation factor 3 complex; Biological process=positive regulation of growth rate
  Coding regions on vcDNA: vcDNA=SeqID_90750; Strand=+; Position=2-415
ERSMKALIGTVDELNKAVNAYGKYTVEKQKYDTMYNNLMQKRQTENEARQSRGEPPLTMEDIKRQLKQPQMQTKYGMLDLLLNALDTDAFTTYQIQTTNENVAKLHLSQAVSAQPVVAASSAAIGTSAANAPNLERK

SEQ ID NO: 164328 - protein, 208 aa, Heterodera glycines
  Homolog annotation: Hit_ID=NP_619610.1; Match level="QueryCoverage =100%, HitCoverage=50%, E-value=1e-107, Identity=89%"; Hit description=DEAD (Asp-Glu-Ala-Asp) box polypeptide 48 [Mus musculus] gb|AAH12862.1| DEAD (Asp-Glu-Ala-Asp) box poly
  Gene Ontology: Mol. function=helicase activity; Cellular component =eukaryotic translation initiation factor 4 complex; Biological process=nucleobase, nucleoside, nucleotide and nucleic acid metabolism
  Coding regions on vcDNA: vcDNA=SeqID_90751; Strand=+; Position=2-628
IYRYLPPNAQVVLLSATLPHDVLEMTSKFMTDPIRVLVKRDELTLEGIKQFFVAVEREEWKFDTLCDLYDTLTITQAVIFCNTRRKVDWLADKMREANFTVSSMHSDMEQKDRDAIMKSFRAGESRVLISTDVWARGLDVPQVSLVINYDLPNNRELYIHRIGRSGRYGRKGVAINFVKNDDIRILRDIEQYYSTQIDEMPMNVSELI

SEQ ID NO: 164329 - protein, 134 aa, Heterodera glycines
  misc_feature (28)..(28): Xaa can be any naturally occurring amino acid
  Homolog annotation: Hit_ID=NP_498534.1; Match level="QueryCoverage =97%, HitCoverage=33%, E-value=4e-18, Identity=38%"; Hit description =UBiquitin Activating enzme related, ectopic membrane RuFfLes in embryo RFL-1, CYtoKinesis defect CYK-5 (r
  Gene Ontology: Biological process=protein modification
  Coding regions on vcDNA: vcDNA=SeqID_90752; Strand=+; Position=2-407
PAVASTNAIIAGSCALEALKLASKYLFXVVALERDPECLVCGQKSVQMYSVREDCTLSGFLDDLKDKYQLQNPSIRAGSTFLYEINTLMPEMETASRKNLCKTLKELHVTEDSELLVADEALTRSIVFRIKYSK

SEQ ID NO: 164330 - protein, 172 aa, Heterodera glycines
  Coding regions on vcDNA: vcDNA=SeqID_90753; Strand=-; Position=1-516
FLILPFIKHSPLNVFLHRMNGLFEVAISDYYLFVFARLILTFIRLAFSAHLRPTGIRSFIISTFISFIAGVLFRNRCGPFAPSVNGVDLVRFFGVGENQFCAPNNSRGNECPFLPGKVRHFGKCRRLLCRTRETSGWPLSAKLGKKLGRKTEKSPTEMKMNSLRWKGFEFQW

SEQ ID NO: 164331 - protein, 110 aa, Heterodera glycines
  Coding regions on vcDNA: vcDNA=SeqID_90754; Strand=+; Position=2-334
YAMLENEIGVKMDELQGLIMALSYSHQIVNMAVSMPEPVYQADELAKRGKNNFAALKRFKPNQVPKKEHRLLAKKGAKRQTISLVDHHELNRILSYWGDGTFVLSNRFTA

SEQ ID NO: 164332 - protein, 129 aa, Heterodera glycines
  Homolog annotation: Hit_ID=CAE70001.1; Match level="QueryCoverage =92%, HitCoverage=19%, E-value=2e-33, Identity=52%"; Hit description =Hypothetical protein CBG16408 [Caenorhabditis briggsae]
  Gene Ontology: Mol. function=carnitine O-palmitoyltransferase activity; Cellular component=mitochondrial inner membrane; Biological process=acyl-CoA metabolism
  Coding regions on vcDNA: vcDNA=SeqID_90755; Strand=+; Position=3-392
GHKRYTGEVMNGMGMDRHLLGIRLLAAEHGVPLPELLGSDIYQRLLHFRLSTSQLPTSHVWPMGFGPSAPDCYGVCYNPQENHIFFIITAFNDCAETSAERFANALERALLDMRDLVDWAGRLKGRAKL

SEQ ID NO: 164333 - protein, 41 aa, Heterodera glycines
  Coding regions on vcDNA: vcDNA=SeqID_90756; Strand=+; Position=84-209
KDENGMSQTHPTLIDSQFDLNDLFIFYCFVVVKKKKKKTRD

SEQ ID NO: 164334 - protein, 24 aa, Heterodera glycines
  Coding regions on vcDNA: vcDNA=SeqID_90757; Strand=-; Position=2-73
FFLSTAVRQRSSKIYSMPQILWAG

SEQ ID NO: 164335 - protein, 71 aa, Heterodera glycines
  misc_feature (5)..(6): Xaa can be any naturally occurring amino acid
  Coding regions on vcDNA: vcDNA=SeqID_90758; Strand=+; Position=37-252
TTSEXXKNLKLDALFKVLAPPDEEFEEWLRDLKLLHTTRFCDCGNEMRYKWIKEDRIFFIICGPKSRNCTQ

SEQ ID NO: 164336 - protein, 146 aa, Heterodera glycines
  Coding regions on vcDNA: vcDNA=SeqID_90759; Strand=+; Position=17-457
MTEFLYIRMKANDCPLVALIRFGGCATSFTSESFARKANLLGNIDRSNCETIYVPIFGGAKVLGWANDVQIRIDELDYQFVYRLGVMEDKHLPMYCKKKFDMLIATDCCFKIGFTIDCGKKVVSRKGKVVKILTEEQIQSEMEDTY

SEQ ID NO: 164337 - protein, 274 aa, Heterodera glycines
  misc_feature (175)..(175): Xaa can be any naturally occurring amino acid
  misc_feature (185)..(185): Xaa can be any naturally occurring amino acid
  misc_feature (226)..(226): Xaa can be any naturally occurring amino acid
  Homolog annotation: Hit_ID=CAC33829.1; Match level="QueryCoverage =98%, HitCoverage=81%, E-value=1e-105, Identity=71%"; Hit description= annexin 2 [Globodera pallida]
  Gene Ontology: Mol. function=phospholipase inhibitor activity; Cellular component=plasma membrane; Biological process=skeletal development
  Coding regions on vcDNA: vcDNA=SeqID_90760; Strand=+; Position=348 -1221
MMSNATKNILGTPTIVDNVSFDPKVSANFLHKAIEEKRKDEIIHLLCTISNQQRQELAREFKQLFGEDLSPKLKKALSGDFEELILALLEPPAVYDAQQMHRAMSGLGTRESVLIEILATHSNRQIDEMKRVYEQLYGHPLEKDIFWDTSGAFQRLLTSLCNDSRDESWSSDPIXANMTAHDLFXESEEESGVNDFLFYQVLANENFIQLHLIFNEYHKVSCHPIXHAIQQQFDGYTKDGYLAAVECVLNRHSFFTKVLQNSTQSFLGIGRRDS

SEQ ID NO: 164338 - protein, 135 aa, Heterodera glycines
  Homolog annotation: Hit_ID=NP_491946.1; Match level="QueryCoverage =94%, HitCoverage=38%, E-value=9e-12, Identity=34%"; Hit description =putative nuclear protein, with 2 coiled coil domains (39.7 kD) (1H376) [Caenorhabditis elegans] gb|AAB524
  Coding regions on vcDNA: vcDNA=SeqID_90761; Strand=+; Position=1-405
VAPPQPVLHTENVSSFLDLQTEFIKRRDAAIAGKSQSFATEPTHRRTPRNNILAISKEEKKAKSEVSTLRVFLIRQNEEAIRKEEQQRAKQQQILQQKAAIYERMAKGERLVYDDGKEAEFLVDFHTKKKELEEE

SEQ ID NO: 164339 - protein, 48 aa, Heterodera glycines
  Coding regions on vcDNA: vcDNA=SeqID_90762; Strand=+; Position=2-145
LFVSYFSVFEFWCAVQQKSVRRFTKKCCSNETFARLSFPLRRFFGRWQ

SEQ ID NO: 164340 - protein, 54 aa, Heterodera glycines
  Coding regions on vcDNA: vcDNA=SeqID_90763; Strand=+; Position=1-165
GSIVTVHANYHCYFRIIIILIILSIIIVINYYYSFFASIPLILPSLFVTHQLIN

SEQ ID NO: 164341 - protein, 30 aa, Heterodera glycines
  Coding regions on vcDNA: vcDNA=SeqID_90764; Strand=-; Position=1-93
FPERTRSLKQQRHFGNGWPEKGSSKPQIKK

SEQ ID NO: 164342 - protein, 48 aa, Heterodera glycines; identical to SEQ ID NO: 137441
  Coding regions on vcDNA: vcDNA=SeqID_90765; Strand=-; Position=47-193

SEQ ID NO: 164343 - protein, 253 aa, Heterodera glycines
  Homolog annotation: Hit_ID=CAE72019.1; Match level="QueryCoverage =67%, HitCoverage=52%, E-value=5e-22, Identity=34%"; Hit description =Hypothetical protein CBG19101 [Caenorhabditis briggsae]
  Coding regions on vcDNA: vcDNA=SeqID_90766; Strand=+; Position=67-828
MAHMTKKASNFLIGDFNSVDFDNMADQLGNHGYVSPCNMLTALVYIMRLKESNERDFLAFNPTELFVSSLVLATKYLNDGTLQEFVWNDEWASVSGLALPKLNELEIRLLTSLRWDVSIQSEDFEKVLARLEGFVASEMAQQNGVMSYNELCILSNTHGFNRSILCLLTVLLKFLFVLLAFHLALLAGLSVLNMAVSRKQELAASDACIYHHGWDDCSHPPILLANERKIDANLTKVVHKDDFFAFVHAFSIS

SEQ ID NO: 164344 - protein, 169 aa, Heterodera glycines
  misc_feature (46)..(46): Xaa can be any naturally occurring amino acid
  misc_feature (147)..(147): Xaa can be any naturally occurring amino acid
  Homolog annotation: Hit_ID=NP_728531.1; Match level="QueryCoverage =97%, HitCoverage=12%, E-value=8e-53, Identity=58%"; Hit description =CG17090-PB, isoform B [Drosophila melanogaster] ref|NP_612038.2| CG17090-PA, isoform A [Drosophila melano
  Gene Ontology: Mol. function=ATP binding; Cellular component=nuclear speck; Biological process=protein amino acid phosphorylation
  Coding regions on vcDNA: vcDNA=SeqID_90767; Strand=+; Position=339-845
KAPISAPEIILGLPFREAIDMWTLGFVIAELFLGWPFYPGSYEYDXIRFIVQTQGLPPQQMLAEAAKTHRFFKMIKDMASYWRLKSIEYELEMSTKSKETRRYVFNCLDDIGQVHLPSDLDDIDRMCERNDRLEFVDILKQMLSMDXDRRLTPTRKLQHKFVKMTHMIE

SEQ ID NO: 164345 - protein, 132 aa, Heterodera glycines
  Coding regions on vcDNA: vcDNA=SeqID_90768; Strand=-; Position=23-421
QQPICSVSLNCECQVHPKKPRNNLCRRKTMRFRPNLAISIFYSLRIGFCETLNFSNPIPARSVPDHNLSFSFIKNLFYMLHRRHPSRPNCHHRSNDALPLDDLVPESFEHGLHRSLPSKTLSIQNGSEERQR

SEQ ID NO: 164346 - protein, 146 aa, Heterodera glycines
  Coding regions on vcDNA: vcDNA=SeqID_90769; Strand=+; Position=47-487
VTEMGSVGVIFVKNVAMVLMLLFGRTMMAPFAIAGIVSDNVEVGYYPSREKGKGIYEWIQVIKPLVQGRVMLTLTIANSVLFIATCILLIYLLVFAVLLSTSNHQLEELRGKINTVDYCSVLHPLSAALQNARESATTRRCDWQMS

SEQ ID NO: 164347 - protein, 179 aa, Heterodera glycines
  Homolog annotation: Hit_ID=NP_508412.1; Match level="QueryCoverage =92%, HitCoverage=35%, E-value=2e-54, Identity=61%"; Hit description =vacuolar atp synthase (54.2 kD) (XC857) [Caenorhabditis elegans] gb|AAA91266.1| Vacuolar h atpase protein
  Coding regions on vcDNA: vcDNA=SeqID_90770; Strand=+; Position=2-538
ATFAVDVEEIAAGHHVTPVDMTTATSKLQLEAAEVRNPANKPNWSSYLRSQLVPQNEYNFIIELEKAKNKQERDEALAKDKTNSARSIINLITEVAKDQLIRYVLTLFDDLLQEDKSRVEIFHDYARRQKRTIWSWFQGILTRNDSFIVNQMSAIFSKLPCYGSVLMDGQELQAYFNFL

SEQ ID NO: 164348 - protein, 132 aa, Heterodera glycines
  Coding regions on vcDNA: vcDNA=SeqID_90771; Strand=+; Position=96-494
TLSELFAVSQLLSVRNAFVGLRLCQIRGADQMAGEESVRHHPIRGRAAHAALSILESVDGTIRVQLHTERMRRTKAEDMSGLIDHLPINHSRIRIIIQYRKPTKHPVEDKTAKTIAIINPVEAKNWNLAACC

SEQ ID NO: 164349 - protein, 113 aa, Heterodera glycines
  Coding regions on vcDNA: vcDNA=SeqID_90772; Strand=-; Position=3-341
FFFFFFIFFFFFFLTINFITIASIIIYHCHYHLSPLISALVLTFFFFLYASSVTSSCCCCCCFGACGWSHAYGSSGFGALFTLCVSVSERFASTQRLVAMVNSVLQFLVAAVT

SEQ ID NO: 164350 - protein, 88 aa, Heterodera glycines
  Coding regions on vcDNA: vcDNA=SeqID_90773; Strand=-; Position=3-266
IKCIFALKFFLYISNLLPRHCWIMADTEANNRQNELEMSVNRWLGETLRIECTMCRTLSWWILANFGNSKKTRRVVIVLGFRSDGRER

SEQ ID NO: 164351 - protein, 110 aa, Heterodera glycines
  Coding regions on vcDNA: vcDNA=SeqID_90774; Strand=-; Position=2-331
QQLIRTFFASQIATIVGNFIFSPFFRFSVHMEKEVSAEGTAPQILIAQFAVAARWAVETPQIVHERMFSVHFIVIVERGDGKDWTSVGQIGAEFHGSAQHMDMEKRKKQK

SEQ ID NO: 164352 - protein, 68 aa, Heterodera glycines
  Homolog annotation: Hit_ID=NP_572998.1; Match level="QueryCoverage =100%, HitCoverage=76%, E-value=6e-13, Identity=52%"; Hit description= CG9065-PA [Drosophila melanogaster] gb|AAF48421.1| CG9065-PA [Drosophila melanogaster]
  Coding regions on vcDNA: vcDNA=SeqID_90775; Strand=+; Position=2-208
TGDAAISGSSAQQAKTGTESSTSKPKACCVCKETKGKRDECIILNGEENCGQLIEAHKKCMREYGFEV

SEQ ID NO: 164353 - protein, 98 aa, Heterodera glycines
  Coding regions on vcDNA: vcDNA=SeqID_90776; Strand=+; Position=21-317
MTDQQNSIDGGWTEQNVNDEKIKSLASRSVAKINSESNDRFSLFPLEVGRSNCSKNQPNLADHANCATEDDQTARKTFLATIWEKPWEQFEQITYKLE

SEQ ID NO: 164354 - protein, 115 aa, Heterodera glycines
  Coding regions on vcDNA: vcDNA=SeqID_90777; Strand=+; Position=1-348
SLSVSALHHSPPLPERNYRITSMDDVSGSPKFCYFYYYPFYRNRYPSYQYNRCRTYASPYDKHSSNWPEHHFNYPFSLSGYKPCSFYGSYTYAPYRPNKSPSGYYYGWYNGISGF

SEQ ID NO: 164355 - protein, 90 aa, Heterodera glycines
  Coding regions on vcDNA: vcDNA=SeqID_90778; Strand=-; Position=254-526
LISHINVFSFSSDAFIVIHSFSTCVKIVVDKPFSVRTALKSLDEKSVLCHCAVVVRKFISAIFDAQIAAKVNFVKSYMQFGRVCVKEFDP

SEQ ID NO: 164356 - protein, 112 aa, Heterodera glycines
  Coding regions on vcDNA: vcDNA=SeqID_90779; Strand=+; Position=33-371
MADTEANNRQNELEMSVNRWLGETLRIELTDGRVIYGQLVCTDNVPNIILVDSREFWKFKEDEAGGDRTRIPIRRTGTVLIKGEYIKRIFQIVLPEEEMNSIRRKEEETTEM

SEQ ID NO: 164357 - protein, 134 aa, Heterodera glycines
  Coding regions on vcDNA: vcDNA=SeqID_90780; Strand=+; Position=9-413
QLSVSLLSFCSMSSSRFFVLLPLLFFLLLSFECVLLAPNLFSSKIVAFGESGDAFDSPSFADGTSTERFSATESDGRAMAKRNSRMVNALSTILNKRKELGTNDAFRVRIRSLDQMGNTNCYFSPVQCYFFEER

SEQ ID NO: 164358 - protein, 113 aa, Heterodera glycines
  Coding regions on vcDNA: vcDNA=SeqID_90781; Strand=-; Position=54-395
LTNHHGLLSLSFFCVVRTFIASDVATCTKLVRIHIAPSRVQTLSSYLRVWLRMEFWHNLAICRQCLALRQPSVVVLSAIRSARQVTPCSGPGLTMAQWPHHQNLKRRGSNSRR

SEQ ID NO: 164359 - protein, 153 aa, Heterodera glycines
  Coding regions on vcDNA: vcDNA=SeqID_90782; Strand=+; Position=48-509
LLQSFTHIFLMSFPCGDGWRQQIHPEEQLPQYEQKCDIEMQLDTLKQTVKANTKACAESAQRIEDLQSFRFYYITLAFFAFFILTMSAMFLYTRISLLSDRIYTQIGNVDNRIRDHLDTKSERLYAKIDALSAQVQRLGLAMATLPNGSHTTT

SEQ ID NO: 164360 - protein, 147 aa, Heterodera glycines
  Homolog annotation: Hit_ID=AAN05585.1; Match level="QueryCoverage =97%, HitCoverage=94%, E-value=6e-64, Identity=77%"; Hit description =ribosomal protein L22 [Argopecten irradians]
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_90783; Strand=+; Position=54-497
MATAKKKTRKLRGHVSHGHGRVGKHRKHPGGRGNAGGQHHHRINFDKYHPGYFGKVGMRNFHVRKNHYYSPSINLDKLWTLCTERTRKQYAEVKDKAPVIDVVRAGYHKVLGKGLLPKQPLIVKAKCFSHSAEEKIRKVGGACVLVT

SEQ ID NO: 164361 - protein, 38 aa, Heterodera glycines
  Coding regions on vcDNA: vcDNA=SeqID_90784; Strand=+; Position=1-114
TDEKYMARKNSQIVQAGSRRRSAERPVTSLHEASHVIA

SEQ ID NO: 164362 - protein, 149 aa, Heterodera glycines
  Coding regions on vcDNA: vcDNA=SeqID_90785; Strand=+; Position=40-489
MFCRCFPHSFLLLLPVLLALLSLFKCISASNHQPQAENVLLEELIQEIRKLNDRMEPALGREGNAEEEQMLEIKRSQGMVPSELWNRAGDKRAQLPFSGGIYGKRSPLPFSGGIYGKRSARNLHSSSLIIPTLNRQARAMPVNDGMYGK

SEQ ID NO: 164363 - protein, 143 aa, Heterodera glycines
  Coding regions on vcDNA: vcDNA=SeqID_90786; Strand=+; Position=33-464
SATGPGILGKTRTFSGSKIKMKQQQQHSPPENSSDSDSPPDPFKINQGSLTLAQLVEFLEVEHAETVELMQAVWRRRRLYKMPVRPPNPNNQNDDRFFGYGDHLAEDVFYNLVEKTRNSIHGIIQLKVLHVGAWKSVDVEYHF

SEQ ID NO: 164364 - protein, 91 aa, Heterodera glycines
  Coding regions on vcDNA: vcDNA=SeqID_90787; Strand=+; Position=2-277
NASFLLLVNILLCSIVLLHLLSNENGLVNAMPALNGGDELLLRKKRQDEGDEAEENAGGENAENGNEENNGEGQNEENNNGEEKKKKKTRD

SEQ ID NO: 164365 - protein, 100 aa, Heterodera glycines
  Coding regions on vcDNA: vcDNA=SeqID_90788; Strand=+; Position=1-303
KGQNGGAAELLAVLFVARLFPRRFLRPLQIGLNVPMVFTFGRPSEQPKPKGTLLLLQSVHKTARAQLLPLLYQPLKKREKQRKGKAKERRNAKNSDDCAA

SEQ ID NO: 164366 - protein, 77 aa, Heterodera glycines
  Coding regions on vcDNA: vcDNA=SeqID_90789; Strand=-; Position=3-233
NCSIFFSFQQMQLCCPYFSQQAKRPAQFVAPAANKHSSNPSARFATIFANSCSCIGVPTTSAKPKKAKRIKNDKISN

SEQ ID NO: 164367 - protein, 92 aa, Heterodera glycines
  Coding regions on vcDNA: vcDNA=SeqID_90790; Strand=+; Position=20-298
FLMTNSMPKILFTIIAFVNISQILFATAMYKGKEICGKTVEECQAALIAFMKDSGSNQNYHASENGPIQLANDKWCIWVQSYVTSGAPRSKW

SEQ ID NO: 164368 - protein, 126 aa, Heterodera glycines
  Homolog annotation: Hit_ID=AAO92289.1; Match level="QueryCoverage =100%, HitCoverage=100%, E-value=1e-67, Identity=99%"; Hit description=FMRFamide-related peptide precursor [Heterodera glycines]
  Coding regions on vcDNA: vcDNA=SeqID_90791; Strand=+; Position=16-396
MEMRCVPSRRPFRLIAPLFNAIPTFYLILTLIFCILSPWADSADADEWYGARQLRAPKPKFIRFGRSGQKMIPFSRSFSTETQYGDEGINQLDALVDAVDKLYQSSPEIRAFKTAPKRAQKFIRFG

SEQ ID NO: 164369 - protein, 120 aa, Heterodera glycines
  Coding regions on vcDNA: vcDNA=SeqID_90792; Strand=+; Position=1-363
MNTTSLIRLLFAVFCVFLANFPQSAQAETKKVYFVYGTQVTVTAVHNGRGINLGATTGEGVESKQYLEIDTNVWNGMNDNDQIVFHVRTPHSVTSYDKTTVGKLRNTSELDFADQTIRAV

SEQ ID NO: 164370 - protein, 103 aa, Heterodera glycines
  Coding regions on vcDNA: vcDNA=SeqID_90793; Strand=+; Position=10-321
MQVSQMRTMSLSVASLVALLVLLAISSHPTFASPISSRDLNDAAEAGPLQAVEKRRNAEFINGLLTMERLNAMGKRSPVPASSDDGVVPMTLWRSQHPFFWTE

SEQ ID NO: 164371 - protein, 124 aa, Heterodera glycines
  Coding regions on vcDNA: vcDNA=SeqID_90794; Strand=+; Position=29-403
MSSNGIITIVALFLVLFGTHITTQIGAMNRHRQQRSLGHPFTVDKQQHTAQNENLVGAYLSRGMFSCGAKYVGTLQRLKRIIEEVHADYSECQKSMKQMDENEQMAFGKGHGTERFAMIDELIN

SEQ ID NO: 164372 - protein, 113 aa, Heterodera glycines
  Homolog annotation: Hit_ID=CAI17295.1; Match level="QueryCoverage =85%, HitCoverage=46%, E-value=2e-15, Identity=45%"; Hit description =phospholysine phosphohistidine inorganic pyrophosphate phosphatase [Homo sapiens] emb|CAH70377.1| phosphol
  Coding regions on vcDNA: vcDNA=SeqID_90795; Strand=+; Position=15-356
MKFVLSDKIRSQRIRGFLVDINGVLFDTSLDGGKAIPGSIEAVKRLYELSCVRFVSNESSGTRGAICQKLHRLGFVGPQPEHIFTPAPVAVKYLRQHGLRPKLIVHKGLKVGL

SEQ ID NO: 164373 - protein, 176 aa, Heterodera glycines
  Homolog annotation: Hit_ID=CAC83611.1; Match level="QueryCoverage =76%, HitCoverage=49%, E-value=4e-61, Identity=80%"; Hit description =EXPB1 protein [Globodera rostochiensis]
  Coding regions on vcDNA: vcDNA=SeqID_90796; Strand=+; Position=59-586
MAKSSGKQSKASNSKSKPKPNQSKSNKPPSSPSSSSSSCMGCLSNTKTAGPIDSYLGKPVKNSIFTFYGAGGRGACGLNAGVPKMSAAGSGQLFKSDGQWKDACRADKQYMLDDPICKNICIKVDYNGKTLTVPINNKCPECPPNHVDLSIDAFNSLEPRRGLVGIANGATLTYMR

SEQ ID NO: 164374 - protein, 128 aa, Heterodera glycines
  Homolog annotation: Hit_ID=EAL40023.1; Match level="QueryCoverage =92%, HitCoverage=34%, E-value=4e-18, Identity=43%"; Hit description =ENSANGP00000028924 [Anopheles gambiae str. PEST]
  Coding regions on vcDNA: vcDNA=SeqID_90797; Strand=+; Position=131-517
GWRTHQEDAHNCILSFGDECSFFAVYDGHGGSDVSSYLKKNFPDFLKEHNLLLHTTDEGLSAALHKLFVKFDETLRHDDTVKAMVELKTALSTTSDQQQQAEEQKANEGCDPGEKERKERESLIDAKK

SEQ ID NO: 164375 - protein, 83 aa, Heterodera glycines
  Coding regions on vcDNA: vcDNA=SeqID_90798; Strand=-; Position=2-250
TWKVIRSLPFIPVHFSVSISKYCFQFNTFSRGFSKINFASVIYSFNCDPSTINEIHFLFCCLRTLGKIGQKNAENREQKTNKG

SEQ ID NO: 164376 - protein, 106 aa, Heterodera glycines; identical to SEQ ID NO: 138111
  Coding regions on vcDNA: vcDNA=SeqID_90799; Strand=+; Position=5-325

SEQ ID NO: 164377 - protein, 110 aa, Heterodera glycines
  Coding regions on vcDNA: vcDNA=SeqID_90800; Strand=-; Position=1-330
RFFAPTTLLILAILCLDEVPPFNSKKMVAKMTRKTHLERILALIMTGEGALFLRYKIWKIGPKCRLTNSQKLKIFVENHQIILFHWFICSRYRASNSLSKFLRVLNFRVF

SEQ ID NO: 164378 - protein, 230 aa, Heterodera glycines
  Coding regions on vcDNA: vcDNA=SeqID_90801; Strand=+; Position=23-715
MAQIHFKIFLIFSLITFSQCRINSEPSEKEGPSSIGGIQNATSDHRSAAAAASDYHASSCDGFGWTLNKGKCYKVIEGLMDWNHMIAACKSEGAILVCIQSEDENHFVGKMIAKPIERSLGNYRLETTLFNTFWIGLNRVKNGEKYDSTWVNGKKAMFGNLPEITTELSTANGKNKYPWGEGEPSGTNKFTDPTGVKEECVHMFSADGSWNDAECRVQMSGGVCQKMPKY

SEQ ID NO: 164379 - protein, 199 aa, Heterodera glycines
  Homolog annotation: Hit_ID=NP_502672.1; Match level="QueryCoverage =93%, HitCoverage=91%, E-value=2e-28, Identity=35%"; Hit description =putative protein, with 2 coiled coil-4 domains, of bilaterial origin (24.4 kD) (4O649) [Caenorhabditis el
  Coding regions on vcDNA: vcDNA=SeqID_90802; Strand=+; Position=1-600
IIRKLVADGDGTGDDRRIVQLFQLIIMLSKSNADTKSITNKILINLDQIELSFQKQAQISAITEIEIANYEQLCTEIDEMITQNNNKMDAVKRELAEAKQIRKNRQEYDALAKLIKEKPSRVETSKRLKLLQDELEEAYAKQKMLEQRLIEKRKNMYTLAVLLDNLEEMNKESEDVPMSEGDDASPAGAVPSSSAGSLK

SEQ ID NO: 164380 - protein, 86 aa, Heterodera glycines
  Coding regions on vcDNA: vcDNA=SeqID_90803; Strand=+; Position=476-733
MRILPPYFSDHFMLFIHQPQNTTTNRQHIFHIWITKKKPDDDFDQPHQFFNCFFLQFLNLFKQFACFFAPPSSPPPPTHLFGLYAF

SEQ ID NO: 164381 - protein, 42 aa, Heterodera glycines
  Coding regions on vcDNA: vcDNA=SeqID_90804; Strand=+; Position=2-130
LIITVKKKYFGENIFKLSSYSLKQSFFSMALSPAGLHLSKSM

SEQ ID NO: 164382 - protein, 105 aa, Heterodera glycines
  Coding regions on vcDNA: vcDNA=SeqID_90805; Strand=+; Position=4-321
KLVDKGEGYTGYQELKDGVYHGYQPLKPRKTPKFTAEFGLSSGMLNIAVARDIDSIPKGDNQDGSQYQYLSAHNVARGQYIPPTNPNLPNLDIPVQQQQQEVAEE

SEQ ID NO: 164383 - protein, 211 aa, Heterodera glycines
  misc_feature (186)..(187): Xaa can be any naturally occurring amino acid
  misc_feature (190)..(190): Xaa can be any naturally occurring amino acid
  Homolog annotation: Hit_ID=CAE62532.1; Match level="QueryCoverage =93%, HitCoverage=77%, E-value=2e-18, Identity=30%"; Hit description =Hypothetical protein CBG06641 [Caenorhabditis briggsae]
  Coding regions on vcDNA: vcDNA=SeqID_90806; Strand=+; Position=1-633
SNEQYSAGTLWPFFFTVDGDEKRAVREAFNVIDRFISVEECSTDKFDDECAKKEGALTDGQKDVSDSLASECQQIRQNKRQFASNAVRQYMTGARCSLFFASPMIRPYNVYKIAEQMVDQSQKESLTRFLARVIPVEETCHANLDEIKTLLSEMVVKHLKGEKKDTPPTYAVEFKASNTKLLSRQXXYDXVAQLMNELSPESAVNLTQPDL

SEQ ID NO: 164384 - protein, 150 aa, Heterodera glycines
  Coding regions on vcDNA: vcDNA=SeqID_90807; Strand=+; Position=59-511
MDGRQKKLKTVDFEILTREQLCVLCQAVLNKWKGQANKNEQHFREEILDSCSLIENPSEAKKCRDGVTDAKVARLRKEGTEEMCVAEGFCGKGEMKELEKKMERMEKRIDDRKQKFEKGLRIIPPVDLSPVKSVPGDKATNTTNQTMGGG

SEQ ID NO: 164385 - protein, 68 aa, Heterodera glycines
  Coding regions on vcDNA: vcDNA=SeqID_90808; Strand=+; Position=1-207
LKNAPFFARRLCAPLSHQSVHFDGRRAKVSFVGLGEAGHTVSKRLRDINISKDQMLDVRKDVGEPVTD

SEQ ID NO: 164386 - protein, 145 aa, Heterodera glycines
  Homolog annotation: Hit_ID=NP_499861.1; Match level="QueryCoverage =57%, HitCoverage=14%, E-value=1e-38, Identity=86%"; Hit description =tetradecanoyl Phorbol Acetate resistant TPA-1, TPA-1 (64.9 kD) (tpa -1) [Caenorhabditis elegans] gb|AAC269
  Gene Ontology: Mol. function=ATP binding; Cellular component =intracellular; Biological process=signal transduction
  Coding regions on vcDNA: vcDNA=SeqID_90809; Strand=+; Position=286-720
MESYKAAPLYSVKFGAEKAQSLGKFIRIFVLSNANGVSGRMLQKTKEMATERERKKQLTNANDLKLDNILLDSDGHIHLADFGMCKTDSNRENGMASTFCGTPDYIAPEIIKGQLYNQAVDFWSLGVLMYEMLIGQSPFHGDGED

SEQ ID NO: 164387 - protein, 59 aa, Heterodera glycines
  Homolog annotation: Hit_ID=NP_508656.1; Match level="QueryCoverage =98%, HitCoverage=96%, E-value=2e-17, Identity=68%"; Hit description =putative endoplasmic reticulum protein, with a transmembrane domain (XE407) [Caenorhabditis elegans] gb|A
  Coding regions on vcDNA: vcDNA=SeqID_90810; Strand=+; Position=1-180
MAVDAQQIIELILCLILPPLAIFIHANSDCNVHVLISIVLRFLLFFPAVLHALWYCFFA

SEQ ID NO: 164388 - protein, 72 aa, Heterodera glycines
  Coding regions on vcDNA: vcDNA=SeqID_90811; Strand=-; Position=112-330
FIPKKTMHSSIFHTFDSVLIILSFSIFHQLSLDYSFFCAGHQSPRLGDGRVFIGLEFLLRFWFFRDCRISGP

SEQ ID NO: 164389 - protein, 277 aa, Heterodera glycines
  Homolog annotation: Hit_ID=XP_395784.1; Match level="QueryCoverage =77%, HitCoverage=56%, E-value=4e-69, Identity=59%"; Hit description =similar to SD03319p [Apis mellifera]
  Gene Ontology: Mol. function=receptor binding; Cellular component =cytoskeleton; Biological process=proteolysis and peptidolysis
  Coding regions on vcDNA: vcDNA=SeqID_90812; Strand=+; Position=8-838
RWKIHTILHFVPHQYAWVVERAGKFHRILEPGVHIVYPLIDEIRYRHCLKEMCIEIPQQEAITKDNVQLDLDAILYVQVVDPYKASYGVQEPEYAISQLAQTVMRAEVGKLMLDNVFHERANLNRAIVGGIKESCAPWGLICLRYEIRTMNMPPEIQRAMKMQVEAERKKRAAILESEGICEAEKNRAEGEKQARILRSEAQMQEQMNKSMGLAKAAEAEKIQRILQSEAEMQMKVNMAIGLAKSAESEKESRVILAEAEEQEQVIVSRGLACAIET

SEQ ID NO: 164390 - protein, 27 aa, Heterodera glycines
  Coding regions on vcDNA: vcDNA=SeqID_90813; Strand=-; Position=1-81
ERTSLEFFFFFFLILALIPFLWWARQQ

SEQ ID NO: 164391 - protein, 54 aa, Heterodera glycines
  Coding regions on vcDNA: vcDNA=SeqID_90814; Strand=+; Position=21-185
MSLWRSIGLTYTRYSQVAAASLRECVKKGTSGEAKTAEPIKITSWEGGKAKKPE

SEQ ID NO: 164392 - protein, 110 aa, Heterodera glycines
  Homolog annotation: Hit_ID=EAA58315.1; Match level="QueryCoverage =86%, HitCoverage=53%, E-value=8e-13, Identity=41%"; Hit description =hypothetical protein AN5806.2 [Aspergillus nidulans FGSC A4] ref|XP _409943.1| hypothetical protein AN5806.
  Coding regions on vcDNA: vcDNA=SeqID_90815; Strand=+; Position=2-334
GSKKSSNKESKKSANISPDSSEDDLEKDELLEKNADKRERDHQGNEIVPIGGNRFISMDRFKGRILIGIREYYQKDGKWLPGKKGISLNHDQFNGLLKILPDVKKMISSA

SEQ ID NO: 164393 - protein, 121 aa, Heterodera glycines
  Homolog annotation: Hit_ID=NP_495281.1; Match level="QueryCoverage =86%, HitCoverage=94%, E-value=8e-40, Identity=68%"; Hit description =putative protein of eukaryotic origin (2G650) [Caenorhabditis elegans] gb|AAA68261.1| Hypothetical protei
  Coding regions on vcDNA: vcDNA=SeqID_90816; Strand=+; Position=2-367
TFLTNQNRSHPWFNLIKMNGEVRRPNKIVRYKPIDPMVQPVTAEDSIPEYMNVLGMVFSMMGLMMRLKWCSWVALICSCVSFANMRASDDTKQVVSSFMLSISAVVMSYLHNPTPIVPPWA

SEQ ID NO: 164394 - protein, 156 aa, Heterodera glycines
  Homolog annotation: Hit_ID=NP_502658.1; Match level="QueryCoverage =88%, HitCoverage=90%, E-value=2e-58, Identity=79%"; Hit description =IscU (16.5 kD) (4O549) [Caenorhabditis elegans] emb|CAA16379.1| Hypothetical protein Y45F10D.4 [Caenorhab
  Gene Ontology: Cellular component=mitochondrion; Biological process =iron ion homeostasis
  Coding regions on vcDNA: vcDNA=SeqID_90817; Strand=+; Position=2-472
SFSLTRLFPTLVFHRHGNIQLLQIAAYHEKVIDHYENPRNVGSLDKNDPSVGTGIVGAPACRDVMKLQIMVDGNGQIIDAKFKTFGCGSAIASSSLATEWIKGQNLEYARKIKNQQIAKELSLPPVKLHCSMLAQDAIQAALSDYQKKQEARNEKT

SEQ ID NO: 164395 - protein, 79 aa, Heterodera glycines
  Homolog annotation: Hit_ID=CAE65930.1; Match level="QueryCoverage =98%, HitCoverage=92%, E-value=3e-34, Identity=82%"; Hit description =Hypothetical protein CBG11103 [Caenorhabditis briggsae]
  Gene Ontology: Biological process=cell growth
  Coding regions on vcDNA: vcDNA=SeqID_90818; Strand=+; Position=3-242
KSKRKAPTKAKSIVALETQFNCPFCNHENVCEVKMDRERNVGFIQCRVCMEDFQSNITALSEPIDVYSDWIDACEAANQ

SEQ ID NO: 164396 - protein, 90 aa, Heterodera glycines
  Coding regions on vcDNA: vcDNA=SeqID_90819; Strand=-; Position=146-418
FFFLRQQFLSANKCNINGITSQQILHSENVKISSWSVEVFRFLCLLLLLLFSSYSGATVKRNFICGLFTWYTPFSETASAGLPFTVASYL

SEQ ID NO: 164397 - protein, 92 aa, Heterodera glycines
  Homolog annotation: Hit_ID=CAE65180.1; Match level="QueryCoverage =89%, HitCoverage=82%, E-value=6e-11, Identity=42%"; Hit description =Hypothetical protein CBG10053 [Caenorhabditis briggsae]
  Coding regions on vcDNA: vcDNA=SeqID_90820; Strand=+; Position=35-313
MFGRQFHIVMADNSVAVLKYKRVPNRRILDFYHTEVPPDFRGQGFAEQLVRAGFRHCLDTRFSVYPSCTYVQKYIRDLATEEEKKIVVEKYH

SEQ ID NO: 164398 - protein, 252 aa, Heterodera glycines
  Homolog annotation: Hit_ID=XP_314537.1; Match level="QueryCoverage =80%, HitCoverage=77%, E-value=7e-39, Identity=39%"; Hit description =ENSANGP00000016990 [Anopheles gambiae]
  Coding regions on vcDNA: vcDNA=SeqID_90821; Strand=+; Position=57-812
MPSSSGSEKGNGRNGVRGEEEVKGGKEIASKTLNIQSKRFYLDVKQNDRGRFVKLAEVAMNGRKNRLFMSMRICKNIKELLGKFEGHVPASEEVNGKAENVTIQSESIVTERRRYYIDLRENRRGSFLRITQLETHSGIRNSVALPFEGIGQLHDALDSILEEYGEGFIEEEAELPHSQMIRTDGKSFFFDPGHNSRGDFLKITELKSFMGVRNSGVLSIRAIPQFTQVLSKLYDDFQELRAVEEVNVNNVL

SEQ ID NO: 164399 - protein, 201 aa, Heterodera glycines
  Homolog annotation: Hit_ID=CAE69354.1; Match level="QueryCoverage =100%, HitCoverage=100%, E-value=3e-57, Identity=55%"; Hit description=Hypothetical protein CBG15443 [Caenorhabditis briggsae]
  Coding regions on vcDNA: vcDNA=SeqID_90822; Strand=+; Position=20-622
MPPPSIHGQPKIRHDEQSNSVFLEVSVQGADAPKTKWYLEEKEIASGTGAYRMSTAEQEGGRKLLICEIKNYDKALQGNYKAVFISADGKENYATFTVKSGSAPEFYEKPKIVQKDNGKIIQIKVRVKSHIEMTSEWFKDDKPLKGSDRLKISSQKDEKDPQGMVLLLDIHEPQKEDQAKYKCVVKNAEGRNEQSLNLQFE

SEQ ID NO: 164400 - protein, 107 aa, Heterodera glycines
  Coding regions on vcDNA: vcDNA=SeqID_90823; Strand=-; Position=87-410
SQKSADKQLTRRKRNNNNNKQMGSISIHHSFVRLQFSWLHHFDLWGPTCYIALHPNTPLIINLSWTVFARVIVLVISASVHKSNQCRLTIFLGFTANIFAIIHSSSE

SEQ ID NO: 164401 - protein, 177 aa, Heterodera glycines
  Coding regions on vcDNA: vcDNA=SeqID_90824; Strand=+; Position=1-531
NESLKNVCCTFRRCSPSPLRFGISSQRRRCFCLLRATLLFAEQRIRRHFWKKNRCAIIANGCQRMGGTAKNGNGKRGRGRDGGGTAAGGSRSDGGEWGGKSEGRADGEGKSNESTNDSPPYTSPFIRRLWKWPNGATIQTNEAVLLLSNPMSDEAIFGLTRPNNAKQRDHSQNTQFL

SEQ ID NO: 164402 - protein, 179 aa, Heterodera glycines
  Homolog annotation: Hit_ID=NP_497949.1; Match level="QueryCoverage =100%, HitCoverage=50%, E-value=3e-60, Identity=59%"; Hit description= protein phosphatase 2C, possibly N-myristoylated (39.1 kD) (3F743) [Caenorhabditis elegans] emb|CAA86456
  Gene Ontology: Mol. function=protein phosphatase type 2C activity; Biological process=cell cycle
  Coding regions on vcDNA: vcDNA=SeqID_90825; Strand=+; Position=37-573
MGQALSEPITTKNSASCSNDRYFVGSSSMQGWRISMEDAHTHLLELPEDPSTAFFAVFDGHGGAQIAKYASENLHTQIAQSNTFREGRISDALVEAFLELDEQMMASEQIREEMSGSTAVAVLIKDNFIYCANAGDSRAVASVDGRAIPLSIDHKPNNEEESRKIFAAGGYVEFGCDNG

SEQ ID NO: 164403 - protein, 85 aa, Heterodera glycines
  Coding regions on vcDNA: vcDNA=SeqID_90826; Strand=+; Position=3-260
LLSFRRKMSFYTVHRDQLPLRALFNQHGLSFQQRWHSPHYKYSEVLGGTYHIPHSRYPPHDVYKTPWLCHLHPTHLTPGEPDWWY

SEQ ID NO: 164404 - protein, 111 aa, Heterodera glycines
  Homolog annotation: Hit_ID=NP_492382.2; Match level="QueryCoverage =99%, HitCoverage=95%, E-value=2e-29, Identity=54%"; Hit description =Janus/Ocnus (13.2 kD) (1J389) [Caenorhabditis elegans] emb|CAB03070.2| Hypothetical protein F36A2.8 [Caen
  Gene Ontology: Mol. function=phosphohistidine phosphatase activity; Cellular component=cytosol; Biological process=dephosphorylation
  Coding regions on vcDNA: vcDNA=SeqID_90827; Strand=+; Position=1-336
KLSPVNIDSKGVFKYILIKASDGATERFLVRGYGRCKFHADILEEVQASEGEKAIEFSCVGGGRIKHEPEAKRIFVYGYSQGFGRADHAKSVEILRERYPNYTIEWSNEGY

SEQ ID NO: 164405 - protein, 105 aa, Heterodera glycines
  Coding regions on vcDNA: vcDNA=SeqID_90828; Strand=-; Position=46-363
AHLSLTYFMKRVKTFIRHKSKLHQNLVILLAQFDGWFWADFAFLPLAMCPLFVEAGPGIGQSSPGPTKSIERLREKRANRFILRNNAEQPTSKKRGDKRKAFKAK

SEQ ID NO: 164406 - protein, 77 aa, Heterodera glycines
  Coding regions on vcDNA: vcDNA=SeqID_90829; Strand=+; Position=2-235
RKKFFAFTIFLFIVLQLTDAKMSKNDYENTCGNTCGRFAKKGDCAGKSPINTCVTEGDCYCKWEGCRADYEEYVSNP

SEQ ID NO: 164407 - protein, 233 aa, Heterodera glycines
  Homolog annotation: Hit_ID=NP_504653.2; Match level="QueryCoverage =94%, HitCoverage=96%, E-value=1e-46, Identity=42%"; Hit description =ubiquitin -terminal (25.3 kD) (5G986) [Caenorhabditis elegans] gb|AAM43789.1| Ubiquitin c-terminal hydrol
  Gene Ontology: Mol. function=peptidase activity; Cellular component =nucleus; Biological process=protein deubiquitination
  Coding regions on vcDNA: vcDNA=SeqID_90830; Strand=+; Position=3-704
ILAGEEKRITWVPLESNPEAFNKYIEKMGVKGVECHELFGFEPDLVSFVPGPHLALIFCYPYQDKANDYQKGIYGQLTASDKGGVPEWAFFMKQKIHNACGTFALFHALTNNTDRIDIGNGVFYDWFKAAKQLNVEQRSDLLANDSELAHLHEHCALRESETDVPRNVAHHFISYFTHGGRLFEFDSGQEFPRDCGPSSEETLLTDAGKICKELMGQLEDISCNAIALCAKNN

SEQ ID NO: 164408 - protein, 128 aa, Heterodera glycines
  Coding regions on vcDNA: vcDNA=SeqID_90831; Strand=+; Position=27-413
LAMDVLKISWSKRNPANCIPSHFPWILMGRHWSPNSSRLRMALMGSKQHCSEDICFWAKRSERRRVLRFMQSKRVNIHNQKKGEMSTYNVVDSVPSMDVWEYDEPPESRKKCLQNALVALQVANDLAS

SEQ ID NO: 164409 - protein, 149 aa, Heterodera glycines
  misc_feature (23)..(23): Xaa can be any naturally occurring amino acid
  misc_feature (65)..(65): Xaa can be any naturally occurring amino acid
  Homolog annotation: Hit_ID=CAE66848.1; Match level="QueryCoverage =87%, HitCoverage=67%, E-value=2e-21, Identity=42%"; Hit description =Hypothetical protein CBG12220 [Caenorhabditis briggsae]
  Coding regions on vcDNA: vcDNA=SeqID_90832; Strand=+; Position=3-453
NFASKRDQCGMRNYIEHSLTKIXTENPYCAHYVVPGRNATPVLRAEYSNGRLVHVNAKAFSTERXCLHMNNLRTRSGIPIYKFENSHFSHNKSVQGMWTPSKWRDTRQNLHILPKPEFSPLLTSATSATKFLWENSVPPTAEEVKDETK

SEQ ID NO: 164410 - protein, 212 aa, Heterodera glycines
  Homolog annotation: Hit_ID=NP_498282.1; Match level="QueryCoverage =100%, HitCoverage=100%, E-value=2e-80, Identity=67%"; Hit description=kdel receptor (24.7 kD) (3G997) [Caenorhabditis elegans] gb|AAA62292.1| Hypothetical protein C28H8.4 [C
  Gene Ontology: Mol. function=KDEL sequence binding; Cellular component=integral to membrane; Biological process=intracellular protein transport
  Coding regions on vcDNA: vcDNA=SeqID_90833; Strand=+; Position=3-638
MNAFRLIADLSHLFAILILLWKIWKTRSCAGLSGKSQVLFALVFTCRYLDILHFISIYNTLMKVLFIGSLFATCYFMFVKFRATYNKDEDTFRVELLVLPCIVLALFVNADFTALEVLWTFSIYLEAVAILPQLFMLQKRGEAETITAHYLFLLDIYRALYIFNWVYRYYTEAFYDPIVIVSGIDQTVLYADLFYLYVTRVVKDGAKLELPI

SEQ ID NO: 164411 - protein, 226 aa, Heterodera glycines
  misc_feature (25)..(25): Xaa can be any naturally occurring amino acid
  misc_feature (163)..(163): Xaa can be any naturally occurring amino acid
  Homolog annotation: Hit_ID=NP_491464.1; Match level="QueryCoverage =87%, HitCoverage=57%, E-value=3e-57, Identity=55%"; Hit description =carbohydrate kinase, PfkB (1F417) [Caenorhabditis elegans] gb|AAK73885.1| Hypothetical protein F57C9.1b [
  Gene Ontology: Mol. function=pyridoxal kinase activity; Biological process=coenzymes and prosthetic group metabolism
  Coding regions on vcDNA: vcDNA=SeqID_90834; Strand=+; Position=1-721
MPLEDYWSKERSGKRVLSIQSHVVXALSGNKCAVFPLQLHGFEVDAINSVQFSNHTQYPNVKGQRLNERDLAELFDGIRNADLPAKYSHILTGYCGDASFLRQIASIVRECRQHNPKLTYVCDPVMGDNGKYYNGIPRELCSIYRDELLPLSDVITPNAFELXDIAIANERDCLRAMEHFHRVKRIRIVVVTSGVPDETTKNKSMMHCYASEAIPSAVDTIRVRYF

SEQ ID NO: 164412 - protein, 74 aa, Heterodera glycines; identical to SEQ ID NO: 127829
  Coding regions on vcDNA: vcDNA=SeqID_90835; Strand=-; Position=2-223

SEQ ID NO: 164413 - protein, 38 aa, Heterodera glycines
  Coding regions on vcDNA: vcDNA=SeqID_90836; Strand=-; Position=114-230
RERERELVSSFFFFFLTINKSLLFMNYSNLHILLLQIW

SEQ ID NO: 164414 - protein, 128 aa, Heterodera glycines
  Homolog annotation: Hit_ID=XP_393875.1; Match level="QueryCoverage =94%, HitCoverage=82%, E-value=3e-21, Identity=38%"; Hit description =similar to modifier 1 [Apis mellifera]
  Gene Ontology: Mol. function=chromatin binding; Cellular component =nucleus; Biological process=chromatin silencing
  Coding regions on vcDNA: vcDNA=SeqID_90837; Strand=+; Position=1-387
RGVGENEFQVDSILARRVLRDGRVEYLLKWKGCSDSENSWEPEQNLNCADLMAKFNTQNQKVEPMDVEGAPSQDEVEEILGAARMNSEIFYLVKLKGDSLAQFFSSRIASEKFPKLVIDFYEQRADMQ

SEQ ID NO: 164415 - protein, 81 aa, Heterodera glycines
  Homolog annotation: Hit_ID=NP_001006464.1; Match level="QueryCoverage= 97%, HitCoverage=100%, E-value=4e-22, Identity=60%"; Hit description =similar to chromosome 11 open reading frame 10 [Gallus gallus] ref|NP_055021.1| chromosome 11 open re
  Coding regions on vcDNA: vcDNA=SeqID_90838; Strand=+; Position=40-285
MVVDISKMEPFSPPVSHALFPHLTTVLLSIGLIFTAWFFVHGVTSTKKTRNLVKELFIGTLAYLFLGFGTLFLMLWVGIYV

SEQ ID NO: 164416 - protein, 177 aa, Heterodera glycines
  Homolog annotation: Hit_ID=CAE73471.1; Match level="QueryCoverage =86%, HitCoverage=30%, E-value=2e-42, Identity=52%"; Hit description =Hypothetical protein CBG20922 [Caenorhabditis briggsae]
  Coding regions on vcDNA: vcDNA=SeqID_90839; Strand=+; Position=8-538
MYNNVGLPTARGSGTNAYIQANLSNLGFSRNKLQYNAEEDIAKAEAEVNKTPNIELLDHEYKRLIEIKCVEFEDLMEGKGFSESEITSKVNEYRKLLFTEFENGRLDMDTELDLRNTHSRAKVAKDNRDKWRSALRIDAAFVDGSSLEKLKKASESVVEMAKNVDKKALEQEMEKSL

SEQ ID NO: 164417 - protein, 103 aa, Heterodera glycines
  Homolog annotation: Hit_ID=AAO92292.1; Match level="QueryCoverage =95%, HitCoverage=94%, E-value=7e-47, Identity=97%"; Hit description =FMRFamide-related peptide precursor [Heterodera glycines]
  Coding regions on vcDNA: vcDNA=SeqID_90840; Strand=+; Position=2-313
GTPNLNTVFMLIVLATSLLLLMPSSSNAKVMPQLGFANAEQLMNDNSSPMGAGVEGEVMDKVEARLLGALELLQSYKEVPIVPKFTEKRKNKFEFIRFGKRRR

SEQ ID NO: 164418 - protein, 188 aa, Heterodera glycines
  Homolog annotation: Hit_ID=NP_509508.1; Match level="QueryCoverage =71%, HitCoverage=84%, E-value=1e-15, Identity=47%"; Hit description =Neuropeptide-Like Protein (23.7 kD) (nlp-14) [Caenorhabditis elegans] gb|AAA81697.1| Neuropeptide-like pr
  Coding regions on vcDNA: vcDNA=SeqID_90841; Strand=+; Position=50-613
MVVAKNICRTKRPFSDLNLLLFLSFVLCSEFIPATNANENGRSAPWGRRGAFKVIAFRPRRALDILESDGFGGFRKRALDVMDGDGFGSFQKRALDSLEGDDFMGLKKKKALTTADGDGFTDLGKRALDVLDGDDFVGFKKRSEMQKKLALLDQIQHRQMRARRALDALEGNAFGFRRLAKSLRKKGF

SEQ ID NO: 164419 - protein, 120 aa, Heterodera glycines
  Coding regions on vcDNA: vcDNA=SeqID_90842; Strand=-; Position=1-360
FIHTDHTQYINNFFVIFFLLFEIIKMNKNKTEIGIFLFPIIIGAQSSAFLLSYLLARLRPPLHLQPHSLFVRLQSELLFAFPPPPCPIRCWHNVLVKVFHCASEQHKGGLLVTNFHKDCG

SEQ ID NO: 164420 - protein, 105 aa, Heterodera glycines
  Coding regions on vcDNA: vcDNA=SeqID_90843; Strand=-; Position=1-315
VISSVLLLLRLSHLLAQRFELCLLFPGRQMGTDQRAVPARAVSVVKGQFHGTIAHLQTRAAVSAFEAAQVDRLFLHHQFLPQWHSLVANGTIFHFIILRRPKMHC

SEQ ID NO: 164421 - protein, 118 aa, Heterodera glycines
  Homolog annotation: Hit_ID=CAE59445.1; Match level="QueryCoverage =39%, HitCoverage=49%, E-value=7e-12, Identity=76%"; Hit description =Hypothetical protein CBG02820 [Caenorhabditis briggsae]
  Coding regions on vcDNA: vcDNA=SeqID_90844; Strand=+; Position=98-454
MTEASPLIQQKDDSIPMPLVFDRPWQPPISLVPNPPPAYFVIPANVPLERPIYDQNDSAIEDELAEEAKAKRAQTFVRFGKRAQTFVRFGKRAQTFVRFGRDAQRQQEMANEQAQKKE

SEQ ID NO: 164422 - protein, 155 aa, Heterodera glycines
  Homolog annotation: Hit_ID=CAE70531.1; Match level="QueryCoverage =100%, HitCoverage=72%, E-value=8e-59, Identity=69%"; Hit description= Hypothetical protein CBG17162 [Caenorhabditis briggsae]
  Gene Ontology: Mol. function=KDEL sequence binding; Cellular component=cytoplasmic vesicle; Biological process=intracellular protein transport
  Coding regions on vcDNA: vcDNA=SeqID_90845; Strand=+; Position=204-668
MNVFRLSADLAHLVAIFILLWKIWKTRSVAGISGRSQVIFLLVFICRYLDLFTNFVSIYNSVMKVFFIGSSIATVFFIYFKFKATYDRNHDTLRIEFLVLPCLCLALLINHEFSLFEILWTFSIYLESVAIMPQLFMLSKTGSAETITAHYYSAL

SEQ ID NO: 164423 - protein, 179 aa, Heterodera glycines
  Coding regions on vcDNA: vcDNA=SeqID_90846; Strand=+; Position=160-699
HIFQYTFEHEKAAIFRWEKERRSERVEEETEQTQQMRKQRQRHMEEKGTKKDGERERAEEGQRRTERRRDNTLNNPEYRNGECFKIESHSLPSSNVSKPNQPPHFASSSLLKPVPMSKSSSNSLHVGIASTQNGNMLQKSTNNNTLNGLEEFEPRRDLFDLLELRSLDARKELEKFFDL

SEQ ID NO: 164424 - protein, 71 aa, Heterodera glycines; identical to SEQ ID NO: 125602
  Coding regions on vcDNA: vcDNA=SeqID_90847; Strand=+; Position=2-217

SEQ ID NO: 164425 - protein, 158 aa, Heterodera glycines
  Coding regions on vcDNA: vcDNA=SeqID_90848; Strand=-; Position=2-475
FFFFFFSHQIYQFDIKMVMFGYIVSLKNVQMPFIHFVSFVCLPLPFLLSLSLTLSVCLPLPFLHSLFHFFPSLFLSFPHFPIALHSFTAFFPHSAHFGAAGFLHSFLHLPLAHFTQSVAHLLFVFGHTLLHSSMIKLASLKEFNATTKIRQKRRKARE

SEQ ID NO: 164426 - protein, 60 aa, Heterodera glycines; identical to SEQ ID NO: 153246
  Homolog annotation: Hit_ID=NP_508656.1; Match level="QueryCoverage =85%, HitCoverage=86%, E-value=3e-11, Identity=49%"; Hit description =putative endoplasmic reticulum protein, with a transmembrane domain (XE407) [Caenorhabditis elegans] gb|A
  Coding regions on vcDNA: vcDNA=SeqID_90849; Strand=+; Position=37-219

SEQ ID NO: 164427 - protein, 197 aa, Heterodera glycines
  misc_feature (163)..(163): Xaa can be any naturally occurring amino acid
  Homolog annotation: Hit_ID=AAB02657.1; Match level="QueryCoverage =89%, HitCoverage=33%, E-value=8e-20, Identity=35%"; Hit description =cytochrome P450 CYP3A24 sp|Q29496|CP3O_SHEEP Cytochrome P450 3A24 (CYPIIIA24)
  Gene Ontology: Mol. function=cytochrome P450 activity; Cellular component=microsome; Biological process=steroid metabolism
  Coding regions on vcDNA: vcDNA=SeqID_90850; Strand=+; Position=2-592
EFGIGDRFLLVLISSAIVYKIFPFSVFVALFSFIVASWIYFQYRQKQHWHNVGVPGPNTNILFGNTLKQFRTGVIEVDEEMFKKYGNSYGSFLFERREFCTKDPKMLRQMFIKEFSHFQNRYNAIPEREHAPKSLMRNILTVLRDDDWRRVRNRITPAFTTGXLKKLIPILCEGTEKLCKVLETENALKGKEVPLKE

SEQ ID NO: 164428 - protein, 137 aa, Heterodera glycines
  misc_feature (97)..(97): Xaa can be any naturally occurring amino acid
  Homolog annotation: Hit_ID=CAE69837.1; Match level="QueryCoverage =95%, HitCoverage=92%, E-value=4e-29, Identity=45%"; Hit description =Hypothetical protein CBG16161 [Caenorhabditis briggsae]
  Coding regions on vcDNA: vcDNA=SeqID_90851; Strand=+; Position=3-417
LISLIVLGILLTNLEAFRQQTVGIRGRLMCGNQPLKDANVKLWNKNTLGSDDQLAANRTDNHGNYELQGGVGQLTKMNVHFKVYHDCDDGIKPCQRXVNFGVPDHYVERSGSTKKWFEAGTMNMEFKYPDEDRSCIN

SEQ ID NO: 164429 - protein, 186 aa, Heterodera glycines
  misc_feature (84)..(84): Xaa can be any naturally occurring amino acid
  misc_feature (168)..(168): Xaa can be any naturally occurring amino acid
  Homolog annotation: Hit_ID=CAE59740.1; Match level="QueryCoverage =100%, HitCoverage=97%, E-value=3e-72, Identity=67%"; Hit description= Hypothetical protein CBG03181 [Caenorhabditis briggsae]
  Gene Ontology: Cellular component=COPII-coated vesicle; Biological process=protein targeting
  Coding regions on vcDNA: vcDNA=SeqID_90852; Strand=+; Position=25-583
MNDDIRDQPGTCSRIFPLIGIKYQYYLDRLTPYTAVRWTIAITLIVFFVWRIVAIQGFYIVTYALFIYYLNLFLAFLTPKIDPXLSIDKDDDGPVLPSSTNEEFRPFMRRLPEFKIWLSTMKSTLVAFGCTFFEMFDIPVVWPILVTYFIVLTTLTMKRQIMHMIRYXYIPMSCGRPRPQGEEETG

SEQ ID NO: 164430 - protein, 140 aa, Heterodera glycines
  Coding regions on vcDNA: vcDNA=SeqID_90853; Strand=+; Position=15-437
LIRMSTIPMPPPPTQDEKDQQKKSQWKPLEIGTTKIPDPEELPFGIVQTAFRASDRMRTTSEDSAESFDAYGPDSPNMTSSGRRMSITERLFGRPVPQERRNSLGEEQMGQEKPKSIAENKDFKELMKRQRKILGDDEWQ

SEQ ID NO: 164431 - protein, 148 aa, Heterodera glycines
  Homolog annotation: Hit_ID=CAE67929.1; Match level="QueryCoverage =79%, HitCoverage=65%, E-value=5e-20, Identity=42%"; Hit description =Hypothetical protein CBG13529 [Caenorhabditis briggsae]
  Gene Ontology: Cellular component=extracellular space
  Coding regions on vcDNA: vcDNA=SeqID_90854; Strand=+; Position=2-448
MKPTFLMLISTCIIALVYASAEYDECEVCTDLFTEVMKKVDESGEKGEPAVKKMIIEHCKSVKGVDDKKEKLCFFIGAHPDSSTSVLGDIAKPLSFHKPPNKVCSQLKERDSQICALKYGKHIINKIKIIRLATSSHFCLKFNLKLHY

SEQ ID NO: 164432 - protein, 129 aa, Heterodera glycines
  Coding regions on vcDNA: vcDNA=SeqID_90855; Strand=+; Position=29-418
MVVVLSALSSGTFPPHFSLRWHSLSFLLVFILLTVRFSADFTNCHSVPSLMAFDPTKLRRLMPIREFLSDDQLAFERAIRQPAGGVKWMRFGKRTPQGKWMRFGKRKMAIEGGKWVRFGKRAEEMQGEE

SEQ ID NO: 164433 - protein, 93 aa, Heterodera glycines
  Homolog annotation: Hit_ID=CAE74012.1; Match level="QueryCoverage =70%, HitCoverage=56%, E-value=5e-09, Identity=46%"; Hit description =Hypothetical protein CBG21660 [Caenorhabditis briggsae]
  Coding regions on vcDNA: vcDNA=SeqID_90856; Strand=+; Position=3-284
NQIKVDQEESTKLWDWPLQSHDELVSIYDGRDRWEVGLDTGFFTPNEIEVNAKCNVLTILERHLVHIVAAVVQLLIPVGMEQIQIHVEKIVKK

SEQ ID NO: 164434 - protein, 70 aa, Heterodera glycines
  Homolog annotation: Hit_ID=CAE64705.1; Match level="QueryCoverage =95%, HitCoverage=62%, E-value=2e-15, Identity=55%"; Hit description =Hypothetical protein CBG09491 [Caenorhabditis briggsae]
  Coding regions on vcDNA: vcDNA=SeqID_90857; Strand=+; Position=26-238
MAKKTKYLIVRLASVISGTKQIWVRERAAAEAAAILYDPAIGKNVLFKEVEQVKGKDSFPDRVKKMYNIS

SEQ ID NO: 164435 - protein, 134 aa, Heterodera glycines
  Coding regions on vcDNA: vcDNA=SeqID_90858; Strand=-; Position=31-435
LSDQCFHLFAADLLSVDQCCCCCCCCCCWYCWYCWYFFFSNSYFSPDPMCMCALQSHIGMRWPAMNCMYINPSSREQLPGCSGQSQIAQMKQLLCIVNFSTWTFSSKISIHVLQIWQNFFVGPVPKFISLAACR

SEQ ID NO: 164436 - protein, 118 aa, Heterodera glycines
  Coding regions on vcDNA: vcDNA=SeqID_90859; Strand=-; Position=3-356
LTQQMVRNGKAVTICDQMNMRKRNKSLADNQSIPLFSFVVDGGGRVFRQNIIHLLAQMERVLVRHFPEKCFNHFGTVLCCSYCSTSSRTLSINRLDSSKKHSGMGANALCSASARIIR

SEQ ID NO: 164437 - protein, 73 aa, Heterodera glycines
  Coding regions on vcDNA: vcDNA=SeqID_90860; Strand=+; Position=174-395
MGFVYAKLDHVFQRFEYCPCQLPRHLSHCMPYQLPEVNAWEKEANQMLDNLLCFTIKDSDIGPALLAELMANE

SEQ ID NO: 164438 - protein, 151 aa, Heterodera glycines
  Homolog annotation: Hit_ID=NP_505304.1; Match level="QueryCoverage =92%, HitCoverage=91%, E-value=3e-19, Identity=37%"; Hit description =esophageal gland cell secretory protein 11 like precursor family member (17.3 kD) (5J403) [Caenorhabditis
  Coding regions on vcDNA: vcDNA=SeqID_90861; Strand=+; Position=3-458
LVPVLVLLALLGGLLHTGAQESISTRSTRAEGTLMCGKVPASKVYVRLFKTNSDEISNALATAVTNDQGKFIIEGNTANYQGSEANIDPFLKIYHKCDQKEGKKGYRRITLRYPREYVTIGRVPRRNYSVGNLNLVLQYPNEAHIDELKGI

SEQ ID NO: 164439 - protein, 147 aa, Heterodera glycines
  Coding regions on vcDNA: vcDNA=SeqID_90862; Strand=+; Position=204-644
HNYHKRPIIKTLVRKRLYWLRSPSPTFADSDHSQNNESSIESAANLHENTATEERPRAESTSQNVGADATACMTTRPSDDNESYLDEQGLRWHRLFAVPDNDLSTLLRICIEFGGGTAQNWSNGNKCIVFGCAFAQQKNADALCPFR

SEQ ID NO: 164440 - protein, 153 aa, Heterodera glycines
  Homolog annotation: Hit_ID=CAE62553.1; Match level="QueryCoverage =95%, HitCoverage=32%, E-value=5e-24, Identity=45%"; Hit description =Hypothetical protein CBG06663 [Caenorhabditis briggsae]
  Coding regions on vcDNA: vcDNA=SeqID_90863; Strand=-; Position=176-637
IEDAYLHMEGSSQVRLRSRSQNGKYTYTHTTRTIEDADGKKLPQPVETRKQLDWHEYQIYLKLLDKDYQAIRKKRVCFLFGNVYFNLDIYIAPLPPALMYNEEQLMILETYTTRPIGDPEPRLPDFLEIDREITMESAYSMLNLARNNPGNVT

SEQ ID NO: 164441 - protein, 129 aa, Heterodera glycines
  Coding regions on vcDNA: vcDNA=SeqID_90864; Strand=+; Position=2-391
MSTIPMPPPPTQDEKDQQKSQWKPLEIGNRMRTTSEDSAESFDAYGPEWEGKGRGIGNRRELSSPNMTSSGRRMSITERLFGRPVPQERRNSLGEEQMGQEKPKSIAENKDFKELMKRQRKILGDDEWQ

SEQ ID NO: 164442 - protein, 64 aa, Heterodera glycines
  Coding regions on vcDNA: vcDNA=SeqID_90865; Strand=+; Position=15-209
SFTMLIFPHIKFSTLLKRATVNSSYYVSYAAYGASAFLVLVYVTEWKRFARYIPGLRSQIKSDE

SEQ ID NO: 164443 - protein, 67 aa, Heterodera glycines
  Coding regions on vcDNA: vcDNA=SeqID_90866; Strand=+; Position=182-382
WSLEDFRRFFFSLRCWMRRCYGFWAMMHILCLFRLITTNISILSLSVENSYFLLSISYTVVKNPHEK

SEQ ID NO: 164444 - protein, 86 aa, Heterodera glycines
  Homolog annotation: Hit_ID=NP_497346.1; Match level="QueryCoverage =94%, HitCoverage=57%, E-value=1e-10, Identity=48%"; Hit description =putative protein, with a coiled coil-4 domain (3C284) [Caenorhabditis elegans]
  Coding regions on vcDNA: vcDNA=SeqID_90867; Strand=+; Position=2-262
VDKHEKSEAVPTEAKNESELIKSTKLEDEEESEEFPVYNKGEGIDTVEAQAAINVWEDNWDDETQETDFHIQLQEELKKCGYKPSA

SEQ ID NO: 164445 - protein, 156 aa, Heterodera glycines
  Homolog annotation: Hit_ID=AAK02015.1; Match level="QueryCoverage =57%, HitCoverage=42%, E-value=6e-09, Identity=31%"; Hit description =enterophilin-2S [Cavia porcellus]
  Coding regions on vcDNA: vcDNA=SeqID_90868; Strand=+; Position=1-471
DMEELWKQSQKIQTDNHELSERVSSLTRENNTLRTEHERILGDHNTLRTEHERILVDHNTLRTEHERILVDHNTLRTEYERILQRQLDDFHYWILCFAFFIPPLSILATARNNGLSFPVTVLSALAATIFCAFLWIPGILFALAFYFGLRKNAKKE

SEQ ID NO: 164446 - protein, 112 aa, Heterodera glycines
  Homolog annotation: Hit_ID=AAG50109.1; Match level="QueryCoverage =98%, HitCoverage=25%, E-value=6e-58, Identity=100%"; Hit description= putative protein kinase [Arabidopsis thaliana] gb|AAF43937.1| Strong similarity, practically identical, t
  Coding regions on vcDNA: vcDNA=SeqID_90869; Strand=-; Position=102-627
GENRLLVYEFMPKGSLENHLFRRGAQPLTWAIRMKVAVGAAKGLTFLHEAKSQVIYRDFKAANILLDADFNAKLSDFGLAKAGPTGDNTHVSTKVIGTHGYAAPEYVATGLF

SEQ ID NO: 164447 - protein, 195 aa, Heterodera glycines
  Homolog annotation: Hit_ID=NP_502246.1; Match level="QueryCoverage =64%, HitCoverage=44%, E-value=3e-28, Identity=48%"; Hit description =enoyl CoA hydratase (4M616C) [Caenorhabditis elegans] emb|CAB01180.1| Hypothetical protein F38H4.8 [Caeno
  Coding regions on vcDNA: vcDNA=SeqID_90870; Strand=+; Position=49-633
MSQAFGHQLLHRFRRPALFALSSSKFCPLFRATAAFATDGAATKQPTASAAAQHQHQQVEQQQPSTTKTEWHLGNRVARLVMDDKRVNSLSLSAMEMLHDTLRELDARPEVRVVILAASGPAYSGGHHLPELTAESGTEMHRKVFNKCLELMTFIRQMQLPVIAEVDGLVAAAGTQLVAACDIVIASGRASFNVA

SEQ ID NO: 164448 - protein, 78 aa, Heterodera glycines
  Coding regions on vcDNA: vcDNA=SeqID_90871; Strand=-; Position=60-296
SSVCIVSVRARPNSQTPTLPIYHSLSASPAHLGTSNIGRHLATASRNVCLQLLNVVRIVAQLVVLVRKFIVSLQNRIT

SEQ ID NO: 164449 - protein, 204 aa, Heterodera glycines
  Coding regions on vcDNA: vcDNA=SeqID_90872; Strand=+; Position=30-641
MTSQKPAEDDPIGAEETVTTAADCVNELLETTEIQAEVDELVKSVVEFVSEAASAAADDVDHQQQRNAADESAKSRFGISSHEIAIPCKEFDRLLRKIGLKSGAKRQCPGKRMCPPRKVKASASDGVSAKIPKLSENGTAGGKQKKKKMQNIVEFDQVMASLLGNFEDDPIFLKCKEVQGMTKDLAQLTFQINQFLCHFITFIP

SEQ ID NO: 164450 - protein, 44 aa, Heterodera glycines
  Coding regions on vcDNA: vcDNA=SeqID_90873; Strand=+; Position=1-135
IRWQTFRRRVPASVHSPPYSKRISNGSITMVDQLDRPRQCVIVL

SEQ ID NO: 164451 - protein, 79 aa, Heterodera glycines
  Coding regions on vcDNA: vcDNA=SeqID_90874; Strand=+; Position=3-242
HFSLQLPPILCFHAFLCGLATKLRPILGQVSNLIWPLFEESRRNDGKAINHLINYFFFHLFLILHLFSLCYVCCLFVNE

SEQ ID NO: 164452 - protein, 82 aa, Heterodera glycines
  Homolog annotation: Hit_ID=NP_499402.1; Match level="QueryCoverage =100%, HitCoverage=20%, E-value=4e-10, Identity=40%"; Hit description= putative cytoplasmic protein of eukaryotic origin (3M21) [Caenorhabditis elegans] pir||T23762 hypothetic
  Coding regions on vcDNA: vcDNA=SeqID_90875; Strand=-; Position=2-247
QLSQFWYTDETCRKIVDECICTLNGAGRVACLCCRSVVQHFMDSKEVKKNSIELSLLECAGRSEQKFPQFFINYDNRKPLDV

SEQ ID NO: 164453 - protein, 133 aa, Heterodera glycines
  Coding regions on vcDNA: vcDNA=SeqID_90876; Strand=-; Position=9-410
SIGNRNKKRQNPINPTNYYFCFQLTILPSLASLLSPSVSNSSSSSFTIRWHCLPSRPAVSAVPAAESASVGAAESAVAAAVQQRRPVAVQSPTEAQRTAPERLAATAQPFAALAAAAAPRAARSNPTKRRPSQ

SEQ ID NO: 164454 - protein, 140 aa, Heterodera glycines; identical to SEQ ID NO: 162652
  Homolog annotation: Hit_ID=AAL18843.1; Match level="QueryCoverage =100%, HitCoverage=99%, E-value=1e-15, Identity=28%"; Hit description= LEA1 protein [Aphelenchus avenae] sp|Q95V77|LEA1_APHAV Late embryogenesis abundant protein 1 (Aavlea1)
  Coding regions on vcDNA: vcDNA=SeqID_90877; Strand=+; Position=29-451

SEQ ID NO: 164455 - protein, 140 aa, Heterodera glycines
  Homolog annotation: Hit_ID=EAL32749.1; Match level="QueryCoverage =76%, HitCoverage=82%, E-value=5e-15, Identity=40%"; Hit description =GA21635-PA [Drosophila pseudoobscura]
  Coding regions on vcDNA: vcDNA=SeqID_90878; Strand=+; Position=20-442
MTLKFVGNLFLGACIGQVFGQRIGAFIRCQGDSMLPTFYNGDILWARVWDPNDGLRPGDVVCLVDPTNANQYVLKRVSAVHENSRPSDPLAGRIEVRGDNATNSVDSRDYGPVPAGLVCYRVSVRLFPLNRRRKIETAII

SEQ ID NO: 164456 - protein, 97 aa, Heterodera glycines; identical to SEQ ID NO: 154665
  Coding regions on vcDNA: vcDNA=SeqID_90879; Strand=-; Position=296-589

SEQ ID NO: 164457 - protein, 127 aa, Heterodera glycines
  Homolog annotation: Hit_ID=NP_612395.1; Match level="QueryCoverage =83%, HitCoverage=20%, E-value=1e-10, Identity=34%"; Hit description =hypothetical protein BC008207 [Homo sapiens] gb|AAH08207.1| Hypothetical protein BC008207 [Homo sapiens]
  Coding regions on vcDNA: vcDNA=SeqID_90880; Strand=+; Position=127-510
MCRKHREFSAAKMGEDSQNKPRSLNKRDKVFDSEYYSLPAIDQLNIQVKEETEFKRFGVVDSHINFLAKIKPDKDTPHLGYETILFNHDKKPIGEIFEIFGTVTDTLYALRFNDESDAVAKLPCWVK

SEQ ID NO: 164458 - protein, 182 aa, Heterodera glycines
  Coding regions on vcDNA: vcDNA=SeqID_90881; Strand=+; Position=5-553
MEDEHSFSRQNNMRSPSKSASTPTMAEEPKKGELMAENNGTKGQLNSHKLLPVKNSLSATELFATANPMHRNGSTNSKLTNEFDQSEKQQPQAPHDDIYTKFYQPEPGTVFGRRLLNCEEFYGNFRRCADRKAKHSNILLSIERDLHSVQTLSKVAEFRSQLVKQRIAATSKRIQELESKSQ

SEQ ID NO: 164459 - protein, 105 aa, Heterodera glycines
  Homolog annotation: Hit_ID=XP_414883.1; Match level="QueryCoverage =99%, HitCoverage=25%, E-value=3e-23, Identity=43%"; Hit description =PREDICTED: similar to Hypothetical protein FLJ13798 [Gallus gallus]
  Coding regions on vcDNA: vcDNA=SeqID_90882; Strand=+; Position=301-615
LPSLEYFFNNFYKLQVPVIIRGMVNGWPAFEKWSFSYLNSICGHRLVPVELGSKYTDDDWRQQMMSFNQYLDDFVFPTTNPSQSGYMAQHRLLDQIPELLADVPV

SEQ ID NO: 164460 - protein, 46 aa, Heterodera glycines
  Coding regions on vcDNA: vcDNA=SeqID_90883; Strand=-; Position=3-140
TNNNNHVLYEKSPKNICSRAATDSPPYCLNSLAPLNSLTMRRKFFA

SEQ ID NO: 164461 - protein, 101 aa, Heterodera glycines
  Homolog annotation: Hit_ID=CAE61521.1; Match level="QueryCoverage =100%, HitCoverage=11%, E-value=3e-18, Identity=43%"; Hit description= Hypothetical protein CBG05421 [Caenorhabditis briggsae]
  Coding regions on vcDNA: vcDNA=SeqID_90884; Strand=+; Position=2-307
NSHILWHNFQSAEQIATFLACCSPLMLHDLFKEFCTNFKESRSGFPDLVVWNENVAKMAVVEVKGPNDSLSAKQQLRLHFFRTHGVRSVVCHVVARNDRML

SEQ ID NO: 164462 - protein, 144 aa, Heterodera glycines
  Homolog annotation: Hit_ID=CAF89757.1; Match level="QueryCoverage =84%, HitCoverage=23%, E-value=7e-17, Identity=40%"; Hit description =unnamed protein product [Tetraodon nigroviridis]
  Gene Ontology: Mol. function=transporter activity; Cellular component= membrane; Biological process=transport
  Coding regions on vcDNA: vcDNA=SeqID_90885; Strand=+; Position=1-435
EALCAVIERLPKEMQLLMARNIVLTGGNALFPGYRKRIEQELRSMMPEQFTLGVQQPSDPICHAWECARDAIQQQQHDAETSASSAADVGAATQFSPRLTAKFVSRAEYEENGPNICRRRFANVYNNRNVEDDDDEGTNSGTQN

SEQ ID NO: 164463 - protein, 190 aa, Heterodera glycines
  Coding regions on vcDNA: vcDNA=SeqID_90886; Strand=+; Position=3-572
SHHFSKQTQKMDNLSVYDSWPMSQRNSPRNHSSNSTCSSDDTAQAEDQPLNIGGTIRDRLASTSLSIASFDVISAGGGLNGGGGAAEHFGNSTPFTISSHNQQQPQQQSNSFAAYFSELNRLPIDHWLKSTSAANGPKKAFPSVTPSMPVTQHPIIPNNISEMFSKMHMNTSETQKKHQLTTSTPIGLHC

SEQ ID NO: 164464 - protein, 203 aa, Heterodera glycines
  Homolog annotation: Hit_ID=NP_872145.1; Match level="QueryCoverage =72%, HitCoverage=25%, E-value=6e-21, Identity=39%"; Hit description =phospholipase D/Transphosphatidylase (5T54) [Caenorhabditis elegans] emb|CAD56614.1| Hypothetical protein
  Coding regions on vcDNA: vcDNA=SeqID_90887; Strand=+; Position=5-613
MENAATGGKRVPRFSHSAGTEGAEGEKEPQAEEPPSAGTAGADRPAEDHSLLLAQLLAAFALFGLVTALLFQLPAFRVRSRIGTDGPVPIHQLDPQMAECAKTCRIELVESIPQNVSFHLSLGNSPALAIPTFSAWMQLISEAKHSLAIAAYKTSLRGKHVLGEDQGNYSTQGETVFDALLDAGLRRGVGIRMVENAVAKDKG

SEQ ID NO: 164465 - protein, 56 aa, Heterodera glycines
  Homolog annotation: Hit_ID=NP_494754.1; Match level="QueryCoverage =92%, HitCoverage=8%, E-value=2e-09, Identity=53%"; Hit description =NAD-dependent epimerase dehydratase family (71.1 kD) (2E587) [Caenorhabditis elegans] gb|AAB00715.1| Hypot
  Coding regions on vcDNA: vcDNA=SeqID_90888; Strand=+; Position=2-172
RAHTVLVSGACGSVASNFVNYAFEKRPPSNYVNLDELILNSDWNYLAPKVRNSARY

SEQ ID NO: 164466 - protein, 205 aa, Heterodera glycines
  misc_feature (35)..(35): Xaa can be any naturally occurring amino acid
  Coding regions on vcDNA: vcDNA=SeqID_90889; Strand=-; Position=0-614
HRANAQTSHHRQGKVSRISSKRRVEGGRGGGEGGXGAGGQRLIHAPLLLTMPLSLLQHKAPCLAHRMPVVRRLFENTVLLLIGHNRFTFGRFGANETQRKAVELGQMDQFPVGQLKRMETVQRVQRVVNGVDVGHMVTQHQFQLPDSVVQSFILLDEDGVRMGQLGNWRTECKRSTAMQSWEVEHWERSGGRIGGREKQKGKETA

SEQ ID NO: 164467 - protein, 199 aa, Heterodera glycines
  misc_feature (161)..(161): Xaa can be any naturally occurring amino acid
  Homolog annotation: Hit_ID=NP_492283.1; Match level="QueryCoverage =73%, HitCoverage=32%, E-value=9e-30, Identity=43%"; Hit description =acid phosphatase 5 (47.7 kD) (1I991) [Caenorhabditis elegans] emb|CAB04053.1| Hypothetical protein F02E9.
  Coding regions on vcDNA: vcDNA=SeqID_90890; Strand=+; Position=21-616
MVSMLCLISGLFLLPPDIHSFSSTPSEQDANRQIPLTTVGRLSCVTEAGCVLSDTSQLNFLVVGDIGGLPVFPYYSYAQTKVARAMAKIGRRHRTHFVVNVGDNFYFNGVQNAFDGRFEDSFEEIYDQPELLVPWYTIAGNHDHLGNVTGQLARTDFSSRXLRTFPRLFYKVRLSFDGLSPPSAVRVDLLMLDTVVLCG

SEQ ID NO: 164468 - protein, 135 aa, Heterodera glycines
  Coding regions on vcDNA: vcDNA=SeqID_90891; Strand=+; Position=3-407
ATKQTQWWCWCRVVHSWRQPDHAQRVHWWWCGCAPCQHWHGRWRRFNARFFSSSPAAANAHVFKCVCRGIRPMVLQRGGRCCIRGRRISVIRHISLIYDFDPSTIDFSFHQVLHFHPRIDENKKVICEKKKKKKK

SEQ ID NO: 164469 - protein, 166 aa, Heterodera glycines
  Coding regions on vcDNA: vcDNA=SeqID_90892; Strand=+; Position=136-633
MEDEIKKRKKNGRTHRRAKSHGAVRPIFHPPTETMKGWDKTATDKWTIGKEERRAQNAEEPTIHSSAIKTQKNKITVAKRRYSVFRHDSLMWEEMPQFTESDRRLRKSVPSSPQTILVLAGLFVCGLILLISGLIVLITNWQNAKAIQNGWYYHVAGCTMLLLGFS

SEQ ID NO: 164470 - protein, 189 aa, Heterodera glycines
  Homolog annotation: Hit_ID=CAE63782.1; Match level="QueryCoverage =97%, HitCoverage=48%, E-value=4e-67, Identity=64%"; Hit description =Hypothetical protein CBG08323 [Caenorhabditis briggsae]
  Gene Ontology: Mol. function=methionyl aminopeptidase activity; Cellular component=cytosolic ribosome (sensu Eukarya); Biological process=proteolysis and peptidolysis
  Coding regions on vcDNA: vcDNA=SeqID_90893; Strand=+; Position=2-568
QSKGCKKPVRSNLRCPTCVKMGLPHAFFCSQTCFKASWMEHKLCHKDDSSNINEYNPWPLYQFTGTLMPAPQSARRAVPEHIPWPDYALHPECVSLEEQNALNSGQIQVLNYEEQLRMRLAAKLGRQVLDEAARAIEPGMTTDEIDRVVHEACIERECYPSPLGYYKFPKSCCTSDNEVICHGIPDKRA

SEQ ID NO: 164471 - protein, 63 aa, Heterodera glycines
  Coding regions on vcDNA: vcDNA=SeqID_90894; Strand=+; Position=2-193
AFLQSTDQKLLVLLTALTSVQGQTVRLVDRLNVLARDRLQHERSSFIQHRHCSNLFPGLFGRF

SEQ ID NO: 164472 - protein, 109 aa, Heterodera glycines
  Coding regions on vcDNA: vcDNA=SeqID_90895; Strand=+; Position=2-328
FNESLLRQLEANANANGQTQSVQHDAVAAHPQDQSVTPAESAVTGPSPTQLEALIQDEVNRRVAAQLEQSQLTQGVRADHRADLDSQTALREADDLLHRLGRVSLPTPE

SEQ ID NO: 164473 - protein, 189 aa, Heterodera glycines
  Homolog annotation: Hit_ID=NP_494846.1; Match level="QueryCoverage =100%, HitCoverage=43%, E-value=5e-44, Identity=44%"; Hit description= protective protein for beta-galactosidase precursor (53.6 kD) (2F29) [Caenorhabditis elegans] gb|AAC4681
  Coding regions on vcDNA: vcDNA=SeqID_90896; Strand=+; Position=6-572
MVRDIILFCWRGGINVYDIYRDCFPQHSKMAAIRRGILRAKAFHSNDTNLWEPLEEINFRGGAPCLDDHAITNYLNTPRVRETLHIPPNVPNWESCNDWVGILYTTEYSDMSPFVRKAINANLRVLLYSGDTDMACNFLSGQHFSAQLGLATIAKKKPWYFRGQIAGFRTEYARNLTFITVRGAGHMGP

SEQ ID NO: 164474 - protein, 133 aa, Heterodera glycines
  Coding regions on vcDNA: vcDNA=SeqID_90897; Strand=+; Position=1-399
VFSKNCPNFLNFVFSAPPFFFFASSVSTTFRPLPMALPPADSFASLSVPCGAAVSVQMQSLFCLCARRVSQLCTPSRMCELRDALPPAVFDTLTALQADIECLRHYFPNSRKNSADEGSPQSHFFLPERCFVL

SEQ ID NO: 164475 - protein, 203 aa, Heterodera glycines
  Coding regions on vcDNA: vcDNA=SeqID_90898; Strand=+; Position=3-611
PIKNFAGTCWTVPSIFNSPHILFDFFALLCLIHMIDFKRECNGRLGYTLVEDDSSLLGGITFRSIVSGDKLPLLRDSPPESHVEPVAQLLRSPRDHMDNIFNPADNNIVDNTNGFALAPYTEQRRAPSGVLAQQTMQRFGNAYFMGNSNNSTNNTTTSSAYSLATIGTNTTTYSGGACNGSGGTLVTNATGTTGGRRKEVYTD

SEQ ID NO: 164476 - protein, 201 aa, Heterodera glycines
  Homolog annotation: Hit_ID=EAA62478.1; Match level="QueryCoverage =99%, HitCoverage=15%, E-value=5e-43, Identity=47%"; Hit description =hypothetical protein AN5318.2 [Aspergillus nidulans FGSC A4] ref|XP _409455.1| hypothetical protein AN5318.
  Coding regions on vcDNA: vcDNA=SeqID_90899; Strand=+; Position=4-606
MLLGRVCIVTGASEGIGEAVARTLALDGGATVVLVARRIDRLEALTQQLNALGVPSERLMAVKCDVASSENVRAMVAQTMERFGRVDVLVNCAGVMFFIQSSKGYTEEWTRQIDVNVHGTTNVVGFVLPLMVERKNGHILTITSDAGRRAFPGLAVYSGTKFYLEAFISALRQENVENGIRFTNIQPGDVATSLARRSTDT

SEQ ID NO: 164477 - protein, 201 aa, Heterodera glycines
  Homolog annotation: Hit_ID=NP_498586.1; Match level="QueryCoverage =100%, HitCoverage=53%, E-value=1e-83, Identity=78%"; Hit description= ribose-phosphate pyrophosphokinase (41.1 kD) (3I303) [Caenorhabditis elegans] gb|AAK29853.1| Hypothetica
  Gene Ontology: Mol. function=ribose-phosphate pyrophosphokinase activity; Biological process=ribonucleoside monophosphate biosynthesis
  Coding regions on vcDNA: vcDNA=SeqID_90900; Strand=+; Position=3-605
PSKTSSPTGSLLLSEGEHSTASGSLVNVRMPNIKVFSGSSHSDLAQRICDRLQLEVAKAALKKFSNKETNVEIIESVRGEDVYIIQSGCGEINDHLMELLIMISACKIASACRVTAVIPCFPYARQDKKDKSRAPITAKLVANMLSISGADHIITMDLHASQIQGFFDIPVDNLYAEPAILKYIRETIPHWQESVIVSPDA

SEQ ID NO: 164478 - protein, 206 aa, Heterodera glycines
  Homolog annotation: Hit_ID=CAE67181.1; Match level="QueryCoverage =94%, HitCoverage=46%, E-value=9e-17, Identity=27%"; Hit description =Hypothetical protein CBG12617 [Caenorhabditis briggsae]
  Coding regions on vcDNA: vcDNA=SeqID_90901; Strand=+; Position=3-620
FTIWFEEHFPSGKQKHFCQFLYKICTTYCLVNAYKNDDRLMKLWLKLTENFPESGFAIMEFAFSKGSCRQLAKFYIHWSTMYQSISWWNKAREKLQLGQKMCAMPLDLLHRAVDELEASVMKVTRSGENSEETEADEMVAVSLEQSRETLGKLRGLGRRHFAPIIRTAQGPPGTLSTSKRNTSSKNAKNNEHFEILADEFTECVSL

SEQ ID NO: 164479 - protein, 204 aa, Heterodera glycines
  Coding regions on vcDNA: vcDNA=SeqID_90902; Strand=+; Position=27-638
MNNENGTLPSVSTIKKKANATGGGYGVVIHSFDSQNKNSAQSIVYVDHNRPLYVVPRYLFDVTYLTNQGFSKSQVNKRSIELGFGANIQFESRGNQIVYFDRCSKGQDWIKIGEQLLLQDKDRRFFFEDKFIDAKNANILLRAHGCVSDEEVRRFFCHSFHSVDSFRVPYAELQKVIPNVLYDLFVNIDLDMHGYEPNMESAHC

SEQ ID NO: 164480 - protein, 202 aa, Heterodera glycines
  Homolog annotation: Hit_ID=C88618; Match level="QueryCoverage=98%, HitCoverage=26%, E-value=4e-31, Identity=35%"; Hit description =protein ZK520.4 [imported] - Caenorhabditis elegans
  Gene Ontology: Biological process=induction of apoptosis by intracellular signals
  Coding regions on vcDNA: vcDNA=SeqID_90903; Strand=+; Position=6-611
MNLRPKAVNFDDVWSKLRETLEAIISLKPIERITWDHNFSDIYFVCVSVPEAQSRRLYTAVKNSLELHTISIRESLLRLSGDQLLSAYNSEWEKFHKGAIYLHNLYGYLNKQLVKEKMDAESQHPFVVDNDSDGLYPHLGVGDLAFSIWRNELLMPLAAQLVAHIIELLGRIRNGISASFGIRISDLRGAVLSFVDVNESIH

SEQ ID NO: 164481 - protein, 79 aa, Heterodera glycines
  Coding regions on vcDNA: vcDNA=SeqID_90904; Strand=+; Position=83-319
MSSPPSPKASLILEAQADFALKLLREVSTDDRSCIVSPFSAAVTLSMVYAGAKGKDGEERGNCLQRVGPNRRAQIFGAF

SEQ ID NO: 164482 - protein, 205 aa, Heterodera glycines
  Homolog annotation: Hit_ID=NP_956267.1; Match level="QueryCoverage =98%, HitCoverage=40%, E-value=2e-36, Identity=38%"; Hit description =ubiquitin specific protease 14 [Danio rerio] gb|AAH44553.1| Ubiquitin specific protease 14 [Danio rerio]
  Gene Ontology: Mol. function=tRNA guanylyltransferase activity; Cellular component=proteasome regulatory particle (sensu Eukarya); Biological process=protein modification
  Coding regions on vcDNA: vcDNA=SeqID_90905; Strand=+; Position=13-627
MAKIKIKWGTKELNVDANPEEPPLLLKAQLFGLTNVPPERQKLIVKGKTISDEAWNGIKIKDGTVIMLIGSTESMLIKAENAESSGHTNSTETEPRQQFPIGLRNLGNTCYMNSSLQCLKIVPEFETALKQYNPNQSVDGSNQRIKLFTNSMKKLYNEMNVLAKDQTADSPEVIPLFLVHVLRQTFPQFDTQDERGNHQQQDANE

SEQ ID NO: 164483 - protein, 87 aa, Heterodera glycines
  misc_feature (26)..(26): Xaa can be any naturally occurring amino acid
  misc_feature (33)..(33): Xaa can be any naturally occurring amino acid
  misc_feature (63)..(63): Xaa can be any naturally occurring amino acid
  Homolog annotation: Hit_ID=CAB88203.1; Match level="QueryCoverage =98%, HitCoverage=28%, E-value=9e-23, Identity=67%"; Hit description =putative cuticular collagen [Globodera pallida]
  Coding regions on vcDNA: vcDNA=SeqID_90906; Strand=+; Position=2-262
VLGIASVCSLLSIIATVLSLPSRYSXDEPNAAXVRYGVEAFRVNTDSLCTDLMDVPVVVTPPXKPPGNRFDCIFRAKRQLPGRWQCA

SEQ ID NO: 164484 - protein, 75 aa, Heterodera glycines
  Coding regions on vcDNA: vcDNA=SeqID_90907; Strand=-; Position=0-224
NPVFFSIVRCFGIGSFSALCHTLFPAPQMAFCAVRFGSPPLIPIVLRHFPSFRWRQNVPKREIKTKRNEWKRNAS

SEQ ID NO: 164485 - protein, 97 aa, Heterodera glycines
  Homolog annotation: Hit_ID=XP_313750.1; Match level="QueryCoverage =73%, HitCoverage=18%, E-value=1e-11, Identity=47%"; Hit description =ENSANGP00000017591 [Anopheles gambiae]
  Coding regions on vcDNA: vcDNA=SeqID_90908; Strand=+; Position=74-364
GVSFSLVRTRFVPAHQLILKNFPFDICRLSNLQVLYLGGNALIDVPDTIGQLSELTSLGLADNRLEQIPTAIASYRNLRNLALHNNRLKKKKKKKKK

SEQ ID NO: 164486 - protein, 202 aa, Heterodera glycines
  Homolog annotation: Hit_ID=NP_509742.2; Match level="QueryCoverage =99%, HitCoverage=20%, E-value=1e-83, Identity=71%"; Hit description =PKN/rhophilin/rhotekin rho-binding repeat and protein kinase and Protein kinase C-terminal domain contain
  Gene Ontology: Mol. function=protein kinase activity; Cellular component=intracellular; Biological process=signal transduction
  Coding regions on vcDNA: vcDNA=SeqID_90909; Strand=+; Position=13-618
MAPPLPTVSAATVAPTPAALAIDDFRLIAVLGRGHFGKVILSQYRRTNAYFALKILKKGDILARDEVESLMVEKRILEIASSSKHPFLINLHATFQTHDHVFFVMEYAMGGDLMRHIHDDIFAEDRACFYAACILLGLEFLHANNIVYRDLKLDNLILDREGYVKLADFGLCKEGMGPFDKTSTFCGTPEFLAPEVLTENSY

SEQ ID NO: 164487 - protein, 78 aa, Heterodera glycines
  Coding regions on vcDNA: vcDNA=SeqID_90910; Strand=-; Position=84-320
FFFFFFFFFAPYCFILLVKRHQNSKNVRQFCRRHIKMVTHQYTIKRRKKMFGKNKHLLKRSIALDGSITIITNSGKIW

SEQ ID NO: 164488 - protein, 187 aa, Heterodera glycines
  Homolog annotation: Hit_ID=CAG04319.1; Match level="QueryCoverage =62%, HitCoverage=37%, E-value=3e-11, Identity=32%"; Hit description =unnamed protein product [Tetraodon nigroviridis]
  Gene Ontology: Mol. function=ubiquitin-specific protease activity; Cellular component=cytoplasm; Biological process=protein deubiquitination
  Coding regions on vcDNA: vcDNA=SeqID_90911; Strand=+; Position=46-606
MYQFPTKIGSTSTKFSTSTLPPTPSPFSRPMHNSLKPLQPRPTTSDAQHSFREKSAANDGELMLKQHSRSSQVPCLKGLTNHGNTCYFSAIIQCLASCEQFVKFFVCNHSEETTDGSSTDQSSTNFMPLLTNALSATLCCLWFNNSLADSSCYRLLQLISKANPQFVFSQQQDAHECLIWLLNRLHD

SEQ ID NO: 164489 - protein, 174 aa, Heterodera glycines
  Homolog annotation: Hit_ID=NP_496203.2; Match level="QueryCoverage =94%, HitCoverage=30%, E-value=7e-58, Identity=62%"; Hit description =leucine-rich repeat containing protein (2K499) [Caenorhabditis elegans] emb|CAA88748.2| Hypothetical prot
  Coding regions on vcDNA: vcDNA=SeqID_90912; Strand=+; Position=1-525
LVQLISQIPSLSHLALDVAFLNAHFLRRLFAGGVHSPGAGLRSLRLCRLRITYRALFSIGRWARSLVDLETSHMPAVDDRFLVLLGKNCKYLQNVNFNGCKWVTDKGVASLARNCKLREVRIRGTSCTDKSVYAFAQFCPTLEWIAHADFSGRPNFSDKALKCLRDSCIQRVIC

SEQ ID NO: 164490 - protein, 202 aa, Heterodera glycines
  Homolog annotation: Hit_ID=CAE73343.1; Match level="QueryCoverage =99%, HitCoverage=40%, E-value=4e-64, Identity=59%"; Hit description =Hypothetical protein CBG20774 [Caenorhabditis briggsae]
  Gene Ontology: Mol. function=electron transporter activity; Biological process=aminobutyrate catabolism
  Coding regions on vcDNA: vcDNA=SeqID_90913; Strand=+; Position=2-607
IDWSSGHQFIVTDPNNGELLCDVSNCGPLEAQLAVAAARRKFPRWAFEYTAKERGAVLRKWCELLGKREKQLAELLTREQGKPLAESRGEIQYAASYLDWYAAEARRCYGQVVPASKPFRSHVHLREPCGVCLLITPWNFPAAMIIHKAADALAVCCTVVVKPAEDTPLTALTLAHTSHEAGVPSGVFNVIPSDRDETAEVS

SEQ ID NO: 164491 - protein, 52 aa, Heterodera glycines
  Homolog annotation: Hit_ID=NP_491349.1; Match level="QueryCoverage =94%, HitCoverage=11%, E-value=2e-09, Identity=63%"; Hit description =GDP-mannose pyrophosphorylase (43.9 kD) (1E875) [Caenorhabditis elegans] gb|AAF60647.1| Hypothetical prot
  Coding regions on vcDNA: vcDNA=SeqID_90914; Strand=+; Position=2-157
AEKGTRFGPLSLKLPKELFPVAGVPLIEHEISWLCEQLENLHNVDIDGFYAG

SEQ ID NO: 164492 - protein, 124 aa, Heterodera glycines
  Coding regions on vcDNA: vcDNA=SeqID_90915; Strand=-; Position=3-374
LTPNLSFNPITLSHYQRPLLLLLSFSVFSVLISAWGKAQTDAEQVENWHTKLPARTISIACACRTAAAPVFKLSSSTTADRRFSFEFQHISSEAEGSQKQAAENDRKKLGNHFCKLNFRKSFNK

SEQ ID NO: 164493 - protein, 178 aa, Heterodera glycines
  Coding regions on vcDNA: vcDNA=SeqID_90916; Strand=+; Position=79-612
QNCPLLLPIMAPKCLPPELLFELVPLFPVEETLPNVFLSCRLLHNFLLPRVDKWKEEMQRNTEEMDRKFEEMEKRLTTKFEQFREDTFELLDTIVERIEDGNKEIAHFCRHTAQTMDLLALNITTSVSAFKRRKQQCGQDTDSAMTAERTFGGGQLTAAAPSAATSAACGGEFGAKVN

SEQ ID NO: 164494 - protein, 55 aa, Heterodera glycines
  Homolog annotation: Hit_ID=A35350; Match level="QueryCoverage=98%, HitCoverage=43%, E-value=3e-13, Identity=64%"; Hit description =protein kinase C inhibitor - bovine
  Gene Ontology: Mol. function=zinc ion binding; Cellular component =cytoskeleton; Biological process=signal transduction
  Coding regions on vcDNA: vcDNA=SeqID_90917; Strand=+; Position=2-166
TEAEKAHKAKPGGDTIFGKIIRKEMPSTILYEDDKVLTFKDIDPEAPINVTVIPK

SEQ ID NO: 164495 - protein, 71 aa, Heterodera glycines
  Coding regions on vcDNA: vcDNA=SeqID_90918; Strand=+; Position=73-288
GHQTRDAPNKGRTLISGEGRMIRDKGKHYAKKGKHAKSINLINYFVAIQQYLYLNFISNVNYVTNKMNVNT

SEQ ID NO: 164496 - protein, 63 aa, Heterodera glycines
  Homolog annotation: Hit_ID=CAG01827.1; Match level="QueryCoverage =90%, HitCoverage=9%, E-value=2e-15, Identity=61%"; Hit description =unnamed protein product [Tetraodon nigroviridis]
  Gene Ontology: Mol. function=protein phosphatase type 2A, intrinsic regulator activity; Cellular component=nucleus; Biological process =signal transduction
  Coding regions on vcDNA: vcDNA=SeqID_90919; Strand=+; Position=1-192
RVFSPSHHSGTEFDPEEDDPVLEPSWPHLQLVYDFLLRFVESADFDCRIAEKFVDHKFIVNVK

SEQ ID NO: 164497 - protein, 209 aa, Heterodera glycines
  Coding regions on vcDNA: vcDNA=SeqID_90920; Strand=+; Position=6-632
MEEYEASSVRQRAKIEERDGKRAKANAQKAPKNGEKSLQIGWIVCFVLFTFAIGILLMYQSRETPTNYQKEVNRECDEGTGQCIAIADYTRDSGKTWHRGIFYVNETTFDFEKMLEKKIGAEAILKCPANADAPEGCVPDHGRLSWPYVATMAIMPFVVGTLHHPTQMQQRTQSALVIGMGGGTLDMFLHRKTPSLNITIYELDPMVVQ

SEQ ID NO: 164498 - protein, 149 aa, Heterodera glycines
  Coding regions on vcDNA: vcDNA=SeqID_90921; Strand=+; Position=96-545
SPNSADVCPNHSSSLRAFRLLRSRRSLSAFAVRLSSPSHAKAAPNCRLNAKTAVSPAPQTLDNRRRGKPKANNGATTAAGNGRIGNHRQHRRQWGRTMNEKGRNSECVTSLFTTIERRFNYEKPRSRRAPSHMRNGSGGTSDCASKHRK

SEQ ID NO: 164499 - protein, 207 aa, Heterodera glycines
  Homolog annotation: Hit_ID=CAA74206.1; Match level="QueryCoverage =85%, HitCoverage=53%, E-value=9e-36, Identity=45%"; Hit description =serine proteinase [Heterodera glycines]
  Coding regions on vcDNA: vcDNA=SeqID_90922; Strand=+; Position=21-641
MLANLSLPMVLLAFYSINSKLLIVSCQQSSNFSECGISDFEPQLANVSKMAIGTNHVYKGQEVGDDKALPWIARLIFGKSYCSGTIVGPRHILTALHCTEHNVAENQIVIAYGSANLKQQQQLTGVAAVKLHPKGTDTQRNQINDAKADKNVIIKAQGLQPNPYDMAIIELKNPLAFTANARPICLMEYGTNDQSTFVVAGWGRTSP

SEQ ID NO: 164500 - protein, 112 aa, Heterodera glycines
  Homolog annotation: Hit_ID=CAE68065.1; Match level="QueryCoverage =84%, HitCoverage=12%, E-value=1e-12, Identity=41%"; Hit description =Hypothetical protein CBG13687 [Caenorhabditis briggsae]
  Coding regions on vcDNA: vcDNA=SeqID_90923; Strand=+; Position=14-349
MPSSSANRPHSWTSWRHRTDNRPAIILMLYCIVDLDVCLIPLEMNCYGGSGQGFTSWILFRLTLLLMARMTCALTTAMYSGHRVETFRSLECPPRMVITHTIIIPEYPSKSL

SEQ ID NO: 164501 - protein, 203 aa, Heterodera glycines
  Homolog annotation: Hit_ID=NP_505879.1; Match level="QueryCoverage =89%, HitCoverage=89%, E-value=2e-72, Identity=71%"; Hit description =emp24/gp25L/p24 family (23.7 kD) (5L804) [Caenorhabditis elegans] emb|CAA98480.1| Hypothetical protein F4
  Gene Ontology: Cellular component=integral to plasma membrane; Biological process=ER to Golgi transport
  Coding regions on vcDNA: vcDNA=SeqID_90924; Strand=+; Position=18-626
MCLSNSVIMLSRTWIVAICFYIFFGTILPFSEAIRFYVASNDKKCLKEEIHKNIVLTGEYELSDSVGHTTTVHVTDTRGHTLYKRENFPEARGKFAFTADEYDIFEICFQMHGPTHQQKLNREVHLVLKHGVEAKNYEDLAKAEKLKPLEVELRRLEDLSDSIVQDFAYMRQREEEMRDTNESTNSRVLYLSIFSMLCLLGLA

SEQ ID NO: 164502 - protein, 68 aa, Heterodera glycines
  Coding regions on vcDNA: vcDNA=SeqID_90925; Strand=+; Position=417-623
LNSIKRGALALSLAFIICHFSYVLIFITAITITGDGSVVKGYLSLLLYDQWALLWQKIVHHKTHCVGY

SEQ ID NO: 164503 - protein, 40 aa, Heterodera glycines
  Coding regions on vcDNA: vcDNA=SeqID_90926; Strand=-; Position=162-284
FFFFFFFLNERNIIDKNKYKLDFKKFESLSATSLLLSSSI

SEQ ID NO: 164504 - protein, 208 aa, Heterodera glycines
  Homolog annotation: Hit_ID=NP_504458.1; Match level="QueryCoverage =100%, HitCoverage=21%, E-value=2e-18, Identity=31%"; Hit description= tyrosine kinase receptor family member (101.6 kD) (5G9) [Caenorhabditis elegans] gb|AAC19210.1| Hypothet
  Coding regions on vcDNA: vcDNA=SeqID_90927; Strand=+; Position=3-626
NITFTPFKRIQKMQPNYYVALYGNGKEPQNSAKNYRLLNPTVDLIDIIGEETNCAEFTTDKSCKRIKNDNSIILDGLVRNKLYGVLLCSVIDPHNTNYPVNDTKQYSKPLVYRLFLQARESVLNGSMENVNKERENYIFWIVGGSGILCAFLLILIVTIFFAYCRQRDKNRKNQANMEHLRRNRDQRYTDFPARSREDQWELERRNLI

SEQ ID NO: 164505 - protein, 96 aa, Heterodera glycines
  Coding regions on vcDNA: vcDNA=SeqID_90928; Strand=-; Position=262-552
LFEYPKRTLEKIDFFVFGAVPPNRCAQIYGETESFGNSFPIVCTLILRWIFAPHNCLSTPNGHLKKSIFLFHKYFSEIALKRTKFYLQVNFSTLML

SEQ ID NO: 164506 - protein, 46 aa, Heterodera glycines
  Coding regions on vcDNA: vcDNA=SeqID_90929; Strand=+; Position=1-141
IWLTPTCIFYISTFCSLQFYIHCDCPLLSVKSIHSSLTIKHYSPLL

SEQ ID NO: 164507 - protein, 210 aa, Heterodera glycines
  Coding regions on vcDNA: vcDNA=SeqID_90930; Strand=+; Position=1-630
QALVCRGIASAPLAIGCPSGKSFDPKTLNCIAAPEQCAVLASAQRPIRQLLLHLYCSKAHPPKKDIPNDEDGIRMRSEGDEPSQQQKPAIVQVSSDAQQNRCRNWYVVCESVEEPELVFCDNGKMFDLSKRICRRILPGDRCPFNGVCRGWEWRMSPVGECRRDFLFCNGIRPQLFQCEKEQEVFRDGECTAASSACDVCQPGESKRSTD

SEQ ID NO: 164508 - protein, 210 aa, Heterodera glycines
  misc_feature (196)..(196): Xaa can be any naturally occurring amino acid
  Homolog annotation: Hit_ID=NP_502390.2; Match level="QueryCoverage =94%, HitCoverage=20%, E-value=2e-40, Identity=44%"; Hit description =high Incidence of Males due to increased X chromosome loss HIM-6, human BLooM syndrome related, RecQ heli
  Gene Ontology: Mol. function=ATP dependent DNA helicase activity; Cellular component=chromatin; Biological process=DNA replication
  Coding regions on vcDNA: vcDNA=SeqID_90931; Strand=+; Position=3-632
NAVQDLRLKIFHILRNKFGINNFKHKQEQAIAAAMLGFDAFVRMPTGGGKSLCFQIPALEDRGVTVVISPLISLIRDQTMKLRNGTTTIPCAVFDAERMARDVYINRIPTFKLLYVTPERAVKNRQFLKYLRYLHRMNLLARFVVDEAHCVTQWGNSFRPDFLQLGDLMKKFRENAEKKVPIMALTASTSESDCRXAFEYLGMDCESALW

SEQ ID NO: 164509 - protein, 211 aa, Heterodera glycines
  Homolog annotation: Hit_ID=EAL32124.1; Match level="QueryCoverage =99%, HitCoverage=37%, E-value=5e-26, Identity=32%"; Hit description =GA22166-PA [Drosophila pseudoobscura]
  Coding regions on vcDNA: vcDNA=SeqID_90932; Strand=+; Position=3-635
PIHSHIVQAVLTMLEKGLNPADISQLHQAYSDASNSPPPPMELIRHNAFLDLLIDALFSANGQRIHAEHRPKYIFLLAFSCSVAEVRGEQGERTRELGELREIEQQLEQLANILHSPEDILLSLEALLRLCQTPVVAVGILHYLKTLLLREDLLAEPSSLHFALIDQIARVHPNLHSRVFNLLCDLYDHQSNRNEVAEVVMERQRHVVERF

SEQ ID NO: 164510 - protein, 151 aa, Heterodera glycines
  Homolog annotation: Hit_ID=CAE75492.1; Match level="QueryCoverage =57%, HitCoverage=36%, E-value=1e-16, Identity=47%"; Hit description =Hypothetical protein CBG23496 [Caenorhabditis briggsae]
  Coding regions on vcDNA: vcDNA=SeqID_90933; Strand=+; Position=15-470
MGWAAAATGAMLLMSFTSITLLIERVQAKPSTPVGGPYSEHGSQCNETWRPNLIEPLQKCSSTQAKNECQKGYHCNGAGFCCPEKGTICRMETDSGHESKDEPYKHIRRYAYDVNLGGCTIFSYFGAGGNFNNFKKFYECKKFCDGIKKTK

SEQ ID NO: 164511 - protein, 57 aa, Heterodera glycines; identical to SEQ ID NO: 162506
  Coding regions on vcDNA: vcDNA=SeqID_90934; Strand=+; Position=86-259

SEQ ID NO: 164512 - protein, 204 aa, Heterodera glycines
  Coding regions on vcDNA: vcDNA=SeqID_90935; Strand=+; Position=25-636
MFFSYSILVSKNSNFAVIWKYMHDRHGIVKVSKRELLSIDIARACEDLQNYIPTGVLLKSELRDKMSLYLLAQLSYGITLVFQAHVNYLITDLESAIKSFARFPEENKREKTPRKSTGRKRRLAELDGVVEAVMAVPRGMEQEDMEEEDDEGAKRRRISAPRKASKLDLADPSAYVDQQLPAARDVNDQSMLMDESSRLDDMFM

SEQ ID NO: 164513 - protein, 117 aa, Heterodera glycines
  Coding regions on vcDNA: vcDNA=SeqID_90936; Strand=-; Position=85-438
RAFLIVPQFLLSVANLPWPTTFCCFALPKGHPKSESPIRPKLDEFGLAKPLIWSLQWAVVGNSFGHGNVAKVAKMAPVETEKAHEKVADKRKPKAHRNHSHAKDEKMQKQTKKIAIS

SEQ ID NO: 164514 - protein, 57 aa, Heterodera glycines
  Coding regions on vcDNA: vcDNA=SeqID_90937; Strand=-; Position=0-170
FFFFFFFFNSSFIRRKFTYKTVLGVISYRLLGWSERERGITRKFGHPMDEWPKWRNA

SEQ ID NO: 164515 - protein, 206 aa, Heterodera glycines
  Coding regions on vcDNA: vcDNA=SeqID_90938; Strand=+; Position=1-618
KELYPLYPSNSRVIDLRSKITPAPMSKTKQFFNELQRIAGSSPTKSSSSLHMKRAYESERWFSPRVDSDQADTSGPPRRSILTQSRLQLLSAQRGRETRKPYWRCPMPSARSIDTEITQPSLVDIIATPLARQGPIKPFRHREPETGRKTNSFAVDEDILTVEEKEKELMSKVQPLEAPKAGFLGTPPPLVDLFEFSDIIVRGPQL

SEQ ID NO: 164516 - protein, 45 aa, Heterodera glycines
  Coding regions on vcDNA: vcDNA=SeqID_90939; Strand=-; Position=1-135
LTKSVDETCQTFKVSSEGDYRCDFSGLLPCQTEQRKKAFQIGRNE

SEQ ID NO: 164517 - protein, 36 aa, Heterodera glycines
  Coding regions on vcDNA: vcDNA=SeqID_90940; Strand=-; Position=1-108
FGLILLPFWIKFSILHPPKFETFSTYFPIFSNHFWI

SEQ ID NO: 164518 - protein, 208 aa, Heterodera glycines
  Coding regions on vcDNA: vcDNA=SeqID_90941; Strand=+; Position=3-626
YWKFCLLFAMKETNSKNSESADICITDQPDNERREIAELFPNMDLTEVFAEYGHLSSEAIIGLILEKRHQIPLKGRKACSFFVGLSVWWPRWLGGRVVRKLLSSFGARVTGIPTDSLLDQLETESGDHPRRQSVKECMECSVCWETTTVDELCFCDGTTMTATSSSSAKLTTETHAFCRQCLERHARAAVEEMPLAKGGLGLRCMAAD

SEQ ID NO: 164519 - protein, 211 aa, Heterodera glycines
  Homolog annotation: Hit_ID=CAE68956.1; Match level="QueryCoverage =97%, HitCoverage=28%, E-value=5e-48, Identity=51%"; Hit description =Hypothetical protein CBG14936 [Caenorhabditis briggsae]
  Gene Ontology: Cellular component=nucleus; Biological process =cystoblast cell division
  Coding regions on vcDNA: vcDNA=SeqID_90942; Strand=+; Position=1-633
VDSDDEQGDTLAIGGPDSWYALALRDTGTVLKKDTGGTGKGKKQGKERDPNAPKRRRTKKPKLSSGPKLNTAQKIAAANLAGVLSDQLSVQNDKNDEATLASQEHVQIRGNDARHLLIQKLMRTNRSSVVVLRNMVTPEGIDEYLEDEIREECSKYGRVTDVVIVQEQETHSVKIFVRFAEPLQAEEARKAIDGRFFDGRTVAAQSYDQIL

SEQ ID NO: 164520 - protein, 197 aa, Heterodera glycines
  Homolog annotation: Hit_ID=CAE74400.1; Match level="QueryCoverage =38%, HitCoverage=24%, E-value=1e-15, Identity=45%"; Hit description =Hypothetical protein CBG22132 [Caenorhabditis briggsae]
  Coding regions on vcDNA: vcDNA=SeqID_90943; Strand=+; Position=36-626
MSKEFRRFDDVQLRLRSFDERMSKVGTLDVPPAQIVSSTVRPISAKSTNGDSAVLVPSTTMAPPFVSSTAATSVERHSAESSEEEETDKRHRKGKTPLRGNGGLSISAVWEGVKRMMGFTADCHNGGYKTIGGDCICPQFFEGRACERIVCANNGTRVRVAAFGGEEVCKCTHPQYISGKHCEVVHCQNGGRLLNDG

SEQ ID NO: 164521 - protein, 51 aa, Heterodera glycines
  Coding regions on vcDNA: vcDNA=SeqID_90944; Strand=-; Position=2-154
FFFVANLYMHAHASNTSSTDLRAILTQFTVLATNFAHHTQLVLIGHRQLRF

SEQ ID NO: 164522 - protein, 189 aa, Heterodera glycines
  Homolog annotation: Hit_ID=CAE57406.1; Match level="QueryCoverage =64%, HitCoverage=15%, E-value=9e-36, Identity=61%"; Hit description =Hypothetical protein CBG00360 [Caenorhabditis briggsae]
  Gene Ontology: Cellular component=mitochondrion; Biological process =embryogenesis and morphogenesis
  Coding regions on vcDNA: vcDNA=SeqID_90945; Strand=+; Position=1-570
KERKYAQTILQVRKSGNRLLCSLLIGNVCVNSAISILFDDLTNGTIAMIVSTTGIVVFGGIFPQALCVKKGLAVGACTIWVTRFFMMLTFIVSYPISLILDKLLGEQVESYDRERLIELIKQQKRVEKASRTGSNASTKSGGSGAGLYNGVQTSLAAVSSDEASRTGSKGSLKIKFTMHTDGSRVGEPT

SEQ ID NO: 164523 - protein, 203 aa, Heterodera glycines
  Coding regions on vcDNA: vcDNA=SeqID_90946; Strand=+; Position=18-626
MRSWTLTFIAAALLVGSQAQQAGFNVNGMVDTLLSRAEDHILPSIDIPDVSVSELFKVLFFNVKASLDVSKGWLLGPKSVRRFDDSKLTMEDQYTFSVDIPVGVNEINFGYNYKTKVAGISGPRGNFTATVGATAVTVRASVTIYDEFCYAKFESLDLTQLGNVTVSATGLGVANSIYSKMLTKFAESQRDKVQAQIAEDFEE

SEQ ID NO: 164524 - protein, 164 aa, Heterodera glycines
  Coding regions on vcDNA: vcDNA=SeqID_90947; Strand=+; Position=3-497
TMERECDFFAFYMDPSDCPKELLPPKFGGISMSISINRCKEVFRSIKRALQRDKLRSEITKLRLLSTFDFDEKSAQILLTQIERIRSTLPKVRSLNIELRAVEFNPNQDLYSNDDFADSNLIPSSASACSHVALFFLNWMRKMKMGDIEIDGCVRLDVDYHCGE

SEQ ID NO: 164525 - protein, 107 aa, Heterodera glycines
  Coding regions on vcDNA: vcDNA=SeqID_90948; Strand=+; Position=2-325
SLSALSSLPPVSLSLLIILSPSHSFSLSVSLCWSFSLSPSPKVINPSLRSLGSFSEAMLNFLQSLNQTFAQQQQKAPDDEAEEGEEMKEQLAEPTIDALVEERMKVN

SEQ ID NO: 164526 - protein, 209 aa, Heterodera glycines
  Homolog annotation: Hit_ID=CAE61759.1; Match level="QueryCoverage =100%, HitCoverage=39%, E-value=1e-84, Identity=73%"; Hit description= Hypothetical protein CBG05718 [Caenorhabditis briggsae]
  Gene Ontology: Mol. function=IMP dehydrogenase activity; Biological process=GTP biosynthesis
  Coding regions on vcDNA: vcDNA=SeqID_90949; Strand=+; Position=2-628
IDSSNGSSKFQVDLLRWIKSEFPEWPQVIAGNVVTMRQAKLLIENGADALRVGMGSGSICITQEVCAVGRAQGSAVYNVARFAKTFGVPVIADGGIRDVGYITKALALGASTVMMGGLLAGTNEAPGEYFWGPSGVRLKKYRGMGSLDAMEANECSQDRYFTCEDGNIKVAQGVTAAQRDRGSVFKFVPYILRGIQHGLQDIGVRSIAE

SEQ ID NO: 164527 - protein, 126 aa, Heterodera glycines
  Coding regions on vcDNA: vcDNA=SeqID_90950; Strand=-; Position=28-408
NIYQWEKQMRKKPILCINKDINNNNIKLWCFNPSLALFKAVQSVPRSLRTSALLSAFVGTEPIPVAEEAGDVFGELEEHRNLANNGNEFDERKGQIKEPNESDWKQRENGQSGTDWEENDEQTDLD

SEQ ID NO: 164528 - protein, 203 aa, Heterodera glycines
  Homolog annotation: Hit_ID=XP_394668.1; Match level="QueryCoverage =93%, HitCoverage=24%, E-value=6e-23, Identity=31%"; Hit description =similar to ENSANGP00000009739 [Apis mellifera]
  Coding regions on vcDNA: vcDNA=SeqID_90951; Strand=+; Position=3-614
SYQRDSDNAERQFRAALKLKGPNDDAELSTLANLGLALIFLSSGREAQFYELFDSLSPSRIPSQANSLRSAAHLIHGFHYFLHARHNECKKQLMDSIAISKEEDMARLQSIALLLLAKLLSSKDVLKAASEWATKSADVGLLLWANSVIRSVGDASDSKKAEEEICAKRRQFDTAREESARGNAHALLKWVDREMPSAATFRQ

SEQ ID NO: 164529 - protein, 191 aa, Heterodera glycines; identical to SEQ ID NO: 149086
  Coding regions on vcDNA: vcDNA=SeqID_90952; Strand=+; Position=34-606

SEQ ID NO: 164530 - protein, 177 aa, Heterodera glycines
  Coding regions on vcDNA: vcDNA=SeqID_90953; Strand=+; Position=3-536
LKPNKRNAKFLDSFLSDLLSVHSSIVSRQGDPGPVLQLFRLLLNDRQLQEIEENPDGYFEFTALCELPIKLSVGKGRPKVKTLAVSVLGSLLQLNKQSQMYRRVLRLLISLLDSPYASLREQAAEQLFEFFSCESDDSEHGTEMALKLLTETDWGRGREGLGENRRRISAILLANAR

SEQ ID NO: 164531 - protein, 183 aa, Heterodera glycines
  Homolog annotation: Hit_ID=NP_502244.1; Match level="QueryCoverage =97%, HitCoverage=28%, E-value=2e-22, Identity=35%"; Hit description =BTB domain containing (67.7 kD) (4M616C) [Caenorhabditis elegans] emb|CAB01179.1| Hypothetical protein F3
  Gene Ontology: Mol. function=protein binding
  Coding regions on vcDNA: vcDNA=SeqID_90954; Strand=+; Position=79-627
MSKPKTLVERMRLLFSTSNGADIQFLVGESDEKELIPAHKTILASASDVFEAMFRFDAGNTGRKTSSAMVPSPVVVPDVEADAFRTMLGFIYTDDLSGMDGDNLFDVLYAAKKYNIVGLVSAYLDFPIPSLPNVFFAFAQARFLEEKDFARRCMEYIEQNMDTLHQSDAFLEIGQSLLCEVLD

SEQ ID NO: 164532 - protein, 129 aa, Heterodera glycines
  Homolog annotation: Hit_ID=CAE59397.1; Match level="QueryCoverage =99%, HitCoverage=42%, E-value=2e-37, Identity=56%"; Hit description =Hypothetical protein CBG02760 [Caenorhabditis briggsae]
  Coding regions on vcDNA: vcDNA=SeqID_90955; Strand=+; Position=2-391
SLTKYVDTFIGVAGPNHGISLQLGALSVPGCLLSVLPVCNAQTGLYSGFCPAESAFLQDINRQQAYEGQNRFSIYSTRDQVVGHKVCGRVTSQLPGQHGEKVYDNADHDGAFLHSFPVQHAMVLNHALI

SEQ ID NO: 164533 - protein, 178 aa, Heterodera glycines
  Coding regions on vcDNA: vcDNA=SeqID_90956; Strand=+; Position=1-537
YKISPMPSIIITATFVAVVLFTCAFLDLCHALTCKSRSITEKNGRQPKDSVLCENGQDVCRAFFCVANHSLLFIQWDCATFSKKDKCPQKDGPNTANSVRVDHGLPQSDDWHCVCEFGQVGEEMGNEHISKMDPTEPTPMADSDVRASVSPLFVLSFLYWVILPLATALYRQLLTWAD

SEQ ID NO: 164534 - protein, 86 aa, Heterodera glycines
  Coding regions on vcDNA: vcDNA=SeqID_90957; Strand=+; Position=85-345
MKPTFNFNLFASVFLVLCVASFVLCEHKRAAAAEACNHPKSVGTGNLSLKRWWWDGRHCKQFTYKGQGGNTNNFPSKKLCDQVCKP

SEQ ID NO: 164535 - protein, 95 aa, Heterodera glycines
  Coding regions on vcDNA: vcDNA=SeqID_90958; Strand=+; Position=4-291
INCGAEAGARRYVDLMALIEFVFNSGARHRELLTYGSNVLDPQFDLVMPPVLAPKCPPKDPSNCTNCCPIKRNLKITIIYRIYPYSFDYPISFIL

SEQ ID NO: 164536 - protein, 199 aa, Heterodera glycines
  Homolog annotation: Hit_ID=NP_502959.1; Match level="QueryCoverage =100%, HitCoverage=95%, E-value=2e-93, Identity=85%"; Hit description= small GTP-binding protein RHO RHO-1, small GTP-binding protein RHO, guanine nucleotide regulatory protei
  Gene Ontology: Mol. function=ATP binding; Cellular component=cytosol; Biological process=cell-matrix adhesion
  Coding regions on vcDNA: vcDNA=SeqID_90959; Strand=+; Position=33-629
MSAIRKKLVIVGDGACGKTCLLIVFSKDQFPDVYVPTVFENYVADIEVDGKQVELALWDTAGQEDYDRLRPLSYPDTDVILMCFSIDSPDSLDNIPEKWTPEVSDWAELSRPYFTLKVRHFCPNVPIILVGNKKDLRNDQQTIRDLSRNKQEPVKSEQGKAIAEQIGAYAYLECSAKTKEGIREVFEKATQAALQQKKK

SEQ ID NO: 164537 - protein, 78 aa, Heterodera glycines
  Coding regions on vcDNA: vcDNA=SeqID_90960; Strand=-; Position=107-343
LCVLVSVFIFVNILCLYKLLLQLINQTNQLAEQTICRIGYILFIISEYSSSSTKLSSVHSSPIIIISSNTISCFFSSN

SEQ ID NO: 164538 - protein, 77 aa, Heterodera glycines
  Coding regions on vcDNA: vcDNA=SeqID_90961; Strand=+; Position=98-331
CALFSQGNPREKKSFPINLNIPFILFVFWTIGPRKASIINNYKANLTNHRFHPFFKMSFTLRHVKMLMMIICFSSDK

SEQ ID NO: 164539 - protein, 96 aa, Heterodera glycines
  Homolog annotation: Hit_ID=EAL27616.1; Match level="QueryCoverage =98%, HitCoverage=84%, E-value=5e-18, Identity=48%"; Hit description =GA11196-PA [Drosophila pseudoobscura]
  Coding regions on vcDNA: vcDNA=SeqID_90962; Strand=+; Position=2-289
CELAWRNNYRMLELSRTCQAAVISITCVIMRLTGTLGFLFYFRCVFLQAFVWQYKTGFRWSAFFTSRSLFLTHSVVSGLFTYVLFWVYVYGLVHVY

SEQ ID NO: 164540 - protein, 68 aa, Heterodera glycines
  Coding regions on vcDNA: vcDNA=SeqID_90963; Strand=-; Position=3-206
RQQSQRINILLLYLDIIRMFSLSLSFGFNSLIKRKTESRDGSKTTGKWAGVGGGVHSIHSFLTLGIRF

SEQ ID NO: 164541 - protein, 120 aa, Heterodera glycines
  Homolog annotation: Hit_ID=NP_496289.2; Match level="QueryCoverage =98%, HitCoverage=97%, E-value=2e-36, Identity=60%"; Hit description =TBP-Associated transcription Factor family member (14.3 kD) (taf-13) [Caenorhabditis elegans] emb|CAA9011
  Gene Ontology: Mol. function=general RNA polymerase II transcription factor activity; Cellular component=transcription factor TFIID complex; Biological process=regulation of transcription, DNA -dependent
  Coding regions on vcDNA: vcDNA=SeqID_90964; Strand=+; Position=16-378
MIDESCLFDSEEEDEEAKKKTPEERKYLFRKELRSMLFGFGDERNPNDDTLEALEQIVVEYVKEVCRKALEVGKPNRVNLEDIHYLIRRDQKKFSRVKELLSLSEELKKARKAFDDAKDL

SEQ ID NO: 164542 - protein, 141 aa, Heterodera glycines
  misc_feature (61)..(61): Xaa can be any naturally occurring amino acid
  misc_feature (83)..(83): Xaa can be any naturally occurring amino acid
  misc_feature (98)..(98): Xaa can be any naturally occurring amino acid
  Homolog annotation: Hit_ID=ZP_00195689.2; Match level="QueryCoverage =100%, HitCoverage=61%, E-value=6e-37, Identity=57%"; Hit description= COG1926: Predicted phosphoribosyltransferases [Mesorhizobium sp. BNC1]
  Coding regions on vcDNA: vcDNA=SeqID_90965; Strand=+; Position=2-424
RKDAGQKLAKALAHILPQRDNIVVLALPRGGVAVACEVADAFQAPLDLLMVRKIGAPGHEXYGIGAVVEGNPPELAINDEARXITRPSEAYVPKTNAXNQLEEKDRRPITYLGDKPPVSLEGRIAIVVDDGVATGGTARVA

SEQ ID NO: 164543 - protein, 133 aa, Heterodera glycines
  misc_feature (63)..(63): Xaa can be any naturally occurring amino acid
  Homolog annotation: Hit_ID=XP_421260.1; Match level="QueryCoverage =99%, HitCoverage=24%, E-value=1e-22, Identity=43%"; Hit description =PREDICTED: similar to methylmalonate semialdehyde dehydrogenase gene [Gallus gallus]
  Gene Ontology: Mol. function=methylmalonate-semialdehyde dehydrogenase (acylating) activity; Cellular component =mitochondrion; Biological process=pyrimidine nucleotide metabolism
  Coding regions on vcDNA: vcDNA=SeqID_90966; Strand=+; Position=2-400
TEIAGLKPEMLCHTEHILGHALCVLHSKTLDQSLELIHPSPLSRNGTALFTPSGIAPRRLLAXSDVRRAGLHVPIPGPRPMYSFPRSRASSPGHADYYGKAGHNSYTQPRNVTHLRRSEDASTATRPHLSLPQ

SEQ ID NO: 164544 - protein, 111 aa, Heterodera glycines
  Coding regions on vcDNA: vcDNA=SeqID_90967; Strand=+; Position=39-374
MGVDSADDDSVPDPIVIKQGESLSLSQLVQKIEHLQNRTVQELTATLRRRTYKMPVGPPDPNGDRFFQNGHLLVEDVVYKVARKTRNSIHGIVQLHAYMGIPLLDEVNYHF

SEQ ID NO: 164545 - protein, 145 aa, Heterodera glycines
  Coding regions on vcDNA: vcDNA=SeqID_90968; Strand=-; Position=28-465
FFFFFFFFFFFFFSINFFIFNNFLFHFCRQNFVQPGFSLSFFNPFICFFRFCLRIHAQVGGCWPSSKSLSAFNVSSWHSIFFCAGKQSRREEPIGSSVKHLSWFSMPKYFGGNAATPPTHLSTQPMSKRTQKTNGKLKKDFIFYQ

SEQ ID NO: 164546 - protein, 68 aa, Heterodera glycines
  Homolog annotation: Hit_ID=CAE68266.1; Match level="QueryCoverage =100%, HitCoverage=64%, E-value=6e-24, Identity=70%"; Hit description= Hypothetical protein CBG13943 [Caenorhabditis briggsae]
  Gene Ontology: Mol. function=DNA-directed RNA polymerase activity; Cellular component=DNA-directed RNA polymerase III complex; Biological process=transcription from Pol III promoter
  Coding regions on vcDNA: vcDNA=SeqID_90969; Strand=+; Position=2-208
TSRIYSKKKEDEKIIGGTEMWENAQVTNERCPSCSHDKAYFQQIQTRSADEPMTIFYRCANCGHRWKE

SEQ ID NO: 164547 - protein, 171 aa, Heterodera glycines
  Homolog annotation: Hit_ID=AAH68925.1; Match level="QueryCoverage =76%, HitCoverage=20%, E-value=2e-17, Identity=36%"; Hit description =MGC83166 protein [Xenopus laevis]
  Gene Ontology: Mol. function=protein binding; Cellular component =cytoplasm; Biological process=regulation of transcription, DNA -dependent
  Coding regions on vcDNA: vcDNA=SeqID_90970; Strand=+; Position=83-595
MTSFASQNSVSLAVQNALHQILTLPLPSPQVPAAQNEQSRREEEDEASAQMDFWTAASLNTENIRDYNFEDEINVKNAAGWTPLMYAAYLGHRELCQLLVLRGADVEAANERNQTGIMLAASCGAIDVVRILLDFSADCNRQDQYGRSSLHYAVKYYHAPVVQLLLENGAD

SEQ ID NO: 164548 - protein, 197 aa, Heterodera glycines
  Homolog annotation: Hit_ID=NP_493277.1; Match level="QueryCoverage =44%, HitCoverage=65%, E-value=4e-13, Identity=45%"; Hit description =RNA-binding S4 (1N575) [Caenorhabditis elegans] emb|CAB54199.1| Hypothetical protein C47B2.9 [Caenorhabdi
  Coding regions on vcDNA: vcDNA=SeqID_90971; Strand=+; Position=29-619
MKFVTSFARRWPLSLSVAASFGRVGATRAASTLTIRDALNQQQCLNPSPLIAPIDRRRFATVKKKRQWNRTAQQSEDEEDDEAEEEEEEEEDEEDEGMPTDCRNKEFTMLSRRLDTVVGVALKTSISALGNWILQGRVRVNETVVIKKAHEIEQGDLVEVWDAPYEENARLATVHRLRIVRCRFDQRKGYVIKTKCW

SEQ ID NO: 164549 - protein, 78 aa, Heterodera glycines
  Homolog annotation: Hit_ID=CAE68136.1; Match level="QueryCoverage =91%, HitCoverage=10%, E-value=3e-25, Identity=74%"; Hit description =Hypothetical protein CBG13784 [Caenorhabditis briggsae]
  Gene Ontology: Biological process=reproduction
  Coding regions on vcDNA: vcDNA=SeqID_90972; Strand=-; Position=34-321
SNQATVFLPGYNIVGDGTPQAFIPILTAQTEEELPLTRKRYRSASFVDEVYPFAWRNFSAAGYATMYGEDGHDFGELL

SEQ ID NO: 164550 - protein, 194 aa, Heterodera glycines
  Homolog annotation: Hit_ID=NP_777085.1; Match level="QueryCoverage =88%, HitCoverage=56%, E-value=5e-35, Identity=47%"; Hit description =solute carrier family 25 member 6 [Bos taurus] pir||B43646 ADP,ATP carrier protein T2 - bovine sp|P32007|
  Gene Ontology: Mol. function=adenine transporter activity; Cellular component=integral to plasma membrane; Biological process=transport
  Coding regions on vcDNA: vcDNA=SeqID_90973; Strand=+; Position=46-627
MSTVPSTSSVIGTQLSDFNQHALKGMAAGAFAAAISKTTVAPMDRVKLCLQLQNAAVSTPHMPVVRLPSAHSLPYRGIVDCLRRLCADEGIRSLWRGNSAAVIRCFPHNALNLAFRDWFRVAFLDGIERRKRPIRFVAGNVAAGGAGAALTLVFCYPLDLARTRLAVDGGVHRGLFHCFSVIRSREGTAGLYRG

SEQ ID NO: 164551 - protein, 143 aa, Heterodera glycines
  Homolog annotation: Hit_ID=CAE60838.1; Match level="QueryCoverage =86%, HitCoverage=97%, E-value=6e-11, Identity=31%"; Hit description =Hypothetical protein CBG04547 [Caenorhabditis briggsae]
  Coding regions on vcDNA: vcDNA=SeqID_90974; Strand=+; Position=43-474
MLSSHHRESLLLQYGRSQVLYSDEFCKLTDEILIIKKFFFGTLRPKVVLLKDIRVVYFDEQKNQQKKYAHRRVWGRAPNSLYWAADFKRCLPGVDKCNRSDVIIDMEDGLLKGFTVADAQSFLSVIRLFAPMSTIIVDNLDIA

SEQ ID NO: 164552 - protein, 133 aa, Heterodera glycines
  misc_feature (84)..(84): Xaa can be any naturally occurring amino acid
  misc_feature (93)..(93): Xaa can be any naturally occurring amino acid
  Homolog annotation: Hit_ID=CAB88203.1; Match level="QueryCoverage =100%, HitCoverage=44%, E-value=2e-25, Identity=45%"; Hit description= putative cuticular collagen [Globodera pallida]
  Coding regions on vcDNA: vcDNA=SeqID_90975; Strand=+; Position=2-400
ASVCFLPPIVGTVVTLECLYSGMSRMNRLGRQRADAFRVNSDSACTDLIYVHVGLTPALRPRANPYNSIFHAFHLRPRHCLCTXPRRYQLIPXPPGKTRTSGQLSLPGGSRLLGQTWRTARPDPPCPLSKITC

SEQ ID NO: 164553 - protein, 158 aa, Heterodera glycines
  Homolog annotation: Hit_ID=NP_741469.1; Match level="QueryCoverage =100%, HitCoverage=50%, E-value=3e-56, Identity=60%"; Hit description= mp-dependent protein kinase (4J301) [Caenorhabditis elegans] gb|AAM75370.1| Hypothetical protein C09G4.2
  Gene Ontology: Mol. function=cAMP-dependent protein kinase, intrinsic regulator activity; Cellular component=cAMP-dependent protein kinase complex; Biological process=signal transduction
  Coding regions on vcDNA: vcDNA=SeqID_90976; Strand=+; Position=1-477
GSRAWTFCGTAEYVAPEVILNKGQDSAVDLWSLGIFMFELLSGSPPFASTDPMHTYNAILRGVQLLAWPRYMGDNARNLICKFCRRDPTQRLGYARIEDVRQDIWFKNFDFASFRNHSMRPPIRPKVRSLTDTQNFDRYPSTDNFACGSDESGWDDDF

SEQ ID NO: 164554 - protein, 194 aa, Heterodera glycines
  Homolog annotation: Hit_ID=CAE60247.1; Match level="QueryCoverage =96%, HitCoverage=21%, E-value=1e-37, Identity=43%"; Hit description =Hypothetical protein CBG03821 [Caenorhabditis briggsae]
  Gene Ontology: Mol. function=translation initiation factor activity; Cellular component=eukaryotic translation initiation factor 3 complex; Biological process=regulation of translational initiation
  Coding regions on vcDNA: vcDNA=SeqID_90977; Strand=+; Position=42-623
MSKFFRGAISSSESSESEESADEQIVQTRTIARDFAYPSDSEDEGPKRIVRTQKDKTYAELKEQIRSSRNARNIKDIAKLQTVFEAQLKLWEKAKTFIVRENLSIPRFYIRYLAELEDFINEQWEDKEGRKIMSKANSKALASLRQKLKKYNKDFEEDLGTYRTEPDPMGYSSGAAEDDEDEEIPTAPAIATND

SEQ ID NO: 164555 - protein, 132 aa, Heterodera glycines
  Coding regions on vcDNA: vcDNA=SeqID_90978; Strand=+; Position=3-401
LSNPFRLFFLRNKQMPSLLLLPTFCFFAFAVVVAHSQMTFSDGWGKRSAVAPFALLADRHMAGNKRHEKPRAAANLFISPTDEDALAMSPAMEACQVGYAQRLMQLHEQMLTLFSTYQQCQTKATMMETKKA

SEQ ID NO: 164556 - protein, 174 aa, Heterodera glycines
  Homolog annotation: Hit_ID=NP_510233.1; Match level="QueryCoverage =94%, HitCoverage=32%, E-value=4e-37, Identity=46%"; Hit description =cytochrome P450 family member (58.3 kD) (XO26) [Caenorhabditis elegans] emb|CAB54200.1| Hypothetical prot
  Gene Ontology: Mol. function=oxidoreductase activity; Biological process=epoxygenase P450 pathway
  Coding regions on vcDNA: vcDNA=SeqID_90979; Strand=+; Position=3-527
DVQLRAQEEIDTVCSSENPTYEELSQLKYMEAVIKETLRLVPVAATVVTRVCSQTTTLGQILVEKGTGVTIDLYTFHRNKELWGDDADEFRPERWLDIDPPPASAYYYAFGGGPRICIGMRFALLEEKMALVRLLRRYSLAKNEQTEKLLKVNSQVVLNPGAVMVQLNLREENF

SEQ ID NO: 164557 - protein, 88 aa, Heterodera glycines
  Coding regions on vcDNA: vcDNA=SeqID_90980; Strand=+; Position=2-265
QLSLKCSYGKLEFEKNSCVESSYYMRNPFEPPNFHKSHRDYSLDDFVIVGSRCFICEQHICVDEQRSLFYRHTFWLRCVWRERHTFPS

SEQ ID NO: 164558 - protein, 196 aa, Heterodera glycines
  misc_feature (163)..(163): Xaa can be any naturally occurring amino acid
  Homolog annotation: Hit_ID=NP_502575.1; Match level="QueryCoverage =96%, HitCoverage=80%, E-value=2e-62, Identity=62%"; Hit description =putative protein of eukaryotic origin (26.5 kD) (4O146) [Caenorhabditis elegans] emb|CAB60598.1| Hypothet
  Gene Ontology: Cellular component=membrane
  Coding regions on vcDNA: vcDNA=SeqID_90981; Strand=+; Position=2-589
TNLLLDPAIRTWVFVPIVLITFLVGIVRHYMFLLLVTKKSADLHSVPDSHCLLKARLLRENGRFLPADSFAQLRWLLCDKQHGHLVKRQDKHNTQTNPMMDPSTMTEMVQGNMLNMVPMLVICGWINWTFSSFITTRMPFPLTLRFEPMLHRGVYLQTLDTSXGSSASWYFLNVFRLLSVYALVLGSENQVYMMDE

SEQ ID NO: 164559 - protein, 129 aa, Heterodera glycines
  Coding regions on vcDNA: vcDNA=SeqID_90982; Strand=+; Position=38-427
MYGNNLFPLVKRKQTNAELEALKKLKLNSPRMKFRFRLEAFRFALYVFWPITIVWIFNSPFFQQKSEEFIQRFGRQFGITEEFIRSNSQRMKEFKQQVTEGKQREEYAKLLHEQMEFESARRFREKYGL

SEQ ID NO: 164560 - protein, 85 aa, Heterodera glycines
  Coding regions on vcDNA: vcDNA=SeqID_90983; Strand=+; Position=59-316
FLQIKNCLTTNGYLSEEEMRKKGQIMGELTKIIKEWVRGKLGIEIENSNLRIPRGIVNQNFLQYEIPLDNPASPEVKFAGISAGL

SEQ ID NO: 164561 - protein, 195 aa, Heterodera glycines
  Homolog annotation: Hit_ID=CAE59704.1; Match level="QueryCoverage =98%, HitCoverage=57%, E-value=2e-78, Identity=77%"; Hit description =Hypothetical protein CBG03136 [Caenorhabditis briggsae]
  Gene Ontology: Mol. function=L-lactate dehydrogenase activity; Cellular component=cytosol; Biological process=carbohydrate metabolism
  Coding regions on vcDNA: vcDNA=SeqID_90984; Strand=+; Position=3-587
KVTIVCVGQVGMACAYSILQQNIASEITLCDVQKDKLLGEVMDLQHGVAFTRQGVVVNASIDGYSGTVGSKVFFITAGCRQREGESRLNLIKRNVEIFKGIVPELVRYSPDTIILVVSNPVDVLTYVTWKLSGLPRERVFGSGTNLDSARFRSLLSERLNIAPFNCHAYVIGEHGDSSVAVWSGMNVAGVSLSLL

SEQ ID NO: 164562 - protein, 56 aa, Heterodera glycines
  Coding regions on vcDNA: vcDNA=SeqID_90985; Strand=+; Position=3-170
ARAVVKWNSTSAVRHAISTMHAKKTTIFCFVQLCLVYFYNLQAQLKCAHQKKKKKK

SEQ ID NO: 164563 - protein, 134 aa, Heterodera glycines
  Homolog annotation: Hit_ID=NP_496963.1; Match level="QueryCoverage =93%, HitCoverage=20%, E-value=2e-35, Identity=57%"; Hit description =abnormal ACEtylcholinesterase ACE-3, acetylcholinesterase class C, glycolipid-anchored (68.8 kD) (ace-3)
  Gene Ontology: Mol. function=cholinesterase activity; Cellular component=synaptic junction; Biological process=synaptic transmission, cholinergic
  Coding regions on vcDNA: vcDNA=SeqID_90986; Strand=+; Position=3-407
IIASSLFLLVILFLLHITELFASLSSTHETNVPVIIDTPNGRLRGFESIFLHSRVSSFLGVPFAEQPIGDLRFRPPQPKRSWNGTIDAMTLSPTCYQGRDTYNESFWGSEMWNANTPISEDCLYMNIWAPVDAK

SEQ ID NO: 164564 - protein, 164 aa, Heterodera glycines
  Homolog annotation: Hit_ID=CAB58173.1; Match level="QueryCoverage =92%, HitCoverage=45%, E-value=6e-20, Identity=35%"; Hit description =putative nucleosome binding protein [Anisakis simplex]
  Gene Ontology: Mol. function=chaperone activity; Cellular component =cytoplasm; Biological process=nucleosome assembly
  Coding regions on vcDNA: vcDNA=SeqID_90987; Strand=+; Position=34-525
MTSTKNNSKLNELLQAGGYDASDGIDSLIPSHLKQLSRPVIRRVRMLKKIQAQSLEIESQFYKELHELEIMYQPLYDAVNAKRTAIVRGEMELTDADGELPPLVSELEPQTLEKLEENAPVEGGEPSKGIPGFWFNTLNMNASISDIIKEYDEPDPQGNLVDIT

SEQ ID NO: 164565 - protein, 208 aa, Heterodera glycines
  Coding regions on vcDNA: vcDNA=SeqID_90988; Strand=+; Position=15-638
FLMANTILQTLAFEHQKHLQLQQQQQMQQEDDGEFGAQQRKRKTSCRASIALNMEQKMRLIDYIHERPQIWDCNVEGFRSNQSRQSAFNEVAVLLSDDIETFSRIQIQEEWGKLRYCFTRIMKKLLEEGGGRTVDEGQLNTISWPYWKRMEFLLPGVRAQLAHQPTSTESECGNQEQGSPGKESNVSVTALPKVRRKRSVRKNSVAMA

SEQ ID NO: 164566 - protein, 109 aa, Heterodera glycines
  Coding regions on vcDNA: vcDNA=SeqID_90989; Strand=+; Position=304-630
PLHFSPSSELMMCGVAKTETNVQVAVVNVNSGVIGANGNGVLLAERETNSRNGADFTPNFDNTHQGNLLPSSFSACGASTPSTLLSMPFECSHDLDTNSLQALHHDDDE

SEQ ID NO: 164567 - protein, 40 aa, Heterodera glycines
  Coding regions on vcDNA: vcDNA=SeqID_90990; Strand=-; Position=2-121
FFFFFFFQFNVYPFYYKFVVNRLNGKITEHAQGMVSKIDG

SEQ ID NO: 164568 - protein, 98 aa, Heterodera glycines
  Coding regions on vcDNA: vcDNA=SeqID_90991; Strand=+; Position=274-570
NFRIRKRKFFVGRKRNTKTKKNNSFCTKRKRKHEKILLISAIIKKHKTLNCITKLKKLKSKIFWKRVKMNKSRILSKVIIRKNRSKIRRIGPDWHFQK

SEQ ID NO: 164569 - protein, 129 aa, Heterodera glycines
  Homolog annotation: Hit_ID=CAE66361.1; Match level="QueryCoverage =100%, HitCoverage=19%, E-value=2e-29, Identity=53%"; Hit description= Hypothetical protein CBG11618 [Caenorhabditis briggsae]
  Gene Ontology: Mol. function=Ras interactor activity; Biological process=endocytosis
  Coding regions on vcDNA: vcDNA=SeqID_90992; Strand=+; Position=242-628
YVEDLSKDDQTLFEAALHQFIECTLLSKEKDPYVVIRRVRQFITGMKNYLMKIGEADLHPIIKRERSRLNIDEFLNIDAILEEVLVKILLSKLKAHLYRLMILESTSNGELRRLSENIAQVRAMSAAEL

SEQ ID NO: 164570 - protein, 70 aa, Heterodera glycines
  Coding regions on vcDNA: vcDNA=SeqID_90993; Strand=-; Position=27-239
ILTFKFFFGNFRYLGYITDPKLLVQALFSNFFMHQSSLRLDGVSLHSGWDPRRMVHQVFKKEYIRLHCIY

SEQ ID NO: 164571 - protein, 116 aa, Heterodera glycines
  Coding regions on vcDNA: vcDNA=SeqID_90994; Strand=-; Position=0-347
ILCDAKTTVFDMSASWKLVQFEFGVDFLRRVVGIVRFAVFATAPFSTNWNPFDSVGFVKQIFSRASITFRLFFLSFAEENIAKFPLQKCACPQHFGLSLRRFEGPVERFVQKWNAT

SEQ ID NO: 164572 - protein, 80 aa, Heterodera glycines
  Coding regions on vcDNA: vcDNA=SeqID_90995; Strand=-; Position=3-245
YLFFSSFLHFFVLFLPLASLRSFRLQFSLKSLSFSLRSLRLQFSLMSLSFSLRSLRLQFSLVSLCFSSSLSSSVLPNLPP

SEQ ID NO: 164573 - protein, 147 aa, Heterodera glycines
  Homolog annotation: Hit_ID=XP_419642.1; Match level="QueryCoverage =89%, HitCoverage=38%, E-value=1e-14, Identity=35%"; Hit description =PREDICTED: similar to hypothetical protein FLJ38968 [Gallus gallus]
  Coding regions on vcDNA: vcDNA=SeqID_90996; Strand=+; Position=3-446
ISTSAALHRELRNLSFRNPGYRCTLPEPSRAKRTVVISAQQPKTSSEPSADRRSMRKRTAKKDGSNSDVQTRSAKSKLRYNNKGRLVLPSRTEVDLCDCLDQKCNGCQYQCKKCGGNKCSYACRVNRTTFIEHIDTLGGGRTNNPFL

SEQ ID NO: 164574 - protein, 206 aa, Heterodera glycines
  Homolog annotation: Hit_ID=NP_491653.2; Match level="QueryCoverage =99%, HitCoverage=23%, E-value=1e-47, Identity=44%"; Hit description =periodic tryptophan protein 2 homolog (102.1 kD) (1G218) [Caenorhabditis elegans] gb|AAB37807.2| Hypothet
  Gene Ontology: Mol. function=signal transducer activity; Cellular component=cytoplasm; Biological process=signal transduction
  Coding regions on vcDNA: vcDNA=SeqID_90997; Strand=+; Position=2-619
SVVGARFFDEYNLFCVDKIGSCSIWESSHRPEQIITRTKERKRMAIAELESERLSFARKKRVNLSKNANPTSSHSVELTAISLHKAKKFLVTAFNNGVFCIFELPELVLLQNFRISEVRINSVDINSAGGWLAIGCGQGSESQLLVWEWQSESYLLRQQSHRQNVTVAAYSPDGALLATGAEDGKVKIWDCSSSFCTVTFSDHGTG

SEQ ID NO: 164575 - protein, 212 aa, Heterodera glycines
  Coding regions on vcDNA: vcDNA=SeqID_90998; Strand=-; Position=0-635
SPFAAPHVFSAPIVCDGPTWSFGMPSFVRPSTRFRLHFPPPPAHCPPFAADSNSFSLAIFAPAVVSPFCGIFCAWPTTANKRRRRPIRSVEQRLAKFGAGRPPPGRGCPPLSLAFGCHFLGRRRRWNWHFRPRRCQVRCRGEQQQGTAGKCIVSRPDATPSHPWHFDDIRSQCAPILAPLRSVPKMRQSRSRATHFSHILLFLAFKKLQPQT

SEQ ID NO: 164576 - protein, 34 aa, Heterodera glycines
  Coding regions on vcDNA: vcDNA=SeqID_90999; Strand=-; Position=57-161
FFFFFFFKFMSKINCYHMCFVLSKAIFNLKNTKF

SEQ ID NO: 164577 - protein, 211 aa, Heterodera glycines
  misc_feature (164)..(164): Xaa can be any naturally occurring amino acid
  Homolog annotation: Hit_ID=AAC72366.2; Match level="QueryCoverage =100%, HitCoverage=18%, E-value=1e-111, Identity=93%"; Hit description=guanylyl cyclase [Heterodera glycines]
  Gene Ontology: Mol. function=protein tyrosine kinase activity; Cellular component=integral to membrane; Biological process=cell surface receptor linked signal transduction
  Coding regions on vcDNA: vcDNA=SeqID_91000; Strand=+; Position=1-634
EEKRKSDILLNRMLPRQVADKLKLGEAVEPESFQMATIFFSDVVSFTTLAGKCTPLQVVNLLNGLYTAFDGIIDTHDCYKIETIGDGYLVCSGIPKRNGDQHAKEIAELSFAFLRTVSNFRVDHLPSERVNLRIGFHSGPAVAGVVGLTMPRYCLFGDSVNTAXRMESNGKAGKIHISSRSNRFLTSVIGGYVTEPRGEVIIKSKGVMETF

SEQ ID NO: 164578 - protein, 151 aa, Heterodera glycines
  Coding regions on vcDNA: vcDNA=SeqID_91001; Strand=+; Position=44-499
FTICNGNGLSVTDLTLIPGPEESTEPRVYIPPEPPIPIIFITLPPSEGTISFPAIQMPTKKEGEKYLEGHIKRIAALLGMTPKEAEELKEGAQRMKKWIKNEIDSCINFIFPKKAKEEAARRTAEEERRKAAFWEEYRRERAAIAKEETMD

SEQ ID NO: 164579 - protein, 201 aa, Heterodera glycines
  Homolog annotation: Hit_ID=CAE75263.1; Match level="QueryCoverage =92%, HitCoverage=96%, E-value=4e-65, Identity=61%"; Hit description =Hypothetical protein CBG23226 [Caenorhabditis briggsae]
  Coding regions on vcDNA: vcDNA=SeqID_91002; Strand=+; Position=2-607
RFSSRQHSFSLLLLFAFLVILPPVCSRYEDRYNMNMLPWDLKPVQDFIGLWQMDRSSGNFKELPPPNLIDLAINPIPKFGARTMNITHTYLDSARNVIRSDYGFMPVKNATRRDPRVHVAYLTTSSEGWSMMEQGFFKDGKLIFHLKQFLKRSFGAGSNLDIREFERQFELSGFHSMTLKVRAETSFQTEAYTAWYTKILF

SEQ ID NO: 164580 - protein, 199 aa, Heterodera glycines
  Homolog annotation: Hit_ID=CAE67231.1; Match level="QueryCoverage =84%, HitCoverage=46%, E-value=2e-66, Identity=64%"; Hit description =Hypothetical protein CBG12670 [Caenorhabditis briggsae]
  Gene Ontology: Mol. function=NADH dehydrogenase (ubiquinone) activity; Cellular component=membrane fraction; Biological process =morphogenesis
  Coding regions on vcDNA: vcDNA=SeqID_91003; Strand=+; Position=20-616
MLRKTIKTLQPIYNARTAFRFQTGGYAAPGTEAQAQEVKKQTSTKYVIDEQKREKLTLFGQYVAACMPKFVQQVQFAGGDELEVLIHPTGVLPVMAFLKGHHSAQFTNFIFACGLDVPTLRTYTDEVAPIDSITPVFSGAEWYEREIYDMYGVWFNNHPDLRRILTDYGFEGHPQRKDFPLSGYVELRWDHELNRVIYE

SEQ ID NO: 164581 - protein, 83 aa, Heterodera glycines
  Coding regions on vcDNA: vcDNA=SeqID_91004; Strand=+; Position=378-626
LYRCLPSQFLLNRPSAFNVTMRQHNGVTTQLNRAEGTNKAGRELICTLEERIWKESETTNAGQSPSVDSPKSTKTRHFCQQRP

SEQ ID NO: 164582 - protein, 207 aa, Heterodera glycines
  Coding regions on vcDNA: vcDNA=SeqID_91005; Strand=+; Position=9-629
MMRLLLALAAIAASPAIGGLLDAGTVGNKFMVTYSIIPDPFHQFSFYSMPRTVSEAKKDSFSQVTSNDEDKTTVWCRKNDYRVCVLFDQQGSVAGIQVSIREAELTSKDSASFGGLSTLLTPEWRRQLFLGKDVWTATAYFVSKEVLLSGGRKMDKNTPTAPEGIFVQQVDIDNKETGRLAVSSTEAQATAAGFTEQACFYGMGKHY

SEQ ID NO: 164583 - protein, 122 aa, Heterodera glycines
  Coding regions on vcDNA: vcDNA=SeqID_91006; Strand=+; Position=123-491
TQFQFPPCNSQNNSRSVPSSPTTATSSPRRSTCSTFGKSASSTRSSSSASSSLSTRPSTTLRTTFSTESMACPSTSRPLAPCLMALERGLPRPFMTSCEQVARGYSRGLGRGFERGIVCGDS

SEQ ID NO: 164584 - protein, 36 aa, Heterodera glycines
  Coding regions on vcDNA: vcDNA=SeqID_91007; Strand=-; Position=2-112
FFFFFLKFLFVWDGRIRSFSQFLVDLFTYFVQKMAI

SEQ ID NO: 164585 - protein, 118 aa, Heterodera glycines
  Coding regions on vcDNA: vcDNA=SeqID_91008; Strand=-; Position=3-356
KAAQFVILHSFRPDLGRNKKQTKPKNNSKTAENCTPKKESEIKVSLGEGNAFFEHFQIILLDNQGRKLILFLKWNKTGKAFRAKKGREGWGAGLHENFKKNFVYENEKGHFDTKTKNK

SEQ ID NO: 164586 - protein, 96 aa, Heterodera glycines
  misc_feature (46)..(46): Xaa can be any naturally occurring amino acid
  Homolog annotation: Hit_ID=NP_492764.1; Match level="QueryCoverage =93%, HitCoverage=22%, E-value=4e-12, Identity=40%"; Hit description =ubiquitin conjugating enzyme (ubc-25) [Caenorhabditis elegans] pir||T21349 hypothetical protein F25H2.8 -
  Coding regions on vcDNA: vcDNA=SeqID_91009; Strand=+; Position=20-307
MENYPRERPIWFCESEDDTVLALHEKITGQVEEDPDHYLLHLLVSXLCSVHNVSISAELSAIAPPNACDERDEGNGSELDSAVDDDETEEDLEMED

SEQ ID NO: 164587 - protein, 80 aa, Heterodera glycines
  Coding regions on vcDNA: vcDNA=SeqID_91010; Strand=-; Position=35-277
HCAQMGICLLLLNGILGIENSESEEDKSMLWLCRCFNSKFVGPSERKRRRLLKFLFFFSHSDAFPFHSSLSFPPNFCFFT

SEQ ID NO: 164588 - protein, 205 aa, Heterodera glycines
  Homolog annotation: Hit_ID=CAE73555.1; Match level="QueryCoverage =99%, HitCoverage=55%, E-value=6e-82, Identity=69%"; Hit description =Hypothetical protein CBG21024 [Caenorhabditis briggsae]
  Gene Ontology: Mol. function=deoxyhypusine synthase activity; Biological process=positive regulation of cell proliferation
  Coding regions on vcDNA: vcDNA=SeqID_91011; Strand=+; Position=3-617
RRRRLTIFLGYTSNLVTSGLRETFRYLLEHDQVDCVVTSAGGVEEDIIKCLRPTYLGSFKMPGNELRAGGINRAGNLLIPNSNYCAFEEWLNPILDKCLEEQRLQGTRWTPSKLIARLGSEIGDKRSICYWAWHNRIPIFCPALTDGSLGDMLYFHSVKNGGDGIVLDIVEDLRYLNTMAVRSLRTGVIILGGGVVKHHINNANL

SEQ ID NO: 164589 - protein, 196 aa, Heterodera glycines
  Homolog annotation: Hit_ID=CAE61856.1; Match level="QueryCoverage =99%, HitCoverage=34%, E-value=2e-26, Identity=33%"; Hit description =Hypothetical protein CBG05834 [Caenorhabditis briggsae]
  Coding regions on vcDNA: vcDNA=SeqID_91012; Strand=+; Position=49-636
MDISFRPHDYLVLLAIPNSFALRAASELVKMLLDTAQFGFKGVTVVRQPTLVLYSYDVTTGVVVDLGERLSIVPVIDEFVVDDAVKMAHFGAPQIREQMLKGIGDNLQKVLDIFGNGSDDDDASIQLLLRYIVEKSCYVAADGIEEERAKGIKDELVEFVGQHSLKVNGELRFMAPAGLFRPQLWGLEMPALHRMV

SEQ ID NO: 164590 - protein, 138 aa, Heterodera glycines
  Homolog annotation: Hit_ID=NP_491489.1; Match level="QueryCoverage =99%, HitCoverage=22%, E-value=9e-30, Identity=47%"; Hit description =aminopeptidase -pro (69.3 kD) (1F534) [Caenorhabditis elegans] gb|AAB96739.1| Aminopeptidase p protein 1
  Gene Ontology: Mol. function=aminopeptidase activity
  Coding regions on vcDNA: vcDNA=SeqID_91013; Strand=+; Position=3-630
NFDHGVGHGVGHFLNVHEYPPYIGYRVQSKYNYLRKGVVVTIELGYYAQGSFGIRFENCYEGSGDAVSSSDSRKFAMFAPLTFVLVQKSLLVRELLDQHEIDWLNRYHNQCLEAVGRYLQEKSMQEEYNFLAEACTPF

SEQ ID NO: 164591 - protein, 119 aa, Heterodera glycines
  Homolog annotation: Hit_ID=NP_509822.2; Match level="QueryCoverage =96%, HitCoverage=99%, E-value=2e-39, Identity=63%"; Hit description =Acyl-coA-binding protein, ACBP family member (13.2 kD) (XL523) [Caenorhabditis elegans] emb|CAA91987.2| H
  Coding regions on vcDNA: vcDNA=SeqID_91014; Strand=+; Position=65-424
MPSLDERFNAAVEIVQKLPKEGPLQTSNDQKLKFYSLFKQATIGNVNTSRPGMFSLVEKAKWDAWKSVEGMSAEEAKEKYIETLLEKFDDAGTQVDISDWLSKIDPSIRTNLALLGKNL

SEQ ID NO: 164592 - protein, 50 aa, Heterodera glycines
  Coding regions on vcDNA: vcDNA=SeqID_91015; Strand=-; Position=260-412
FFFFFFFLKINFLLKNELMATQNNSSVPFCFGMFCSIFCCTISLCKLFSL

SEQ ID NO: 164593 - protein, 95 aa, Heterodera glycines
  Homolog annotation: Hit_ID=AAB02615.1; Match level="QueryCoverage =100%, HitCoverage=9%, E-value=4e-46, Identity=88%"; Hit description =Na,K-ATPase alpha subunit
  Gene Ontology: Mol. function=sodium/potassium-exchanging ATPase activity; Cellular component=sodium/potassium-exchanging ATPase complex; Biological process=neurotransmitter uptake
  Coding regions on vcDNA: vcDNA=SeqID_91016; Strand=+; Position=1-337
VQWADLIISKTRRNSIVQQGMSNWVLNIGLVFETLSAVFLCYCPGLDKGLRMYGLRFSWWFPALPFSILIFIYDEIRRFLIRRFPGGWVERETYY

SEQ ID NO: 164594 - protein, 26 aa, Heterodera glycines
  Coding regions on vcDNA: vcDNA=SeqID_91017; Strand=-; Position=37-117
FFFFFFFFFFLKIIRIYLYKFVLYNF

SEQ ID NO: 164595 - protein, 186 aa, Heterodera glycines
  Homolog annotation: Hit_ID=CAE67815.1; Match level="QueryCoverage =84%, HitCoverage=30%, E-value=3e-33, Identity=46%"; Hit description =Hypothetical protein CBG13395 [Caenorhabditis briggsae]
  Gene Ontology: Mol. function=glutathione synthase activity; Cellular component=intracellular; Biological process=neurogenesis
  Coding regions on vcDNA: vcDNA=SeqID_91018; Strand=+; Position=63-620
MSPSTNTDLVTPNYIAEIVGVNETVAPQQQLNLLVEDALDWAHCFGLVLRTTEHKDRSDVCQAAPFALFSSPFPRNLFDEAMAVQKDLNLLYFRISWDLEFLKEAHQHVIPSDAFTRKMLEILEDVHSGGVKQHITLLTQRADYMCHVTTIDDQTETARQQQFELKQIEVNNIAVSMGGLAQRASV

SEQ ID NO: 164596 - protein, 185 aa, Heterodera glycines
  Coding regions on vcDNA: vcDNA=SeqID_91019; Strand=+; Position=3-560
RFANLGAVLYILQRLHRLHPDGFTVAQYVQFENRQKRARPTSEGFFFNNTLPSVASLLESDDDLLRVDIKEEKFYVSEEVTLTHLFCLSKNLCSNLFRLLRRCSSNNAIRVQHLLEISSQLVPIGAPMPNSNALVDLCNRFPTIFKLRCSPQDNYRFDNSVIMLNEQLLDSENLAWRVVLDTDEF

SEQ ID NO: 164597 - protein, 48 aa, Heterodera glycines
  Coding regions on vcDNA: vcDNA=SeqID_91020; Strand=+; Position=184-330
LNHGYVPITESVAPLCVLYNEIDPPSNPSDCMYIIYPLIHHLILPMSE

SEQ ID NO: 164598 - protein, 159 aa, Heterodera glycines
  Coding regions on vcDNA: vcDNA=SeqID_91021; Strand=+; Position=78-557
MAVLAEAHHLRQHQKRLEERGIVLEDQNRQLQMQLERLQMLMAKKGNALQTLPTTEEQQSHNQPGFISSTDAEDTDMEMLALAMPIREIKAIGISSGQLGTEIRRNRMDRLRETVDELNRAMENFVVFTQNCAQKEQQQDTDDSGTADNHQQTVEELER

SEQ ID NO: 164599 - protein, 210 aa, Heterodera glycines
  Homolog annotation: Hit_ID=NP_501879.1; Match level="QueryCoverage =100%, HitCoverage=42%, E-value=4e-64, Identity=57%"; Hit description= lipopolysaccharide-binding protein like family member (4L13) [Caenorhabditis elegans] pir||T20482 hypoth
  Coding regions on vcDNA: vcDNA=SeqID_91022; Strand=+; Position=3-632
LIAHFKPTVEQRICQMIEGVINGDMNAVLATMPLKVRINEDNLDLIGRNFGISPDQSKNSEIKISKKLQAPRNFTLLNFVSQLRDRNLVLDFSLIDDPFVSQGTVLMKSHGEISYDGLGETPFAPPNVIIPQAQGVFMAEFFGTDFVANSMLYHAFKQKYMDVVVGPESSPQLKDVLLTTCSSGFCIGEYLGSLGQQFPGRQVEIQFSAK

SEQ ID NO: 164600 - protein, 122 aa, Heterodera glycines
  Coding regions on vcDNA: vcDNA=SeqID_91023; Strand=+; Position=261-626
EEKSAGPSNNRLPGEQSKILVYGKVELCRGYLFLTKENCQLLGGQKPTQCVPTVPLRQMSVQRNASGSSLIREGLNCDDTTEWQKPESRSIGEGPNCFDTTERQKPESRSIGEGPNCFHTKE

SEQ ID NO: 164601 - protein, 161 aa, Heterodera glycines
  Homolog annotation: Hit_ID=NP_594530.1; Match level="QueryCoverage =100%, HitCoverage=100%, E-value=4e-27, Identity=39%"; Hit description=tropomyosin [Schizosaccharomyces pombe] emb|CAA93291.2| cdc8 [Schizosaccharomyces pombe] sp|Q02088|TPM_
  Gene Ontology: Mol. function=actin lateral binding; Cellular component=contractile ring (sensu Saccharomyces); Biological process= actin filament-based process
  Coding regions on vcDNA: vcDNA=SeqID_91024; Strand=+; Position=75-560
MDKFKEKLNLLRAEADAANARADQAELQLKKVQEQLASKDNEVNSLNNKVALLQLDNERAEKRIDQVKTQNAAESDLKSQIDALNRKVSLLEKDLATAESALKVAQEKVRTLELSSEQFERKANNLEREKIELETKLDDISAKYAKTKQELEDTLKQLEEL

SEQ ID NO: 164602 - protein, 95 aa, Heterodera glycines
  Homolog annotation: Hit_ID=AAO33473.1; Match level="QueryCoverage =88%, HitCoverage=92%, E-value=5e-32, Identity=72%"; Hit description =gland-specific protein g4e02 [Heterodera glycines]
  Coding regions on vcDNA: vcDNA=SeqID_91025; Strand=+; Position=1-288
LLRPTVPFVSLSLFLLLFLFIAFPSTDGFGVERAVRDKRGWPWDWIGKQACKTAANCKCKDGKSWAKCVKSEGYAASNCCDKNYVWACCGKKPKH

SEQ ID NO: 164603 - protein, 73 aa, Heterodera glycines
  Coding regions on vcDNA: vcDNA=SeqID_91026; Strand=+; Position=124-345
LGPHVPNAKEKSNCVRIFMYNGKFALTCSVLFFSNCVRIFMYNGKFALTCSVLFHGVIINTIVTGLLPIIKLV

SEQ ID NO: 164604 - protein, 57 aa, Heterodera glycines
  misc_feature (41)..(41): Xaa can be any naturally occurring amino acid
  Homolog annotation: Hit_ID=NP_054998.1; Match level="QueryCoverage =84%, HitCoverage=88%, E-value=8e-15, Identity=83%"; Hit description =hypothetical protein SpolCp096 [Spinacia oleracea] ref|NP_054981.1| hypothetical protein SpolCp077 [Spina
  Coding regions on vcDNA: vcDNA=SeqID_91027; Strand=+; Position=2-175
NCQLLLSEIGLTTYSSHSTWFHKTVRFSRSKSSRFYMKKIXLGMFYSIRVGETVFFS

SEQ ID NO: 164605 - protein, 175 aa, Heterodera glycines
  Homolog annotation: Hit_ID=NP_496469.1; Match level="QueryCoverage =90%, HitCoverage=38%, E-value=7e-63, Identity=72%"; Hit description =DNaJ domain (prokaryotic heat shock protein) (45.0 kD) (dnj-13C) [Caenorhabditis elegans] emb|CAA91333.1|
  Gene Ontology: Mol. function=glutaryl-CoA dehydrogenase activity; Cellular component=mitochondrion; Biological process=regulation of transcription, DNA-dependent
  Coding regions on vcDNA: vcDNA=SeqID_91028; Strand=+; Position=105-629
MQASKNNNCVDSNFNFFDAFDLDSQLTEEERTLRDQAHAYCQEKLQPRVTQAFREEKFDPSLLPELGRMGFLGAPYKGYGCAGTSFVGYGLLARELERVDSGYRSIVSVQTSLVIGPIVTYGSEAQKEKFLPKLASGELIGAFGLTEPDHGSNPAGMETKAEWDEQQQLYRLSGS

SEQ ID NO: 164606 - protein, 207 aa, Heterodera glycines
  Homolog annotation: Hit_ID=CAE63259.1; Match level="QueryCoverage =81%, HitCoverage=58%, E-value=3e-35, Identity=45%"; Hit description =Hypothetical protein CBG07631 [Caenorhabditis briggsae]
  Gene Ontology: Biological process=cell organization and biogenesis
  Coding regions on vcDNA: vcDNA=SeqID_91029; Strand=+; Position=19-639
MSTNNHNDSYASTSIEGLTKQNNNCIQSARKFMVKMHTQDIIGIFIFFALPIGFLYAVTFPLSLSFDPFSKGWLVWVVPCSLLGLNVYLNALMMFKVGPNSQRNVLPSVVKRDFHFCHLCQSNSPPRSFHCPVCNFCVFRRDHHCSFTGSCVGHFNQRYFVAAVFNLWPVVFSCCVWNWHALLLAFSPISLSDFLKWVFPHMALLFR

SEQ ID NO: 164607 - protein, 71 aa, Heterodera glycines
  Coding regions on vcDNA: vcDNA=SeqID_91030; Strand=+; Position=2-214
DSPRPKPITQSAGTQTTPPIASTSPFSSTTTVRRRAHSLADFPPLYNFSQRPLTHIRHSSLGENSGADPNF

SEQ ID NO: 164608 - protein, 211 aa, Heterodera glycines
  Coding regions on vcDNA: vcDNA=SeqID_91031; Strand=+; Position=1-633
HPSSTAIVQHPVITWAFITRLPQHTTLVMSASQRGSTSQPSGSNGQPTPSPDRHWSSTPSLLNVLQSAVDRAATFQTTARPPPNPNSLAPPPVVVEGGSDMEPDKEEDTEHQNKGPNDDEVADSQESGGNSDDHPDDAGDTNSAGLLTQLAAALAVPGTEHFMGTLAQDLHGLPSREKDRLFAALLINIAYRQANPPPPPPAPSAIDPDLA

SEQ ID NO: 164609 - protein, 78 aa, Heterodera glycines
  Homolog annotation: Hit_ID=CAE59477.1; Match level="QueryCoverage =98%, HitCoverage=18%, E-value=8e-31, Identity=79%"; Hit description =Hypothetical protein CBG02861 [Caenorhabditis briggsae]
  Gene Ontology: Mol. function=transcription factor activity; Cellular component=mitochondrion; Biological process=regulation of transcription, DNA-dependent
  Coding regions on vcDNA: vcDNA=SeqID_91032; Strand=+; Position=1-237
DEGRLAPEMISIVKRNSCGKALEIARKARDILGGNGIVDDYQVMRHMVNLESVNTYEGTHDIHALILGKAITGHQAFQ

SEQ ID NO: 164610 - protein, 83 aa, Heterodera glycines
  Coding regions on vcDNA: vcDNA=SeqID_91033; Strand=+; Position=39-290
MKYVKAHLKCDTVLETAISPNAMAALSLRKNDVRKLPMFLHRAEVHLPWTKASDGTVNSFHMIRAEMPPFFVHALKKLHLLRK

SEQ ID NO: 164611 - protein, 57 aa, Heterodera glycines
  Coding regions on vcDNA: vcDNA=SeqID_91034; Strand=-; Position=159-332
FFFFFFFFFFFFFFNITGFIQNDKCSKMDSCCSYKNFRNISQKVEIKVFGRLLHGNG

SEQ ID NO: 164612 - protein, 212 aa, Heterodera glycines
  Homolog annotation: Hit_ID=EAA72175.1; Match level="QueryCoverage =73%, HitCoverage=13%, E-value=6e-11, Identity=27%"; Hit description =hypothetical protein FG04561.1 [Gibberella zeae PH-1] ref|XP _384737.1| hypothetical protein FG04561.1 [Gib
  Coding regions on vcDNA: vcDNA=SeqID_91035; Strand=+; Position=1-636
VEQKLTSVHREGLSTLENVQKQMLEERGTIYLKAAQFCAFLKKWALKPYNDSMEAYINLSIKQAEKVVSECKGEADENLHEDKLKGLRESLRLYREQKELIDNATADDSNGPNVITAENVKKFFDELCDLPVFGADIRQMFETKQKSRHEHQKEYSEKKTNVGVKLRPTKSGKVVQPEQCWNEEQRKLLKTYEKKQKEMEQLEREMENENML

SEQ ID NO: 164613 - protein, 212 aa, Heterodera glycines
  Coding regions on vcDNA: vcDNA=SeqID_91036; Strand=-; Position=3-638
SDRLPLEVALSADRFKTEVALADRLLLPLHLISSDGHSSSSAASLHRPVSRPLSVLFDCRVSSVRPFANRFEASVPSILAPFATKSPPKSSASAPKLCTDAILRVVEDGLFRQQTAAPAPGSTQNGTTSAGPPRVRRAEVEGVVQLHNANAVVAHAADLQHTQMDHPLSSTFDVFVHNSVRRRWTGGGRRSGRGSFGVLKRQSVFVVRHLLV

SEQ ID NO: 164614 - protein, 195 aa, Heterodera glycines
  Homolog annotation: Hit_ID=YP_011575.1; Match level="QueryCoverage =96%, HitCoverage=84%, E-value=8e-36, Identity=47%"; Hit description =thiamine-phosphate pyrophosphorylase [Desulfovibrio vulgaris subsp. vulgaris str. Hildenborough] gb|AAS96
  Gene Ontology: Mol. function=thiamin-phosphate pyrophosphorylase activity; Cellular component=cytoplasm; Biological process =pyrimidine base metabolism
  Coding regions on vcDNA: vcDNA=SeqID_91037; Strand=+; Position=41-625
MLPKDLFSLYLIVDPILCGGHSHSVKLLNAVIPCGVKIVQLRAPNWHKGAILALAKDLLTITRPKGIPLIINDHVDVCLASGADGVHLGANDLPVESARELLGPDAILGYSVNNEKALEHAIRLGHKIDYLGVGPVFPTATKSDHAPPLGIERQRLICSRSIHPTVAVGGINAQNAAEVMAIGAPDALAVISAIC

SEQ ID NO: 164615 - protein, 89 aa, Heterodera glycines
  Homolog annotation: Hit_ID=NP_570963.1; Match level="QueryCoverage =86%, HitCoverage=22%, E-value=2e-24, Identity=61%"; Hit description =scratch homolog 1, zinc finger protein [Mus musculus] gb|AAH57562.1| Scratch homolog 1, zinc finger prote
  Gene Ontology: Mol. function=transcription factor activity; Cellular component=nucleus; Biological process=regulation of transcription, DNA-dependent
  Coding regions on vcDNA: vcDNA=SeqID_91038; Strand=+; Position=3-272
KAECEICHKKFGRPWLLNGHMRTHSGDKPYSCEKCDKTFADRSNCRAHERTHGAEKPFECPRCKKAFKVKSYLTKHKKSCGKSESKFDD

SEQ ID NO: 164616 - protein, 72 aa, Heterodera glycines
  Coding regions on vcDNA: vcDNA=SeqID_91039; Strand=-; Position=94-312
FFFFFFSFIFIQFYANCKTYFDKHIFQIFLLIAAFFLFHLQPHHLSFASIMSRAIASAFTDNGRCRIMLITH

SEQ ID NO: 164617 - protein, 176 aa, Heterodera glycines
  Homolog annotation: Hit_ID=NP_493408.1; Match level="QueryCoverage =98%, HitCoverage=36%, E-value=3e-44, Identity=51%"; Hit description =inositol monophosphatase (1O344) [Caenorhabditis elegans] pir||T27326 hypothetical protein Y6B3B.5 - Caen
  Gene Ontology: Cellular component=mitochondrion
  Coding regions on vcDNA: vcDNA=SeqID_91040; Strand=+; Position=102-629
MAMIRVNLRNTLLFIIVSSFVYLAFLIWTAKDRVPQFEVQLRDVLSYVVLAVEMGGHAIVRTFMEKKQIPFSEKGQMDVGRAELLTKADLISNQLMLTLLGRFPFLKVISEEKSEFLPEKETERYRADNYELWLGLREVLSKFPSWRIPLARVTVWIDPLDATQEFTEGLTQFVTV

SEQ ID NO: 164618 - protein, 42 aa, Heterodera glycines
  Coding regions on vcDNA: vcDNA=SeqID_91041; Strand=-; Position=94-222
FFFFFFSEEISEFLFPVLIFFLFPIYRIKPIYPLKIWQGFRV

SEQ ID NO: 164619 - protein, 81 aa, Heterodera glycines
  misc_feature (13)..(13): Xaa can be any naturally occurring amino acid
  misc_feature (22)..(22): Xaa can be any naturally occurring amino acid
  misc_feature (35)..(35): Xaa can be any naturally occurring amino acid
  Homolog annotation: Hit_ID=NP_724223.2; Match level="QueryCoverage =100%, HitCoverage=23%, E-value=1e-14, Identity=56%"; Hit description= CG31692-PB, isoform B [Drosophila melanogaster] gb|AAN11058.2| CG31692-PB, isoform B [Drosophila melanog
  Coding regions on vcDNA: vcDNA=SeqID_91042; Strand=+; Position=2-244
QKKFPDATGDLDXLLTSLVTAXEAISSAEPQGGIXAQLNGVAGNVNVQGEDMKKYVMSLSNELMINMVKSTYAVSTLVSED

SEQ ID NO: 164620 - protein, 208 aa, Heterodera glycines
  Homolog annotation: Hit_ID=AAV27340.1; Match level="QueryCoverage =79%, HitCoverage=57%, E-value=5e-09, Identity=30%"; Hit description =Hc38 [Haemonchus contortus]
  Coding regions on vcDNA: vcDNA=SeqID_91043; Strand=+; Position=1-624
IYRETVGSRLLAHIYVHHTAEELWRPNLAWLERATHLALPRLMKRQKEMDEWALNRKRCFVGLPPNLLRHCVLHGIRPSDVQLRQLLDEQSGPNAVVDPCPPKDNRRQRYEPANLDDLLQLHGLNVEDSPAMDGALQGFVGTFLRTLLPDQEQARLDSLIQALRQRIGFDSGGGGGPSADNATAELGTENEQEQRQQQNDAQNQQQRN

SEQ ID NO: 164621 - protein, 88 aa, Heterodera glycines
  misc_feature (20)..(20): Xaa can be any naturally occurring amino acid
  Homolog annotation: Hit_ID=CAE57672.1; Match level="QueryCoverage =88%, HitCoverage=15%, E-value=4e-18, Identity=57%"; Hit description =Hypothetical protein CBG00666 [Caenorhabditis briggsae]
  Gene Ontology: Cellular component=mitochondrion
  Coding regions on vcDNA: vcDNA=SeqID_91044; Strand=+; Position=8-271
MSAVDLFFKQEYLQVTFRYXQRGARFALLRLSDNEPSIGLIAASAGNHALSLAYHGSGLVIPVTAEMQKFAPLMNISCCESYKDAFIL

SEQ ID NO: 164622 - protein, 114 aa, Heterodera glycines
  misc_feature (40)..(40): Xaa can be any naturally occurring amino acid
  Homolog annotation: Hit_ID=NP_498593.1; Match level="QueryCoverage =99%, HitCoverage=48%, E-value=8e-19, Identity=41%"; Hit description =haloacid dehalogenase-like hydrolase, similar to Homo sapiens GS1 protein that escapes X-chromosome inact
  Coding regions on vcDNA: vcDNA=SeqID_91045; Strand=+; Position=2-343
ASTITHVVFYLDGVLIDTERHYTTANERTLDKFGAKFTPXMKLKMMGHKKTEAVTVLLKDARIADRVTMDQYFAENNKRLLHIMHALSEELPGATKLIDHLYAHGVPMAICTGS

SEQ ID NO: 164623 - protein, 110 aa, Heterodera glycines
  misc_feature (11)..(11): Xaa can be any naturally occurring amino acid
  Homolog annotation: Hit_ID=AAG01801.1; Match level="QueryCoverage =100%, HitCoverage=100%, E-value=2e-34, Identity=67%"; Hit description=acidic ribosomal protein P2 [Aspergillus fumigatus]
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_91046; Strand=+; Position=13-346
MKSIAAYLLVXLGGNESPSVADVTAILASVGVDADEQLEKVVAELNGKNVEDIIAEGMTKLASVPAGGAAAAAPATGASAATGASAAPAAAPKEEEKEESDEDMGFGLFD

SEQ ID NO: 164624 - protein, 121 aa, Heterodera glycines
  Coding regions on vcDNA: vcDNA=SeqID_91047; Strand=-; Position=224-589
QGGVRCLRRCMCADGARTVSDSESNPAQRRRLSRRRIQKTAAPPSNTIIFNDVQQPTALEGEQSVRQRCQNWRCFRELGFEEIWALWVPFSSVIPWPGILLAQANILTFYCLQDSTKPQRH

SEQ ID NO: 164625 - protein, 203 aa, Heterodera glycines
  Coding regions on vcDNA: vcDNA=SeqID_91048; Strand=+; Position=3-611
AALLHFFRVALCYSVDGITFLPSRQKKLQWIPKDANDRHNWKLCVTLKAIIPSLSPLSAPSPPPMSSASSFSPTNSASENSSIRFALPINQAKQLLHCLEQLQIDGGSDGGCAGNSDPLNVHQQRLSGPLFGFKKSAFYLSVCRPSKALSGKPLVFLSEHQLLPNEFHAWHSVVNSLPLSLCCLPELRKCLRLVLEQPEATSS

SEQ ID NO: 164626 - protein, 129 aa, Heterodera glycines
  misc_feature (57)..(58): Xaa can be any naturally occurring amino acid
  misc_feature (74)..(74): Xaa can be any naturally occurring amino acid
  misc_feature (83)..(83): Xaa can be any naturally occurring amino acid
  misc_feature (87)..(87): Xaa can be any naturally occurring amino acid
  misc_feature (110)..(110): Xaa can be any naturally occurring amino acid
  misc_feature (113)..(113): Xaa can be any naturally occurring amino acid
  Homolog annotation: Hit_ID=CAE72016.1; Match level="QueryCoverage =100%, HitCoverage=25%, E-value=1e-26, Identity=45%"; Hit description= Hypothetical protein CBG19098 [Caenorhabditis briggsae]
  Gene Ontology: Mol. function=sodium:phosphate symporter activity; Cellular component=integral to plasma membrane; Biological process =hermaphrodite genital morphogenesis
  Coding regions on vcDNA: vcDNA=SeqID_91049; Strand=+; Position=2-388
LSVFQLLLVWTIILGFLLPFVLAFAFGAKDTVYSVWASDGSRELTLLQAYLLASVFXXMGAALLEYHVTDTMCXGVIDLYIYXDASXELMLGQIAVSTGCGAWLLIATFXRLXVSTTDSIVGGTSGYSM

SEQ ID NO: 164627 - protein, 204 aa, Heterodera glycines
  Homolog annotation: Hit_ID=NP_496956.1; Match level="QueryCoverage =99%, HitCoverage=29%, E-value=3e-59, Identity=54%"; Hit description =block of proliferation 1 (77.4 kD) (2O442) [Caenorhabditis elegans] emb|CAB54439.1| Hypothetical protein
  Gene Ontology: Biological process=physiological processes
  Coding regions on vcDNA: vcDNA=SeqID_91050; Strand=+; Position=3-614
HKFDALRMVPFYDKFYDERVERCMDLYLAPRQRKMRLNVDPKQLLPNLPNPKDLQPFPTTLAFYLRGHSGQVRTLAVEPEIGELLVSGGADSTVRVWLLPSGKCLRLFEMPASVTCVAFCPNSNRTLTLVSCESDLVTVLNIQSGDRLAVSNTRQFIAGIPFGTENTAGVLWTHIHSKTMNGIRIKMNDKIRSLCWHKSGDYFA

SEQ ID NO: 164628 - protein, 79 aa, Heterodera glycines
  Coding regions on vcDNA: vcDNA=SeqID_91051; Strand=+; Position=2-238
NQPQPAVQDAGLLAANQYMHLLYGQLQRAQSQLIMTNDNLSEEFSRVVRVNAVLTRRIDLLTRSAPQHHPHNAVDALVN

SEQ ID NO: 164629 - protein, 206 aa, Heterodera glycines
  Coding regions on vcDNA: vcDNA=SeqID_91052; Strand=+; Position=3-620
REFSASPLQTIATFSVAFGHTNYLIEALIGQKRDSFATSSPTDFEVIDEDIRFLFNAEEGIEIGLDFDHKEEIFRTFPPLLSPSSKFTLKWRWVRLGIAADGRAKRTSPPAELLFRGPNGTVFHRMALPSYNSFSGTQFAQFEFGRFSGVSPGVWSVALHANNSLPIASLSFPVFPDPSLSSEWAEQRIVRLIDEFFTVRDFCSVT

SEQ ID NO: 164630 - protein, 116 aa, Heterodera glycines
  Homolog annotation: Hit_ID=NP_595605.1; Match level="QueryCoverage =89%, HitCoverage=71%, E-value=1e-31, Identity=61%"; Hit description =40s ribosomal protein s10 [Schizosaccharomyces pombe] emb|CAC37376.1| rps10-2 [Schizosaccharomyces pombe]
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_91053; Strand=+; Position=2-352
LISKGDREQIYQYLFGEGVLVARKDFELPRHKDIPVSNLAVLKACQSLESRGFLKSQLSWHWFYYTLTDAGIEYLREYLHIPAEIVPATFKNDRAAASRRDRSEGDVRRPRQEGEC

SEQ ID NO: 164631 - protein, 168 aa, Heterodera glycines
  Homolog annotation: Hit_ID=CAE62744.1; Match level="QueryCoverage =82%, HitCoverage=89%, E-value=8e-42, Identity=58%"; Hit description =Hypothetical protein CBG06907 [Caenorhabditis briggsae] emb|CAE62743.1| Hypothetical protein CBG06906 [Cae
  Gene Ontology: Mol. function=transcription factor activity; Biological process=response to stress
  Coding regions on vcDNA: vcDNA=SeqID_91054; Strand=+; Position=79-585
MASSSEQSAGGQCHQKAGDGQTPAIDRLEGAKKDPKAVTEDEWRKVLSPEAFEVTRQSGTEAPFTGKFDKHFVAGGKYTCVCCGAALFVSEQKFNSGCGWPAFSKSIGDDQNIVRLPDNSYGRQRIEVRCAKCDAHLGHVFDDGPPADGGQRYCINSVAIDFVSGQQK

SEQ ID NO: 164632 - protein, 204 aa, Heterodera glycines
  Homolog annotation: Hit_ID=NP_741410.1; Match level="QueryCoverage =70%, HitCoverage=23%, E-value=6e-21, Identity=39%"; Hit description =lin-12 And Glp-1 transcriptional regulator, suppressor of hairless homolog., Lin-12 And Glp-1 phenotype L
  Gene Ontology: Mol. function=transcriptional activator activity; Cellular component=cytoplasm; Biological process=N signaling pathway
  Coding regions on vcDNA: vcDNA=SeqID_91055; Strand=+; Position=22-633
MINGIVSAEEQQNSFLSGGYSASCSTSYVQQHFQQQQQQHLAFSCRTPLQKLTPERMREYLRNREDLDCILEIYHPKVAQKSYGTEKRFFSPPPLVYLRGRGWRWRWMLLQNGNDKMLDIQNIRFSELSNEFPEPIAYIGIVGSKDQEKHKLDWQKDKDGRCAIKSLHISENDNNRKKYFTLSVYCSYKTSMPGLLQTLGVFES

SEQ ID NO: 164633 - protein, 211 aa, Heterodera glycines
  misc_feature (120)..(120): Xaa can be any naturally occurring amino acid
  Homolog annotation: Hit_ID=NP_500892.1; Match level="QueryCoverage =99%, HitCoverage=62%, E-value=7e-50, Identity=45%"; Hit description =putative mitochondrial protein, with a coiled coil domain, of eukaryotic origin (38.6 kD) (4G702) [Caenor
  Coding regions on vcDNA: vcDNA=SeqID_91056; Strand=+; Position=3-634
MSDTVGSLSEALQNEDPGIELVTFYNSEGSRISKSTRIQHLLRLPSFYIRINDTFFKFTINSFVFENIENLETLDGIKSKVFSMYSLMNMDEYKLKLEHSLMEEIENVEQRLRPLIIFRXRSAIEKECEEYTQRVFWLGFSAICFQVGVFARLTWWEYSWDIMEPITYFSTFSSVVIAMSYYIVTKQNFEYTSAHSRVLRNDFYKRSLKYG

SEQ ID NO: 164634 - protein, 45 aa, Heterodera glycines
  Coding regions on vcDNA: vcDNA=SeqID_91057; Strand=+; Position=2-139
DIGVRSIAELWNGVNCGAVKLERRTHSAQLEGGVHSIHSYDKVAM

SEQ ID NO: 164635 - protein, 35 aa, Heterodera glycines
  Coding regions on vcDNA: vcDNA=SeqID_91058; Strand=-; Position=1-105
FFFFFFFISNYLTNQSSPLTIRAVPCRYLRPTPFL

SEQ ID NO: 164636 - protein, 143 aa, Heterodera glycines
  Homolog annotation: Hit_ID=NP_957220.1; Match level="QueryCoverage =98%, HitCoverage=22%, E-value=2e-44, Identity=59%"; Hit description =similar to excision repair cross-complementing rodent repair deficiency, complementation group 2 [Danio r
  Gene Ontology: Mol. function=ATP dependent DNA helicase activity; Cellular component=nucleus; Biological process=post-embryonic development
  Coding regions on vcDNA: vcDNA=SeqID_91059; Strand=+; Position=85-601
GHCLLEMPSGTGKTVSLLALVVAYMRKYPERLHKLIYCSRTIPEIEKCVEELKRLFRYYTNVTGSAPDFLALTLSARKNLCINKSVVSFRYGSAVDGACQRLTASYVRAKRRLNPNLPCCSFFEKFDEKRDMTLPKGVYNLVS

SEQ ID NO: 164637 - protein, 136 aa, Heterodera glycines
  Homolog annotation: Hit_ID=XP_448509.1; Match level="QueryCoverage =100%, HitCoverage=100%, E-value=1e-52, Identity=69%"; Hit description=unnamed protein product [Candida glabrata] emb|CAG61470.1| unnamed protein product [Candida glabrata CB
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_91060; Strand=+; Position=30-440
MVKFVKPGKVAVVLQGRYAGKKAVVIKNFDEGNKAHPFPHAVVAGIERYPLKVAKTMSQKKIARRSVIKPFIKVINYNHLMPTRYTLELESTKSLVTAETFKEPTQRKEAKKTVRKIFEEKYKAGKNKWFFTKLRF

SEQ ID NO: 164638 - protein, 70 aa, Heterodera glycines; identical to SEQ ID NO: 161668
  Homolog annotation: Hit_ID=NP_502247.1; Match level="QueryCoverage =50%, HitCoverage=10%, E-value=1e-09, Identity=85%"; Hit description =protein phosphatase catalytic (36.3 kD) (4M623) [Caenorhabditis elegans] emb|CAB01174.1| Hypothetical pro
  Gene Ontology: Mol. function=protein phosphatase type 2A, intrinsic catalyst activity; Cellular component=cytoplasm; Biological process =embryogenesis and morphogenesis
  Coding regions on vcDNA: vcDNA=SeqID_91061; Strand=+; Position=133-345

SEQ ID NO: 164639 - protein, 81 aa, Heterodera glycines
  Homolog annotation: Hit_ID=CAE71877.1; Match level="QueryCoverage =93%, HitCoverage=15%, E-value=6e-13, Identity=44%"; Hit description =Hypothetical protein CBG18932 [Caenorhabditis briggsae]
  Coding regions on vcDNA: vcDNA=SeqID_91062; Strand=+; Position=2-244
ATVSLEIEHVLHNLERRKAAVNAEKTFTAILGSPQIVREPKGVVLLGGPWNYPPNTLLRPLVEVLGAGNTAGLTPAEIASN

SEQ ID NO: 164640 - protein, 209 aa, Heterodera glycines
  Homolog annotation: Hit_ID=CAE62081.1; Match level="QueryCoverage =90%, HitCoverage=68%, E-value=8e-10, Identity=24%"; Hit description =Hypothetical protein CBG06104 [Caenorhabditis briggsae]
  Coding regions on vcDNA: vcDNA=SeqID_91063; Strand=+; Position=3-629
DDENEFGALRAVQIDAALLDNTLLAFIQARIDQIVDIGGAHCLQQYKQHFRECIAPLYFLSHFLTGQSPGQRLLQIRTNFPTTFKALLNYVLCFLLPSFVAFFVKLRPFDRRIQLWYSRAQTAHRLVDFIHFCLFLAQGGPIRPTERLFGSRPVYVQKPTIGSLNFTALNRELLGHSFVQLCFLFVPLFNVFKRRFLRALSRRRQQHFR

SEQ ID NO: 164641 - protein, 41 aa, Heterodera glycines
  Coding regions on vcDNA: vcDNA=SeqID_91064; Strand=-; Position=2-124
INLLLSIFIIKYFYRLMRFIYFKLVVFLYFSLSVVQHLSCL

SEQ ID NO: 164642 - protein, 194 aa, Heterodera glycines
  Homolog annotation: Hit_ID=NP_990439.1; Match level="QueryCoverage =100%, HitCoverage=73%, E-value=1e-86, Identity=76%"; Hit description= ribosomal protein S4 [Gallus gallus] gb|AAB59946.1| ribosomal protein S4 pir||A56537 ribosomal protein S
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_91065; Strand=+; Position=21-602
MARGPKKHLKRLAAPKHWMLDKMTGTWAPRPSAGPHKLRECLPLVVFLRNRLKYALTYKEVISILMQRLVKVDGKVRTDATYPAGLMDVISLEKTNEAFRLIYDAKGRFAVHRITAEEAEYKLCKIRKVKVTGKAIPVVVTHDGRTIRYPDPSIKVNDTVKIDLATGKITDFVKFESGNLALITGGRNMGRVGV

SEQ ID NO: 164643 - protein, 141 aa, Heterodera glycines
  Homolog annotation: Hit_ID=AAK26377.1; Match level="QueryCoverage =100%, HitCoverage=47%, E-value=4e-78, Identity=100%"; Hit description=putative alpha/beta hydrolase [Heterodera glycines]
  Coding regions on vcDNA: vcDNA=SeqID_91066; Strand=+; Position=1-426
LSSGSQVDMRGDLAFKGMRNTDQWMPAAKAPYLEHYSNEFLKEQWAGLCDVVAKVYKDLGGSFPCDRVLNTLKIPVLIVNGNMDRFVLDPSLMSKKLENARIEIHAQGGHDLHIKYPRWFALKVTSFVKESAKSDVKANRK

SEQ ID NO: 164644 - protein, 60 aa, Heterodera glycines
  Homolog annotation: Hit_ID=AAG45420.1; Match level="QueryCoverage =100%, HitCoverage=9%, E-value=9e-09, Identity=56%"; Hit description =vegetative cell wall protein gp1 [Chlamydomonas reinhardtii] sp|Q9FPQ6|GP1_CHLRE Vegetative cell wall prot
  Coding regions on vcDNA: vcDNA=SeqID_91067; Strand=-; Position=2-181
PVPPLPPSPFPSLPSFPLGSFTPVPPVPLPPLSPEVPPLRPSPSPEVPPLRRSSSPKVPP

SEQ ID NO: 164645 - protein, 72 aa, Heterodera glycines
  Coding regions on vcDNA: vcDNA=SeqID_91068; Strand=+; Position=7-225
QPWDSSTRTATRRTCSCTSLTARRTFTADRRLGGGVSVWPWRIKLPSMGGNNQRIVVGFYVPFSSLSFIFFK

SEQ ID NO: 164646 - protein, 106 aa, Heterodera glycines
  Homolog annotation: Hit_ID=CAE67502.1; Match level="QueryCoverage =92%, HitCoverage=63%, E-value=1e-42, Identity=77%"; Hit description =Hypothetical protein CBG13012 [Caenorhabditis briggsae]
  Coding regions on vcDNA: vcDNA=SeqID_91069; Strand=+; Position=56-376
LSKCFCWQSAHIVTGSHFSQVFRLGFKLRLICKARGDPRPKIKWFKEGMEMQPKRNAHYYEKPLGKDEIWSKLEIDPATMGDQGIYACVANNQHGVMAKNFKAEYR

SEQ ID NO: 164647 - protein, 205 aa, Heterodera glycines
  Homolog annotation: Hit_ID=NP_499445.2; Match level="QueryCoverage =72%, HitCoverage=49%, E-value=2e-14, Identity=31%"; Hit description =nitrogen fixation protein like (3M326) [Caenorhabditis elegans] emb|CAB55073.2| Hypothetical protein Y47D
  Coding regions on vcDNA: vcDNA=SeqID_91070; Strand=+; Position=1-615
MSSTKDENLLDENQKSTKIQRLRNFEIQPILPSSLQTEHIELTEAVVLNVTNKSLFSALLRILPPLPAQFEHLKRVNGTELLVSVSQNGDDGTIGTAERTAIGQLIGGEPTFIGRHIPCRKPQSRHQLEMYRKIWPMSFHKNAKLEAMIDGTLLTADESARIKQLFVIVERTKGALFYDPATDQIVADGTTTAQFEAPAAAANPR

SEQ ID NO: 164648 - protein, 168 aa, Heterodera glycines
  Homolog annotation: Hit_ID=CAE63529.1; Match level="QueryCoverage =92%, HitCoverage=60%, E-value=2e-12, Identity=28%"; Hit description =Hypothetical protein CBG08009 [Caenorhabditis briggsae]
  Coding regions on vcDNA: vcDNA=SeqID_91071; Strand=+; Position=20-526
MSASFDDELQLEMQSIEAIFPNEIHIESARQISVQCASNVQLNLNIPADYPSAPPSVEICAPSVSGEQKRLLLSAMDAIVVDYREGPMLYPLIEGALEFFAEHRQKDAEEKDQSGAEEKEPYASADEETCAEFFAGPTIEDRKSKFQAYVAKVESKDQVDFLLTKSKV

SEQ ID NO: 164649 - protein, 118 aa, Heterodera glycines
  Homolog annotation: Hit_ID=NP_496497.1; Match level="QueryCoverage =84%, HitCoverage=13%, E-value=5e-31, Identity=64%"; Hit description =threonyl tRNA Synthetase (84.4 kD) (trs-1) [Caenorhabditis elegans] emb|CAA93762.1| Hypothetical protein
  Gene Ontology: Biological process=tRNA modification
  Coding regions on vcDNA: vcDNA=SeqID_91072; Strand=+; Position=6-362
MIIVVHHSVSDYASKVFRRIFDAGFEVEFDEDSPDTLNKRIRNAQLAQFNFILVIGQQEKNNGTVNVRTRDNQVRGEIAVDALIQKFQIFRDTFAQDTESAGSFEGPKEQKEILDDKK

SEQ ID NO: 164650 - protein, 92 aa, Heterodera glycines
  Homolog annotation: Hit_ID=CAE56548.1; Match level="QueryCoverage =81%, HitCoverage=43%, E-value=8e-18, Identity=57%"; Hit description =Hypothetical protein CBG24280 [Caenorhabditis briggsae]
  Coding regions on vcDNA: vcDNA=SeqID_91073; Strand=-; Position=2-277
SLLQFLSHSLSRLLLALKNLGFPREYVDAANSVLGECKIAAEKRLKRKNSRLDKCGIPEEQLWQMQQQLIEKVGKKKESGDLPMEWAQSARK

SEQ ID NO: 164651 - protein, 176 aa, Heterodera glycines
  misc_feature (93)..(93): Xaa can be any naturally occurring amino acid
  misc_feature (105)..(105): Xaa can be any naturally occurring amino acid
  misc_feature (112)..(112): Xaa can be any naturally occurring amino acid
  misc_feature (140)..(140): Xaa can be any naturally occurring amino acid
  Homolog annotation: Hit_ID=XP_319666.1; Match level="QueryCoverage =100%, HitCoverage=54%, E-value=5e-29, Identity=40%"; Hit description= ENSANGP00000021376 [Anopheles gambiae]
  Coding regions on vcDNA: vcDNA=SeqID_91074; Strand=+; Position=53-580
YEEALSHYNLAIIKNPNDPTYFTNRALCNLNVTKWDSASDDCKIALDMDFINVKANYYLGKVYVLDGQFDEAIIVVSRAHERVLYLKQTYGDXIDPLLRLARREXVPSRRRXRMAPEIVLQSYLNQLIDDYITKKVNQLXDKREYDVEQKEEELNTQGDTFETPLNNLVVHVDDRR

SEQ ID NO: 164652 - protein, 97 aa, Heterodera glycines
  Homolog annotation: Hit_ID=ZP_00138348.1; Match level="QueryCoverage =98%, HitCoverage=41%, E-value=3e-24, Identity=52%"; Hit description =COG0692: Uracil DNA glycosylase [Pseudomonas aeruginosa UCBPP-PA14]
  Gene Ontology: Mol. function=uracil DNA N-glycosylase activity; Cellular component=mitochondrion; Biological process=DNA repair
  Coding regions on vcDNA: vcDNA=SeqID_91075; Strand=+; Position=2-292
AETIWHKLLRKEFLMKYMRNICCFLEEQAEQGVCVYPPRNLIFNAFNLTPFDTIRVVVIGQDPYHNLGEAHGLCFSVPNGQPIPPSLKNIFKELSSE

SEQ ID NO: 164653 - protein, 152 aa, Heterodera glycines
  Coding regions on vcDNA: vcDNA=SeqID_91076; Strand=+; Position=2-460
EDDWLSYLSLNHGHHWLIEEMPFQLDRDLRCSFGRQLRVIREREENMKRKNSTNGRRQRRQKVFSQINNGNSTTPYTEETERYPAENWKSTNSNVSNNKKKGNETSGQLSASPVNNLFEGVELPPFTDNQMNVWFKYLSCINSRIREITEDA

SEQ ID NO: 164654 - protein, 57 aa, Heterodera glycines; identical to SEQ ID NO: 127826
  Coding regions on vcDNA: vcDNA=SeqID_91077; Strand=-; Position=70-243

SEQ ID NO: 164655 - protein, 124 aa, Heterodera glycines
  Homolog annotation: Hit_ID=CAA96571.1; Match level="QueryCoverage =97%, HitCoverage=30%, E-value=3e-20, Identity=42%"; Hit description =parasite pepsinogen [Haemonchus contortus]
  Gene Ontology: Mol. function=aspartic-type endopeptidase activity; Cellular component=soluble fraction; Biological process=digestion
  Coding regions on vcDNA: vcDNA=SeqID_91078; Strand=+; Position=252-623
YVALITIGSPPQELEVVMDTGSANLWVPDTTCNSTSTQKCFKWCQISFYCSANCDEYCCGESSKVSTCDQKSKFNSAQSSTYEQKGKAFQIMYGTGFVYGFLGMDTVRLGASIDQNALTIPKAF

SEQ ID NO: 164656 - protein, 97 aa, Heterodera glycines
  Coding regions on vcDNA: vcDNA=SeqID_91079; Strand=+; Position=194-487
KTKCRTLPSFFFTFHWRTLNASIPANCSFLNSLEPVTPTLKPDKNDLPELKRSRFIRIAEYEQSLKRYVKLRVTLVAFNNALTPQCQLELMDARRWI

SEQ ID NO: 164657 - protein, 75 aa, Heterodera glycines
  Homolog annotation: Hit_ID=EAA26134.1; Match level="QueryCoverage =96%, HitCoverage=36%, E-value=3e-20, Identity=62%"; Hit description =unknown [Rickettsia sibirica 246] ref|ZP_00142725.1| hypothetical protein [Rickettsia sibirica 246]
  Coding regions on vcDNA: vcDNA=SeqID_91080; Strand=+; Position=2-226
PKEDLETLLKKIKNSLDIWIAFLTRHDLLNKDNLPQPLNSNSLKKALHVLDTINFTAEERMAYEDRLKWLRIEAN

SEQ ID NO: 164658 - protein, 187 aa, Heterodera glycines
  Homolog annotation: Hit_ID=NP_254194.1; Match level="QueryCoverage =88%, HitCoverage=75%, E-value=3e-38, Identity=46%"; Hit description =hypothetical protein PA5507 [Pseudomonas aeruginosa PAO1] gb|AAG08892.1| hypothetical protein PA5507 [Pse
  Coding regions on vcDNA: vcDNA=SeqID_91081; Strand=+; Position=25-588
MEKHPFSGQFHEHAQKVVIPNIRRLIETARQLKIEVVFTVMENQTKDGRDRSLDYKLSNFFIPKGSREAKVVDQLTPLDDELVIPKTSCSLFNSTNFAYLMRNIGIDTIAVTGFLTDQCVDQTIRDGADATGGFWMIGVSDGCAAETAERHAAALNVLRGYCRMESTQSLIEAMHSEMGGESSKMGD

SEQ ID NO: 164659 - protein, 172 aa, Heterodera glycines
  Coding regions on vcDNA: vcDNA=SeqID_91082; Strand=+; Position=3-518
LSVEEYAELLLGFLVQKQPIKAKYCYTRAIEKFVRNQQLMQIWEFGDTICKQNFDKALRICNATTLGEALQPYVEELKRRLTSVQLFTMTNSYSSIGLSKFAQLVGLDESSGTVQELLQKCNWTVSEDGFISPVRNAELMQAIESLNDAKFGTGFDIKFAERGVGGATESDS

SEQ ID NO: 164660 - protein, 200 aa, Heterodera glycines
  Homolog annotation: Hit_ID=CAE71413.1; Match level="QueryCoverage =46%, HitCoverage=27%, E-value=2e-23, Identity=57%"; Hit description =Hypothetical protein CBG18323 [Caenorhabditis briggsae]
  Coding regions on vcDNA: vcDNA=SeqID_91083; Strand=+; Position=25-624
MLKLTRVFFTAIPTSSDSVNSRIFNRQWRHQQQLQLRLCSSFSTTGPPGPSFNCNGQRMDNLRDVQQKEEDTVKQQRPTVSLARSGIAKDFSGTTAELFELQRQAGHNVFGDDACFIASHMSTYAAGVADGVGGWRRYGVDPSKFSSQLMKNCADIVTSGEFLSQRPDLIISKAFSQLRSKTRPVGSSTACVLVVHDRTL

SEQ ID NO: 164661 - protein, 119 aa, Heterodera glycines
  Homolog annotation: Hit_ID=XP_419558.1; Match level="QueryCoverage =66%, HitCoverage=2%, E-value=4e-09, Identity=35%"; Hit description =PREDICTED: similar to lysosomal trafficking regulator, partial [Gallus gallus]
  Gene Ontology: Cellular component=microtubule cytoskeleton; Biological process=signal transduction
  Coding regions on vcDNA: vcDNA=SeqID_91084; Strand=+; Position=2-361
HSERQRTITSIAITDLPEGTAVNCVAIGLQSGMIRLIEMWTMTVVRDISFQSFHFPVLSLLFANESRRLYAAFANSNVVLCLQVPSLYGASSEEPMTVSRERPCFKVLNPFKCSDSFPL

SEQ ID NO: 164662 - protein, 110 aa, Heterodera glycines
  misc_feature (63)..(63): Xaa can be any naturally occurring amino acid
  Homolog annotation: Hit_ID=CAE64793.1; Match level="QueryCoverage =100%, HitCoverage=27%, E-value=1e-36, Identity=66%"; Hit description= Hypothetical protein CBG09586 [Caenorhabditis briggsae]
  Gene Ontology: Mol. function=structural constituent of cytoskeleton; Cellular component=microtubule associated complex; Biological process=actin filament organization
  Coding regions on vcDNA: vcDNA=SeqID_91085; Strand=+; Position=2-331
DADGRKVIVVYNGTGYLKCGYAGSNFPSYIFPSDVGRPLVGSPPRLVNDILIKDLMVGEECSXLRHMLYVSYPMENGIVQNWDDMGHPWDYTFGTDKLTLIQMTATLMLT

SEQ ID NO: 164663 - protein, 71 aa, Heterodera glycines
  Coding regions on vcDNA: vcDNA=SeqID_91086; Strand=-; Position=139-354
LLVLDLLHFMYFYSNKFKPIMKFVENLIVAGMPFSITYLLFSVPSAESASFSPAPLHFRLCSIWWESMCAV

SEQ ID NO: 164664 - protein, 182 aa, Heterodera glycines
  Coding regions on vcDNA: vcDNA=SeqID_91087; Strand=+; Position=1-549
EKRKQKKMKGLTNERENLQRAAKRFGEAATSALLEYSPSFRRCHQRPQSARTHSIYDFTSRDKSPTKLIKPRFSLNVGSLSAREPRPSPSFERIQSLLSPRSASVSDQLRHSVRARAGSGQSTKSSISPSPRHRSSISSAGTRFLRWIGLLSPSDEGHHRQNGKNEDRKKSTSNKRRMSSFQ

SEQ ID NO: 164665 - protein, 198 aa, Heterodera glycines
  Coding regions on vcDNA: vcDNA=SeqID_91088; Strand=+; Position=19-612
MSLIKLVVKTIDGKDSIVRVDPKMSLDHLRHAIEAATGISKNDQRLIFRGRILKDESLSLTDQGFVDGLAIHVVTNSPPASTNGSSTESRSSETSQSHQQPEVMVVPQITTQNLIVGQVVLERTSLFDNPNVALDAVTNALEEIRGAFQLETESSLNTNIQNGSFAVNVILRGMREQIVDGPARERFESLRVEVKKLA

SEQ ID NO: 164666 - protein, 68 aa, Heterodera glycines
  misc_feature (32)..(32): Xaa can be any naturally occurring amino acid
  misc_feature (52)..(52): Xaa can be any naturally occurring amino acid
  Homolog annotation: Hit_ID=AAH77666.1; Match level="QueryCoverage =100%, HitCoverage=38%, E-value=9e-14, Identity=55%"; Hit description= MGC89761 protein [Xenopus tropicalis] ref|NP_001005129.1| MGC89761 protein [Xenopus tropicalis]
  Coding regions on vcDNA: vcDNA=SeqID_91089; Strand=+; Position=2-205
LTKGDNNMVDDRGLGAPGQQCLPRKDVISLAXGFVPYVGMGTIMVNHYSILXYTVLVLPGGFMLMSPE

SEQ ID NO: 164667 - protein, 65 aa, Heterodera glycines
  Coding regions on vcDNA: vcDNA=SeqID_91090; Strand=-; Position=3-197
FFFFFFLQLDIFNYLKNWGHNTVLKIGVYGETNLGAFENKANLTSENLASCVIPVSGGEVAPTPQ

SEQ ID NO: 164668 - protein, 100 aa, Heterodera glycines
  Coding regions on vcDNA: vcDNA=SeqID_91091; Strand=-; Position=254-556
PPKKPLTLSLLSSELVAAASADECAVEVPLLSRPGHFVVQMGLNVNLNCPRRFVVQMMNSSGHHRILLLVVLQVTVLLLELGQCGTQHVIVGRLKMIGSD

SEQ ID NO: 164669 - protein, 21 aa, Heterodera glycines
  Coding regions on vcDNA: vcDNA=SeqID_91092; Strand=-; Position=97-162
FFFFFFFYVNVRINYQVNFHS

SEQ ID NO: 164670 - protein, 122 aa, Heterodera glycines
  Coding regions on vcDNA: vcDNA=SeqID_91093; Strand=+; Position=45-413
VIRNIKREITKDITDPYAYNTTANRINNEVLSRGPLGQNDKLFDLGTMIATIEQQTGDLTEHSRFRSFVILHISTWTSKACVIPIGLSTNQFLNYSGFGYVEMYAHHLFTTNDELYKLFLFL

SEQ ID NO: 164671 - protein, 158 aa, Heterodera glycines
  Homolog annotation: Hit_ID=CAA39215.1; Match level="QueryCoverage =99%, HitCoverage=99%, E-value=2e-12, Identity=28%"; Hit description =extensin (class I) [Lycopersicon esculentum] pir||S14974 extensin class I (clone uG-18) - tomato (fragment
  Gene Ontology: Mol. function=profilin binding; Cellular component =cytoplasm; Biological process=hearing
  Coding regions on vcDNA: vcDNA=SeqID_91094; Strand=-; Position=1-474
TTPTPCFFFFPPPPPTLYFPLGGGGGAPLFFFLRPPPPPPPSFFFRRRKEKSAVFLFVFPPPPNTPLFVFFFPAAPKKKGVFFPSFWAPQKGGGPSPPPPPLFFFFGGAPPPAGFSRLCFSRPPPFFLFSPRGPPKRGFFPPAVPPFPAGPPLFFPPP

SEQ ID NO: 164672 - protein, 88 aa, Heterodera glycines
  Homolog annotation: Hit_ID=CAE74692.1; Match level="QueryCoverage =90%, HitCoverage=7%, E-value=4e-19, Identity=59%"; Hit description =Hypothetical protein CBG22506 [Caenorhabditis briggsae]
  Coding regions on vcDNA: vcDNA=SeqID_91095; Strand=+; Position=3-269
AARPGQILWLLGLTRLQTQMRVVKAFQATVQNSHPSSLSLQAGDRLRQSYRRLRIAKEIERANELRSRGPIRIVDSETKPKSSDLKFV

SEQ ID NO: 164673 - protein, 188 aa, Heterodera glycines
  Homolog annotation: Hit_ID=XP_414793.1; Match level="QueryCoverage =91%, HitCoverage=12%, E-value=8e-21, Identity=34%"; Hit description =PREDICTED: similar to TRIAD3 protein isoform a; zinc finger protein inhibiting NF-kappaB; ubiquitin conju
  Coding regions on vcDNA: vcDNA=SeqID_91096; Strand=+; Position=1-564
NSEEAKRREIEKKLNEAIVRCCPKCRLQFVKLDACNKMTCACGTTQCYICREVGITYDHFCNHPRDLIIAKCDKCVKPKCMLWEDFKRHDREAIGRILKESGVEINIPASPMPGPSTKQQPRAIIPPMLPQRVHVALHLPPRVAPPNRMAPPPQRVAPPQHVAPPQRMAPPPQRVAPPQHVAPPQRMA

SEQ ID NO: 164674 - protein, 197 aa, Heterodera glycines
  Homolog annotation: Hit_ID=NP_497089.1; Match level="QueryCoverage =95%, HitCoverage=39%, E-value=5e-12, Identity=25%"; Hit description =beuren syndrome Williams region 20 like (2P261) [Caenorhabditis elegans]
  Coding regions on vcDNA: vcDNA=SeqID_91097; Strand=+; Position=24-614
MNFYHAEAAEILNKAAKKEGSLRRFIYESKLKDKKVLLKICCEVAKHRHWLQQLACRPAVQTFLARELSCGDSSYQLVLIFELLHGKWKRKVPTNGNGQHWTALRQLKSILDEESDLLLKDGVSSESLSPAESSASLLPRYVRVNTVRMAFTQAVELLERDGWCLCRLKKRITPSKYRRLVSTLESPKIYVDPHIYD

SEQ ID NO: 164675 - protein, 166 aa, Heterodera glycines
  Homolog annotation: Hit_ID=CAE62113.1; Match level="QueryCoverage =91%, HitCoverage=28%, E-value=1e-28, Identity=43%"; Hit description =Hypothetical protein CBG06151 [Caenorhabditis briggsae]
  Gene Ontology: Mol. function=ATP-binding cassette (ABC) transporter activity; Cellular component=membrane; Biological process=transport
  Coding regions on vcDNA: vcDNA=SeqID_91098; Strand=+; Position=66-563
MDYGVERKRRRLSNYGATSPTKSVQEVKPVALSWHGLTAVHAKSGRKILDDASGMADAGQLVALTGDGGVDKTALLNTLLDHNLKTLSVEGQVLINAHSLGRFITYVIGYVQQDDLFMGTPTVKEHLMAPAQLWMVGHTQRTMRRRVNELEEAISDGEARRLPFVF

SEQ ID NO: 164676 - protein, 78 aa, Heterodera glycines
  Coding regions on vcDNA: vcDNA=SeqID_91099; Strand=+; Position=57-290
IGGGLSARHGRSCRRFVRTGQENQSRLNAEKGANGDGQTANSEIFLFIFSLCIFLFVYSVRIAQLNLTLFKKKKKKKK

SEQ ID NO: 164677 - protein, 86 aa, Heterodera glycines
  Coding regions on vcDNA: vcDNA=SeqID_91100; Strand=-; Position=69-329
RTSRHGIFSCWHLLVAKVVLQHVANVRFNTPPLTPDVWPIRMPCAEPYPHSHRHILQQSSALGHPKAHSNPFGPEFCRPTPPQTLH

SEQ ID NO: 164678 - protein, 203 aa, Heterodera glycines
  Homolog annotation: Hit_ID=CAE63551.1; Match level="QueryCoverage =95%, HitCoverage=35%, E-value=6e-89, Identity=80%"; Hit description =Hypothetical protein CBG08037 [Caenorhabditis briggsae]
  Gene Ontology: Mol. function=glucose-6-phosphate isomerase activity; Cellular component=cytosol; Biological process=neurogenesis
  Coding regions on vcDNA: vcDNA=SeqID_91101; Strand=+; Position=1-609
HALLPYDQYLHRFAAYFQQGDMESNGKCITRNGTRVRHSTGPIVWGEPGTNGQHAFYQLIHQGTRLIPCDFIATIKSHNPLRGGLHHKILLANFLAQTEALMRGKSATEVEEELRASGMSSEKIAKIVPHKVFEGNRPTNSIVLPQLTPSTLGSLIAMYEHKIFVQGVIWGINSFDQWGVELGKQLANIILDELRGGPTRKHD

SEQ ID NO: 164679 - protein, 75 aa, Heterodera glycines
  misc_feature (13)..(13): Xaa can be any naturally occurring amino acid
  Coding regions on vcDNA: vcDNA=SeqID_91102; Strand=+; Position=1-227
LPLPPRATPTHNXPRPTPTRPRLPPNAAESTTAPAALPPRQCPLRPPPCRTLPPSPRPPRLPTSCPPTCRCPRRS

SEQ ID NO: 164680 - protein, 141 aa, Heterodera glycines
  misc_feature (89)..(89): Xaa can be any naturally occurring amino acid
  misc_feature (117)..(117): Xaa can be any naturally occurring amino acid
  Homolog annotation: Hit_ID=NP_493241.1; Match level="QueryCoverage =100%, HitCoverage=39%, E-value=5e-20, Identity=40%"; Hit description= predicted CDS, apolipoprotein A-I binding protein like (1N400) [Caenorhabditis elegans] emb|CAA22319.1|
  Coding regions on vcDNA: vcDNA=SeqID_91103; Strand=+; Position=23-445
MKFLIQQEAIDIYRELFTSCGFCVDQLMELAEVACAQDIGETSDNANDLILSWPGNNDGDELVCARLLKDFGFSPTILCTIPSPNDLMXTIDASIGMISTFPSNESFPDPNSIETLXSVLDEIFGFIFRHPIQEPFDVILK

SEQ ID NO: 164681 - protein, 88 aa, Heterodera glycines
  Coding regions on vcDNA: vcDNA=SeqID_91104; Strand=+; Position=53-319
QHSSRKDIDKQLDIGRAERLQKSRKRPQRYIIKEQSVVRILDEADFESEEGLANALHLLGLVMQGFVEGLHIRGNDESDEETADADGN

SEQ ID NO: 164682 - protein, 189 aa, Heterodera glycines
  Homolog annotation: Hit_ID=EAA55223.1; Match level="QueryCoverage =88%, HitCoverage=54%, E-value=4e-49, Identity=57%"; Hit description =hypothetical protein MG06880.4 [Magnaporthe grisea 70-15] ref|XP _370383.1| hypothetical protein MG06880.4
  Coding regions on vcDNA: vcDNA=SeqID_91105; Strand=+; Position=41-607
MTTSATNSDSAKFVFTDDMKVKFLNDGYLIIPGFFSTADAAALKSRADELLHSMDLSTHPMTTFATGGKDGTKHVGDKYFLESGDKIRYFFEEDAVDKQTGKLLKPKERAINKIGHALHVLDDKYREFSHRSAVIDIVRKLDFEKPVILQSMLIFKQPEIGGAVPPHQDSTFLHTDPPSAVGFWFALED

SEQ ID NO: 164683 - protein, 47 aa, Heterodera glycines
  Homolog annotation: Hit_ID=NP_503322.1; Match level="QueryCoverage =100%, HitCoverage=14%, E-value=3e-14, Identity=74%"; Hit description= stress-induced-phosphoprotein 1 like (37.0 kD) (5B253) [Caenorhabditis elegans] gb|AAG24172.1| Hypotheti
  Coding regions on vcDNA: vcDNA=SeqID_91106; Strand=+; Position=2-145
EILRDPGMRVLLEQMSHDPDAAREHIRNPDIFRKLMKLQEAGVIQIR

SEQ ID NO: 164684 - protein, 94 aa, Heterodera glycines
  Homolog annotation: Hit_ID=NP_495318.2; Match level="QueryCoverage =95%, HitCoverage=33%, E-value=8e-19, Identity=53%"; Hit description =small GTP-binding proteins rab-like (30.0 kD) (2G815) [Caenorhabditis elegans] gb|AAA81090.2| Hypothetica
  Gene Ontology: Mol. function=GTPase activity; Cellular component =Golgi apparatus; Biological process=embryogenesis and morphogenesis
  Coding regions on vcDNA: vcDNA=SeqID_91107; Strand=+; Position=2-283
GQERFRCMVPLYMRNASAAVLVYDITNRESFEQIEQWHNEVLRCPTALEEPIFVLIGNKADQHDENREVAEGEGVQKALRLNAHFFEVSSVHSE

SEQ ID NO: 164685 - protein, 127 aa, Heterodera glycines
  Homolog annotation: Hit_ID=NP_499495.1; Match level="QueryCoverage =79%, HitCoverage=58%, E-value=2e-09, Identity=38%"; Hit description =putative cytoplasmic protein of ancient origin (3M668) [Caenorhabditis elegans] emb|CAC35907.1| Hypotheti
  Coding regions on vcDNA: vcDNA=SeqID_91108; Strand=+; Position=16-399
MLRHCMLYSRAFCTVKSPPLDLTKEVITKLERLSALQMQLPQESRNLAEDIQVAERIFEVNTEGVDPLHNIVDDFINCPVREDVSEHTSINETLANARKTFEGFFVSPSVGVEYKRRGKDGNKKTDR

SEQ ID NO: 164686 - protein, 174 aa, Heterodera glycines
  misc_feature (67)..(67): Xaa can be any naturally occurring amino acid
  Homolog annotation: Hit_ID=EAA11692.2; Match level="QueryCoverage =96%, HitCoverage=98%, E-value=2e-20, Identity=38%"; Hit description =ENSANGP00000010844 [Anopheles gambiae str. PEST]
  Gene Ontology: Mol. function=profilin binding; Cellular component =actin cytoskeleton; Biological process=actin filament-based movement
  Coding regions on vcDNA: vcDNA=SeqID_91109; Strand=+; Position=97-618
SLLSSSPPPSLPRLPPLPRTTRPRPAPTTMPPSPRLPPSNPATTRPSPRLPLCSPGTTVTPSPPPPXRRPARLPRPLSPPCPPTTTTARRRPRPPLVPTTARRPTARRPARRRLPTKLRLPRPRRAKSRRPRRPTRTSKSRRRSPPVRTMSRSSLRASSRMPTGRCTRRRVPAR

SEQ ID NO: 164687 - protein, 138 aa, Heterodera glycines
  Homolog annotation: Hit_ID=NP_588162.1; Match level="QueryCoverage =100%, HitCoverage=99%, E-value=2e-53, Identity=67%"; Hit description= ubiquitin-conjugating-enzyme-like protein [Schizosaccharomyces pombe] emb|CAA19336.1| SPCC338.05c [Schiz
  Gene Ontology: Mol. function=ubiquitin conjugating enzyme activity; Cellular component=cytoplasm; Biological process=S phase of mitotic cell cycle
  Coding regions on vcDNA: vcDNA=SeqID_91110; Strand=+; Position=32-448
MAKVPRNFRLLEELEKGEKGIGDGTISYGLANPEDIFLSDWNGTILGPPHTVHENRIYSLKIHCDANYPNSPPAVSFVSKVNLPCVSPTTGRVEASRLPCLSHWERNYTLETVLSEIRREMAAPNNKKLAQPPEGSTF

SEQ ID NO: 164688 - protein, 208 aa, Heterodera glycines
  Homolog annotation: Hit_ID=AAH76790.1; Match level="QueryCoverage =94%, HitCoverage=32%, E-value=2e-44, Identity=50%"; Hit description =Tdp1-prov protein [Xenopus laevis]
  Gene Ontology: Biological process=DNA repair
  Coding regions on vcDNA: vcDNA=SeqID_91111; Strand=+; Position=3-626
DFSHIKDRIVASVPGRFQRSGTDGDASCRFGHLRLRRLLSEAFSVEERQRHKAFVGQFSSIGSLGARPEAWLCDEFLTSLSCGRSMISASSLKLIYPSVENVRRSLEGYAAGLSLPYSSQTHQKQTYLKQFLHQWRSDRLKRSAASPHVKSYVALDAAGECQWLLLTSANLSHSAWGKLEKGGTQLFIRSFELGVLMCAKDHLRRQSP

SEQ ID NO: 164689 - protein, 205 aa, Heterodera glycines
  misc_feature (74)..(74): Xaa can be any naturally occurring amino acid
  Homolog annotation: Hit_ID=XP_392230.1; Match level="QueryCoverage =100%, HitCoverage=33%, E-value=1e-38, Identity=41%"; Hit description= similar to ENSANGP00000011155 [Apis mellifera]
  Gene Ontology: Mol. function=structural constituent of cytoskeleton; Cellular component=actin cytoskeleton; Biological process=female meiosis chromosome segregation
  Coding regions on vcDNA: vcDNA=SeqID_91112; Strand=+; Position=23-638
MAFAGDHIEELREHYPTLLQNGGSGFISSTEVQGALKLLGIDLPGYQIRELLSRHGDPKHLNCSEFEAIYMDLXSFRNAETARWKKRIGSVTGAYQVQGIAEHGAEEIVHTIRVEEEVAFANWINSSLSEDQHLKGLLPLKGGDLYGKVKDGLIICKMINLAVPETIDERALNTSVFDTYTRLENLTLALNSARAIGCAIVNIDA

SEQ ID NO: 164690 - protein, 183 aa, Heterodera glycines
  Coding regions on vcDNA: vcDNA=SeqID_91113; Strand=+; Position=41-589
LAKTLDQNHSNHSNSTRHITFSITTKMVPWWSSNPSTLNSSMESIEAAAAGEQHRHVRPVHATPPPADYFDGIVIVGQGVTADVTAAGDFVPCSTSTLAQSIERVFGNLQHQQIHPESYEEAKRLLVFAGLFFLLMCAFVLIKFQVAFDDVFRWSPAVWLVSVIICALLMNMSVQIRRFVQRI

SEQ ID NO: 164691 - protein, 72 aa, Heterodera glycines
  misc_feature (45)..(45): Xaa can be any naturally occurring amino acid
  Homolog annotation: Hit_ID=NP_502691.1; Match level="QueryCoverage =80%, HitCoverage=11%, E-value=3e-09, Identity=56%"; Hit description =selenium binding protein like (52.4 kD) (4O819) [Caenorhabditis elegans] emb|CAA19490.1| Hypothetical pro
  Coding regions on vcDNA: vcDNA=SeqID_91114; Strand=+; Position=2-217
SHPICPQSCPPPSLGPRYKSPLDDFRNGPREKVLFVTCPTVAPTXVADSVATVDVNPNSATFCQVIAQVHLP

SEQ ID NO: 164692 - protein, 112 aa, Heterodera glycines; identical to SEQ ID NO: 155557
  misc_feature (65)..(65): Xaa can be any naturally occurring amino acid
  Homolog annotation: Hit_ID=Q8WQ53; Match level="QueryCoverage=68%, HitCoverage=33%, E-value=6e-13, Identity=50%"; Hit description=Ras -related protein Rab-21 emb|CAC85935.1| Ras-realted small GTPase [Geodia cydonium]
  Coding regions on vcDNA: vcDNA=SeqID_91115; Strand=+; Position=6-345

SEQ ID NO: 164693 - protein, 40 aa, Heterodera glycines
  Coding regions on vcDNA: vcDNA=SeqID_91116; Strand=+; Position=3-122
EKGHLISILCLHLFKNDWPITPNVTFIDKHIKLQKKKKKK

SEQ ID NO: 164694 - protein, 89 aa, Heterodera glycines
  Coding regions on vcDNA: vcDNA=SeqID_91117; Strand=-; Position=0-266
KIFEFKAGGVAGRRAVVALPSYGGLYSTSMVRRGRGGGGPVVVVALHPLLSLPFLFLRCCCVVAFFLLLQLLLLLLQFLFLLLQLLLLL

SEQ ID NO: 164695 - protein, 35 aa, Heterodera glycines
  Coding regions on vcDNA: vcDNA=SeqID_91118; Strand=+; Position=1-108
IHRNAPTCPSCKCRSRSKNPKKPRKKAEPSELRRN

SEQ ID NO: 164696 - protein, 67 aa, Heterodera glycines
  Coding regions on vcDNA: vcDNA=SeqID_91119; Strand=+; Position=1-204
FIFYKLSLFRASLKKCPKTSFGDFNSATEEAPPTTAPVPPPMPGGLSDVKVCQEGDEKLTFCFGFYL

SEQ ID NO: 164697 - protein, 21 aa, Heterodera glycines
  Coding regions on vcDNA: vcDNA=SeqID_91120; Strand=-; Position=198-263
FFFFFFFSDGIFLFENKYIKN

SEQ ID NO: 164698 - protein, 167 aa, Heterodera glycines
  Homolog annotation: Hit_ID=NP_501363.1; Match level="QueryCoverage =91%, HitCoverage=33%, E-value=1e-37, Identity=48%"; Hit description =p38 Map Kinase (54.9 kD) (pmk-3) [Caenorhabditis elegans] gb|AAB92065.2| P38 map kinase family protein 3
  Gene Ontology: Mol. function=MP kinase activity; Cellular component =nucleus; Biological process=protein kinase cascade
  Coding regions on vcDNA: vcDNA=SeqID_91121; Strand=+; Position=1-501
TTTNSSSDCSSTATRPFVHINVNTVEYAVPSEYQFVDYLGGGNYGNVIKVRAAQGVELAVKKMYEPFSSAIKARRVFRELKLLQLISHENIIQFVDMYTPDMDDKCFKNVYIVSGYAGVSLKQVLDRQKQLGQSLINHDHIKYIVYQLLRALKYLHSANVIHRDLKP

SEQ ID NO: 164699 - protein, 146 aa, Heterodera glycines
  Coding regions on vcDNA: vcDNA=SeqID_91122; Strand=+; Position=1-441
VIQLPNCADAQRRVSLTNGFHPPPPYFVNSFPAQPSARPQPFAMSSPNPKPARGPPPSMLHKQIENILRSSRGRLPPNGHPFIVRKISIRSQVQQVVQKEQQVQVVQEDEQSHDLQKPKQSSNAKDESEDIIGQLIEQFKRLKVSD

SEQ ID NO: 164700 - protein, 76 aa, Heterodera glycines
  Coding regions on vcDNA: vcDNA=SeqID_91123; Strand=-; Position=3-230
HTFFKFIFIKSFKSVVVVVREASLNAVSVRTFKESNKLANSDLSACFHGNSSARTVHILSHHLLRLPSSFVCFNNL

SEQ ID NO: 164701 - protein, 167 aa, Heterodera glycines
  misc_feature (19)..(19): Xaa can be any naturally occurring amino acid
  Homolog annotation: Hit_ID=CAE56771.1; Match level="QueryCoverage =97%, HitCoverage=22%, E-value=4e-27, Identity=36%"; Hit description =Hypothetical protein CBG24575 [Caenorhabditis briggsae]
  Coding regions on vcDNA: vcDNA=SeqID_91124; Strand=+; Position=74-574
MVPHNSEFTRKLRAAVRAXIEEFGIDVDDELPDYVMIMVGNKKDKARMKSDLKLFLGDKTPDFVEWLFGFFQKVKNATTTSSASTQQPQKQSSTEWATDKEKKRTMDKDKGDGEGKAAEKVSSMEEKPTKHDRRERTRESEKPSSDRAKVISSSSAHSQPQRSSSHT

SEQ ID NO: 164702 - protein, 192 aa, Heterodera glycines
  Homolog annotation: Hit_ID=BAD32988.1; Match level="QueryCoverage =75%, HitCoverage=43%, E-value=4e-17, Identity=34%"; Hit description =putative THO complex 3 [Oryza sativa (japonica cultivar-group)]
  Coding regions on vcDNA: vcDNA=SeqID_91125; Strand=+; Position=40-615
MSASREIIATHGKEITADDHFRSANGAKEFFKRKDRSKSYEMNNVSGVRTISWNASGTYLASGSDNRVVSVGSLDPHSCRLKQIFVGYGHEDIVEAIEFAKRDEMKMASCSSDKSVRLWDLRNPSSHTKLSTPGANLFVTWSYCDNFIIFGDKSDNLGVIDARAMKTLELFTFKDEINEFVCHPNGPLIFVA

SEQ ID NO: 164703 - protein, 148 aa, Heterodera glycines
  Coding regions on vcDNA: vcDNA=SeqID_91126; Strand=+; Position=69-512
QLQNIQQELEQSEQIRVELEQRNRENNRLAQKEIDTLRSALVDQSNELQDQSKELQDQSILLQDQSKQLQKQQNTIASLLAENDSLRNRLHIFLLFLSFVAPPVAVAMKSNSRRMSHAETASALIRCTFLCFVFWFPAVIFAISFVGV

SEQ ID NO: 164704 - protein, 203 aa, Heterodera glycines
  Coding regions on vcDNA: vcDNA=SeqID_91127; Strand=+; Position=1-609
QHHPSTSSAAIASPSMSVDVPPFKMAPSSPNSAPSSDGTFSFHQQIAASSDNANAEGPKRTQQKDGAMGKKAYGRTAEGMGLPTDGQFQSHGGGGPFFGFHHHQHPSAPPVHPSMDHHHSASVPPPFMTHLHPPPFGHQIHSSAVGGGPFNVPPPVFPMSAAASVAPNAAPSFQQQLGSHAFNVGGFSSSSDSVGGPPRPQPS

SEQ ID NO: 164705 - protein, 171 aa, Heterodera glycines
  Homolog annotation: Hit_ID=CAE61720.1; Match level="QueryCoverage =94%, HitCoverage=81%, E-value=9e-45, Identity=38%"; Hit description =Hypothetical protein CBG05670 [Caenorhabditis briggsae]
  Coding regions on vcDNA: vcDNA=SeqID_91128; Strand=+; Position=42-554
MAMANSRGGMPSINPCAFGTGQFLFCKPSTAPGAPCPGQQFCHVGDSPTTTICCNKPAAVDACQQPLFVGVGPSNLVRWFFFAPSAQCQSFTYKGLQGNENNFLSRFDCEQICQANPCAVGTPLRDQQGQIGFCSATQQNICPIGFYCHAGRDVKTSLCCPMMAGDPCSQP

SEQ ID NO: 164706 - protein, 102 aa, Heterodera glycines
  Coding regions on vcDNA: vcDNA=SeqID_91129; Strand=-; Position=2-307
SLLLSSAKPFSLPPLRHPSVPMMLFRLPQLFLQRVVLLRVFLQQLPFATFCRFVEGTRWLKCLKNNDCSNNHPSEENCTFSQNECDTVGTTILLNGLSIGKR

SEQ ID NO: 164707 - protein, 78 aa, Heterodera glycines
  Homolog annotation: Hit_ID=NP_492717.1; Match level="QueryCoverage =97%, HitCoverage=98%, E-value=7e-28, Identity=77%"; Hit description =vertebrate NEDd8 related, ubiquitin-like, required for terminal differentiation of epidermis (ned-8) [Cae
  Coding regions on vcDNA: vcDNA=SeqID_91130; Strand=+; Position=4-240
MQIKVKTLTGKEIEIDVNPDDKITRVKEKVEEKEGIPPPQQRLIFGGKQMADEKTLADFNVAAGSVLHLVLALRGGSN

SEQ ID NO: 164708 - protein, 199 aa, Heterodera glycines
  misc_feature (135)..(135): Xaa can be any naturally occurring amino acid
  Homolog annotation: Hit_ID=CAG08734.1; Match level="QueryCoverage =98%, HitCoverage=19%, E-value=6e-60, Identity=58%"; Hit description =unnamed protein product [Tetraodon nigroviridis]
  Gene Ontology: Mol. function=N-acetyltransferase activity; Cellular component=nucleus
  Coding regions on vcDNA: vcDNA=SeqID_91131; Strand=+; Position=3-600
TAATGAIGDAAETATTARRRPLFELTLEESIRYAMNDPVEDWLNQTLCLNSQQSLPTSLTGTPAPDKCELYYVNRDSLFSFHKAAEVFLANLMSIYAAAHYKNSPDDLQMLADAPAHHLFVLMAPVPADQSSVPXILAVVQLCLEGSISKQSVTNVRDKGKKRAAGDLIPWTLCQHFLDDEFPTLCGARIVRVAVHPNF

SEQ ID NO: 164709 - protein, 120 aa, Heterodera glycines
  Coding regions on vcDNA: vcDNA=SeqID_91132; Strand=+; Position=102-464
ARPKGSPGRPHAPNPSASTTLSPPLVVANPSLFFSSNPSLRWILYLCRFRLPLLKFLPILQVDPCLPSSQTARRSRFSYFNAVDSVQKQVFQVAHGASLVVVCSNSHKCVPQGRPVWPRH

SEQ ID NO: 164710 - protein, 201 aa, Heterodera glycines
  Homolog annotation: Hit_ID=AAH12957.1; Match level="QueryCoverage =71%, HitCoverage=17%, E-value=6e-16, Identity=35%"; Hit description =Ash2l protein [Mus musculus] sp|Q91X20|ASH2_MOUSE ASH2-like protein dbj|BAC40047.1| unnamed protein produc
  Gene Ontology: Cellular component=nucleus; Biological process =positive regulation of transcription of homeotic gene (trithorax group)
  Coding regions on vcDNA: vcDNA=SeqID_91133; Strand=+; Position=2-604
TSSNGEKEKEAAKSKQTVAVFPDIENAEAPIQLSRETTHSNHHILIAPDNLTLRGTKGYCQAKCNNGVTEGRWYYEVDITKMGPKDNARIGWSMISSLLTGPCGFDLFSYSYRARTGVLYHDSRPRSPPAIGDLDKFIRGYGASSRALSLHWTHATPDKSLLTGPGDVLGVEIYLPKPTEQQKSILDSRVWRPKARSSYEA

SEQ ID NO: 164711 - protein, 129 aa, Heterodera glycines
  Coding regions on vcDNA: vcDNA=SeqID_91134; Strand=+; Position=1-387
LTRPPPISHQAALPPRPQQIVALFKCSSDTSTTNSFQQWHRAPSKHRRHWPTVSAAVVRRSVPAARTLAAVRRRRMSHHPLPHPRRPHRLWTNCPQILLAKQSQQHQQMDNNNSSERPHCSITTHRCVC

SEQ ID NO: 164712 - protein, 140 aa, Heterodera glycines
  Homolog annotation: Hit_ID=NP_588139.1; Match level="QueryCoverage =93%, HitCoverage=94%, E-value=1e-60, Identity=85%"; Hit description =60s ribosomal protein L23. [Schizosaccharomyces pombe] ref|NP _594075.1| 60s ribosomal protein L23. [Schiz
  Gene Ontology: Cellular component=cytosolic ribosome (sensu Eukarya); Biological process=protein biosynthesis
  Coding regions on vcDNA: vcDNA=SeqID_91135; Strand=+; Position=11-433
MAKNAKAYVSGTKFRMALGLPVGAVMNCADNSGAKNLYVISVKGTKARLNRLPKAGPGDMVLATVKKGKPDLRKKVMPAVVVRQRKPWRRRDGVFLYFEDNAGVIVNPKGEMKGSAITGPVAKECADLWPKIASASGTVV

SEQ ID NO: 164713 - protein, 152 aa, Heterodera glycines
  Homolog annotation: Hit_ID=CAE74185.1; Match level="QueryCoverage =98%, HitCoverage=45%, E-value=9e-23, Identity=42%"; Hit description =Hypothetical protein CBG21858 [Caenorhabditis briggsae]
  Coding regions on vcDNA: vcDNA=SeqID_91136; Strand=+; Position=20-475
MAAKFQTDNGEPIELKDDYQDTDPSPKAIPTEGKSRQSPTIDFVHGSPGSHKDFKYMMLPLREKGLRSVAFNWSGMGYTLFDRRLRLTNSERTAFARSLIDQLLPSPTELIFVGHSRGGENALRLAREYPARTKALLLLNSCGCRPHKGVRP

SEQ ID NO: 164714 - protein, 114 aa, Heterodera glycines
  misc_feature (62)..(62): Xaa can be any naturally occurring amino acid
  Homolog annotation: Hit_ID=AAT39478.1; Match level="QueryCoverage =100%, HitCoverage=35%, E-value=2e-25, Identity=50%"; Hit description= mannanase [Bacillus circulans]
  Coding regions on vcDNA: vcDNA=SeqID_91137; Strand=+; Position=2-343
GSDDFAKLRRAADYWIILASTLKGLEDHVIINIANEWFGSSGQAARWASGYASVLPSLRAAXLTHLIIVDSPVWGQDAISITQQGRVNFEADPDPNLIFSIHMYDAAAPYAATV

SEQ ID NO: 164715 - protein, 94 aa, Heterodera glycines
  Homolog annotation: Hit_ID=NP_501822.1; Match level="QueryCoverage =76%, HitCoverage=19%, E-value=3e-20, Identity=65%"; Hit description =C. elegans WNT family member precursor (40.4 kD) (wnt-2) [Caenorhabditis elegans] emb|CAA92624.1| Hypothe
  Gene Ontology: Mol. function=extracellular matrix structural constituent; Cellular component=extracellular space; Biological process=cell-cell signaling
  Coding regions on vcDNA: vcDNA=SeqID_91138; Strand=+; Position=159-443
TYLKIFFNINYFLNKWNFEECEWQFRYHRWNCSTPQELKEHIGPIHKKGTREAAFTYAILSAGVTHEIGRRCRLGFLRSCGCSESDNAPNRVGF

SEQ ID NO: 164716 - protein, 191 aa, Heterodera glycines
  Homolog annotation: Hit_ID=NP_495470.1; Match level="QueryCoverage =100%, HitCoverage=85%, E-value=1e-50, Identity=50%"; Hit description= ribosomal protein L10 (25.3 kD) (2H403) [Caenorhabditis elegans] gb|AAA82424.1| Hypothetical protein F10
  Gene Ontology: Biological process=protein biosynthesis
  Coding regions on vcDNA: vcDNA=SeqID_91139; Strand=+; Position=51-623
MPKSKRDRVVSLTKVKKKSREGKENILKEVRECVGQYKHLFVFSTENLRSARLAEVRQHFKQNSRIFFAKNNLMAVALGRSAQDEQANELHKVSALLRGQSGLMFTNAKAKEVQRFFDEHTEAEFAQAGAVASADISLPAGPMPAELHLHGAMEPQLRKLGMPTRLENGAIELLEAFTLCKTGDQLSADQA

SEQ ID NO: 164717 - protein, 51 aa, Heterodera glycines
  Coding regions on vcDNA: vcDNA=SeqID_91140; Strand=-; Position=1-153
FSAQQQRKMLQRSAFLNQFHVEATYALKAYAQNMMNRGIELLKSVYFWNTK

SEQ ID NO: 164718 - protein, 207 aa, Heterodera glycines
  Coding regions on vcDNA: vcDNA=SeqID_91141; Strand=+; Position=1-621
PIVFNVAPISAWRLVFSQEGQELAALSLSPPHSVALFFNYGLENLRQLKGIERGDILMDAAWHKSTSALKSTTKFFYTLSKKRRLCRHAIAYELSNEIRDEMSTPIMQSAVDEERDRMIAAAASAVEERTETLPSGNLEERSRKEIELPAPTRPFPRHLVGSGQSSGKTALGFGTANLKSLISSLKAEGGRSAGGTTDGGHKTPQSP

SEQ ID NO: 164719 - protein, 199 aa, Heterodera glycines
  Homolog annotation: Hit_ID=CAE67763.1; Match level="QueryCoverage =78%, HitCoverage=19%, E-value=8e-20, Identity=39%"; Hit description =Hypothetical protein CBG13338 [Caenorhabditis briggsae]
  Coding regions on vcDNA: vcDNA=SeqID_91142; Strand=+; Position=2-601
NLGADVLKFRYFIGYYLQSEEDKGPVLAVSKWETHSTPRCVMPPVEASTAGICRANLRDIFGFSGGREFFSDGWVLTDEMHQILMTVSGEALKFYKQKHIREEYMLKMVPFDLRRNRNDASNAEDDEEPTVTAMDELPPLTHPALPSHSPTEIAVRSNYSPVPSTGTLKLTLFLRLGHFPPELVFVVRSLRSLPIAFFV

SEQ ID NO: 164720 - protein, 64 aa, Heterodera glycines
  Homolog annotation: Hit_ID=CAE71845.1; Match level="QueryCoverage =100%, HitCoverage=9%, E-value=2e-17, Identity=62%"; Hit description =Hypothetical protein CBG18887 [Caenorhabditis briggsae]
  Gene Ontology: Mol. function=protein binding; Cellular component =endomembrane system; Biological process=receptor mediated endocytosis
  Coding regions on vcDNA: vcDNA=SeqID_91143; Strand=+; Position=2-196
LSDVDKDGHLDSDEFALSNYLINLKLEGHELPTELPKHLVPPSKKAMAGDASSSDNQIYPTLDE

SEQ ID NO: 164721 - protein, 99 aa, Heterodera glycines
  misc_feature (92)..(93): Xaa can be any naturally occurring amino acid
  Coding regions on vcDNA: vcDNA=SeqID_91144; Strand=+; Position=173-469
KLLQEISQTPSGRRKREKCHFWSGAISCGGKNANKKWHKHSLILTTLIEGLVVVENGETIGQQQEQELGTEKKPPVWVGTFLIWHNLWRNDXXKKKKKK

SEQ ID NO: 164722 - protein, 209 aa, Heterodera glycines
  Homolog annotation: Hit_ID=XP_513252.1; Match level="QueryCoverage =98%, HitCoverage=24%, E-value=8e-29, Identity=35%"; Hit description =PREDICTED: hypothetical protein XP_513252 [Pan troglodytes]
  Gene Ontology: Mol. function=sphingomyelin phosphodiesterase activity; Cellular component=extracellular space; Biological process= ceramide biosynthesis
  Coding regions on vcDNA: vcDNA=SeqID_91145; Strand=+; Position=2-628
QFPDAVLLPVLGNHDSAPGNSFTDHPAKQQIYEKMFIIWKQWIGQEGKESFTRGGYYRVETSAGLFLVLNTNIYYESNPLRKELVEPEDPTSQFDFLQFELEKARQKGVPVHILGHVPPGAFEEYSVNKLEMEQIPQKYNQKLVDLLVEYAPQIGWIFFGHYHTDTFRVIKNSDGKAVQRFFTAPALTPAFQKNNPAFRVADYNTDTWE

SEQ ID NO: 164723 - protein, 154 aa, Heterodera glycines
  Coding regions on vcDNA: vcDNA=SeqID_91146; Strand=+; Position=147-608
STVLTITAICCAPVTTCTGKSFSPTSPPFRNCFYPRPYHIKALNPELFPLFDTVRAEHRERPLTFDEAQAMTFEDMQKRRLEFDLQSWHSNDEPTPLRQRVEESFGDAGGEQRREETQGKEKVSVSDALVETADKEKEGTAELAAHRPSSVLEG

SEQ ID NO: 164724 - protein, 185 aa, Heterodera glycines
  Homolog annotation: Hit_ID=NP_501127.2; Match level="QueryCoverage =77%, HitCoverage=11%, E-value=2e-49, Identity=62%"; Hit description =RNA Polymerase, Class III (C), rna polymerase (rpc-1) [Caenorhabditis elegans] gb|AAA83341.2| Rna polymer
  Gene Ontology: Mol. function=DNA-directed RNA polymerase activity; Cellular component=DNA-directed RNA polymerase III complex; Biological process=growth
  Coding regions on vcDNA: vcDNA=SeqID_91147; Strand=+; Position=10-564
MEYRMLSDDHLMVPFPSGVPIRRSLGTLGGNLTEQDRKNAPLTMAQCVSKGSFINIAQMIALVGQQSISGKRPSDGFENRSGLTPTEFFFHTMGGREGLVDTAVKTAETGYMQRRLVKCLEGQDLAVNYDNTVRTSTNEVVQFTFGDDGLDPAYMEAKDGRPLDFQPMLAQVRNITSNSTCLGQM

SEQ ID NO: 164725 - protein, 189 aa, Heterodera glycines
  Homolog annotation: Hit_ID=BAB84117.1; Match level="QueryCoverage =98%, HitCoverage=36%, E-value=1e-16, Identity=32%"; Hit description =hSSH-2 [Homo sapiens]
  Gene Ontology: Biological process=regulation of actin polymerization and/or depolymerization
  Coding regions on vcDNA: vcDNA=SeqID_91148; Strand=+; Position=54-620
MSLISVQRSPSPIDEPSAVNDSDCESEGQRTGSSGQKSRTLSECFFTVRGTAVILPHHSTNESSASLAVRCCSNRTNAEGGEDSIQAHLHVMLNALRPEDSLTMVVRLQSPSLVSPSSPHVRYLAVLSTQFDATESREAALLGFHFIGPSTSTAPRSAIGIAVPISTSSTICLDGDGGIKIEEDKQPNS

SEQ ID NO: 164726 - protein, 75 aa, Heterodera glycines
  Homolog annotation: Hit_ID=AAK82924.1; Match level="QueryCoverage =89%, HitCoverage=12%, E-value=2e-15, Identity=53%"; Hit description =Abnormal cell lineage protein 17, isoform b [Caenorhabditis elegans]
  Coding regions on vcDNA: vcDNA=SeqID_91149; Strand=+; Position=107-331
SLIHPIRAPHILFFVCSVFVPMCPARLPQAHTSCRSVCYDALHDCIKILHECNFPWSPVIHCCRFPASPELRMSP

SEQ ID NO: 164727 - protein, 197 aa, Heterodera glycines
  Homolog annotation: Hit_ID=NP_500617.1; Match level="QueryCoverage =98%, HitCoverage=19%, E-value=3e-51, Identity=55%"; Hit description =dehydrogenase, E1 component and Transketolase, central region (115.7 kD) (4F462) [Caenorhabditis elegans]
  Gene Ontology: Mol. function=oxoglutarate dehydrogenase (lipoamide) activity; Cellular component=mitochondrion; Biological process =embryogenesis and morphogenesis
  Coding regions on vcDNA: vcDNA=SeqID_91150; Strand=+; Position=25-615
MFRIVAKRSLSTTRQWLQQPTHRPPSSALSAEPFMNATSGVYIEQMYESWQLDRGSVHRSWDAFFTNVNAGAAPGQAFQAPPSVPSLSTVPHATVVPRDMREVQPQTAGQVIPADELTRAINDHLKIQVLIRSFQTRGHNIADLDPLGINSADLDDTIPRELELDFYGFTEQDMDREFLLPPTTFIGGERATLSLRE

SEQ ID NO: 164728 - protein, 186 aa, Heterodera glycines
  Homolog annotation: Hit_ID=EAA13587.2; Match level="QueryCoverage =98%, HitCoverage=31%, E-value=2e-49, Identity=51%"; Hit description =ENSANGP00000014333 [Anopheles gambiae str. PEST]
  Gene Ontology: Mol. function=chaperone activity; Cellular component =TRAPP; Biological process=reproduction
  Coding regions on vcDNA: vcDNA=SeqID_91151; Strand=+; Position=48-605
MDLVLIVQQYINEMVRLAGPGMKAILMDKETTSCVSCAYAQSEMMQKEIYLFERLDSVVIREPIKFLKCVVFVRPTQENVQLLSEELQSPKYSQYYIYFSNRIPKADVKILAESDEQETVRELREFFVDFVPLAPHLVSLNISTAYETQQFGISASTFRRCLQALVALALSLNKKPTIRYQKTSRD

SEQ ID NO: 164729 - protein, 91 aa, Heterodera glycines
  Coding regions on vcDNA: vcDNA=SeqID_91152; Strand=+; Position=26-298
RIGAAYVRIHCRRAAAVALLGLMNWTISSDCQRHTTIRPYLSFSNAIVMQKPPHNEGLRAKKCHLLFCCYFMYLNPFYCINANLKKKKKKK

SEQ ID NO: 164730 - protein, 125 aa, Heterodera glycines
  Coding regions on vcDNA: vcDNA=SeqID_91153; Strand=+; Position=248-622
IEELLLGQLRVIQTNMRICVHFKNGQMANFTIGEIFPRVQMANCFANGNSLSHPPAFLMAYGTRLLVNAPHSAAASDEKLVEGNVKGMRKESERAAEGTASLGRAFVPGIGSEVSDCFYSSMVPA

SEQ ID NO: 164731 - protein, 190 aa, Heterodera glycines
  Homolog annotation: Hit_ID=NP_741190.1; Match level="QueryCoverage =98%, HitCoverage=21%, E-value=5e-35, Identity=47%"; Hit description =A kinase anchor protein 1 (96.4 kD) (3H455) [Caenorhabditis elegans] gb|AAM22053.1| Hypothetical protein
  Gene Ontology: Mol. function=RNA binding
  Coding regions on vcDNA: vcDNA=SeqID_91154; Strand=+; Position=52-621
MMLQQQHHHRNGVTSDGIRRTYAGRASIGSTGTASGGRQHPVNGICECKHCTEALNDLHSSRGYKNAESPNSTHSEGSADSGRATGHLTSYSPFADAAAELGQQAADNLPIYEFEVPNTLVGLIIGIKGKTIKELCTRADVRMLIRPHHTQGKFDTHQLCSVEGRRDNINKCLHMIRLRFPPCRFPDLNL

SEQ ID NO: 164732 - protein, 153 aa, Heterodera glycines
  Coding regions on vcDNA: vcDNA=SeqID_91155; Strand=+; Position=143-601
WKGKRTQCQWSTFTARLRAKVVGIFNGGFPNRDFSKFVFITELRSRPVYGFCAASKKEAKKACALRLLDILMTEERLECVNLSGRKVRKMPPKPIPTKAANVEQSQQQENMHLSFSDDIDLDAIRKDFERLNPLPSAANESEVFARLRSTAFR

SEQ ID NO: 164733 - protein, 195 aa, Heterodera glycines
  Homolog annotation: Hit_ID=BAA88672.1; Match level="QueryCoverage =91%, HitCoverage=39%, E-value=5e-12, Identity=28%"; Hit description =CiMsi [Ciona intestinalis]
  Gene Ontology: Cellular component=cytoplasm
  Coding regions on vcDNA: vcDNA=SeqID_91156; Strand=+; Position=17-601
MSHYISAENEPKAVEASQPTNRVFINNLTSDLEEFTIYKYCTAYGEITKCQILKDSKNGMSRGFGFITYALPSSAQAILNGRPHYIGHHKIDVRPAFPTSEIVVSTMVSSSSSSYCDQSDDLPKILQSRRLLIVYNIAEATRNDLSEPAIFGYLSSFGIVKEIVQQFSTSSEEAKQNPVNEYWIVDFLDELSVER

SEQ ID NO: 164734 - protein, 89 aa, Heterodera glycines
  Coding regions on vcDNA: vcDNA=SeqID_91157; Strand=-; Position=2-268
KSGLAIGLFQGLPLPLSKCDCFVTSLRRPSIVPIARVKPKMLEKAMMATILAKAPSALAIAHSQSVSSVRLFIAAQIVMVTTRRGTMTQ

SEQ ID NO: 164735 - protein, 186 aa, Heterodera glycines
  Homolog annotation: Hit_ID=YP_002416.1; Match level="QueryCoverage =50%, HitCoverage=59%, E-value=2e-09, Identity=37%"; Hit description =hypothetical protein LIC12488 [Leptospira interrogans serovar Copenhageni str. Fiocruz L1-130] ref|NP_711
  Coding regions on vcDNA: vcDNA=SeqID_91158; Strand=+; Position=50-607
MAMHTTLARLVQTAGLTRPAWRRLTPISAAIPAGNPPSPPTSPIEPSRHISTSPRLLSGNEDGDSRYPAIAAGHGPWPFASSPAQLHLAVRPLAKSYPSHLHIQVQWGDQDAFGHLNNVSLMRYFESVRMQYLIDFSRHLPAGQRHSFAHPTPGYPGPIVANVTTRYRAQVHYPDTLTYFLRVSER

SEQ ID NO: 164736 - protein, 169 aa, Heterodera glycines
  misc_feature (110)..(110): Xaa can be any naturally occurring amino acid
  Homolog annotation: Hit_ID=NP_524207.1; Match level="QueryCoverage =100%, HitCoverage=51%, E-value=6e-17, Identity=32%"; Hit description= CG7405-PA [Drosophila melanogaster] gb|AAF51784.1| CG7405-PA [Drosophila melanogaster] gb|AAC26868.1| cy
  Gene Ontology: Mol. function=cyclin-dependent protein kinase activity; Cellular component=nucleus; Biological process=regulation of CDK activity
  Coding regions on vcDNA: vcDNA=SeqID_91159; Strand=+; Position=36-542
MYFVGTQIQNWTSQSLDELEQLRISANAKHINRFQSVLAERPGIVSDDFLTAREETVICRIVSESGIRFVFYFKPEMWPSVRWIAFSYFKRLYLRESAMEYYPKNVRMAXYYLAAKVDDTKASIDNCGDNVRNGARTGDTETILTIEQGGTLKLKYHWTEHPPRRPLEG

SEQ ID NO: 164737 - protein, 125 aa, Heterodera glycines
  Homolog annotation: Hit_ID=NP_524430.1; Match level="QueryCoverage =96%, HitCoverage=24%, E-value=2e-28, Identity=49%"; Hit description =CG3412-PA [Drosophila melanogaster] gb|AAF55853.1| CG3412-PA [Drosophila melanogaster] gb|AAM50758.1| LD0
  Gene Ontology: Mol. function=ubiquitin conjugating enzyme activity; Cellular component=endoplasmic reticulum; Biological process =locomotor rhythm
  Coding regions on vcDNA: vcDNA=SeqID_91160; Strand=+; Position=2-379
YLSEREKALSVRYLHERDAMFERFSEWTEQDQTDFCKHLLQSMCDHQHGQIDQFLGPMLQRDFIALLPTGLAENVLHLLDTKSMCASEFVSRPWNRVIDHGLLWHEHIERQVSNDALWAGLSIQR

SEQ ID NO: 164738 - protein, 158 aa, Heterodera glycines
  Coding regions on vcDNA: vcDNA=SeqID_91161; Strand=-; Position=24-500
FLINSIHKITIISIFLIICSADHFLPNVFVLSLPLSLLSEAESNSQTNVHVSVHHKARSSTQGTVAVGSVIAEALSAAQVAKVAKTDKKLKFHETKSLSAASLTEPHLPVFLANACWEASQVWLAAVIWPFEWPQKANNTIKQKRRKIIGGELGKKLR

SEQ ID NO: 164739 - protein, 186 aa, Heterodera glycines
  Homolog annotation: Hit_ID=EAL27882.1; Match level="QueryCoverage =95%, HitCoverage=28%, E-value=8e-18, Identity=33%"; Hit description =GA14079-PA [Drosophila pseudoobscura]
  Gene Ontology: Mol. function=protein serine/threonine kinase activity; Cellular component=cytoplasm; Biological process=eye photoreceptor development (sensu Drosophila)
  Coding regions on vcDNA: vcDNA=SeqID_91162; Strand=+; Position=48-605
MARERIVTSKKRRHDRDSSDYVEESKRRCDEARKRQIDREDRARRRSREKREQVEKEYEYYLQIACSESKKESQKNGGQQHNFDANGGARHHRTHNQHHHSAIQGECGVVVSASPAHRLPIQDDKDGHLIYSNGDRIDNKFEIVKTLGEGTFGKVVQVKDLNNPKGPQRALKIIKNVSKYREAARL

SEQ ID NO: 164740 - protein, 190 aa, Heterodera glycines
  Homolog annotation: Hit_ID=NP_499161.1; Match level="QueryCoverage =56%, HitCoverage=6%, E-value=2e-30, Identity=55%"; Hit description =CBP/p300 homolog (cbp-1) [Caenorhabditis elegans] emb|CAA82353.2| Hypothetical protein R10E11.1a [Caenorha
  Gene Ontology: Mol. function=signal transducer activity; Cellular component=cytoplasm; Biological process=signal transduction
  Coding regions on vcDNA: vcDNA=SeqID_91163; Strand=+; Position=32-601
MRGGGITQQQQTAGNHPQQQMLGCAGQPQDPKARKLIQQQLVLLLHAHKCQQIERSEPLQNRAPCTLPYCSVMKGVLDHMVDCSAGRQCQYAHCASSRQIIAHWKNCNKDDCPVCNVHINETMVVDPRQAGIMLSAVGFPSVTLAQGAIGQQQQSMNNANSGGPPQARGWHNAAATNGWQSSTANALRGQ

SEQ ID NO: 164741 - protein, 171 aa, Heterodera glycines
  Homolog annotation: Hit_ID=NP_495773.1; Match level="QueryCoverage =60%, HitCoverage=8%, E-value=1e-25, Identity=53%"; Hit description =golgi apparatus protein 1 (131.7 kD) (2I714) [Caenorhabditis elegans] emb|CAA91405.1| Hypothetical protein
  Coding regions on vcDNA: vcDNA=SeqID_91164; Strand=+; Position=102-614
SAVKHYMALVDTQQYEACHQEAVTRCHATDNWHENTNKLPGQDQKVVVDPGPQVLACLYHSGFDETDPLGKECALYVRQVLRERAARVNMLPDIEENCCDALSEYCFQIVMLDNYCSPKVDIESEGKTVHSFLVHSQEKDEGKNGLHYFKTQERERKKAEKDKSVKQRQWH

SEQ ID NO: 164742 - protein, 205 aa, Heterodera glycines
  Coding regions on vcDNA: vcDNA=SeqID_91165; Strand=+; Position=1-615
DMADQTDVFGVASSSIGKPIRVELGTGSRKTIISGNLLTTDPESGSIVLVEKRQQNKTSDQGKCSQRFILIPGSSVHSAKLVTINEGTIGTVKKDGQLEEGTKSNAELREKADGIESGDEATIESHGKRTLSETVRIFDEFALSRRLCLIDALNKYGIKFSEKPHVLVQNIDNGQTEGQMPSTVISLQSGGIKIYPPYGKNDIIG

SEQ ID NO: 164743 - protein, 36 aa, Heterodera glycines
  Coding regions on vcDNA: vcDNA=SeqID_91166; Strand=-; Position=136-246
FFFFFFFGNQNLKVIKNITESYTSPIINFVWSILCV

SEQ ID NO: 164744 - protein, 134 aa, Heterodera glycines
  Homolog annotation: Hit_ID=NP_492711.1; Match level="QueryCoverage =85%, HitCoverage=10%, E-value=3e-24, Identity=48%"; Hit description =glutamyl (E) tRNA Synthetase, glutaminyl (Q) tRNA Synthetase (125.2 kD) (ers-2) [Caenorhabditis elegans]
  Gene Ontology: Cellular component=mitochondrion; Biological process =protein complex assembly
  Coding regions on vcDNA: vcDNA=SeqID_91167; Strand=+; Position=3-407
EVDLDLDNKDYKKTLKVTWLAKRAENFAVKTVRFDHLISTPIIGKEEDWKEFVNRDSEHFGTLLAEPALQKVNCGDILQIQRKSFYICDAKTANSMTLIEIPDGRETKNAAQKGPEGKETKKEGKETKKAKIVN

SEQ ID NO: 164745 - protein, 110 aa, Heterodera glycines
  misc_feature (46)..(46): Xaa can be any naturally occurring amino acid
  misc_feature (98)..(98): Xaa can be any naturally occurring amino acid
  Homolog annotation: Hit_ID=CAD90560.1; Match level="QueryCoverage =98%, HitCoverage=21%, E-value=9e-41, Identity=68%"; Hit description =cytochrome c oxidase subunit I [Strongyloides stercoralis] ref|NP _937900.1| cytochrome c oxidase subunit I
  Gene Ontology: Mol. function=cytochrome c oxidase activity; Cellular component=mitochondrial inner membrane; Biological process =mitochondrial electron transport, cytochrome c to oxygen
  Coding regions on vcDNA: vcDNA=SeqID_91168; Strand=-; Position=1-330
FFFLLILTLPVLAGAITLLLVDRNFNGNFFDRTGGGNPLVFQHLFXFFGHPEVYVLILPAFGLVRLTIQFYTGKKILFGYLGIIYAIISIGFIGCLVXAHHIFVVGIDID

SEQ ID NO: 164746 - protein, 168 aa, Heterodera glycines
  Homolog annotation: Hit_ID=CAE60218.1; Match level="QueryCoverage =83%, HitCoverage=59%, E-value=5e-31, Identity=50%"; Hit description =Hypothetical protein CBG03787 [Caenorhabditis briggsae]
  Gene Ontology: Mol. function=endodeoxyribonuclease activity; Cellular component=nucleus; Biological process=nucleotide-excision repair
  Coding regions on vcDNA: vcDNA=SeqID_91169; Strand=+; Position=41-544
MATTSSENDQPQTSALLAPALTRGNPFGLSTLKINRRRQEGNPVLKYIRNVPYEWSSDVKCDFECSGNCGLLYLALKYHKLHCGYIETRFTDLRAYPVKVLLAYVNVEDPSFLLRDLNMFCYRMDVSLVLCYSVEEAAEFIETFKFTENRSAESELARIQQNKLQRQQ

SEQ ID NO: 164747 - protein, 58 aa, Heterodera glycines
  Coding regions on vcDNA: vcDNA=SeqID_91170; Strand=-; Position=2-175
NKKKQRLNALNSFFLLPFHPAVLLLFLDCLTWFPDEILSGSLGSFSISSSSISPCRCG

SEQ ID NO: 164748 - protein, 55 aa, Heterodera glycines
  Coding regions on vcDNA: vcDNA=SeqID_91171; Strand=+; Position=3-170
PPKKIKKRARSARHEAAKRPNVLKKLKDGREAPVLRPRSGRMSPKKLKTGAIFPS

SEQ ID NO: 164749 - protein, 193 aa, Heterodera glycines
  Coding regions on vcDNA: vcDNA=SeqID_91172; Strand=-; Position=0-578
IMEPRPALTTVKSGIAGGASVETASGVAIGSVIPRIECWWPAFTSTTDGEMEAIPVTGASAALASEAEMTARLALEIEVKKPSRIACAVLDARSAKRFPRGSAAAELAPAEAGSRLVDDGCEVPGLCNAAALFMTQDVRSPRTSAAVNDGPKAHSKGDVARKVCSSKRRRGIIFRRRNAFSRRCHSWSYLCLT

SEQ ID NO: 164750 - protein, 121 aa, Heterodera glycines
  Coding regions on vcDNA: vcDNA=SeqID_91173; Strand=-; Position=0-362
INPTEIVTPTARRVFIGGWQNAHRFHQIFAIIAVRLKHLQSLLVIQHCVRSFFGRENDCIAELQSFLKSNNLCIFHAIWIFADKKSPWHCEEWRVFVPKYEMHNVSLQRRRDNDTIVNRRT

SEQ ID NO: 164751 - protein, 188 aa, Heterodera glycines
  Homolog annotation: Hit_ID=AAL78214.1; Match level="QueryCoverage =77%, HitCoverage=73%, E-value=1e-19, Identity=40%"; Hit description =putative esophageal gland cell protein Hgg-20 [Heterodera glycines]
  Coding regions on vcDNA: vcDNA=SeqID_91174; Strand=+; Position=51-614
MVDHPRRIFKQICICADILLDCFRLLAPAKVGLALALVSDRFDVLADTHFRSRKWPIGNLGICRGKNGAAIHNQKGGEGRTAAVKRLLPIPQVPLPNGVVGFGRIGLGYIDGTVIAFLRRIRRLFHTNGVTLELSFSSVEGRSCDAFASSIWPLLNAAAIVEMRFKVNNNLGYLRSRLSPSILRDCAN

SEQ ID NO: 164752 - protein, 95 aa, Heterodera glycines
  Homolog annotation: Hit_ID=NP_492346.1; Match level="QueryCoverage =60%, HitCoverage=19%, E-value=3e-09, Identity=44%"; Hit description =aminomethyltransferase (1J241) [Caenorhabditis elegans] pir||T22009 hypothetical protein F39H2.3 - Caenor
  Coding regions on vcDNA: vcDNA=SeqID_91175; Strand=+; Position=2-286
IENETAPDDYAASSADLRHRLACGLAEGTEMVHQIPLNMNGDITGLISFEKGCYIAQELVAHTHLTAIVRRRLMPFRPIDDKNGRPDFPRRISAG

SEQ ID NO: 164753 - protein, 197 aa, Heterodera glycines
  Coding regions on vcDNA: vcDNA=SeqID_91176; Strand=+; Position=14-604
MDAPQPQALAEPQPSRDNPPALALGSSPQVRTSAVQSMSPVGRIDPASSPLFASNLPVHPIPSPKMPSSTARCHVSRRPRLAVLAGLALAVIAVISVQSPRLAVAVAAPNPQRRDGGILDRILPNRDGGGNDDSSSTPTTPLPPPSGNRNGGRNANDDDIGILPIVGGNQSENENADNNNGGGSSNNNNGNGGGRNS

SEQ ID NO: 164754 - protein, 193 aa, Heterodera glycines
  Homolog annotation: Hit_ID=AAP22960.1; Match level="QueryCoverage =100%, HitCoverage=63%, E-value=1e-80, Identity=75%"; Hit description= 14-3-3-like protein [Paracoccidioides brasiliensis]
  Gene Ontology: Mol. function=DNA binding; Cellular component=nucleus; Biological process=regulation of mitosis
  Coding regions on vcDNA: vcDNA=SeqID_91177; Strand=+; Position=27-605
MATERDNQVYMAKLSEQAERYDEMVNFMKEVAKLGVELTVEERNLLSVAYKNVIGARRASWRIVSSIEQKEENKGNSAQVDKIKAYRQKIEAELSDVCSDILAVLDQYLIPSAEAGESKVFYYKMKGDYHRYLAEFAAGDKRKEAASSAHDAYKHATDIAQTELAPTHPIRLGLALNFSVFYYEILNSPDRAC

SEQ ID NO: 164755 - protein, 147 aa, Heterodera glycines
  Homolog annotation: Hit_ID=NP_491357.1; Match level="QueryCoverage =78%, HitCoverage=25%, E-value=3e-27, Identity=50%"; Hit description =pyruvate dehydrogenase phosphatase (50.7 kD) (1E937) [Caenorhabditis elegans] gb|AAF40007.1| Hypothetical
  Coding regions on vcDNA: vcDNA=SeqID_91178; Strand=+; Position=25-465
MQNCCPPLCHRASQKCWHRISHHRHFTLRRAAIDQLLKANERRFILSDDHQQSVLRVDVAQVAANRPIEDFYSASKCLYSNAFLFGIFDGHGGAACARHVCTRLFDYICCSALDKHRVVQIPVGEQIQWLGANAPHSLPQEKDDAHL

SEQ ID NO: 164756 - protein, 189 aa, Heterodera glycines
  Homolog annotation: Hit_ID=AAS64750.1; Match level="QueryCoverage =97%, HitCoverage=38%, E-value=3e-26, Identity=38%"; Hit description =cyclin L; C52E4.6a [Caenorhabditis elegans] ref|NP_506007.1| cyclin (56.0 kD) (5M472) [Caenorhabditis eleg
  Coding regions on vcDNA: vcDNA=SeqID_91179; Strand=+; Position=1-570
KAWSFMNDGLRTDMFLRYTPETIACACIQLAVRTVDQPIVLPTEPFAWFELFDASDRDVRAISQTIWELYTRKKAPNLKWVSDHLEQLYQKAVVEPEKARKEKTMVEMRDIKEQILQRKSAMLFGAGKTVADDRSPPKRRRRDMAGQNVAETKRRRDRTPPRQNVAETKRRRDKTSPRQNVAEKKYSKN

SEQ ID NO: 164757 - protein, 184 aa, Heterodera glycines
  Coding regions on vcDNA: vcDNA=SeqID_91180; Strand=+; Position=3-554
LFCTIFESMSSLFDSTWEGHLQHIKFWRSEVKRSLGESISNVQLVKGADGTMAVVGLATAPGDSAHVQMVMQAELPDISLGYDFEQDETKQRPTLELQPLFSHKTEAEHSTDASPRKIPPELALHYERMRGQMVDGVDDFKLHEKSGAVLFTTAKEISIFKGGEIKNIAQWRPSSAVLNVSFCE

SEQ ID NO: 164758 - protein, 84 aa, Heterodera glycines
  Homolog annotation: Hit_ID=NP_730664.1; Match level="QueryCoverage =92%, HitCoverage=16%, E-value=1e-11, Identity=43%"; Hit description =CG7807-PA, isoform A [Drosophila melanogaster] gb|AAF51751.1| CG7807- PA, isoform A [Drosophila melanogast
  Gene Ontology: Mol. function=transcription factor activity; Cellular component=nucleus; Biological process=leg joint morphogenesis (sensu Holometabola)
  Coding regions on vcDNA: vcDNA=SeqID_91181; Strand=+; Position=2-253
KAKSKDGGRLLREQLHMYGVELALGRRKQSPLSCFSSLVEQEAVQLATDFRTICQRDYPIQAVATHSLAGVNNGQDAYIPRMEL

SEQ ID NO: 164759 - protein, 51 aa, Heterodera glycines; identical to SEQ ID NO: 146846
  Coding regions on vcDNA: vcDNA=SeqID_91182; Strand=-; Position=124-279

SEQ ID NO: 164760 - protein, 175 aa, Heterodera glycines
  Homolog annotation: Hit_ID=CAE67219.1; Match level="QueryCoverage =96%, HitCoverage=81%, E-value=1e-54, Identity=60%"; Hit description =Hypothetical protein CBG12656 [Caenorhabditis briggsae]
  Gene Ontology: Mol. function=transporter activity; Cellular component= ER-Golgi transport vesicle membrane; Biological process=ER to Golgi transport
  Coding regions on vcDNA: vcDNA=SeqID_91183; Strand=+; Position=1-525
HLSSVLFLPLLLLLSKFTPSSVATELTFELPDNANQCFYEEIKKDVDCSLEFQVVTGGQYDVDVVLEDPNGKVLYKEARKQLDTHTYKTEANGTYKVCFSNEFSTFSHKVVYLDWQVGPDEQHKMMPIPRAGGAQATQMERSAETISDRLQIVDDYQTHHPLREATSRKRAEDLN

SEQ ID NO: 164761 - protein, 193 aa, Heterodera glycines
  Homolog annotation: Hit_ID=NP_505641.2; Match level="QueryCoverage =94%, HitCoverage=87%, E-value=7e-82, Identity=81%"; Hit description =SNAP-25 (23.1 kD) (5K742) [Caenorhabditis elegans] emb|CAA16322.2| Hypothetical protein Y22F5A.3 [Caenorh
  Gene Ontology: Mol. function=t-SNARE activity; Cellular component =plasma membrane; Biological process=synaptic vesicle fusion
  Coding regions on vcDNA: vcDNA=SeqID_91184; Strand=+; Position=31-609
MAKKGGGNAAEVPDSLDEINLRINHTADESLESTRRMLAYCEESKEAGIKTLVMLDDQGEQLERVEGNLDQINTDMKEAEEHLKGMEKCCGLCVLPCLKGNDFEKNSEYAKTWKKDDDGGVISDQPRITVGDSGMGPQGGYITRITSDAREEEMDENIQQVSTMVGNLRNMAIDMSTEVSNQNRQLSRIQEKA

SEQ ID NO: 164762 - protein, 117 aa, Heterodera glycines
  Homolog annotation: Hit_ID=Q27666; Match level="QueryCoverage=92%, HitCoverage=67%, E-value=2e-33, Identity=57%"; Hit description =Superoxide dismutase [Cu-Zn] emb|CAA93447.1| cytoplasmic superoxide dismutase [Haemonchus contortus]
  Gene Ontology: Mol. function=copper, zinc superoxide dismutase activity; Cellular component=cytoplasm; Biological process =neurogenesis
  Coding regions on vcDNA: vcDNA=SeqID_91185; Strand=+; Position=2-352
DPSVKGMITFPQDEEGSPVTVHGEISGLEPGLLGFHGHAYGDLSNGCTCAGPHFDPTNKTHGGPHDQIRHVGDLGKVHAGPEGIGKLTFSDHLISLCGANNIVGRALVEQQSERQFG

SEQ ID NO: 164763 - protein, 72 aa, Heterodera glycines
  misc_feature (41)..(41): Xaa can be any naturally occurring amino acid
  Homolog annotation: Hit_ID=AAH53812.1; Match level="QueryCoverage =98%, HitCoverage=49%, E-value=2e-11, Identity=56%"; Hit description =Rps15-prov protein [Xenopus laevis] gb|AAH81261.1| Unknown (protein for MGC:86345) [Xenopus laevis] pir||C
  Coding regions on vcDNA: vcDNA=SeqID_91186; Strand=+; Position=47-262
LLLDMNGKQVHQMIPARQRRKMNRGLCLQPNSWLDLLRNAXLNCPQLMIAECGKTHLRDMIVLPEMVGCVGV

SEQ ID NO: 164764 - protein, 133 aa, Heterodera glycines
  Homolog annotation: Hit_ID=AAH41712.1; Match level="QueryCoverage =97%, HitCoverage=30%, E-value=2e-29, Identity=54%"; Hit description =MGC52531 protein [Xenopus laevis]
  Gene Ontology: Mol. function=transcription factor activity; Cellular component=nucleus; Biological process=central nervous system development
  Coding regions on vcDNA: vcDNA=SeqID_91187; Strand=+; Position=137-538
MGATESVEHSKSDLQQLKGDIFVNGRPLPDQIRQRIVALAMDGMHPRDISRNLLVSSGCVSKILASCGTIDGRSGPQMLSQEIVEKITLYKTEYPSIFAWEIRDRLKQDSLCTAETLPSISSINTVLRSHAIL

SEQ ID NO: 164765 - protein, 68 aa, Heterodera glycines
  misc_feature (9)..(9): Xaa can be any naturally occurring amino acid
  Coding regions on vcDNA: vcDNA=SeqID_91188; Strand=-; Position=54-260
FFFLKIFFXKCINLLSTVKKSDDKQNEYPKRNKRSSFLFIQILFGFFAGNSSLTTDGQSTPSSSKTIS

SEQ ID NO: 164766 - protein, 85 aa, Heterodera glycines
  Coding regions on vcDNA: vcDNA=SeqID_91189; Strand=-; Position=94-351
FFFFFFLFCHIVFLKQINKERNYNWETIKSSKTLSLQWLTDVLLHSLHSKIHRFYAFCHRFSVVIATIHHVKEIRDKRARPTIFL

SEQ ID NO: 164767 - protein, 195 aa, Heterodera glycines
  Homolog annotation: Hit_ID=AAO01126.1; Match level="QueryCoverage =77%, HitCoverage=26%, E-value=5e-12, Identity=31%"; Hit description =CG9951-PA [Drosophila willistoni]
  Coding regions on vcDNA: vcDNA=SeqID_91190; Strand=+; Position=29-613
MEDVDRMIVDHLVNDLRCSFADKVLKLADFDSAHIVEGIIRCIWRCRPESVATFPSFQLPNNPIERFRLASKISREVQAIGVRDHQIGYQALLYPNVFDSRHIFLALFEHFPKETVKPTDEKPLSPIEKLRAEVGVVIADQLKGEWTPEFCRFYDLQRIGRLWFPSGRKAEEEKQHSSDVWTTVICTGQQPKDGQ

SEQ ID NO: 164768 - protein, 172 aa, Heterodera glycines
  Homolog annotation: Hit_ID=CAE66880.1; Match level="QueryCoverage =98%, HitCoverage=33%, E-value=5e-38, Identity=45%"; Hit description =Hypothetical protein CBG12259 [Caenorhabditis briggsae]
  Gene Ontology: Mol. function=serine carboxypeptidase activity; Cellular component=lysosome
  Coding regions on vcDNA: vcDNA=SeqID_91191; Strand=+; Position=2-520
GDLLANSVKDVMETLAMVDYPYPATFLAPLPGWPVKEACKAYSTRLGSQHGLAMAAHAMLNLFYNYTGQQKDLCLCGNDCPGTFSELGDPDGWPWQSCTEMVMPMSSHGPPTDPFSASCPYHVRDSFRWCQDHFAKLGFRTELFRPLWGMINYGTEYPTATYIVFSHGWLDP

SEQ ID NO: 164769 - protein, 202 aa, Heterodera glycines
  Homolog annotation: Hit_ID=CAE62749.1; Match level="QueryCoverage =64%, HitCoverage=25%, E-value=5e-25, Identity=43%"; Hit description =Hypothetical protein CBG06913 [Caenorhabditis briggsae]
  Gene Ontology: Cellular component=extracellular space
  Coding regions on vcDNA: vcDNA=SeqID_91192; Strand=+; Position=12-617
MSLVARFLRPSNGWIFSSVFRQQQLLLLIARPYASDAIASDGGNEKGRNGRHSSAEDTHPSSAPAADTQHGQGWISRILTGPAGAEGLKQSHSSMLSVGDSIYELQTHDAVGGDRDKYLGAYKKYAQEVSAATPGATLFGSWHVLFGNQDQVVNLWRYQNGYPDLDSHIRALSSNTSVKSAELDYARLCRRRRTVITKPFSY

SEQ ID NO: 164770 - protein, 104 aa, Heterodera glycines
  misc_feature (52)..(52): Xaa can be any naturally occurring amino acid
  misc_feature (58)..(58): Xaa can be any naturally occurring amino acid
  misc_feature (70)..(70): Xaa can be any naturally occurring amino acid
  Homolog annotation: Hit_ID=CAA65474.1; Match level="QueryCoverage =99%, HitCoverage=34%, E-value=9e-20, Identity=52%"; Hit description =collagen [Globodera pallida]
  Coding regions on vcDNA: vcDNA=SeqID_91193; Strand=+; Position=2-316
THMVLGIAFVCSLMAMIATVGCLPSLCAERTPLNSKLRCGVEVFPVNTESDXTVLTDXEGSLTTSANPRXIPWKSVCRRERALGGHWERDGLQEPSGPNWPPGA

SEQ ID NO: 164771 - protein, 140 aa, Heterodera glycines
  Homolog annotation: Hit_ID=NP_498397.1; Match level="QueryCoverage =90%, HitCoverage=28%, E-value=4e-09, Identity=38%"; Hit description =zinc finger protein -related like (43.1 kD) (3H473) [Caenorhabditis elegans] gb|AAB47598.1| Hypothetical
  Gene Ontology: Biological process=embryogenesis and morphogenesis
  Coding regions on vcDNA: vcDNA=SeqID_91194; Strand=+; Position=1-423
QEADEEEENGESQEKHLDSVLYDEGAFLVLPSGARIGHRSLVRYFRQRLGYGLGDGGSGDWNSKQQQRQLMHNAKQSRILKQLGGPAVGGGCCSVAVLEASVKARARDVSFMKRTVARYQLRRALASNKLFKSRGRNDQQ

SEQ ID NO: 164772 - protein, 200 aa, Heterodera glycines
  Homolog annotation: Hit_ID=AAP30770.1; Match level="QueryCoverage =99%, HitCoverage=77%, E-value=6e-49, Identity=52%"; Hit description =putative gland protein G17G01 [Heterodera glycines]
  Coding regions on vcDNA: vcDNA=SeqID_91195; Strand=+; Position=9-608
MEKKIVYLKLFQIVFTLTIIWQLLSLRQFCGTFADPKGFLNETVRHCKGYSLIGKDSKTGKYSSMFNKLFTQFFMSSPTAEQRHQFMDEMAAKLPPAGRHCIPIMITPFDWFFDWVRLYRNPLNNDTLFLFSKLFFNALVSLGCLCIVIMEMLRSVEEYESSGILLAFASVLFWGHSVAFSFNLLFFWSHFWTCFNFRAD

SEQ ID NO: 164773 - protein, 109 aa, Heterodera glycines
  Coding regions on vcDNA: vcDNA=SeqID_91196; Strand=-; Position=2-328
MGCSVSVCCCCCWPCCCCCGCWGCPSAAPSVVFAAFSSPSLGKSAGGPGGNPAPDFSNFPISSSSVGVFFAFCSSPGTGGSSKPGEEGKNSLANDGFWALAKKTQKNAS

SEQ ID NO: 164774 - protein, 203 aa, Heterodera glycines
  Homolog annotation: Hit_ID=CAE69707.1; Match level="QueryCoverage =88%, HitCoverage=15%, E-value=9e-09, Identity=26%"; Hit description =Hypothetical protein CBG15975 [Caenorhabditis briggsae]
  Coding regions on vcDNA: vcDNA=SeqID_91197; Strand=+; Position=16-624
MTYRDGDRPQRKTWVQKQTEANKSTPTLNLSSSGNGGPSVEGRTRDTHLSGDELADNSPQKGQQQILNQTFTKSSTKEYDSATLIAPVSNGTESLNNRSGGLVLEDVCDSNSEMTPEMQAKRRAILASQIRRKERIMARSEEKETEEMDRLQVKMQRMEQAEMRRMEREQRRQKLLEDYKKKKVEQEFMLKPGSDRACVSSTI

SEQ ID NO: 164775 - protein, 166 aa, Heterodera glycines
  Coding regions on vcDNA: vcDNA=SeqID_91198; Strand=+; Position=3-503
NTKSQLMSGQSAQKDGKIAATILIDPVTQKSANITIRTPAQQLRMEQIEVPYKVRPFAFDSPRSAQQKHSLAQLVHPFASIPPPMDRLKGQRELFEDLSTGPPSLQWYTGGGKKGGQTPPIWGGCKKSAPPPQKKKGAPPGEGWKVPPKEKYLGLKKPRWFPNFFF

SEQ ID NO: 164776 - protein, 205 aa, Heterodera glycines
  Coding regions on vcDNA: vcDNA=SeqID_91199; Strand=+; Position=3-617
NPSLVNYSLFPREEHSHEVVQTSGEAIMAFPPEQIEQAIEDGRSSNSEVLLAALQDVQKYMKEMGHAASPHEAVGTTSSMQSPTMDTPPPLSAEDAQPMDTSEELGKEKPKKRLKVELTPPRETKPHPRMSLNSRLSNHTGDEVVDNESHSPAVATPPVPKSKKRTAASLKQNDSGNNKSLSTLIEAAKMMEGGSSSEEHHQDGV

SEQ ID NO: 164777 - protein, 175 aa, Heterodera glycines
  Coding regions on vcDNA: vcDNA=SeqID_91200; Strand=+; Position=1-525
FRVTERMANYYGVNLLPCLTGNCVDPSLFWSASPPLSSAPSRPSTSASIKREPPSNVPSPAHSVDTTARKPIGGGQLKPADDIPQFTHFCGQKIESVLSAYSDLLESLKEPPLSPPFTVGQFVLFRHDKLGMCHGTVVRQDSQHLVVKHLVTQDAHYVKMEAIFAFPHQLLKECS

SEQ ID NO: 164778 - protein, 96 aa, Heterodera glycines
  Homolog annotation: Hit_ID=CAG13232.1; Match level="QueryCoverage =100%, HitCoverage=21%, E-value=2e-29, Identity=62%"; Hit description= unnamed protein product [Tetraodon nigroviridis]
  Coding regions on vcDNA: vcDNA=SeqID_91201; Strand=+; Position=1-291
GIGELYRSMFVSAQVKLLQRYVPELRPEDVERGLAGIRAQAMDAEGNLVDDFVFDSGEGPLAKRMLHVRNAPSPGATSSMAIAQMIVEKSTEKFGI

SEQ ID NO: 164779 - protein, 205 aa, Heterodera glycines
  Homolog annotation: Hit_ID=NP_496307.1; Match level="QueryCoverage =90%, HitCoverage=38%, E-value=5e-28, Identity=35%"; Hit description =diphthamide biosynthesis-like protein 2 (2K992) [Caenorhabditis elegans] emb|CAA86761.1| Hypothetical pro
  Gene Ontology: Biological process=peptidyl-diphthamide biosynthesis from peptidyl-histidine
  Coding regions on vcDNA: vcDNA=SeqID_91202; Strand=+; Position=6-620
MRGSVASIDLNTFFEVDRICSWILSNKFQRTALQLPDELLEHSFHLVEAVEHRVESAGTWEEQRGRLYVLADTSYRSCCLDEIAAEHVACDSIVHFGDACLSARSSSIPALYIFCRHPFELEKFVEQFRIEFSEFGTEKQWDDCLLLCEAAYTHIQNSLGSAISRILPPSVRLFNFEVSEPNSPSSSILGRQVPVGFVIDQCSEK

SEQ ID NO: 164780 - protein, 62 aa, Heterodera glycines
  Coding regions on vcDNA: vcDNA=SeqID_91203; Strand=-; Position=79-267
FFFFFYKVHIYYICDQISKIAKTKSGGNNSQKFKKIYFLRKSKFLINGGEWHTNVAQNKMFI

SEQ ID NO: 164781 - protein, 196 aa, Heterodera glycines
  Homolog annotation: Hit_ID=NP_496239.1; Match level="QueryCoverage =98%, HitCoverage=31%, E-value=1e-37, Identity=39%"; Hit description =eukaryotic translation initiation factor 2A (2K709) [Caenorhabditis elegans] emb|CAA91279.1| Hypothetical
  Gene Ontology: Biological process=protein biosynthesis
  Coding regions on vcDNA: vcDNA=SeqID_91204; Strand=+; Position=39-626
YSFYINDILLQKSDMGDDLVFAVRGSFGYSLQCGIKSPTEVINENLDPKDSSCRCFTFSNNGVYFAYCNSNSTTIVESSTGRKCFSADLGKTQCIIFSPKDSFMVTYEPYVIYGSRKNSDGSLKTPNPNLRFWSVPNGELLATVVADKQAVWKPYFSADESLMLRVLGSEVHFFKNGNFAKAAHKVVVKDIASFSI

SEQ ID NO: 164782 - protein, 217 aa, Heterodera glycines
  Homolog annotation: Hit_ID=NP_498403.1; Match level="QueryCoverage =61%, HitCoverage=32%, E-value=3e-40, Identity=53%"; Hit description =fibroblast growth factor, human FGF20-like, LEThal LET-756 (49.6 kD) (let-756) [Caenorhabditis elegans] g
  Gene Ontology: Mol. function=growth factor activity; Cellular component=soluble fraction; Biological process=cell-cell signaling
  Coding regions on vcDNA: vcDNA=SeqID_91205; Strand=+; Position=1-651
VLQPSPSSSSSTGSTLGQQRLIDRCAHRAQHKQRRNHSATAFDSSSLWHRLGSALSGQNETRGGGTPPFVSGLPVRQVRYDHVHRRGALFCRTGSWLEMVGEPGERIEVRGTRRENSKFTLLEFLAVAFGLVSIRSVTNRHFLCMDSSGQLYAAPASRYSADCVFMEEMMHNYYNLYSSCVYGSARSPWFVALRRNGQQRQRRHSRRREKSSPFVIV

SEQ ID NO: 164783 - protein, 192 aa, Heterodera glycines
  Coding regions on vcDNA: vcDNA=SeqID_91206; Strand=+; Position=3-578
LRYFFTMNDSWIKKYLSSPLQSTSFSSSVQTSSSFTQFDKINVQNLSFTPLSVPLPSPLQNVQHLGLTPLSRNASIHREKNRKRPFSPLENDLGSVCSIAKIKSPKTPRHAVKILKKIDYEDRASCYLVQWNCGSAEEKGPSTTWEWANKLSPNCRKLAKVFEQSIAKDAKKAWEFTDYEVEAILDRTVQGE

SEQ ID NO: 164784 - protein, 188 aa, Heterodera glycines
  Homolog annotation: Hit_ID=AAL78214.1; Match level="QueryCoverage =89%, HitCoverage=90%, E-value=9e-15, Identity=29%"; Hit description =putative esophageal gland cell protein Hgg-20 [Heterodera glycines]
  Coding regions on vcDNA: vcDNA=SeqID_91207; Strand=+; Position=26-589
MEKAIFISADCWLEVFDLLPPFQLGLGIAMISRQFDYYVDEHFKTRKWKLGKMKIRRKIGQNGANEMKIVNSDGKELPIPQNPLPNKVIGFRAIQIIFIDQNVITFLGRFDRFFASCTTMLFITTGNVRVSEFVLHNIWPMFKDTIRLMDLNSIAFRQMRQLAPSMLNDCPSLRFFNFYDGISLEFPP

SEQ ID NO: 164785 - protein, 207 aa, Heterodera glycines
  Homolog annotation: Hit_ID=EAA69694.1; Match level="QueryCoverage =68%, HitCoverage=8%, E-value=8e-18, Identity=38%"; Hit description =hypothetical protein FG00284.1 [Gibberella zeae PH-1] ref|XP _380460.1| hypothetical protein FG00284.1 [Gibb
  Gene Ontology: Cellular component=plasma membrane
  Coding regions on vcDNA: vcDNA=SeqID_91208; Strand=+; Position=2-622
NIVDSLGEPQLLDDLSDHWTSDNHVVERDNVIMALQDLAAKYRVRVSIVSGDVHCAGAGEVGPQMGIAVTRDQVPAFMTQVISSAVGNVSPPWFVIKGLHMVSKQRPIGGSDSLVERMINVFHKDVNGRNIDRDEQSLMGRRNWMSVLPEGAGASDESKTLAFTLHMEKKVGDLKGETVDYTIRVPHVVGKLRPRMAELQEPVGEMH

SEQ ID NO: 164786 - protein, 55 aa, Heterodera glycines
  Coding regions on vcDNA: vcDNA=SeqID_91209; Strand=-; Position=0-164
RHYPAEARTSILGHRRRRRRRWRHLNRQERQSILLLHHRCRFLRQQRCVAERGEV

SEQ ID NO: 164787 - protein, 146 aa, Heterodera glycines
  misc_feature (3)..(3): Xaa can be any naturally occurring amino acid
  misc_feature (7)..(7): Xaa can be any naturally occurring amino acid
  misc_feature (16)..(17): Xaa can be any naturally occurring amino acid
  misc_feature (21)..(21): Xaa can be any naturally occurring amino acid
  misc_feature (24)..(24): Xaa can be any naturally occurring amino acid
  misc_feature (28)..(29): Xaa can be any naturally occurring amino acid
  misc_feature (31)..(34): Xaa can be any naturally occurring amino acid
  misc_feature (42)..(42): Xaa can be any naturally occurring amino acid
  misc_feature (47)..(47): Xaa can be any naturally occurring amino acid
  Homolog annotation: Hit_ID=NP_509009.1; Match level="QueryCoverage =95%, HitCoverage=70%, E-value=7e-33, Identity=50%"; Hit description =heat shock protein (hsp-25) [Caenorhabditis elegans] gb|AAA68804.1| Heat shock protein protein 25, isofor
  Coding regions on vcDNA: vcDNA=SeqID_91210; Strand=+; Position=2-439
ERXEKEXRRGDEERQXXRHEXEGXRPAXXRXXXXTTGGTQPXEGGGXPRIFFLGGGAMARHSPIYDPDLENGKSPLIKDESDGKTLRVRFDGAQYRPEEVTGKTGDNRLVVHAKHEEKTPSRTGYREDNREGMLPRGTNPGTEQLN

SEQ ID NO: 164788 - protein, 79 aa, Heterodera glycines
  Homolog annotation: Hit_ID=AAH85632.1; Match level="QueryCoverage =88%, HitCoverage=10%, E-value=7e-12, Identity=54%"; Hit description =Zgc:92087 [Danio rerio] ref|NP_001007300.1| zgc:92087 [Danio rerio]
  Coding regions on vcDNA: vcDNA=SeqID_91211; Strand=+; Position=5-241
MSSISSGVDLTTKYQRLAVEYVKVRNQVAVLKSALVEEQSKRADLGKEMAQRETKLFKLEGERDSLLFRNEQLLKRVEG

SEQ ID NO: 164789 - protein, 169 aa, Heterodera glycines
  misc_feature (72)..(72): Xaa can be any naturally occurring amino acid
  Homolog annotation: Hit_ID=NP_504227.1; Match level="QueryCoverage =79%, HitCoverage=21%, E-value=2e-23, Identity=45%"; Hit description =putative protein, with at least 9 transmembrane domains, of bilaterial origin (5E922) [Caenorhabditis ele
  Coding regions on vcDNA: vcDNA=SeqID_91212; Strand=+; Position=8-513
MSTVSMLLLALFWEWTMPIFGAQHSVAILLLTFLMALVSATSNVLFLPFMATFHPNYLTAYFVGMSFSSLVXFLLKLIQGVGNYDCVPNGTANSTLVAVYMEPLFHIRLYNMAMFAWMCAATASFAFLYWNGRRKAKRTTTAGAKDQQPAEGEEDTEEGGSDNGTTGDG

SEQ ID NO: 164790 - protein, 131 aa, Heterodera glycines
  Coding regions on vcDNA: vcDNA=SeqID_91213; Strand=+; Position=1-393
YKQEKDDKRVKNLDKMLVEYEVERAKKEENFRAQLFSENANFEEIPLPLGAPGAMDAAKTPFSLPLPTGITPGDVPLPSGVQLFAAMRASILKKTGATAPSQKRHKHPPGPPPGLPPPLAVAASSDNDGED

SEQ ID NO: 164791 - protein, 175 aa, Heterodera glycines
  Homolog annotation: Hit_ID=NP_610620.1; Match level="QueryCoverage =76%, HitCoverage=24%, E-value=5e-09, Identity=34%"; Hit description =CG7686-PA [Drosophila melanogaster] gb|AAF58742.1| CG7686-PA [Drosophila melanogaster] gb|AAD34760.1| unk
  Coding regions on vcDNA: vcDNA=SeqID_91214; Strand=+; Position=24-548
MGKHKKPFIDRKSAVNYSLHNKHLEEAQRTSNRKSVANFRPFDKHFEDFYEGYANEAEEDGAEEMHDGEGQIETDPALFSSLLADGQSQRCGEERFQRELPDPELKSAVLRYVKAMEIGKGRAEPTEDILVDNAKRNRWDCESILSIHSNIYNHPTEIREPMKVIGRRRGGTTTN

SEQ ID NO: 164792 - protein, 100 aa, Heterodera glycines
  Coding regions on vcDNA: vcDNA=SeqID_91215; Strand=+; Position=58-360
RISVAPPPMAMGTMPATTAPPSKVCPILPKRWHLCTNLAHCSSSARSALTISPRHCNSFTIQLYFSIARQIRCSTICSPKFCITVATNLTGPPCTTVCTS

SEQ ID NO: 164793 - protein, 201 aa, Heterodera glycines
  Homolog annotation: Hit_ID=NP_493464.1; Match level="QueryCoverage =100%, HitCoverage=35%, E-value=4e-61, Identity=55%"; Hit description= DNaJ domain (prokaryotic heat shock protein) (dnj-29) [Caenorhabditis elegans] emb|CAB63399.1| Hypotheti
  Gene Ontology: Mol. function=protein transporter activity; Cellular component=signal recognition particle; Biological process =intracellular protein transport
  Coding regions on vcDNA: vcDNA=SeqID_91216; Strand=+; Position=61-663
MGRAQFEYDEVGNTFYYVIVSFFAVILFPLTHFLWPSLPKRTEVLKRGCRCEGDLVKRFRKEHIKPWEKAKCVIKGFVLLILWALFILLAYKVSQLEQTFEEYDPYKILQLDVDADVGEIKKKYRELSKQHHPDKGGDPVTFDGIVKAYKALTDEESRENWRLYGNPDGPKATTFGIALPKWIVSEQYGGWVLGLNVFIFL

SEQ ID NO: 164794 - protein, 49 aa, Heterodera glycines
  Coding regions on vcDNA: vcDNA=SeqID_91217; Strand=-; Position=88-237
NLKDLKPDNILVTVRNQVRIADFGLACIYFPDDAERTYEHQVVNRKLIR

SEQ ID NO: 164795 - protein, 74 aa, Heterodera glycines
  Coding regions on vcDNA: vcDNA=SeqID_91218; Strand=+; Position=278-499
ILIIYSSQFDVSFLKFDSICLLNLYTYTSSHVFLQTLNHSPDCPLSNSDRSWFLIRVLCLDFVLCCAFCFMLKP

SEQ ID NO: 164796 - protein, 80 aa, Heterodera glycines
  Coding regions on vcDNA: vcDNA=SeqID_91219; Strand=+; Position=3-245
GIIFPKTNFSNFVLIVQNRFMHAITQNHNINGGQSNLTNCKNIKLVVKAFLEGFLSGWLKINTGTYFDQCKTPKANLNKC

SEQ ID NO: 164797 - protein, 95 aa, Heterodera glycines
  Coding regions on vcDNA: vcDNA=SeqID_91220; Strand=+; Position=204-488
VKKNLSATFVLQKNFLTKFQAKKNGSLKIYSKMFYMPCSKVRHSSNNKCSLLANPLVDKLGTLITLPLSETIEFESGFDGSSSATSTTASVFLVE

SEQ ID NO: 164798 - protein, 187 aa, Heterodera glycines
  misc_feature (65)..(65): Xaa can be any naturally occurring amino acid
  Homolog annotation: Hit_ID=EAA72689.1; Match level="QueryCoverage =72%, HitCoverage=32%, E-value=7e-39, Identity=57%"; Hit description =hypothetical protein FG03242.1 [Gibberella zeae PH-1] ref|XP _383418.1| hypothetical protein FG03242.1 [Gib
  Coding regions on vcDNA: vcDNA=SeqID_91221; Strand=+; Position=56-616
MTVPRSNRAVLLAAVVFVTIFLGLAHFHLKTPSESTAAVKSGVDEPAPFVPEKEAAAAVPTFVPXEDEEIGATPAVEVVAETPKPEEHHHAVTPDKPEADPAEEPSDPEEIAEAEEQAANASPTPAAAASPAAEPEKEPDHDHDHDQQHEEAHDHEHEHEHDPESEEEFIPETEVEETPETPAIPEA

SEQ ID NO: 164799 - protein, 96 aa, Heterodera glycines
  Homolog annotation: Hit_ID=NP_493603.1; Match level="QueryCoverage =98%, HitCoverage=9%, E-value=1e-22, Identity=51%"; Hit description =PaTched Related (111.8 kD) (ptr-23) [Caenorhabditis elegans] emb|CAB04167.1| Hypothetical protein ZK270.1
  Coding regions on vcDNA: vcDNA=SeqID_91222; Strand=-; Position=165-656
LMDWRSVVDRYADLNASVFHDESIFLDLIDNMPTDAWQSGLATLLCMCFICAVFMGHDWRTVLMAGTTIGSIIVGTLGTLSWIGATMDPVMMVRLT

SEQ ID NO: 164800 - protein, 182 aa, Heterodera glycines
  Coding regions on vcDNA: vcDNA=SeqID_91223; Strand=-; Position=3-548
NLDSTEHQRACLYNKVTTENGKFTKRMWISKNSQFALSFQENAKSVESCGHTLKLSDQGFAVPSWQFRIITGKTTHRIKREQWWPKEKPLDQNEKSSTAAAQLTARAIYQNKETKELFQKMVNLICGILQNANPKQDLSHLNPTQLMREKTGTELVKAKWISPNVLEWWPCSYANTTFIPSP

SEQ ID NO: 164801 - protein, 108 aa, Heterodera glycines
  Coding regions on vcDNA: vcDNA=SeqID_91224; Strand=+; Position=3-329
QQMEPAHCHVFSWELNSRTPLCYRFNLGISRSVFSNCELNSTNIKVNRAGWLENFRPTNGTVLARFGKIPCNISFIFLVCLLRRICQMYLQLKVLGKTHFGWAVRMAR

SEQ ID NO: 164802 - protein, 135 aa, Heterodera glycines
  misc_feature (31)..(31): Xaa can be any naturally occurring amino acid
  misc_feature (48)..(48): Xaa can be any naturally occurring amino acid
  Coding regions on vcDNA: vcDNA=SeqID_91225; Strand=-; Position=3-411
CPAHLGPFAEHHHFHGCDCCHRHHHRFGQSXGSVRHEQRRQQPHEHSXHQHYHHHQHWLATFLVKPVDPNGFVGRSEWLCRSIRMALSVDQNGSVGRSEWLCRSIRMALSVDQIGFDASLVHAALLQHVSQFVDL

SEQ ID NO: 164803 - protein, 159 aa, Heterodera glycines
  Homolog annotation: Hit_ID=CAE61890.1; Match level="QueryCoverage =88%, HitCoverage=44%, E-value=1e-15, Identity=36%"; Hit description =Hypothetical protein CBG05881 [Caenorhabditis briggsae]
  Coding regions on vcDNA: vcDNA=SeqID_91226; Strand=+; Position=85-605
YGRISKLYVECFNEREKCLTVIGGGKMATALVHGLVSAGFIDKSEVNICSRSKETAFRWTTQGYQNAYTNDEFYSKVKKPRGIVIVAVKPQIFPGFLDELRKNGWLNFVGPEVLCVSIMAGIALDTFKQQLKLVGFNGHAARFMPNVNCLVSAGIVLVC

SEQ ID NO: 164804 - protein, 208 aa, Heterodera glycines
  Homolog annotation: Hit_ID=NP_505204.1; Match level="QueryCoverage =99%, HitCoverage=36%, E-value=3e-64, Identity=61%"; Hit description =asparagiNyl tRNA Synthetase (nrs-2) [Caenorhabditis elegans] gb|AAC25799.1| Asparaginyl trna synthetase p
  Gene Ontology: Mol. function=asparagine synthase (glutamine -hydrolyzing) activity; Cellular component=soluble fraction; Biological process=asparagine biosynthesis
  Coding regions on vcDNA: vcDNA=SeqID_91227; Strand=+; Position=3-626
CCASLDGVFAFAMADKKFLYLGRDPIGVRPLFYGFAGQALLIGSEVKSIEKLCRRVNFFPPGFCAQIPLGSTFSTDNQQIAFQQFFQIPSIVNYSISAFDAKAIIRKLLVEAVEKRLMDNRQFGFMLSGGLDSSLIAALATRFLHSNDFCASPIAFSVGFEDSPDLVNARKVAEYLGICHRVLVISARECVEAIPEVVFSLETFDPLV

SEQ ID NO: 164805 - protein, 89 aa, Heterodera glycines
  Coding regions on vcDNA: vcDNA=SeqID_91228; Strand=-; Position=0-266
SFTNHFVHHQSITDSSSDPPLVDEFLEFVALSGQSHLPWTLIQPVIVWKLQVISTCNSVLPSLCHFDFCLSLTLSLVFYNSLVSSIHSS

SEQ ID NO: 164806 - protein, 171 aa, Heterodera glycines
  misc_feature (79)..(79): Xaa can be any naturally occurring amino acid
  Homolog annotation: Hit_ID=NP_733439.2; Match level="QueryCoverage =83%, HitCoverage=19%, E-value=4e-31, Identity=53%"; Hit description =CG1775-PC, isoform C [Drosophila melanogaster] ref|NP_524610.1| CG1775-PA, isoform A [Drosophila melanoga
  Gene Ontology: Mol. function=transcription cofactor activity; Cellular component=cytoplasm; Biological process=SMAD protein heteromerization
  Coding regions on vcDNA: vcDNA=SeqID_91229; Strand=+; Position=2-515
QSQTHRFTHYNFELLQLPSVRKLPDHWCSIAYFELDTQSGELFKVPWQIKEVAIDGGMDPSGALSARFCLGALANVHRXSERARMHIGKGVSLKFADNCEAVFLKCLSQKSVFVRRGDSIVHKICPGVERKVFDLRWAYVEMCRRRENAQLSAIAHAYAVAGFPSQMPSSS

SEQ ID NO: 164807 - protein, 144 aa, Heterodera glycines
  Homolog annotation: Hit_ID=NP_496399.1; Match level="QueryCoverage =96%, HitCoverage=35%, E-value=4e-48, Identity=61%"; Hit description =plasticity related gene 1 (46.1 kD) (2L515) [Caenorhabditis elegans] emb|CAA88966.1| Hypothetical protein
  Coding regions on vcDNA: vcDNA=SeqID_91230; Strand=+; Position=3-434
PLRFVRSHSDTFGGSSTHLAMTDPISAAKYKINYFLLPNFIIHSIGLSSLWALWYYLRFTNVFPYHHRVFYCRDVDLFKPFFAPEDFELFVSYPLLYVLGFTIPPIIMLGGELMFWLFSTKPRKGVYATCGECKIALITPRLFR

SEQ ID NO: 164808 - protein, 64 aa, Heterodera glycines
  Coding regions on vcDNA: vcDNA=SeqID_91231; Strand=-; Position=150-344
RAQLSESVGYITHIFLTTIAMMYLLLQNVMDIIFHVLSRFSVAHLRYTKGTQIHTTHILKRTSI

SEQ ID NO: 164809 - protein, 175 aa, Heterodera glycines
  Coding regions on vcDNA: vcDNA=SeqID_91232; Strand=+; Position=43-567
TTLALSREKIKNAIQADAYDNFHAIYLLLLERLRGHPLSRSHSASSHANHPLVNSPSATSLPSPTAPHAQAVLASPTTKAAPAVVLTESAGGGDSGEQRPPIIRGVTIRRQSDGIAIVGGAVPCHCYCCSAARAHPMLQSIQPQYAPLGIMTRFAQHPQTRRDSDGIAMQFAYQM

SEQ ID NO: 164810 - protein, 113 aa, Heterodera glycines
  Coding regions on vcDNA: vcDNA=SeqID_91233; Strand=-; Position=213-554
HSDQQHLANCNQFCHFSKEHFFNAQGLGHPFGVFVLLLPRRADDNFLRPQMLAEAARVDELVSTRFPLFNHRTNRTENFAQFCRDFCQLNEPMRRFAVREIKIIKLNLKIKIF

SEQ ID NO: 164811 - protein, 203 aa, Heterodera glycines
  Coding regions on vcDNA: vcDNA=SeqID_91234; Strand=-; Position=2-610
SNQCTFLWLMSHSRKTGSRATSQERDEEINITIIDRNFWNGKTSVKVPDLERAHIEVLRLEEAVNRSFRIVNRRAYANTRALNKMAGEVNTNMGILNAKIDTLAEIVKPKITPNQTSHVRFNSCNNANLSQDNEEYLDPFAEDSFELGRVNTLTGMIGHLEVFGEDSVIAFDEWAERFTDYVGAVGRNWNEDEKVARFKMSLI

SEQ ID NO: 164812 - protein, 78 aa, Heterodera glycines
  Homolog annotation: Hit_ID=NP_509928.1; Match level="QueryCoverage =100%, HitCoverage=59%, E-value=7e-12, Identity=42%"; Hit description= predicted CDS, folate hydrolase (XM161) [Caenorhabditis elegans] emb|CAB01688.1| Hypothetical protein C3
  Coding regions on vcDNA: vcDNA=SeqID_91235; Strand=+; Position=344-577
MEVAEKIAKIWKQNGIEDVHFVSYDVLLSYPNFSSPNHLSVLSANGQVNFRTDGVSPELMAPNSEDLRSSIQWVAYSA

SEQ ID NO: 164813 - protein, 122 aa, Heterodera glycines
  misc_feature (80)..(80): Xaa can be any naturally occurring amino acid
  Homolog annotation: Hit_ID=NP_506049.1; Match level="QueryCoverage =99%, HitCoverage=16%, E-value=4e-34, Identity=60%"; Hit description =asparaginase/glutaminase and ankyrin (5M636) [Caenorhabditis elegans] emb|CAB02791.1| Hypothetical protei
  Gene Ontology: Mol. function=lysophospholipase activity; Biological process=phospholipid metabolism
  Coding regions on vcDNA: vcDNA=SeqID_91236; Strand=+; Position=2-367
GTIGMCACHDGVYAPEQYYLPRAIRDIPPLYDKEYADPMYSDFPLKPLCLPPVHGMNKRLVYCLAEYEPLLYSADMTFDXWIPMVKDIRKSNSAYYGFVVLHGTDSLAYTACALSCMMENLA

SEQ ID NO: 164814 - protein, 181 aa, Heterodera glycines
  Coding regions on vcDNA: vcDNA=SeqID_91237; Strand=-; Position=0-542
IHLKSDQSEMISCDLERETLTQMALFRARSDKTPTHAGIPAPDEVREGGCGQNRTNPAAPRGKAVAIQRQNGITIPINACAQSGLVRTQRVQQWSAVEESALKDVVVRNTDDRGLINWAKGVLPEWQRLCQLNPTMYMARSSPSLSNKWASLRRTHVGPGCPSKEGSGPSQDLSDVKIQPA

SEQ ID NO: 164815 - protein, 127 aa, Heterodera glycines
  Coding regions on vcDNA: vcDNA=SeqID_91238; Strand=-; Position=220-603
RVPVHAVLRHFCAVPFPRWTQLNGGLGQRDHLLLVPLFSLLLLRFVRPLVSSSHPPVDHFAHSSPFLSAAALCLFGPKIRFLLLFVPWPPLLFILCTRKQLLVHPFLLQNCAQHLLLALHSNKCRGH

SEQ ID NO: 164816 - protein, 109 aa, Heterodera glycines
  misc_feature (93)..(93): Xaa can be any naturally occurring amino acid
  Homolog annotation: Hit_ID=NP_492614.1; Match level="QueryCoverage =99%, HitCoverage=22%, E-value=2e-24, Identity=46%"; Hit description =innexin, putative gap junction protein, OPUs gap junctional protein (inx-20) [Caenorhabditis elegans] emb
  Coding regions on vcDNA: vcDNA=SeqID_91239; Strand=+; Position=2-328
HYHENYLSLLYLSIRMLFRSIELLQACWISRCLQTHDYDFYDWGVFMDLIGGNAWSDSGNFPRLTFCDIDVRIVGAMQRHTVQCILEINILTXNAFLLMWHRYSLLLMI

SEQ ID NO: 164817 - protein, 97 aa, Heterodera glycines
  Coding regions on vcDNA: vcDNA=SeqID_91240; Strand=-; Position=200-493
DCPPPCPISCLILVLVVLITTVRRRRTAVADRNVVLSLLLLFSATRRRRTFLGQQCGAFLFLRIQKRTAENELRILKKFAITGYGKTVFTGKKHSFF

SEQ ID NO: 164818 - protein, 140 aa, Heterodera glycines
  Homolog annotation: Hit_ID=CAE60521.1; Match level="QueryCoverage =84%, HitCoverage=11%, E-value=3e-16, Identity=39%"; Hit description =Hypothetical protein CBG04140 [Caenorhabditis briggsae]
  Coding regions on vcDNA: vcDNA=SeqID_91241; Strand=+; Position=198-617
MSWPTQTTTVSNGSTRTFRPPLTHRPKAAQPMPTTPRPYFSQTTEGPTTWSSTSTETSADRFAKISSTNVPKGTTSKSAKEFGENGEEEETLYDDSICWETMIGQEIVKLVTMDLYITIISIFLIEFVRGVWIRYCSTWW

SEQ ID NO: 164819 - protein, 106 aa, Heterodera glycines
  misc_feature (55)..(55): Xaa can be any naturally occurring amino acid
  misc_feature (87)..(87): Xaa can be any naturally occurring amino acid
  Homolog annotation: Hit_ID=CAE60581.1; Match level="QueryCoverage =100%, HitCoverage=21%, E-value=2e-21, Identity=44%"; Hit description= Hypothetical protein CBG04215 [Caenorhabditis briggsae]
  Gene Ontology: Biological process=negative regulation of FGF receptor signaling pathway
  Coding regions on vcDNA: vcDNA=SeqID_91242; Strand=+; Position=2-319
TCTLARDSCTFLLPLCYDEYLLYRPLFGLDDSAGTLGAMTPPTPASLLFSFWPDXPHIPPFEAIVGGICRVLYDTLRPLVVHNPHLXTLGQLCTLLKVKMIDERCA

SEQ ID NO: 164820 - protein, 69 aa, Heterodera glycines
  Coding regions on vcDNA: vcDNA=SeqID_91243; Strand=+; Position=327-533
TLGRLFVNSPTEIKYFDSLGNYPNEDLSSYLNLFERILINDRIVQHQFSDACGQFCIYFLTQRCSGIPY

SEQ ID NO: 164821 - protein, 172 aa, Heterodera glycines
  Coding regions on vcDNA: vcDNA=SeqID_91244; Strand=+; Position=1-516
QDCINALHVRISDNFSQIIAFLRNSLSVKSDRRTGRVISWLESVKCSVVGLVSSLCSSDGDCTAAASVSLDQLRARILEVCQSQCDSTDQQQLLLRQCLLLALADLRRLRNVCAADDTFVDTLSEHCESVFLFRYVGRHCAQMEQLLHDEALSVKFIFLKVAESVPSIVFGT

SEQ ID NO: 164822 - protein, 100 aa, Heterodera glycines
  Coding regions on vcDNA: vcDNA=SeqID_91245; Strand=-; Position=192-494
FMVINTILNNLAFTVSQASIRTGSGRIQFGLHSPQPSTPTVTLSEESSLQLIRCWEQDNVQPPRFPISFWNVHTRAQMEIERTNNGMEAAHGQFAVQKIL

SEQ ID NO: 164823 - protein, 84 aa, Heterodera glycines
  Coding regions on vcDNA: vcDNA=SeqID_91246; Strand=+; Position=113-367
FTLITNTNYARLFCVPPCTPFVVLETADFIFRSPFWRTVDDRMGVRSFFAFCFGFSIFSFHFSFSPNSFVIFVIFMVILEHLIN

SEQ ID NO: 164824 - protein, 205 aa, Heterodera glycines
  misc_feature (84)..(84): Xaa can be any naturally occurring amino acid
  Homolog annotation: Hit_ID=CAE65258.1; Match level="QueryCoverage =97%, HitCoverage=26%, E-value=7e-70, Identity=62%"; Hit description =Hypothetical protein CBG10148 [Caenorhabditis briggsae]
  Gene Ontology: Mol. function=transcriptional activator activity; Cellular component=membrane; Biological process=nonselective vesicle transport
  Coding regions on vcDNA: vcDNA=SeqID_91247; Strand=+; Position=1-615
ADRTRSFDDLESKLETEYIQRFLGQLTPLEESRLCELKYGLQSMHKGKMPNDAHLLRFLRARDFDVQKATQLTLNSLLWRKQFXIDSLLDDFVPPALFKKYFPGGWHYNDSEGRPLFILRLGQMDIKGLLRSVGLQSIVKFTLSICEQGLNKSAEATHRLGKPISTWNLLVHLDGLSMRHLWAAGGQGLFGIIQIVEAPLPGNQG

SEQ ID NO: 164825 - protein, 114 aa, Heterodera glycines
  Coding regions on vcDNA: vcDNA=SeqID_91248; Strand=-; Position=2-343
PNAEPAVQLLVAGPRDTVEQPICGADGQGSQHTSMLLPSGGFHTLPFAGAQDAVGDRERTRWRLLSWSMINRNDDQAQRAKKKKLSTLRNGTCKLNNIRQWLPQRRNAVIQKLN

SEQ ID NO: 164826 - protein, 137 aa, Heterodera glycines
  Coding regions on vcDNA: vcDNA=SeqID_91249; Strand=+; Position=3-413
VIAQIYDEFVWTGDELGTLSIFEQDEHQLLMTNSAAPLYKIDTIEMLEESSQSKTFLAFGHPPLSRLITIASSLSSSSAVRHIVAFRERRLIIVGLTVAVLLCPWHGRESVPQLICCIPLNPIPSLGASDANAVHLF

SEQ ID NO: 164827 - protein, 91 aa, Heterodera glycines
  Coding regions on vcDNA: vcDNA=SeqID_91250; Strand=+; Position=99-374
ELLLYLIDEGTDGGTSAGKMSPKARVLASVRLPLFPLARNHKIRGTFPLLDRVEKRTKKYLFLNISKLGRRICHFRGVHRCVNLLEIRLCF

SEQ ID NO: 164828 - protein, 169 aa, Heterodera glycines
  misc_feature (165)..(165): Xaa can be any naturally occurring amino acid
  Homolog annotation: Hit_ID=CAE60153.1; Match level="QueryCoverage =92%, HitCoverage=15%, E-value=5e-13, Identity=32%"; Hit description =Hypothetical protein CBG03703 [Caenorhabditis briggsae]
  Coding regions on vcDNA: vcDNA=SeqID_91251; Strand=+; Position=3-509
MTMFERCVNKHIQFIMLVDEKRKDTHGLLKLSEAMHKVTTQHVTLEKANDVVRKNQRQTLENILNKLNMKNFGLNYVPVMEPSACRRFSLENGNVLVIGYDVNHPAPMPQQTRRLLASQGESQLSSLDPSCVGICANMAPDFNAFVGDYFFQESRREAIDQMQLXDRMK

SEQ ID NO: 164829 - protein, 204 aa, Heterodera glycines
  Homolog annotation: Hit_ID=AAN63429.1; Match level="QueryCoverage =94%, HitCoverage=20%, E-value=2e-44, Identity=43%"; Hit description =Hypothetical protein C52E12.1 [Caenorhabditis elegans] ref|NP _495439.2| zn-finger, RING and Zn-finger, C2H
  Coding regions on vcDNA: vcDNA=SeqID_91252; Strand=+; Position=2-613
FKFESYYVIECFNAYMANRCFKCSNGIEKVDFPTFAELRAHMSQVHQLSFCHICCDNLNVLTKDRRVYTRDQLQRHMAGRLHGEADGFRGHPTCQFCEQRFYDDEQQYRHLRKDHYFCQFCDQDGLEQNVFYRNQHQLNQHNRKVHHPCTDPDCLHVGIVFRTDTELDVHRAKHHRVCGGSRAIPLDIQFSRSGSTRGGAPSRG

SEQ ID NO: 164830 - protein, 77 aa, Heterodera glycines
  Coding regions on vcDNA: vcDNA=SeqID_91253; Strand=+; Position=1-234
LFKNLVIDFLSQSRPALICRERRYQFGERDEIEMWLYIIHEAKQKNKAALICDQQFWELFRTQRLQFETSSVSIEKQ

SEQ ID NO: 164831 - protein, 142 aa, Heterodera glycines
  Coding regions on vcDNA: vcDNA=SeqID_91254; Strand=+; Position=1-426
VTSQQLSRIGANVYIGSAEFRELPTDERMKYQLKVVPEEQSNGICICEMNRKCGCVQVHSEPFSLLLPNSSSSDQSDFVSLLRPSVPFFSVPSPSSHSFALPPLLLACLFLSLTLILLAIILLLLVLPRSADQSGERKRRIL

SEQ ID NO: 164832 - protein, 188 aa, Heterodera glycines
  Coding regions on vcDNA: vcDNA=SeqID_91255; Strand=+; Position=3-569
QIREKLKSRKMPISGTKSELVNRLHESLVAEEKLLEDSGPGGDNIDLSGVNVDEVLGLDDEKDSAVSSASETKPNDSLLSLCSPLNESPELKKTEILSPAKKQLTVNNGIAGAQPTNTGEDGQEKHSESESATDEDTGVGNKTQSNDNERKVQLKMAARLGVPLGESEAKRARATRFGYNGCGGENEL

SEQ ID NO: 164833 - protein, 56 aa, Heterodera glycines
  Coding regions on vcDNA: vcDNA=SeqID_91256; Strand=-; Position=114-284
MGTQPNQSKGSRRMKKKSLCPQRNGRGGGRIWVINPRGVLMPNGAGGGGGGGVSQQ

SEQ ID NO: 164834 - protein, 189 aa, Heterodera glycines
  Homolog annotation: Hit_ID=NP_503173.1; Match level="QueryCoverage =79%, HitCoverage=38%, E-value=5e-22, Identity=37%"; Hit description =PHD finger protein (5A784) [Caenorhabditis elegans] gb|AAK68369.1| Hypothetical protein F33E11.6 [Caenorh
  Coding regions on vcDNA: vcDNA=SeqID_91257; Strand=+; Position=31-600
MEDASSSSLLGENKTIELNEEADFSAPMIIRNESEDNLPITESLAETNDSPQQETDSLLSLSQSESDVASKPKSKTPSRAVLAPDVTHVPIQAADIVEYEWPSKSGDKFFLQEQISELLGINSFKRKYPELVRRTVEPAERDYLLKELRANIALPAHHLTALQAADVHELMASEYPFEYAEYKKCAMSA

SEQ ID NO: 164835 - protein, 175 aa, Heterodera glycines
  Homolog annotation: Hit_ID=NP_500617.1; Match level="QueryCoverage =82%, HitCoverage=14%, E-value=2e-45, Identity=63%"; Hit description =dehydrogenase, E1 component and Transketolase, central region (115.7 kD) (4F462) [Caenorhabditis elegans]
  Gene Ontology: Mol. function=oxoglutarate dehydrogenase (lipoamide) activity; Cellular component=mitochondrial matrix; Biological process=embryogenesis and morphogenesis
  Coding regions on vcDNA: vcDNA=SeqID_91258; Strand=+; Position=3-541
LRSSSVLSTQRRTVHERTSSVYIEQMYESWQLDRGSVHRSWDAFFNNVNAGAAPSQAYQAPPSVPSLSTVPHATVVPRAAETAGQVIPADELTRAINDHLKIQVLIRSFQTRGHNIADLDPLGINSADLDDTIPRELELDFYGFTEQDMYREFLLPPTTFIGANAPRCSCANLQP

SEQ ID NO: 164836 - protein, 112 aa, Heterodera glycines
  Coding regions on vcDNA: vcDNA=SeqID_91259; Strand=+; Position=1-336
DRLTNRAFEPASASLASSHPSSPPRDASHSLPSLFDDMNINSSGSSFGQERLCFLPTTARPLNENVFAAFNRQPHITPQANGFGDPPRTYNSSENSRQNGSHFSSAFQRHGS

SEQ ID NO: 164837 - protein, 153 aa, Heterodera glycines
  Homolog annotation: Hit_ID=NP_494846.1; Match level="QueryCoverage =67%, HitCoverage=21%, E-value=2e-39, Identity=68%"; Hit description =protective protein for beta-galactosidase precursor (53.6 kD) (2F29) [Caenorhabditis elegans] gb|AAC46812
  Coding regions on vcDNA: vcDNA=SeqID_91260; Strand=+; Position=1-459
KGMAIGNGYMNANLNIDTSARFAYGHGIIDEKIWNELEQRCCRGCIDGCDLTALKDSCEFLVDDIFEFLWHGGLNPYDLYRDCDPSPGRNYIRMEVLKNGLVPPKMLRRFFSNVTRNFRRRLRDTGQGAQNVGTPSEASLKRSGLTTYMESTR

SEQ ID NO: 164838 - protein, 155 aa, Heterodera glycines
  misc_feature (12)..(12): Xaa can be any naturally occurring amino acid
  misc_feature (37)..(37): Xaa can be any naturally occurring amino acid
  misc_feature (40)..(40): Xaa can be any naturally occurring amino acid
  misc_feature (138)..(138): Xaa can be any naturally occurring amino acid
  misc_feature (141)..(141): Xaa can be any naturally occurring amino acid
  Homolog annotation: Hit_ID=AAD13153.1; Match level="QueryCoverage =100%, HitCoverage=41%, E-value=2e-50, Identity=65%"; Hit description= actin [Setaria digitata]
  Gene Ontology: Biological process=reproduction
  Coding regions on vcDNA: vcDNA=SeqID_91261; Strand=+; Position=2-466
AALATDNGSGMXKARIEADDAARKEFPYIVGRPRNRXVMXEMEQKDSKKRNKPQTTTRILTLQGPIEHRILPNWDHMENIWPHTFYNEMGDTPEEHPLLLTEDPLNPKASREKMTPIMIETFHTPAMYMAIQAVLSLXPAXRTTGIVVNSAHGVT

SEQ ID NO: 164839 - protein, 97 aa, Heterodera glycines
  Homolog annotation: Hit_ID=CAE56395.1; Match level="QueryCoverage =98%, HitCoverage=12%, E-value=8e-13, Identity=40%"; Hit description =Hypothetical protein CBG24082 [Caenorhabditis briggsae]
  Coding regions on vcDNA: vcDNA=SeqID_91262; Strand=+; Position=3-296
YLPRFTNELFTVAEVHSERSPVVYRLRDDNNEIISGWFYANDLCKTLEDKQQKMYEIKKILKKKRQNGVDYAFVKWKGYGTRFISWIPVNSISEKNI

SEQ ID NO: 164840 - protein, 70 aa, Heterodera glycines
  Coding regions on vcDNA: vcDNA=SeqID_91263; Strand=-; Position=68-280
SNERFSSLGDAFGRKSQPFGFTLYAMFAFACPCSRPYSDDGIYKHKTRVICYFCILRDLKIQKMQEVTTL

SEQ ID NO: 164841 - protein, 86 aa, Heterodera glycines
  Coding regions on vcDNA: vcDNA=SeqID_91264; Strand=+; Position=141-401
KVSIFLLLGFSRSLSLAPISAKPGPRTKILLLNRQLKSLNFVFLFVKSCLNTRKQIESINCCIYLSLFIRKRLNSQVWIFDFCFIK

SEQ ID NO: 164842 - protein, 63 aa, Heterodera glycines
  Coding regions on vcDNA: vcDNA=SeqID_91265; Strand=+; Position=3-194
LILVHVRIIPLILVHVRIIPLILVHQNNSAYSGTRQNNSAYSQNDSTYSCTRQNNSAYSGTSE

SEQ ID NO: 164843 - protein, 149 aa, Heterodera glycines; identical to SEQ ID NO: 138388
  Homolog annotation: Hit_ID=CAE67661.1; Match level="QueryCoverage =47%, HitCoverage=3%, E-value=1e-14, Identity=56%"; Hit description =Hypothetical protein CBG13224 [Caenorhabditis briggsae]
  Gene Ontology: Cellular component=mitochondrion
  Coding regions on vcDNA: vcDNA=SeqID_91266; Strand=-; Position=130-579

SEQ ID NO: 164844 - protein, 194 aa, Heterodera glycines
  Homolog annotation: Hit_ID=AAH58998.1; Match level="QueryCoverage =96%, HitCoverage=18%, E-value=1e-31, Identity=36%"; Hit description =Dock1 protein [Mus musculus]
  Gene Ontology: Mol. function=GTPase activator activity; Cellular component=cytoplasm; Biological process=myoblast fusion
  Coding regions on vcDNA: vcDNA=SeqID_91267; Strand=+; Position=12-593
MFCTAQLVDFYQSIEHHELYVLYVYKLYTLHRTVGNWVEAGLTLKRHADLLRWSTSHRPESFLCGTARKSGGTEFGTELELKEYIYKEMAELFTQGEHWELAIETNRELANIYETATFDFAKLADLLARNAALYDKVTKTLRMESHYFMIAFYGKSCPSHLVNLKFVARGRPLEQWGCFKQRFVANFSDFKFVD

SEQ ID NO: 164845 - protein, 166 aa, Heterodera glycines
  Coding regions on vcDNA: vcDNA=SeqID_91268; Strand=+; Position=1-498
VSIPNSNSSNNNNSSSSSSSSSSSSSRTTMFNSRRKSDFSALNCNRHSEKNNLAALNAIGAPCSTVSLQRTSSDRRFAMPSSLTSPSIASSSLVANNAGGRVSAAMASKRRRCSRVINFGYACAIYFLDEPPEMDDEDEYEEEEEEAEGMGVLAYQTVEGAQSTDN

SEQ ID NO: 164846 - protein, 152 aa, Heterodera glycines
  Homolog annotation: Hit_ID=NP_491097.2; Match level="QueryCoverage =100%, HitCoverage=16%, E-value=2e-44, Identity=55%"; Hit description= phosphatidylinositolglycan class N (105.2 kD) (1D637) [Caenorhabditis elegans]
  Gene Ontology: Cellular component=membrane; Biological process=signal transduction
  Coding regions on vcDNA: vcDNA=SeqID_91269; Strand=+; Position=3-458
AAKLDRWVFDRVKLFFDEIRSDANAKSRLLGLRRAIFFLHLLGLDTNGHGHKPNSEQYLKNIATVDEGILGIVQMVEGFFGDNRTAFLFTADHGMTDWGSHGDGTDDEVNVPFLAWGAGIEPSGASRKLSLAQVDLAPLQSALVGTAIPVNS

SEQ ID NO: 164847 - protein, 212 aa, Heterodera glycines
  Homolog annotation: Hit_ID=NP_741745.1; Match level="QueryCoverage =87%, HitCoverage=10%, E-value=2e-10, Identity=29%"; Hit description =kinesin-like protein (klp-4) [Caenorhabditis elegans] gb|AAK39239.1| Kinesin-like protein protein 4, isof
  Coding regions on vcDNA: vcDNA=SeqID_91270; Strand=+; Position=2-637
SIWPWAKKQEILTGTGLFVDIVACIPKCSVGFERREELAKLAVQHATNSSDQMEDGDLSLVSFGSSALPGALADYSPRDEAKSNYLSEYVSKTISAVEWLIKLDRLRQEEAIRRAMAKLSAERAPKAEIEGCRASDGRMTRTISLPTSFLPPLHLSNFNLISSKQISPEHVQQGDGQNQSVPFAPWLTAFRQQQNQSPSLTMAPSQMVKSSQ

SEQ ID NO: 164848 - protein, 211 aa, Heterodera glycines
  Homolog annotation: Hit_ID=CAE66017.1; Match level="QueryCoverage =88%, HitCoverage=20%, E-value=2e-48, Identity=47%"; Hit description =Hypothetical protein CBG11210 [Caenorhabditis briggsae]
  Gene Ontology: Mol. function=transcription co-activator activity; Cellular component=nucleus; Biological process=transcription from Pol II promoter
  Coding regions on vcDNA: vcDNA=SeqID_91271; Strand=+; Position=1-633
KRLAAESLEASNGKRRSDHDGVENGEKRKRKEPLTAEEKALEERKREVAEELGEHLKERNREHERHKIYEHEQNFKALLVDLIKHTDISWHDGRKLMRKDNRYQNCELLEKDVKERLFKEHVRELERKRRDVFFQLLDEHQDITFTTRWHSAKKIIAEDERFGKLKMDDKKLEQDYREWMDRRRSQALDDFETLLRETKIITYKSKQMIAE

SEQ ID NO: 164849 - protein, 198 aa, Heterodera glycines
  Coding regions on vcDNA: vcDNA=SeqID_91272; Strand=+; Position=2-598
SKECFSLVYKNDERRDQRTKGRETEETPLSRRNDTHLLLEELFSPQCIHVLGQVDARVLDDVHVKLRFVMPKIGRIRFRRVFYDHIPAHKGQKCAYLISNPLERRQLHAFVTKLFVLLFNAELLDHSNVKMFCENIATTFIDLRNRGFLMSRTQILKGIRFDQILWLKGLHFQLKQSIVLNILKSFLNLFTRIFTYFF

SEQ ID NO: 164850 - protein, 184 aa, Heterodera glycines
  Homolog annotation: Hit_ID=EAA09806.2; Match level="QueryCoverage =69%, HitCoverage=25%, E-value=1e-12, Identity=35%"; Hit description =ENSANGP00000016017 [Anopheles gambiae str. PEST]
  Coding regions on vcDNA: vcDNA=SeqID_91273; Strand=-; Position=2-553
RAVQNFKKSANKIIISAVKPSYEVKSFSKQINPLTIDEVERAEVHLWKEAQKAFPPSNETILNLNLFQENGIWRAKGRMQNSGMDHYAIHPIYLNKNCPIVEIIIMDIHRERKHTGMENMVASLRSKFWIPSVRSKVNSVLRINPNTRCWICARFHAKAYVYPEAPPLPSYRVSGNLIWETIGL

SEQ ID NO: 164851 - protein, 118 aa, Heterodera glycines
  Coding regions on vcDNA: vcDNA=SeqID_91274; Strand=-; Position=286-642
IFKCFIIFEVLREHYDTESCAEKLKCTIDKSSPGCLETLSCVNYCVWAEGYKESECCRENYTLSCWTWVSFKNCCMFQGYSRKISRFLGISRFVSIRVAPRSSGRRKSGIGEKIFHKI

SEQ ID NO: 164852 - protein, 50 aa, Heterodera glycines
  Coding regions on vcDNA: vcDNA=SeqID_91275; Strand=+; Position=355-504
FFQNYFYFIRFLKIFYLKIFFLSFEGKLYDGWWGLSAPVFPSVFSPLLIC

SEQ ID NO: 164853 - protein, 76 aa, Heterodera glycines
  Coding regions on vcDNA: vcDNA=SeqID_91276; Strand=-; Position=130-360
NKRLIVSDVDGICRSINVRSCPFFPSSSSVRFANHLRSPHPMPSPNHCGDRISVCLDTFVDGLNKSHCVRSIRWHL

SEQ ID NO: 164854 - protein, 176 aa, Heterodera glycines
  Homolog annotation: Hit_ID=CAE66072.1; Match level="QueryCoverage =90%, HitCoverage=43%, E-value=2e-50, Identity=57%"; Hit description =Hypothetical protein CBG11286 [Caenorhabditis briggsae]
  Gene Ontology: Mol. function=cytoskeletal regulator activity; Cellular component=cytoskeleton; Biological process=peripheral nervous system development
  Coding regions on vcDNA: vcDNA=SeqID_91277; Strand=+; Position=122-649
MDNEAAGTVGEAVEDEEVMTDADFERAMEQLREEGGEDVNELFMAMSENRIISWEEAEHILGNSTNEPVKSSLPQQTRPTEPDNDTDVDWCVQRLMNNDPKLVEINLNNMKRTPIPKIKRVIEACRDNEHMEKLSLANMGLYDTDVQPLIDILENNATLRCINLETNYLSGDFFAR

SEQ ID NO: 164855 - protein, 106 aa, Heterodera glycines
  Homolog annotation: Hit_ID=CAE58402.1; Match level="QueryCoverage =98%, HitCoverage=11%, E-value=1e-38, Identity=71%"; Hit description =Hypothetical protein CBG01531 [Caenorhabditis briggsae]
  Gene Ontology: Mol. function=kainate selective glutamate receptor activity; Cellular component=integral to plasma membrane; Biological process=synaptic transmission
  Coding regions on vcDNA: vcDNA=SeqID_91278; Strand=-; Position=138-603
MDSSSLEYEVQQNCNLTQIGGVLGSKGYGIALQKNSEWTDRISRQILLYQKRGIIAMKKTKWWRSKGASCHGVGSSVKQQRISLNLHNVSGLFVILSMGLLFSVNF

SEQ ID NO: 164856 - protein, 85 aa, Heterodera glycines
  Coding regions on vcDNA: vcDNA=SeqID_91279; Strand=-; Position=380-637
ENEEENDDEDEDDFDEDDDDEPSDEKTLRDIPLDKIDIWCFMRLFKDKDEDGQGDRMICISLAQVGSSSSTRRTTLTPFDILPLF

SEQ ID NO: 164857 - protein, 164 aa, Heterodera glycines
  Homolog annotation: Hit_ID=CAE63786.1; Match level="QueryCoverage =96%, HitCoverage=14%, E-value=2e-35, Identity=44%"; Hit description =Hypothetical protein CBG08327 [Caenorhabditis briggsae]
  Coding regions on vcDNA: vcDNA=SeqID_91280; Strand=+; Position=3-494
HSQFFFDPNCPETCSPFYLDALFRKGHLVIRMLEKRLPKEQFVKVLQRILSLGVQYSQNLYRPVEWTHMLINTAMFLRVMTDVTGKELPSFVEQWIDFGGFVNFQVSHIFNRKRNIIELELRQTVPLREGCRNYTGPLAIVVQELGGLFAHGMRRDGGGSRQGI

SEQ ID NO: 164858 - protein, 212 aa, Heterodera glycines
  Coding regions on vcDNA: vcDNA=SeqID_91281; Strand=+; Position=1-636
GTFDQPHHYQRRQNMHNSLFSATYQHANNKWMMAAMPAEELSTEVIVHRKAAQRHRRRTVSKSSGGDSDNGSSSRCHSNANLHAFEESSLEGKEGILSVTSNANDDEMTVGKMDAEGMEQAPVFEEETPALSALRDSLGLGETTAKSVAIDIKPKHRLASFGSPLPSLGTSLQDELLLAAAAVTGKDDDDKITVEELARKKFSQQGMALNSK

SEQ ID NO: 164859 - protein, 182 aa, Heterodera glycines
  Homolog annotation: Hit_ID=CAE64788.1; Match level="QueryCoverage =79%, HitCoverage=94%, E-value=6e-28, Identity=46%"; Hit description =Hypothetical protein CBG09581 [Caenorhabditis briggsae]
  Gene Ontology: Mol. function=thiol-disulfide exchange intermediate activity; Cellular component=mitochondrion
  Coding regions on vcDNA: vcDNA=SeqID_91282; Strand=+; Position=2-550
IFRQFLRRFLVANHRFVPLESFWVGRLNSVLHSTVCGVGPSNFSTGFANHLVQHRFFSSQSDGLNVFELGSENDFDDRVLQAQQPVMVQFYADWCGPCQNLAPRIEAKVNGQNGEVLLARINVDSSLGFLTAQFDVTSVPTVVCFHNGEVIHRFEGDVDDSYLDEIIAHLKEGNSENDKEII

SEQ ID NO: 164860 - protein, 104 aa, Heterodera glycines
  Coding regions on vcDNA: vcDNA=SeqID_91283; Strand=+; Position=88-402
YLMKRMFFVFVFSGGVPKRSNSIDFRCSLRRSLAENNGLQLRTIHSIHSHFHIDSFPPIIFYFLSRDFVIFIYLKPTEKFFSFLAIFLADFHQKNSQFFDFRKV

SEQ ID NO: 164861 - protein, 205 aa, Heterodera glycines
  Coding regions on vcDNA: vcDNA=SeqID_91284; Strand=+; Position=3-617
YLSTTARRQKKTWHQTIARTLQKDIELFEPDPTNTQSAFVGANQQPQAVGAATVGSETGDEATATAAQQSTQQQHHRCAFALRERDLFRIGPMHEAIMQLSKRHTSTVSAASTPTAVEKELLGLGTSEADVLQSGALSDLTGGPKTRGASKRKAAAALAVSCTSSVSGGPTAGAATNVLLPAMSSPQCNYSVPPAECLLMCRLIV

SEQ ID NO: 164862 - protein, 184 aa, Heterodera glycines
  Homolog annotation: Hit_ID=NP_497103.1; Match level="QueryCoverage =94%, HitCoverage=31%, E-value=1e-33, Identity=42%"; Hit description =amidase (2P346) [Caenorhabditis elegans] emb|CAB61089.1| Hypothetical protein Y53F4B.18 [Caenorhabditis e
  Gene Ontology: Mol. function=receptor binding; Cellular component =insoluble fraction; Biological process=amino acid derivative metabolism
  Coding regions on vcDNA: vcDNA=SeqID_91285; Strand=+; Position=17-568
MAMSYAGDVSAYGVTNNPHDTRRITGGSSAGEGALIGAGASLCGIGNDIGGSVRIPAAMNGIFALKPTTVPDHVVPIFGILPKSLLYKPALNMLSNGPMCRYASDLPLALAVMAGKKVDAFQQDVDFSKVKVFYMDDLNVLLAQELQNAQQLPVKMVKSYFEFKHNVTVQRVEVPLMSRFLQLF

SEQ ID NO: 164863 - protein, 205 aa, Heterodera glycines
  Homolog annotation: Hit_ID=NP_501970.1; Match level="QueryCoverage =99%, HitCoverage=5%, E-value=2e-34, Identity=37%"; Hit description =EGF motif related, Lin-12 and Glp-1 X-hybridizing, abnormal EPIthelia EPI-1 (407.8 kD) (epi-1) [Caenorhabd
  Gene Ontology: Mol. function=extracellular matrix structural constituent; Cellular component=basal lamina; Biological process =cell-cell signaling
  Coding regions on vcDNA: vcDNA=SeqID_91286; Strand=+; Position=16-630
MNIQSSRSVLDDQWHTLLVEREAGAAVLYLDGRLEAQNRTNLGTIELLQLQSPLYIGGLPPELVPLAARLLPGVKPEFGGCLREFSLNDLALEEPVAEKDIAQCSQFIEQGIFFGKDGGYAILSPQFVVGLSFSFELELKPRTKTAVLLSVGVLEFLSLQLLNGTGKFREGQRWRHGIRCSTSQSVPTSWCDGPWDPDPNLQKKR

SEQ ID NO: 164864 - protein, 140 aa, Heterodera glycines
  Homolog annotation: Hit_ID=AAP88024.1; Match level="QueryCoverage =84%, HitCoverage=31%, E-value=1e-26, Identity=51%"; Hit description =beta-1,4-endoglucanase-4 [Heterodera glycines]
  Coding regions on vcDNA: vcDNA=SeqID_91287; Strand=+; Position=246-665
MKNLTTFVFFLIIAALPPIVSPAQSPPYGQLQIKGSKLMSSSGKEIVLRGMSLFWSQWDPKYWNAETVKQLKCNWGINILRAPMGVEGSDGYLQSAAASAANTQKLMTIVDACINLGIYVIIDWHYTSGKAYTAPAVDFF

SEQ ID NO: 164865 - protein, 173 aa, Heterodera glycines
  misc_feature (125)..(125): Xaa can be any naturally occurring amino acid
  Homolog annotation: Hit_ID=NP_506567.1; Match level="QueryCoverage =98%, HitCoverage=26%, E-value=2e-19, Identity=35%"; Hit description =predicted CDS, nuclear eXport Factor NXF-1, nuclear rna export factor (nxf-1) [Caenorhabditis elegans] em
  Coding regions on vcDNA: vcDNA=SeqID_91288; Strand=+; Position=3-520
NPGLKYTIFTKRVPAPFETISFSNRQIIEQVVKGRFKQQTNSLDLSSFQNDPLFERSQLSYGLFHNHVVVAVANLIARNFPSIRGIRLNNNSLRTLDFLSCLVYAAPNVVELDLANNAVSEFHAXNELDKLKSWSLESVHFENNEFVASYQGNFVAYSQAIHQFFPRVTYLDG

SEQ ID NO: 164866 - protein, 176 aa, Heterodera glycines
  Homolog annotation: Hit_ID=NP_495097.1; Match level="QueryCoverage =100%, HitCoverage=33%, E-value=1e-38, Identity=46%"; Hit description= a cluster of two very similar genes (2F923) [Caenorhabditis elegans] gb|AAK82897.1| Hypothetical protein
  Gene Ontology: Mol. function=protein binding; Cellular component =endoplasmic reticulum; Biological process=protein-nucleus import
  Coding regions on vcDNA: vcDNA=SeqID_91289; Strand=+; Position=3-533
CTAMVEADILCPTKHFPELAWARELPKSDSHYVTNVEFTEKDEFGMEVRRNGRPMPVEYLLVDVPCGVRLQEVHKFTVPESVDETFPIENRTIVDQHQNLRDLAKYVSAFDLPDQFLTMASDFHFLLFLFTNHHVEFSVAELKSLVASVRKSDAQGAKEWAERSENWGTLLLLSQS

SEQ ID NO: 164867 - protein, 59 aa, Heterodera glycines
  Coding regions on vcDNA: vcDNA=SeqID_91290; Strand=+; Position=62-241
EFGVAQRTFLNVFRTFKFKISLCSSNQQSVGTFNFQISVYYTICTLLLYTHSECYTNCG

SEQ ID NO: 164868 - protein, 173 aa, Heterodera glycines
  Homolog annotation: Hit_ID=CAE64431.1; Match level="QueryCoverage =89%, HitCoverage=15%, E-value=2e-35, Identity=48%"; Hit description =Hypothetical protein CBG09134 [Caenorhabditis briggsae]
  Gene Ontology: Mol. function=transcriptional repressor activity; Cellular component=nucleus; Biological process=negative regulation of transcription
  Coding regions on vcDNA: vcDNA=SeqID_91291; Strand=+; Position=1-519
HHHGQQSSVGAACSSTQSSAPSSSQSEQADSTLHPEERKRILHLHAEKNRRFALKEGFESLVNAIPVVEQTGVKCTNAVVLNRAAQHIKQLKSEQDQQQMKLRVLREKITNMNERIALIQSNLPSSSTGGSRPCEAQTPSMRIQVEQFFEHYKKERSREDYRFWLMGEVLKPI

SEQ ID NO: 164869 - protein, 192 aa, Heterodera glycines
  Homolog annotation: Hit_ID=NP_496270.1; Match level="QueryCoverage =83%, HitCoverage=80%, E-value=2e-48, Identity=55%"; Hit description =protein conserved (2K828) [Caenorhabditis elegans] emb|CAA90664.1| Hypothetical protein R166.3 [Caenorhab
  Coding regions on vcDNA: vcDNA=SeqID_91292; Strand=+; Position=66-641
MACPNICFTSGAIDLDTTKNESVCSMELPVYCFDVVLARLNKRPSPKCPPTIPNECFPLFVSWKKGHARQLRGCIGTFSRNLPLHEGLNEYAQISAFRDNRFDPVGLHELPSLHCSVSLLLCFEPADNYRDWVIGVHGIRIEYRQHHRALNAVYLPEGAYENGWDHVETLKHLMWKGGFRGDITEGQPQMGL

SEQ ID NO: 164870 - protein, 203 aa, Heterodera glycines
  Homolog annotation: Hit_ID=XP_453746.1; Match level="QueryCoverage =59%, HitCoverage=29%, E-value=4e-16, Identity=39%"; Hit description =unnamed protein product [Kluyveromyces lactis] emb|CAH00842.1| unnamed protein product [Kluyveromyces lac
  Coding regions on vcDNA: vcDNA=SeqID_91293; Strand=+; Position=1-609
DSPPPSTLCHYQQQPNASLKSHIFDESDCSFSVLDQRLLPSAVEYVRIRSVQDGYEAIKEMKVRGAPLIATVGMFSLLVDVTASSTATAEHFCSDSFVQKTFRQSVERKCQMLLSARPTAINLANAFHELIDFLKNDEDNNSDAGTETAAEINRRLKIRLKHFVLDWQSRESAENAALLHNSVQAVLNECAATKNVGQNDDDN

SEQ ID NO: 164871 - protein, 118 aa, Heterodera glycines
  Coding regions on vcDNA: vcDNA=SeqID_91294; Strand=+; Position=296-649
TIKTTERLKLTFILNFRWYNEVLNVPFNENGTTKNDEILKAFRHELRHFQKFVSNRIFVSAPTLQFKHDVAKELAKRLWQHAPLGDLQLSLREHYVTNRFSYARLRLLNCPKCVQFDL

SEQ ID NO: 164872 - protein, 122 aa, Heterodera glycines
  Homolog annotation: Hit_ID=NP_495408.1; Match level="QueryCoverage =99%, HitCoverage=18%, E-value=2e-49, Identity=77%"; Hit description =ATP-binding cassette sub-family D member 3 like (74.9 kD) (2H174) [Caenorhabditis elegans] gb|AAA68340.1|
  Gene Ontology: Mol. function=nucleotide binding; Cellular component =extracellular space; Biological process=peroxisomal long-chain fatty acid import
  Coding regions on vcDNA: vcDNA=SeqID_91295; Strand=+; Position=3-368
KLFYVPQRPYMTIGSLRDQVIYPDRPADMRRRGFTDSALEALLDQVQLRNILEREGGWEGQQDWMDVLSGGEKQRIAMARLFYHSPQFAILDECTSAVSADVEDAIYRRCHELGITLVTVSQ

SEQ ID NO: 164873 - protein, 181 aa, Heterodera glycines
  misc_feature (54)..(56): Xaa can be any naturally occurring amino acid
  misc_feature (119)..(119): Xaa can be any naturally occurring amino acid
  misc_feature (129)..(129): Xaa can be any naturally occurring amino acid
  Homolog annotation: Hit_ID=CAB88203.1; Match level="QueryCoverage =100%, HitCoverage=57%, E-value=7e-49, Identity=60%"; Hit description= putative cuticular collagen [Globodera pallida]
  Coding regions on vcDNA: vcDNA=SeqID_91296; Strand=+; Position=2-545
IVLGIASVCSLLAIIATVVTLPSLYSEMSQMNSKVRDGVEAFRVNTDSAWTDLXXXVQVVVTPPSKPRDNPFNSIFRAKRQLPGHCQCAGLQQPSLSPPGPARPLPNRPGTAPGTPLKXQEKPEKPGRXGKPLSFWPPKNPPPPFSLWGPPARPQGKRDPPHKKRPPPRTHWSPPPAGGGR

SEQ ID NO: 164874 - protein, 128 aa, Heterodera glycines
  Homolog annotation: Hit_ID=AAC47437.1; Match level="QueryCoverage =100%, HitCoverage=98%, E-value=1e-31, Identity=63%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_91297; Strand=+; Position=3-389
RVKAYRFVAYTTVSFSIISLLSVCLTLPMLKSYVSNVGMKMDSELSSCQHNAKDIWSEVSQLKGLPLLVSGNRTARSAYGSGQECCSGGAQGQPGQPGQPGNPGERGICPKYCAVDGGVFFEDGTRRR

SEQ ID NO: 164875 - protein, 152 aa, Heterodera glycines
  misc_feature (99)..(99): Xaa can be any naturally occurring amino acid
  misc_feature (116)..(116): Xaa can be any naturally occurring amino acid
  Homolog annotation: Hit_ID=XP_448713.1; Match level="QueryCoverage =71%, HitCoverage=81%, E-value=2e-34, Identity=66%"; Hit description =unnamed protein product [Candida glabrata] emb|CAG61676.1| unnamed protein product [Candida glabrata CBS1
  Gene Ontology: Mol. function=DNA binding; Cellular component=nuclear nucleosome; Biological process=chromatin assembly/disassembly
  Coding regions on vcDNA: vcDNA=SeqID_91298; Strand=+; Position=1-456
NSQESQVASPVKAGKATTKTTASGKGGKAKADGKVKAGGKGAKKAGGKGGKVKIAASGSKNTRSARAGVAFPVGRIHRLLRHGRHAQRIGAGTPVYMAXVLEYLAAEMLELTGNAXKEKQKLRITPRHLQLAVRNDKELNKLLAEGTLSSGG

SEQ ID NO: 164876 - protein, 181 aa, Heterodera glycines
  Homolog annotation: Hit_ID=CAE61720.1; Match level="QueryCoverage =100%, HitCoverage=95%, E-value=1e-59, Identity=40%"; Hit description= Hypothetical protein CBG05670 [Caenorhabditis briggsae]
  Gene Ontology: Mol. function=extracellular matrix structural constituent; Cellular component=basement membrane
  Coding regions on vcDNA: vcDNA=SeqID_91299; Strand=+; Position=1-543
MYCHVGASPVTTVCCPAEQINPCAQSVEQGIGPNQLERFAFDVQAQQCVPFAYRGLKGNRNNFLSQEECEVACLPNSCPSGSPFVGADGRAQSCAVSTAMSTCPNGYWCHVGANAATTMCCPEANASPCQLPMSTGEGPFRLDRFYFDLGSKSCKSFIYKGLKGNQNNFLSLRACQLNCLP

SEQ ID NO: 164877 - protein, 136 aa, Heterodera glycines
  Coding regions on vcDNA: vcDNA=SeqID_91300; Strand=+; Position=2-409
HLSAQTDHHHHPSNHRQHCPPLPERFVAGLRCAFQLLDINGSGKVPFEQICKKWPVHFADLPVPSNFLECLRRVNPSEEMVTFEQFIKGAQLALRERMNTAGRLKRVQSEGKLFGSDLENGKSGESNRAKSRGAPS

SEQ ID NO: 164878 - protein, 122 aa, Heterodera glycines
  Homolog annotation: Hit_ID=CAE65201.1; Match level="QueryCoverage =100%, HitCoverage=22%, E-value=7e-55, Identity=81%"; Hit description= Hypothetical protein CBG10076 [Caenorhabditis briggsae]
  Gene Ontology: Mol. function=ATP binding; Cellular component =intracellular; Biological process=aspartyl-tRNA aminoacylation
  Coding regions on vcDNA: vcDNA=SeqID_91301; Strand=+; Position=2-370
VREKYQTDFYVLDKYPLAVRPFYTMPDPNDTKYSNSYDMFMRGEEIISGAQRVHDSAMLTERAKLHGIDIEKIQSYIDAFRFLCPPHAGGGIGLERVTMLFLGLPNVRLASLFPRDPKRITP

SEQ ID NO: 164879 - protein, 213 aa, Heterodera glycines
  Homolog annotation: Hit_ID=NP_035754.1; Match level="QueryCoverage =68%, HitCoverage=16%, E-value=2e-10, Identity=33%"; Hit description =topoisomerase (DNA) III beta [Mus musculus] gb|AAH31723.1| Topoisomerase (DNA) III beta [Mus musculus] sp
  Gene Ontology: Mol. function=DNA topoisomerase activity; Cellular component=nucleus; Biological process=electron transport
  Coding regions on vcDNA: vcDNA=SeqID_91302; Strand=+; Position=1-639
KYRKALDEDQLARQLYELICRYFLATCLCPSKIAEMTIKFSIGPETFKSVKHTVVVQGFLLVVPWMRPEFCDTELPTEATKQLNQFIKQTFIVSDVRRLQIENPKGGLSEAKLISQMALLELGNYDTIPETLSKLMQKKLANVVGPGRWIVPTSEGLQRLESFRQDGVDTDGNTEQVSDDVLEERDEDDGSDVREVKQHSDRRARKRVRFDLT

SEQ ID NO: 164880 - protein, 66 aa, Heterodera glycines
  Coding regions on vcDNA: vcDNA=SeqID_91303; Strand=+; Position=2-199
EAKVEGDANILCKLSAPSVKVKTEVDLHNSQLNADQLYEYAKNCFKFKNICVLRFRKWSEARNFYK

SEQ ID NO: 164881 - protein, 193 aa, Heterodera glycines
  Coding regions on vcDNA: vcDNA=SeqID_91304; Strand=+; Position=18-596
MAALMMLTFLLMSSFVAEMANALKILIVQQNYMFFRSHFGFGLNLAKYLAEEGHQIHMLIPITDETYKLKNKNDEAQLYVRYFVPKKTKPLHKLIMEGDKGKMSDRIYKEIAEDFELMDGLRAEKFDVGMAEAFCLTEYSLALFHFLQIAVTIATQSQPMSPFQLHLMGHLSKMKQSEGMPTEFIGISTMNFF

SEQ ID NO: 164882 - protein, 214 aa, Heterodera glycines
  Homolog annotation: Hit_ID=CAE67428.1; Match level="QueryCoverage =86%, HitCoverage=22%, E-value=2e-78, Identity=69%"; Hit description =Hypothetical protein CBG12918 [Caenorhabditis briggsae]
  Gene Ontology: Mol. function=GTPase activator activity; Cellular component=COPII vesicle coat; Biological process=vesicle-mediated transport
  Coding regions on vcDNA: vcDNA=SeqID_91305; Strand=+; Position=3-644
QKLVIPVSTFFTPLKEKPTDQPKQPPLEYDPIFCQKSSCKAVLNALCMVDYRTKVWVCPFCNQRNPFPPHYAAISEENRPPELHPLFTTIEYTLKKATTLPPIFLFVIDTCIASEELKALKESLQKAISYLPADALIGLITFGRMVEIHELNVKGMARSYVFKGTKEANPKQLRDIIALQIGLPSATVRRQSAASTPVPHHPIQQPLINGVHPG

SEQ ID NO: 164883 - protein, 206 aa, Heterodera glycines
  Coding regions on vcDNA: vcDNA=SeqID_91306; Strand=+; Position=3-620
DAVKLSTFRRVKSGTHSSDFVEMPFTGSDFDVRPLLHHITHASLPDILDIGLGFTTDVPLSSPLSHSLLSLQNGTLPNFLFYCLIEMASELRLRHSKLFFSSRPLLLSIDLANSLPLDKLLEAFETNELPALCLLNTEKKSFRCMTGEKNIENFTTSNAPADFAQRMATEKSKAFEFLGNGVGPTGDFPSSSHPFAIIQIEHIGAL

SEQ ID NO: 164884 - protein, 154 aa, Heterodera glycines
  Coding regions on vcDNA: vcDNA=SeqID_91307; Strand=+; Position=1-465
RKDAPLGHRIGPAPSPSSASASSTLTHFQWKEGRNSAERRTAYEGICAIPSQQKPTDAFYGIFARLFDKNTIELDKTERDDDIKDNYMMYFISKSEEHPTNISRRKEPNGETDGERRGRSLSPKVERQTRTSKCSVAAHMSIPVDQLQPRNCRM

SEQ ID NO: 164885 - protein, 86 aa, Heterodera glycines
  misc_feature (30)..(30): Xaa can be any naturally occurring amino acid
  Homolog annotation: Hit_ID=AAC48358.1; Match level="QueryCoverage =97%, HitCoverage=27%, E-value=5e-12, Identity=42%"; Hit description =cuticle preprocollagen [Meloidogyne incognita]
  Coding regions on vcDNA: vcDNA=SeqID_91308; Strand=+; Position=68-325
YPRAPTSPVQRRQTPQTTCNELHATPCTPXPMGQNSQNFATEPPVSPGAPGQPGTGGGQLQAGEASPSALYGQPLQSAEPGFTGQS

SEQ ID NO: 164886 - protein, 219 aa, Heterodera glycines
  Homolog annotation: Hit_ID=CAE64674.1; Match level="QueryCoverage =95%, HitCoverage=39%, E-value=2e-71, Identity=61%"; Hit description =Hypothetical protein CBG09450 [Caenorhabditis briggsae]
  Coding regions on vcDNA: vcDNA=SeqID_91309; Strand=+; Position=1-657
RQRSGGRSASFFRVLDELKPKGIKVVGCMCMCRNSIGSHSYTCDEIITSRSGKRVHIYNTDAEGRMAMADPLAEAKEKAMKANNPHLFTIATLTGHLILTYGHCSAAMDNGPARAANYAEQLRKTGDEFGQPVEVSRLFSEDFDFHSAKCEAADLMQSNALPSVRTPRGHMGPSAFLMRVSRIQQGGLDSAKPLKSPHLDIGISMGGKPKPFGHPSPLL

SEQ ID NO: 164887 - protein, 96 aa, Heterodera glycines
  Coding regions on vcDNA: vcDNA=SeqID_91310; Strand=+; Position=107-394
FPLAKSNKFCMTKSLLLYEEEFQCKVEGDLFRSEDGLLNSLLSFEHFARKLRIVERGWPSGFRMWFREKSGWIYERCSLVARIKGGFAQSDAHFDM

SEQ ID NO: 164888 - protein, 115 aa, Heterodera glycines
  Coding regions on vcDNA: vcDNA=SeqID_91311; Strand=+; Position=153-500
YTKTIEIIAPKNHHNSILLGMNGGNEAASSSSTSAPPNATMLQLNVPKNQQLFMLNPPNGPVVNIGDHIQGDGGGQQQSTSASTPLPDKILDDDDNLPPPLLTSVIEQDGEEIVL

SEQ ID NO: 164889 - protein, 145 aa, Heterodera glycines
  Coding regions on vcDNA: vcDNA=SeqID_91312; Strand=-; Position=3-437
PNWIGFAVTPPPPKKPPPDSAAFAAKFAKVFVPGREAPPKRLLPMGTDGVVKVEAPLNRATETAVVVTAGSRGSKVGLNPTGSVVLAVTLAAKFDNVFVPGRQAPPKRLPLIGMDEAVKVKVPLNGATETAVVTAGVGSVVGLNP

SEQ ID NO: 164890 - protein, 195 aa, Heterodera glycines
  misc_feature (79)..(79): Xaa can be any naturally occurring amino acid
  Homolog annotation: Hit_ID=CAE64154.1; Match level="QueryCoverage =92%, HitCoverage=17%, E-value=2e-57, Identity=55%"; Hit description =Hypothetical protein CBG08772 [Caenorhabditis briggsae]
  Gene Ontology: Mol. function=GTP binding; Cellular component =nucleolus; Biological process=rRNA processing
  Coding regions on vcDNA: vcDNA=SeqID_91313; Strand=+; Position=51-634
MEWRKGQKRNAFGSFSDAEFDQTNEQYNALVEEMDKQSKLNKSVFDDLDEEQRQKLEGFRPGLYIRVKVEDVPAAFVDXFHPTFPYIVGGLLPVEQNDGYVQVRIKKHRWYDRLLKSRDPLIISCGWRRFQSMVVYSVLDHNHRLRFFKYTPKEAFCHGAFWAPFVTQNTGFLCLQSVDEEKKGFRIAASGVVLG

SEQ ID NO: 164891 - protein, 166 aa, Heterodera glycines
  Homolog annotation: Hit_ID=EAL27559.1; Match level="QueryCoverage =100%, HitCoverage=99%, E-value=2e-66, Identity=68%"; Hit description= GA21906-PA [Drosophila pseudoobscura]
  Gene Ontology: Mol. function=ubiquitin conjugating enzyme activity; Cellular component=endoplasmic reticulum; Biological process =establishment and/or maintenance of chromatin architecture
  Coding regions on vcDNA: vcDNA=SeqID_91314; Strand=+; Position=28-528
MSSEQSKLLLQKQLNELTRNPVDGFSAGLVDESNLYKWQVFIMGPPNSPYEGGNFRAELVFPKDYPLRPPTMRFVSRIVHPNIDRDGNVCISILHEPGDDRFGYEKASERWLPVHTVETILISVISMLSDPNFDSPANVDAAKTHRENPTEYRRQVARCVRETEEQ

SEQ ID NO: 164892 - protein, 140 aa, Heterodera glycines
  Homolog annotation: Hit_ID=XP_321745.1; Match level="QueryCoverage =99%, HitCoverage=27%, E-value=8e-24, Identity=43%"; Hit description =ENSANGP00000016823 [Anopheles gambiae]
  Gene Ontology: Cellular component=mitochondrion
  Coding regions on vcDNA: vcDNA=SeqID_91315; Strand=+; Position=2-421
PLDLLAFTLILPLLPPLIHHLSKQHQIKSDPIFAEFDSGAHGLQTFLNDPSIERNNGVFVGGILGSLFSFLQVLSSPIVGSLSESHGRKSLLLAAVIGSLISYCLWSLSSESFSIFFVPRLIGGLSKASDPVAIAIVTDI

SEQ ID NO: 164893 - protein, 167 aa, Heterodera glycines
  Homolog annotation: Hit_ID=NP_497103.1; Match level="QueryCoverage =98%, HitCoverage=29%, E-value=3e-16, Identity=34%"; Hit description =amidase (2P346) [Caenorhabditis elegans] emb|CAB61089.1| Hypothetical protein Y53F4B.18 [Caenorhabditis e
  Coding regions on vcDNA: vcDNA=SeqID_91316; Strand=+; Position=13-513
MLRYKVIRSLYPVLCLIASLYYALINRVFTLISHFWPKSKVTWTEGEAEEPLLFMSAKKMAEKIRRKEISSSQLVSLYIARLCRVQPLINAIVMDNYEAAKEEAEAVDLYIASMDDDSEELQTLTTTKPLLGVPFTFKNNMDVKGFVSVAGFNKFLKNAPAERVFES

SEQ ID NO: 164894 - protein, 205 aa, Heterodera glycines
  Homolog annotation: Hit_ID=NP_011082.1; Match level="QueryCoverage =77%, HitCoverage=7%, E-value=2e-11, Identity=29%"; Hit description =Bem2p [Saccharomyces cerevisiae] emb|CAA84524.1| Ipl2p [Saccharomyces cerevisiae] sp|P39960|BEM2_YEAST GTP
  Gene Ontology: Mol. function=Rho GTPase activator activity; Cellular component=intracellular; Biological process=small GTPase mediated signal transduction
  Coding regions on vcDNA: vcDNA=SeqID_91317; Strand=+; Position=3-617
MNDFTTVAIALLSRYSNNLLKKDSEAALSGEIVGDERETENIVRTLITIIDSFEENEFFAQGLYRLSGSLTTQQNALNIIENANGRELKLYFIYELNATDKASCIKTLLRKMPDTLFPHCQRVALLDLSGMVTSYGAPCESDDRILKALQILVYFIPETHKQCLECLLIHLKRVSAHSDKNKMDESNLGLLFSSYVFPVQQQKYE

SEQ ID NO: 164895 - protein, 213 aa, Heterodera glycines
  Homolog annotation: Hit_ID=AAR85527.1; Match level="QueryCoverage =100%, HitCoverage=85%, E-value=3e-52, Identity=46%"; Hit description= 14-3-3b protein [Meloidogyne incognita]
  Gene Ontology: Mol. function=protein domain specific binding; Biological process=protein kinase C activation
  Coding regions on vcDNA: vcDNA=SeqID_91318; Strand=+; Position=3-641
EKHLHFVRLAEEAARYDEMVQGMKQVIELDAKLNENERKLLGVAYRKSVTGQRFAWRVIASVLARGKGTKRQLEMVKQLLNKLEREVEERCREILDLLDWVLIKEAADDEAKVFYLKLKADHFRYLAETRTVKNGVAEKAKQAYQEAFDLAKNKLRPMHPIRLTVALNFAILQFEVQKSPADACQTAQRAYDDATSDAQTTGESICAESVTIM

SEQ ID NO: 164896 - protein, 100 aa, Heterodera glycines
  misc_feature (68)..(68): Xaa can be any naturally occurring amino acid
  misc_feature (80)..(80): Xaa can be any naturally occurring amino acid
  Homolog annotation: Hit_ID=NP_499240.1; Match level="QueryCoverage =96%, HitCoverage=20%, E-value=3e-23, Identity=62%"; Hit description =speckle-type POZ protein (51.1 kD) (3L182) [Caenorhabditis elegans] emb|CAA83138.2| Hypothetical protein
  Coding regions on vcDNA: vcDNA=SeqID_91319; Strand=+; Position=5-301
MAAASSASGTSSTTSSSSSSSSSMIPLDIGLCMLPIAENWCNTQVKVVKLNYMWTINNFSFLPDEMGXETLKSSTFSGGXETKLKRCLGIKPKGLEQESK

SEQ ID NO: 164897 - protein, 98 aa, Heterodera glycines
  Coding regions on vcDNA: vcDNA=SeqID_91320; Strand=+; Position=254-547
LEAVESNTLQLLANTLDDALTKAELVKKRQSEDVLLHMTGLNTKYLLHLCEMRGSTNADDPNGYVSVHSVKIPEAANWNVRNPSPIISIGNVTYIILI

SEQ ID NO: 164898 - protein, 83 aa, Heterodera glycines
  Homolog annotation: Hit_ID=CAB88203.1; Match level="QueryCoverage =71%, HitCoverage=65%, E-value=2e-23, Identity=72%"; Hit description =putative cuticular collagen [Globodera pallida]
  Coding regions on vcDNA: vcDNA=SeqID_91321; Strand=+; Position=3-254
GGEGPPGPTGAPGLPGLSGNIGQPGQPGAPGQPGKDSGYCPCPPRSSAMALKKKMAAVKIFLAKRAASNCDAKDNPIIGCWRN

SEQ ID NO: 164899 - protein, 169 aa, Heterodera glycines
  Homolog annotation: Hit_ID=AAP30770.1; Match level="QueryCoverage =99%, HitCoverage=65%, E-value=3e-46, Identity=58%"; Hit description =putative gland protein G17G01 [Heterodera glycines]
  Coding regions on vcDNA: vcDNA=SeqID_91322; Strand=+; Position=3-509
CPKAFLHDISVGHCKRFTLIGKDSKTGEFGAVLDERKWHNQLFMSSTNFLPIKEQQQQFMDELAAKLPCPGRHCIPITTPSFFFWTEKNRNLFDNVMDSFSGQLLLALCSLLTIGIGFARMLRPAAEYECFDYCMALYSVFCWCCSAWASSYLLLYWTPYWSCMNFRAD

SEQ ID NO: 164900 - protein, 170 aa, Heterodera glycines
  Homolog annotation: Hit_ID=NP_499686.1; Match level="QueryCoverage =58%, HitCoverage=30%, E-value=2e-12, Identity=40%"; Hit description =RNA binding motif protein like (3O18) [Caenorhabditis elegans] emb|CAA21536.1| Hypothetical protein Y37D8
  Coding regions on vcDNA: vcDNA=SeqID_91323; Strand=+; Position=33-542
MSGHVNMQQECTVYLRNLDGKVTEKLLEELFVQVGPVNFVTIRDPQQQHKGPHSADTTPKTSGNRYAFVEFADVESVLFACEVMDAVEIYGQKLKVQPRDNTLQRAIFTQMNMHTASWERHHAPAADSSVAGKGRPATRHSDIGVYNELERQSPGAGGGQRIVTFNRSHG

SEQ ID NO: 164901 - protein, 212 aa, Heterodera glycines
  Homolog annotation: Hit_ID=NP_506153.1; Match level="QueryCoverage =100%, HitCoverage=10%, E-value=2e-20, Identity=30%"; Hit description= TEMO (5N87) [Caenorhabditis elegans] emb|CAA98425.1| Hypothetical protein C14C10.5 [Caenorhabditis elega
  Coding regions on vcDNA: vcDNA=SeqID_91324; Strand=+; Position=3-638
HTESALSLDGIVVTPADEHKREKLALITLLNYFSSLSTHWAQLLRPFATSIFQLIPLFSHYSNENTDEELRGCCNAQLVRYMGLSTVASAADLEELFATCTTLRERASWWKSKVCLLRFLQVFAFTNQFFISAHPNGFSALEQLIIDFLCDPRFDVRVAAAETLGGLIRAAIIAVDQQFLAKARDMANSTDPITRHSGVLALSAIVRAFPYS

SEQ ID NO: 164902 - protein, 213 aa, Heterodera glycines
  misc_feature (83)..(83): Xaa can be any naturally occurring amino acid
  Homolog annotation: Hit_ID=NP_506060.1; Match level="QueryCoverage =100%, HitCoverage=23%, E-value=3e-76, Identity=61%"; Hit description= dehydrogenase E1 (5M685) [Caenorhabditis elegans] pir||T28034 hypothetical protein ZK836.2 - Caenorhabdi
  Gene Ontology: Mol. function=oxoglutarate dehydrogenase (lipoamide) activity; Cellular component=mitochondrion; Biological process=2 -oxoglutarate metabolism
  Coding regions on vcDNA: vcDNA=SeqID_91325; Strand=+; Position=3-641
KIEQGQIDWSTAEALAIGTALLQGNDVRLSGQDVGRATFSHRHAMLVDQRTDKVHVPLNHIAKDQQNFLEIANSPLTEAAVVXFEFGFAIENPHRMVIWEAQFGDFYNGAQVQIDTLIANGESKWLLQNGIVLLLPHGIDGAGPDHSSGHIERFLQLTNSREDQRPPDGDDVNLSGGNPSTAAQYFHLLRGQIVRPLRKPLGIFSPQMLLRPP

SEQ ID NO: 164903 - protein, 187 aa, Heterodera glycines
  Homolog annotation: Hit_ID=NP_647989.2; Match level="QueryCoverage =98%, HitCoverage=18%, E-value=2e-47, Identity=50%"; Hit description =CG10542-PA [Drosophila melanogaster] gb|AAF50744.2| CG10542-PA [Drosophila melanogaster]
  Gene Ontology: Mol. function=ubiquitin-protein ligase activity; Cellular component=nucleosome; Biological process=establishment and/or maintenance of chromatin architecture
  Coding regions on vcDNA: vcDNA=SeqID_91326; Strand=+; Position=1-564
QSLENQLATKLLHCQRLEEKERVLTENRVTLEHELRIRDQNNETLRKKGIEFSQLATDLRLRLDRLDIQFTELRESVIKKASSYEANANKIKRLEEEKSSLKRKLDRAKRMEKYENVDELLQEENRILKESLTCPSCKVNRKNAILDKCHHVFCFECIRLRYDNRRRKCPKCNAAFGANDFHRIYLE

SEQ ID NO: 164904 - protein, 167 aa, Heterodera glycines
  Homolog annotation: Hit_ID=AAO50779.1; Match level="QueryCoverage =85%, HitCoverage=8%, E-value=9e-09, Identity=33%"; Hit description =similar to Mus musculus (Mouse). Sex-determining region Y protein (Testis-determining factor) [Dictyosteliu
  Coding regions on vcDNA: vcDNA=SeqID_91327; Strand=+; Position=3-506
AHGVQYQFPSLPQPSPHTQTTQQQQPTTANLHYSQSHQQQAVPFQRNLNVLSHPMLFQHQQNVQLSQQQQQMGTQQHSVVYAGGHAMPTQHHQQYSAAYPLLQQQQQSQQFPPSTGAAFAPMVIPLQNDPIAVGIRQQHQQVYQHTPSHSALQHGTSHAGGYLAQQK

SEQ ID NO: 164905 - protein, 197 aa, Heterodera glycines
  misc_feature (29)..(29): Xaa can be any naturally occurring amino acid
  Homolog annotation: Hit_ID=CAE61329.1; Match level="QueryCoverage =92%, HitCoverage=31%, E-value=5e-64, Identity=61%"; Hit description =Hypothetical protein CBG05167 [Caenorhabditis briggsae]
  Gene Ontology: Cellular component=membrane; Biological process=lipid metabolism
  Coding regions on vcDNA: vcDNA=SeqID_91328; Strand=+; Position=3-597
HSEDIGRLFSKLDYAGISLLIIGSFVPWXYAFFCRVLPMTIYISMIFLLGIAALVVSLFDKFSQPKYRPLRAIVFMAMGLFSVVPALHLLVTDGIVWMFEKASLHWLILMGILYLSGATIYMVRFPERCFPGKCDILCQSHQLFHLFVIFAAAVHYHGVLELAMKRLQDGSCSEQLISHSGSDEATIQWLDDRLRPY

SEQ ID NO: 164906 - protein, 193 aa, Heterodera glycines
  Homolog annotation: Hit_ID=NP_502295.1; Match level="QueryCoverage =98%, HitCoverage=10%, E-value=2e-35, Identity=45%"; Hit description =SF21 (181.5 kD) (4M869) [Caenorhabditis elegans] emb|CAA92597.1| Hypothetical protein F11A10.4 [Caenorhab
  Coding regions on vcDNA: vcDNA=SeqID_91329; Strand=+; Position=3-581
TNPLNSDERKRHEFIDCLAIELIRTELLPYAAALPREFMQRIIDILNRGSINTMDSHDVLASDAYQQRADLSRVCFDALLSLTQTDAAASSATTSKPKSPTPSGGGVLRNSNQTTAACSSLGATAIASLLQRCSKVLNDYAKDEQTAGHFRLPQERIFEAISALQAITALIEGFSRNPNNPTLYSHLVTLHPS

SEQ ID NO: 164907 - protein, 148 aa, Heterodera glycines
  misc_feature (32)..(32): Xaa can be any naturally occurring amino acid
  misc_feature (39)..(39): Xaa can be any naturally occurring amino acid
  misc_feature (59)..(59): Xaa can be any naturally occurring amino acid
  Homolog annotation: Hit_ID=NP_499246.1; Match level="QueryCoverage =98%, HitCoverage=41%, E-value=5e-20, Identity=36%"; Hit description =blr7445 like (3L204) [Caenorhabditis elegans] emb|CAA87427.2| Hypothetical protein ZK1128.1 [Caenorhabdit
  Gene Ontology: Cellular component=mitochondrion
  Coding regions on vcDNA: vcDNA=SeqID_91330; Strand=+; Position=2-445
QLLRIMRDQIRSSGPITVDEYMKICATCQLGXLSLSKRXFGERGDLVTSPHLTQIFGEXIASRAVHEVEMTSWKDQWPFGKLGSGSGELKDDGLCGLRQFDVLHKVEAYMVKNSKRLVERQRHTLRKKCGEHLLRTIRWYHSLDDVPQ

SEQ ID NO: 164908 - protein, 217 aa, Heterodera glycines
  Homolog annotation: Hit_ID=CAG81542.1; Match level="QueryCoverage =92%, HitCoverage=39%, E-value=1e-33, Identity=39%"; Hit description =unnamed protein product [Yarrowia lipolytica CLIB99] ref|XP _503336.1| hypothetical protein [Yarrowia lipol
  Gene Ontology: Mol. function=general RNA polymerase II transcription factor activity; Cellular component=nucleotide excision repair factor 3 complex; Biological process=regulation of transcription, DNA-dependent
  Coding regions on vcDNA: vcDNA=SeqID_91331; Strand=+; Position=3-653
KTREVEALPTATPTTTDEDDYDISIDSPPPTAQSGGLGGGPSAAGPPGLLGAGGGYAWEEEYKRSWDALQEDEDGSITASVSYFTSQLKRKRLLRDTRIVQRGLVRHLVVVVDLSQACRDVDFKPTRIEQVCVLLDVYLSEFFDQNPLAQVALVVTHNERAVQVTALSSHPGDHLRKVKERHSALLAAEADPGEPSLQNALEMATGILGHVPAHGTR

SEQ ID NO: 164909 - protein, 91 aa, Heterodera glycines
  misc_feature (12)..(12): Xaa can be any naturally occurring amino acid
  misc_feature (38)..(38): Xaa can be any naturally occurring amino acid
  Homolog annotation: Hit_ID=CAE64816.1; Match level="QueryCoverage =100%, HitCoverage=10%, E-value=2e-13, Identity=41%"; Hit description= Hypothetical protein CBG09610 [Caenorhabditis briggsae]
  Coding regions on vcDNA: vcDNA=SeqID_91332; Strand=+; Position=2-277
GLVALPTAVVPXQIFSRLLILLCMAIISTFSADMLGQXCEILLRRLPGYRTHCQRPYAEIGLKALGPKITTIRSIVRNVTQHGATSVLLLL

SEQ ID NO: 164910 - protein, 126 aa, Heterodera glycines
  Coding regions on vcDNA: vcDNA=SeqID_91333; Strand=+; Position=265-642
MPSLSYPIGPPQPPVPPSYPIVPQAPFAGTTSPTACECCCCSAYRSCPCRPSCPPCCGGTHTTSTTVPPTKPTEETTTTTTTKDKTPKTTTSSSTPVTNPLLHPYNPCCLSLIINCPNNNCNCPPS

SEQ ID NO: 164911 - protein, 136 aa, Heterodera glycines
  Homolog annotation: Hit_ID=NP_492616.1; Match level="QueryCoverage =55%, HitCoverage=20%, E-value=1e-11, Identity=44%"; Hit description =enzyme hatching EHE1 family member (1K463) [Caenorhabditis elegans] emb|CAB05814.2| Hypothetical protein
  Coding regions on vcDNA: vcDNA=SeqID_91334; Strand=+; Position=1-411
SDSPLDSSSSSSFSSSSPSSSSSSIFDQLGQNDLDLIKQKRHIGDIQQLWDEDEMNGKMRNALKPTSSNRWTQIRSHDGKFVIPFIISGQFTMEERQKIQKAMAAIANNSCVEFRPRKFNEFDYVDIQNRKDEGYL

SEQ ID NO: 164912 - protein, 203 aa, Heterodera glycines
  Homolog annotation: Hit_ID=XP_526337.1; Match level="QueryCoverage =82%, HitCoverage=37%, E-value=2e-13, Identity=29%"; Hit description =PREDICTED: similar to Transcription factor AP-2 gamma (AP2-gamma) (Activating enhancer-binding protein 2
  Gene Ontology: Mol. function=transcription factor activity; Cellular component=nucleus; Biological process=cell-cell signaling
  Coding regions on vcDNA: vcDNA=SeqID_91335; Strand=+; Position=33-641
MDQSKDQQIAQLKAIIEELKAGKHKAVTDQQPQSSSTASAKSPSKPFKEKVKGRLTFENGSAANYPVSFGEVQRRVESPDRMKISDFLTLFHLRKTGSNSVDLRKSIEKSGIEIQTGQRQHSEDTCFTFLLEAEAVKLAEDFAKLCISNYPIKPIANEMTSGENGGESGAKPYNKEELKSIGRFLAEVLAFQQADESPHPPAH

SEQ ID NO: 164913 - protein, 180 aa, Heterodera glycines
  Homolog annotation: Hit_ID=CAE65233.1; Match level="QueryCoverage =100%, HitCoverage=85%, E-value=4e-46, Identity=42%"; Hit description= Hypothetical protein CBG10116 [Caenorhabditis briggsae]
  Gene Ontology: Mol. function=extracellular matrix structural constituent; Cellular component=basement membrane; Biological process=muscle development
  Coding regions on vcDNA: vcDNA=SeqID_91336; Strand=+; Position=1-540
GQTGILGEFGLRGIDGKPGRPGQPGLAGLPGPQGLPGPKGARHPDAFSGLPGPPGEPGYAGMRGEIGPEGNRGIPGDRGPDGFPGIAGNKGDQGMEGVPGLPGTIGLPGRQGPPGIPGPSPQFIQEMHAPTGRPGDIGLSGIPGYPGEPGDAGLPGPPGPAGYPGAPGPPGESGIPGLPG

SEQ ID NO: 164914 - protein, 200 aa, Heterodera glycines
  Homolog annotation: Hit_ID=NP_506019.2; Match level="QueryCoverage =86%, HitCoverage=29%, E-value=6e-42, Identity=48%"; Hit description =aspartyl(D) tRNA Synthetase (drs-2C) [Caenorhabditis elegans] emb|CAB04081.2| Hypothetical protein F10C2.
  Gene Ontology: Mol. function=diacylglycerol O-acyltransferase activity; Biological process=regulation of nurse cell apoptosis
  Coding regions on vcDNA: vcDNA=SeqID_91337; Strand=+; Position=2-601
FTICSFSRFPFSSHLLFFAPFSSRAFVNSFSLRTHNCGELRLSDVGSRVKLFGWMAAKRMNKFVLLRDSYGSVQTVLPKALFSSLKNTNFESALCLEGVVADRGKERNDKMPTGDIEVVVDGLEVLNPSDAPLPVDESSNEYTRITHRYLDLRSEKMQRAMRLRARVVSKCRRFLEDSCGFVEVQTPTLAHTTPGGAAEF

SEQ ID NO: 164915 - protein, 212 aa, Heterodera glycines
  Homolog annotation: Hit_ID=NP_496480.1; Match level="QueryCoverage =99%, HitCoverage=28%, E-value=9e-95, Identity=79%"; Hit description =aminotransferase (81.1 kD) (2L884) [Caenorhabditis elegans] emb|CAA91315.1| Hypothetical protein F07A11.2
  Gene Ontology: Mol. function=glucosamine-fructose-6-phosphate aminotransferase (isomerizing) activity; Biological process=fructose 6-phosphate metabolism
  Coding regions on vcDNA: vcDNA=SeqID_91338; Strand=+; Position=3-638
LMEELTELPVVVELASDFIDRETPIFRDDVCFFISQSGETADTLLALRYCKPRGALLIGITNTVGSSICRETHCGVHVNAGPEIGVASTKAYTSQILALVMFALNMSEDRISMSQRRANIIDGLNNISDQIKQVLTLDQQVLQIANQIYKEKSLLVMGRGYNFATCLEGSLKIKELSYMHCEGILSGELKHGPLAMVDKDKCIVMVICNEMC

SEQ ID NO: 164916 - protein, 78 aa, Heterodera glycines
  Homolog annotation: Hit_ID=NP_252658.1; Match level="QueryCoverage =97%, HitCoverage=20%, E-value=1e-09, Identity=39%"; Hit description =hypothetical protein PA3969 [Pseudomonas aeruginosa PAO1] gb|AAG07356.1| conserved hypothetical protein [
  Coding regions on vcDNA: vcDNA=SeqID_91339; Strand=+; Position=2-238
ATIFARINRISAITDPDWAMIATPTFLPFFTFCPSIRPPACTIEELPKIDIVLISHNHYDHLDVVGVRELAQHFPTII

SEQ ID NO: 164917 - protein, 150 aa, Heterodera glycines
  Coding regions on vcDNA: vcDNA=SeqID_91340; Strand=-; Position=114-566
MILLAKKCGVAPFAWHWIWTASSPPPLCLCAVLSWCCCCPPFSSEEAIASVGGAPGIVPEPEQPFEYGDESSSSLSTPFLFSSFSSSTVISCSFTSIWTFCCNGMCRCCSSPTIALLLFVPFCCCCRKCCCCCCWCCTVAAIAAAATIAC

SEQ ID NO: 164918 - protein, 129 aa, Heterodera glycines
  Homolog annotation: Hit_ID=NP_502680.1; Match level="QueryCoverage =88%, HitCoverage=18%, E-value=5e-10, Identity=35%"; Hit description =putative protein, with a coiled coil-4 domain, of bilaterial origin (86.8 kD) (4O727) [Caenorhabditis ele
  Coding regions on vcDNA: vcDNA=SeqID_91341; Strand=+; Position=152-538
QNRSLADQISEIDSGIDSLRQYHSPFHFAATNGPQKHFSDRRKSLGAVVEMAAVPLTDGTTASGNSEVDKCLAIHLDRAQQAIRVICQVQQSPFEYTLSRMLYRMESTETVALEMTLALAQNAAVNCQP

SEQ ID NO: 164919 - protein, 202 aa, Heterodera glycines
  misc_feature (72)..(72): Xaa can be any naturally occurring amino acid
  Homolog annotation: Hit_ID=NP_872105.1; Match level="QueryCoverage =90%, HitCoverage=53%, E-value=1e-27, Identity=38%"; Hit description =COLlagen structural gene (27.6 kD) (col-107) [Caenorhabditis elegans] gb|AAO44912.1| Collagen protein 107
  Gene Ontology: Mol. function=structural constituent of cuticle; Cellular component=extracellular; Biological process=embryogenesis and morphogenesis
  Coding regions on vcDNA: vcDNA=SeqID_91342; Strand=+; Position=2-607
LPFPSSASPPLSAIPRVRFLTLSLSFVSVVFFLLTLAFSVLILTNINALHTEVMVDIEQFKGVVSKAWDGMXELQAADGGQNNGKSAGKENAQTTIDRQKRQYGTMPSYSSAYVNKQQTCNCAARANKCPAGPPGPPGAPGLPGEPGTRGQDGIPGMPGMSQSFDSGYQDGCVQCPPGPPGVQGIQGVPGTPGSDGQPGTPG

SEQ ID NO: 164920 - protein, 204 aa, Heterodera glycines
  Coding regions on vcDNA: vcDNA=SeqID_91343; Strand=+; Position=2-613
MPVLQLNALDHDGLQQKKLNLPNAPRQPDILLGMDVWHELKIQPIEQLPSGFTICQSKIGNIISGKGRIELSQPSNVSFVMMVFNKESTGSKPTHMQKAKQHRESKTLRRHQINKLLSSAATLRSRRKRESVPNSTTPIVIDLSSDSERNSSDVEIIQDPVAGQQISSSNKHSTAPLPKALRRPTATKQSSSIAKRPASFRKQT

SEQ ID NO: 164921 - protein, 199 aa, Heterodera glycines
  Coding regions on vcDNA: vcDNA=SeqID_91344; Strand=-; Position=0-596
IIAVFQLFYYPFAVVVLFSFCSDFFWRCPMFFHTMNITAAPISEYSTMLVYITSLKLAVIKNYPFSFFRLYHSFSNSNSAIITQNALGPVAFSHRSFDGQSGTKQKAGATDGNVQICPVQMFGIFNRRCVPIDKLSAAFSVRRLGQFDQLRLCCCDWLRKGGMTGKHLSDLFFSMFFFSLAFCPPNFVSHQRFFNENVT

SEQ ID NO: 164922 - protein, 187 aa, Heterodera glycines
  Coding regions on vcDNA: vcDNA=SeqID_91345; Strand=+; Position=1-564
DKLMMMFHLYSLVFCFLFFILALSSHFGTCAGATEGDDGNDQNGQQQQQQQQNSRFSSSSSSSGSSNGCQFSINNGIISDGKGYSRRMTPAEEQQMGNYHAQVARATEEFQQQMAQAVQAPFRGGFGIPSIGQTPQLRLPQLPCFRVDSSSGGDGAQSSQNVAAQNFSGNAAGGVDEENYASVSVEE

SEQ ID NO: 164923 - protein, 102 aa, Heterodera glycines
  misc_feature (55)..(55): Xaa can be any naturally occurring amino acid
  Homolog annotation: Hit_ID=AAR82784.1; Match level="QueryCoverage =79%, HitCoverage=7%, E-value=1e-21, Identity=53%"; Hit description =LD17186p [Drosophila melanogaster]
  Gene Ontology: Mol. function=protein kinase activity; Cellular component=intracellular; Biological process=cell cycle checkpoint
  Coding regions on vcDNA: vcDNA=SeqID_91346; Strand=-; Position=2-486
KPFQDLIHVDFNILFDKGEYLKVPEIVPFRLTRNMVDGFGATGVEGTFRKSCEKXMKVMRAESRMLRTVLHAFAHDPLLEWTTTEARNQQYRQVRLVARAVY

SEQ ID NO: 164924 - protein, 24 aa, Heterodera glycines
  Coding regions on vcDNA: vcDNA=SeqID_91347; Strand=-; Position=2-73
FFFFFFFLAPLSLLVRSEPGKNLS

SEQ ID NO: 164925 - protein, 160 aa, Heterodera glycines
  misc_feature (65)..(65): Xaa can be any naturally occurring amino acid
  Homolog annotation: Hit_ID=NP_495843.1; Match level="QueryCoverage =96%, HitCoverage=12%, E-value=3e-29, Identity=42%"; Hit description =putative protein of bilaterial origin (2I960) [Caenorhabditis elegans] pir||T19713 hypothetical protein D
  Coding regions on vcDNA: vcDNA=SeqID_91348; Strand=+; Position=13-492
MLGAVPHQFRSPADFPAVEGVAAGRSTALAALCRIVCAKRSRERLDDEQLAFFFTILHEALISNXPCQNQFFPAVRYIIDRDRLMLCALLYHTSDELFKLALNGVQILLPNYVMAIDIVHTESMKLRLHPSVSQAEMRAACLRALASVLAWPSVFGSNLI

SEQ ID NO: 164926 - protein, 68 aa, Heterodera glycines
  Coding regions on vcDNA: vcDNA=SeqID_91349; Strand=-; Position=0-203
AQQLHFICFELRKYIYIKRNTPFKFPNANTVVSRRTKSAKFVKFLIKTTHNFSQTQPNCTILVSYDSP

SEQ ID NO: 164927 - protein, 119 aa, Heterodera glycines
  Coding regions on vcDNA: vcDNA=SeqID_91350; Strand=-; Position=1-357
NTFYNIYKWVGKKYSNKIVKILHKNGVFLFISRYLPLFASRPPLLLLPAVRLSCYCQPSASLVIASRPPLLLLPAVRLSCYCQPSASFVIASRPPLLLLPAVRLSCYCQPPISLVIAVR

SEQ ID NO: 164928 - protein, 169 aa, Heterodera glycines
  Coding regions on vcDNA: vcDNA=SeqID_91351; Strand=+; Position=132-638
MSELLRISIAPMVVRLKMYIETAQENLGKELTDQSVRADLLAERQNLCKTISLLEKYNGKWEAIFLRVKGQALQDEEQNYRDFKPEGKAFMHWVDQARGLVDTIEGALGLSELGDAIPQPNQPAQVVQQAPVVHQRHDVTLPPITLPKFSGEPREWPLFWKLFETSVES

SEQ ID NO: 164929 - protein, 55 aa, Heterodera glycines
  Coding regions on vcDNA: vcDNA=SeqID_91352; Strand=-; Position=105-272
FIFKCQCYSRAVPSFTIEFAHFSFGLAGCWEVIWHSFPIRSHFLLQIHFKILIYP

SEQ ID NO: 164930 - protein, 208 aa, Heterodera glycines
  Coding regions on vcDNA: vcDNA=SeqID_91353; Strand=+; Position=1-624
SKNVVVLTADSSASNTGGGDGDGSAAVPPTISSGATSTGAIKNQIKKSRSAGGVGVGNKRVPPTTMTAPVAVSPPSSTFFTIEPPQQQSSTTTTAAQYQKHLHQHQARAVSATSCTSEESEESVPDSWEEGRAPLLRRSPRSPLADDDDEWAAPSADDRTAGHEGVAGGTAVADAAAAADAAASPKGRRRIPRERRKAGYAFLMLVFC

SEQ ID NO: 164931 - protein, 86 aa, Heterodera glycines
  Coding regions on vcDNA: vcDNA=SeqID_91354; Strand=+; Position=379-636
KISVSFFQFLRNLLPDEDGSVIPDNFFGEFTPRSPTFLSPRVRKVVWALSLEVLPFLLSHFLPHSASFWHQKYSKLNYYYYNKLFL

SEQ ID NO: 164932 - protein, 190 aa, Heterodera glycines
  Homolog annotation: Hit_ID=CAE72049.1; Match level="QueryCoverage =100%, HitCoverage=29%, E-value=2e-66, Identity=64%"; Hit description= Hypothetical protein CBG19133 [Caenorhabditis briggsae]
  Gene Ontology: Mol. function=gamma-glutamyl transferase activity; Cellular component=plasma membrane; Biological process =spermatogenesis
  Coding regions on vcDNA: vcDNA=SeqID_91355; Strand=+; Position=6-575
MCGPPAPSSFAVAQAIIGVMAHFYRDEKVNLDDPLVYHRLVEVQKFAYAQRTKLGDSVFVKNARLISRNMTKHAFSKWIASLIPEKAQPLQYYSLDLTGHVPDHGTSHVVAIDHEGNAISATSTINQLLGSKRVSPTLGIIWNDQMDDFSTPHMTNLFGIPPSPTNYIVPKKRAMASMSPMIVYNKNTEK

SEQ ID NO: 164933 - protein, 169 aa, Heterodera glycines
  misc_feature (113)..(113): Xaa can be any naturally occurring amino acid
  misc_feature (127)..(127): Xaa can be any naturally occurring amino acid
  Homolog annotation: Hit_ID=AAO85452.1; Match level="QueryCoverage =99%, HitCoverage=31%, E-value=1e-70, Identity=81%"; Hit description =putative gland protein G12H04 [Heterodera glycines]
  Coding regions on vcDNA: vcDNA=SeqID_91356; Strand=+; Position=127-633
MALSALLLLLPLLLNVQNIPDESVQSDVKAVDSAISSLEQWKDPRNSLASLDSQLTEPQRALAKMFWELETIEKEKPKAPPQFDLGLFLEALEAMVEMNEEAKEVKLRKDKLXRMGRRRESKRRERXKTKEEETVPEVRVNENGKVEVTNGAGGDGKMEVKRGKDENGN

SEQ ID NO: 164934 - protein, 219 aa, Heterodera glycines
  Homolog annotation: Hit_ID=NP_508324.1; Match level="QueryCoverage =94%, HitCoverage=7%, E-value=7e-18, Identity=27%"; Hit description =predicted CDS, peptidase family A16 and RNA-directed DNA polymerase and Integrase, catalytic domain and Zn
  Coding regions on vcDNA: vcDNA=SeqID_91357; Strand=-; Position=1-657
EDCARTAKDFKCAGTAATIITLLPADQVNSFVIRTQQDELLGTVRLRLPSITMVCVPKTESWLRSYTISTVAVKRCPSAGSCRDNNCSTMNSRVMVPELNELNHRPGHSMCMSSTSFWHNSCGLPSASCLFYRWAAVPTSTTVFEEFSCIEWDLQLSAWIEIETNNGKIETQRLILHPGVPEKWGNMTIAVIPTSLPPMPILSAYFISDGRAMAMGKPI

SEQ ID NO: 164935 - protein, 179 aa, Heterodera glycines
  misc_feature (95)..(95): Xaa can be any naturally occurring amino acid
  Homolog annotation: Hit_ID=CAE57390.1; Match level="QueryCoverage =98%, HitCoverage=27%, E-value=6e-31, Identity=39%"; Hit description =Hypothetical protein CBG00339 [Caenorhabditis briggsae]
  Coding regions on vcDNA: vcDNA=SeqID_91358; Strand=+; Position=3-538
SNGLNVIERSGDVMGSSLSPFHIVVWEQNNIWMGPRFADLVHTGAKFTPCIRRDDKIYEQITEERKTEAESTGCCVGLSGCFQTSECSVRKLANXIVSIFVQKQFATLLKWTNGTFPEMNYSRVVCGQDPRYCARPRSVHPYVWGLNISNWPICEKHSPSIPKSEKHMHCTVTGRPCCI

SEQ ID NO: 164936 - protein, 67 aa, Heterodera glycines
  Homolog annotation: Hit_ID=XP_453279.1; Match level="QueryCoverage =100%, HitCoverage=13%, E-value=1e-25, Identity=82%"; Hit description= unnamed protein product [Kluyveromyces lactis] emb|CAH00375.1| unnamed protein product [Kluyveromyces la
  Gene Ontology: Cellular component=cytosol; Biological process=sulfur amino acid metabolism
  Coding regions on vcDNA: vcDNA=SeqID_91359; Strand=+; Position=1-578
ETSLVSIMAVNNEIGVRQPLKEIGELCRKKNVHFHTDAAQAVGKVPLDVDELKIDLMSISGHKIYGP

SEQ ID NO: 164937 - protein, 126 aa, Heterodera glycines
  Coding regions on vcDNA: vcDNA=SeqID_91360; Strand=-; Position=3-380
SSSPSPSPPSLVVPFRPTVSHRQQRFVAVVGCGDGIGCAVRWRQPPLCRQGQSVQNGTIQINCRAQIFGGKPTATVEQTRPLRRAKCGDEIFDAISAAVRILHLRVQFAIECPFDVLVGGLAKCDQ

SEQ ID NO: 164938 - protein, 121 aa, Heterodera glycines
  Coding regions on vcDNA: vcDNA=SeqID_91361; Strand=+; Position=171-536
LVREIVAKKCGGAALSPFLKFMLGTYLPVTELLQSIVLNKVSFWVWHSVEFRLFILFPSQLNQRTVNDIDANWVGELRERIARVRSDPTRKSHLAMLRSLHSELYLLREDFITRNLGELIH

SEQ ID NO: 164939 - protein, 41 aa, Heterodera glycines
  Coding regions on vcDNA: vcDNA=SeqID_91362; Strand=-; Position=30-155
LFFPLISAISNPFSFDQLAQMFLLTSAIFPILCDQFAYILY

SEQ ID NO: 164940 - protein, 89 aa, Heterodera glycines; identical to SEQ ID NO: 136281
  misc_feature (51)..(51): Xaa can be any naturally occurring amino acid
  Homolog annotation: Hit_ID=NP_001004212.1; Match level="QueryCoverage= 96%, HitCoverage=20%, E-value=2e-16, Identity=50%"; Hit description =similar to N33 protein [Rattus norvegicus] gb|AAH79193.1| Similar to N33 protein [Rattus norvegicus]
  Gene Ontology: Cellular component=integral to membrane
  Coding regions on vcDNA: vcDNA=SeqID_91363; Strand=-; Position=350-619

SEQ ID NO: 164941 - protein, 116 aa, Heterodera glycines
  Coding regions on vcDNA: vcDNA=SeqID_91364; Strand=+; Position=216-563
VLAQRAIGHCFVGSVPSLLDRLLPPHDQVPPMLLFSSLLLVLLSALLSLLCCVQLCRRSKSSTHCTDVHELMAIAAEAGGPVVSDGRGGHCGGNRISGNPIYEPLLLSSLPQIPRH

SEQ ID NO: 164942 - protein, 175 aa, Heterodera glycines
  Homolog annotation: Hit_ID=NP_510834.2; Match level="QueryCoverage =61%, HitCoverage=18%, E-value=2e-26, Identity=58%"; Hit description =nuclear Hormone Receptor (nhr-1) [Caenorhabditis elegans]
  Gene Ontology: Mol. function=RNA polymerase II transcription factor activity; Cellular component=nucleus; Biological process=blood coagulation
  Coding regions on vcDNA: vcDNA=SeqID_91365; Strand=+; Position=135-659
MGDMGTSTEMLKPMAFCKGMAQQQTRRQIRAEVQQMTVFEVHLQQQTMTTATIIQNGTSHVMPCSSTAPFLNSVPLPALEMDINGGTAEYQQQQRHGGSNSSAENNGTGGGAKMQPRQRRKVPEGELCAVCSDRATGYHYGVASCNGCKTFFRATIVSEHSFVCQYSGNCDVTKN

SEQ ID NO: 164943 - protein, 68 aa, Heterodera glycines
  Coding regions on vcDNA: vcDNA=SeqID_91366; Strand=-; Position=414-620
QMHEMASSNANWSQSTALSTSAEIDEESIYKCVGYPHLNVVKDIFRALLDNSIEIAYKSKLKFCIFSV

SEQ ID NO: 164944 - protein, 105 aa, Heterodera glycines
  Coding regions on vcDNA: vcDNA=SeqID_91367; Strand=+; Position=266-583
RNGMTIRPKHTKTAKGSPSSKHLRRNEYKREKSSSTNFAPSSLAQSHLQIKGFFGVFFNNFFYFKSVGWPMIFRKTSTATAASHELVGIQRRSSKMVRISSFWEA

SEQ ID NO: 164945 - protein, 186 aa, Heterodera glycines
  Coding regions on vcDNA: vcDNA=SeqID_91368; Strand=+; Position=1-558
SSRFDGLVDTHFDGKSELKIWRPITIGKGRRVTSAAFMCGYKSVPFLSPDSPLKLFVKGKSEGFPLPDRLLSNKIRIKCLQIKHIDHSVIAFLHANKQIWDKRATNLRIFTFYSNTNIQPFMDVLVREILPIFAPTIQRLQLLDVDLLIKCHSAWPTILPDLTRLNSIDAHLILPSLGDDHLDAPT

SEQ ID NO: 164946 - protein, 112 aa, Heterodera glycines
  misc_feature (41)..(41): Xaa can be any naturally occurring amino acid
  Homolog annotation: Hit_ID=AAK54043.1; Match level="QueryCoverage =73%, HitCoverage=23%, E-value=1e-19, Identity=54%"; Hit description =G protein alpha subunit 3 [Strongyloides stercoralis]
  Gene Ontology: Biological process=oviposition
  Coding regions on vcDNA: vcDNA=SeqID_91369; Strand=+; Position=253-590
SILIICLIKFISLTISILHDHGFTDEEREKQKSAVYNNTVXAMATLLHGMQRLNIPFHNPRIENEAMIVMEVVNHGKESEPLSDELAHAIKTLWAGKGNKIVKKWIFCNDEI

SEQ ID NO: 164947 - protein, 178 aa, Heterodera glycines
  misc_feature (139)..(139): Xaa can be any naturally occurring amino acid
  Homolog annotation: Hit_ID=CAE66993.1; Match level="QueryCoverage =92%, HitCoverage=5%, E-value=3e-36, Identity=45%"; Hit description =Hypothetical protein CBG12391 [Caenorhabditis briggsae]
  Gene Ontology: Mol. function=intracellular transporter activity; Cellular component=intracellular; Biological process=Golgi to endosome transport
  Coding regions on vcDNA: vcDNA=SeqID_91370; Strand=+; Position=113-646
FLLLGLCCSKLIQIPHPPGANPVILPLKESEFMSEKKAKVKILGESNWSAEFPLDMAGSSGRVICKGIAKKKRAFEMTVDVQLGQSGLTKVVTILPFFLLQNDSKVDIEVREPHLTKWIVVPAESVIGFWPVEKKKHKXLVARYAKTKEESVQFPITEAFEGFCQIRNNLIGLYVIVS

SEQ ID NO: 164948 - protein, 103 aa, Heterodera glycines; identical to SEQ ID NO: 133313
  Homolog annotation: Hit_ID=NP_499343.2; Match level="QueryCoverage =85%, HitCoverage=31%, E-value=5e-15, Identity=46%"; Hit description =MtN3 and saliva related transmembrane protein family member (3L716) [Caenorhabditis elegans] emb|CAA21014
  Coding regions on vcDNA: vcDNA=SeqID_91371; Strand=+; Position=218-529

SEQ ID NO: 164949 - protein, 182 aa, Heterodera glycines
  Coding regions on vcDNA: vcDNA=SeqID_91372; Strand=+; Position=2-547
FLRLFPSSSSSTLSATNEQSQIAPSQPLLFSAYRNLGLLCYSNGEPNKLHLVIVASAGSPPTAKILENPPNSSQPIKTCVLFKRITTVVLSPKLPENAQFTNLLVNASGSRATLVGTRMIFVVELDTDFWHRPPFDGPDCVDHLRPEYYAKCDLLHVGLFVRNFHPPFVVSVGLSLSRIFWK

SEQ ID NO: 164950 - protein, 114 aa, Heterodera glycines
  Coding regions on vcDNA: vcDNA=SeqID_91373; Strand=-; Position=282-626
VISGTTTKKNEFSLSCQFGDLSKYNSQQNLNFPRKCHFEFPNPLPKFEFPLICHFMTNHNFPHLSLVTNQKFPIKKFPPSPRLSLFKSSKFSVKKVQDNLKPFNRFWFGSPPPN

SEQ ID NO: 164951 - protein, 121 aa, Heterodera glycines
  Homolog annotation: Hit_ID=AAO51834.1; Match level="QueryCoverage =87%, HitCoverage=28%, E-value=1e-26, Identity=51%"; Hit description =similar to Rickettsia conorii. Tryptophanyl-tRNA synthetase (EC 6.1.1.2) (Tryptophan--tRNA ligase) (TrpRS)
  Gene Ontology: Mol. function=tryptophan-tRNA ligase activity; Cellular component=soluble fraction; Biological process=tryptophanyl- tRNA aminoacylation
  Coding regions on vcDNA: vcDNA=SeqID_91374; Strand=+; Position=183-545
MFNLSVDSEKTLLVQQSRLPEHTELMWILGSTTTVTSLTSMSQFKDKFRGFPQGAAPLGLLAYPLLQAADVLTYRATHVPVGEDQTQHMELTRHLANKFNSRFHCNFFPVPEKVLFAKRFA

SEQ ID NO: 164952 - protein, 142 aa, Heterodera glycines
  Coding regions on vcDNA: vcDNA=SeqID_91375; Strand=+; Position=195-620
MEQQYWNGGQQTEFCTKMDTDKDMIKAIETKLIELVEHQKKEEIFIGVLKDRFGKDGQQREFYAKMNTEKDMIKAIETKIIALEEHKKNEEIFIGVLKDRFGKELLKAVHPDIRKNIVEKFSYPKQNYWDANASHNDLEVFG

SEQ ID NO: 164953 - protein, 75 aa, Heterodera glycines
  Coding regions on vcDNA: vcDNA=SeqID_91376; Strand=+; Position=347-574
LILMRGHKIINGKTMTQQNGKELKHYLNCIFSFQSLTNKLYCSDITSFRIENLRKNYLHKFFQCKNFCIFFSLVY

SEQ ID NO: 164954 - protein, 206 aa, Heterodera glycines
  Coding regions on vcDNA: vcDNA=SeqID_91377; Strand=+; Position=35-652
FSDCHMNPPPKRGKYSMIVDDDGETVGTSELLKEGWKQCDYVSNRARLRCQNVRKPENLKEYGFCEEHRGFIERIRKEGLRAKHCFDSSFNSCQNLHLTDDIDETLLPKHPADFPFVYESLYCDNRIDDNDNPLSRANVFTKREIAKQYVSALRRQDASIQQMRIIYQEKHRRTLHQIMELRGKSHLTKLNPNRDSQKIKRILAMR

SEQ ID NO: 164955 - protein, 187 aa, Heterodera glycines
  Homolog annotation: Hit_ID=AAC38987.1; Match level="QueryCoverage =100%, HitCoverage=64%, E-value=9e-71, Identity=46%"; Hit description= P-glycoprotein [Haemonchus contortus] pir||T31073 multidrug resistance p-glycoprotein - nematode (Haemonc
  Gene Ontology: Mol. function=ATP-binding cassette (ABC) transporter activity; Cellular component=integral to membrane; Biological process=transport
  Coding regions on vcDNA: vcDNA=SeqID_91378; Strand=+; Position=2-620
AFFDDERHSTGKLCTRFATDTPNVRYVFTRLMVVISSVVTLLGAIAIGFVNGWQLALILLAIIPLILASGYFEMQQQFGKKMRDTELLEDAGKVASEAVENIRTVQSLNKQLFFHRKYASLLSAPHSANMHQVHIYGFVFAFSQSLIFFMYALAFWVGSLFVLNGIMRPASVFRVFFAIAFCGQSVG

SEQ ID NO: 164956 - protein, 152 aa, Heterodera glycines
  Coding regions on vcDNA: vcDNA=SeqID_91379; Strand=-; Position=58-516
NELMHFLMEIVKLLYTFLFILFADASRHFQLFVEQKENILDPREQHKELMEVGENGIESAKPVTEVKLNYWYDEMGRGGGRQPQNQNQFEVFQRWRSNEIPAGTGGSAVFLNYDMNRNVALGPSFSPPALWPRCQCSNSAWECSSFLSIAFH

SEQ ID NO: 164957 - protein, 42 aa, Heterodera glycines
  Coding regions on vcDNA: vcDNA=SeqID_91380; Strand=-; Position=445-573
SGNGHCHASDGSVAAARLAQVGCEIIILMKIRITTDLSRFPS

SEQ ID NO: 164958 - protein, 184 aa, Heterodera glycines
  Homolog annotation: Hit_ID=NP_497062.1; Match level="QueryCoverage =100%, HitCoverage=56%, E-value=9e-68, Identity=53%"; Hit description= DEAD/DEAH box helicase and Sec63 domain and helicase, C-terminal (2P63) [Caenorhabditis elegans] emb|CAA
  Gene Ontology: Mol. function=ATP dependent RNA helicase activity; Cellular component=spliceosome complex; Biological process =regulation of translation
  Coding regions on vcDNA: vcDNA=SeqID_91381; Strand=+; Position=2-553
ILPSSIKPHTDLLDLDPLPLTALNNPPFQSLYNFEFFNPVQTQVFHTLYATDEYALIGAPTSSGKTLCAELAIFRLFNQKPGKKCVYIAPLKALVRERVLDWEDKFNRRLGYQIVEVSGDNTPEPHELNRASILITTPEKWDGITRCADTRHYVKQVELLVIDEIHLLGVERGAVLEAIITRIK

SEQ ID NO: 164959 - protein, 134 aa, Heterodera glycines
  Coding regions on vcDNA: vcDNA=SeqID_91382; Strand=+; Position=1-405
DFALFDRMTSFDQLMRGIRRRPNESVDELGNRISGLVRRAYPGLTEQQYDDYSIMHFIRAISNPELAITLEMTRRPGATFDEFIAQAARAEATHRLPEIRLGQIKLFNGKCRIRHIHPIMCHQTTIPVIGPDQK

SEQ ID NO: 164960 - protein, 177 aa, Heterodera glycines
  Homolog annotation: Hit_ID=NP_499949.2; Match level="QueryCoverage =87%, HitCoverage=12%, E-value=4e-44, Identity=54%"; Hit description =rac effector, Gut on EXterior GEX-2 (145.0 kD) (gex-2) [Caenorhabditis elegans] gb|AAB92078.6| Gut on ext
  Coding regions on vcDNA: vcDNA=SeqID_91383; Strand=+; Position=3-533
SLLLLLGQLLNMFLVLDALKDMKASIKNDLSTFRRASQFFTNDSNNLIWFVATQNKIKQSLRERIQKIEAHEELLADLIYISAHFHENRMFISPDQRHTHIKVIAFCLYLMDAEVYTRLDQKKRISIQKFDKIFNSIEVVPLFGDMNILPFSFVKQCRNTGQCAKGTGQQCKCYDPA

SEQ ID NO: 164961 - protein, 182 aa, Heterodera glycines
  Homolog annotation: Hit_ID=NP_497915.2; Match level="QueryCoverage =98%, HitCoverage=33%, E-value=2e-74, Identity=75%"; Hit description =chaperonin Containing TCP-1 (59.4 kD) (cct-5) [Caenorhabditis elegans] emb|CAA84660.1| Hypothetical prote
  Gene Ontology: Mol. function=chaperone activity; Cellular component =actin filament; Biological process=cell organization and biogenesis
  Coding regions on vcDNA: vcDNA=SeqID_91384; Strand=+; Position=11-556
MATAGQLLFDESGQPFIVIREQEKQKRLTGIQALKSHIIAAKHVANTLKTSLGPRGLDKMLVSSDGEVTITNDGATIMKNMDVEHHVAKLMVELSQSQDDEIGDGTTGVVVLAGALLEHAESLLDKGIHPTKIADGFELACKKAIEKVESIAQQFPIDDKKALVKSAKTSLGSKVVNQCLRQ

SEQ ID NO: 164962 - protein, 68 aa, Heterodera glycines
  misc_feature (15)..(15): Xaa can be any naturally occurring amino acid
  Homolog annotation: Hit_ID=AAS53559.1; Match level="QueryCoverage =98%, HitCoverage=8%, E-value=6e-11, Identity=53%"; Hit description =AFR188Wp [Ashbya gossypii ATCC 10895] ref|NP_985735.1| AFR188Wp [Eremothecium gossypii]
  Gene Ontology: Mol. function=helicase activity
  Coding regions on vcDNA: vcDNA=SeqID_91385; Strand=+; Position=2-205
AHRLQMLDASLRRAXRFHREIALEMPHPPSSMEILKIVTKRLKLDIHVYFAVLARLSPGYVGADLLAL

SEQ ID NO: 164963 - protein, 211 aa, Heterodera glycines
  misc_feature (86)..(86): Xaa can be any naturally occurring amino acid
  Homolog annotation: Hit_ID=NP_502737.1; Match level="QueryCoverage =98%, HitCoverage=64%, E-value=4e-47, Identity=34%"; Hit description =MEGF6 (4P83) [Caenorhabditis elegans] emb|CAB60454.1| Hypothetical protein Y64G10A.7 [Caenorhabditis eleg
  Gene Ontology: Mol. function=scavenger receptor activity; Cellular component=plasma membrane; Biological process=cell recognition
  Coding regions on vcDNA: vcDNA=SeqID_91386; Strand=-; Position=3-635
SLLDPFKLFSCHFFLSPFSCANLCDCQNGARCDPRSGECRCAPGFTGPHCTQMCRAGRFGQNCKEKCQCEDPTNCDPKTGQCKCGXAPKPKRRILLRLFYVNCLCIAIPRFPYSSGWIGPTCQQQCPQGKYGFNCSMECDCHGSAGCDPTSGCCHCPKGRYGFRCQFGTFHFGLLCPFPFEISLECPPGQFGLQCAESCHCQNGASCDPVT

SEQ ID NO: 164964 - protein, 93 aa, Heterodera glycines
  Homolog annotation: Hit_ID=NP_499701.1; Match level="QueryCoverage =82%, HitCoverage=19%, E-value=1e-23, Identity=64%"; Hit description =putative protein family member, with at least 3 transmembrane domains (45.1 kD) (3O86) [Caenorhabditis el
  Coding regions on vcDNA: vcDNA=SeqID_91387; Strand=+; Position=2-283
GHDPFHCLRCFSIAVAIWNILYCLLQFALLGWQVQVVKQWQWHWENRALFVMGAIDQYQARFPGLYAIYTETPERRRVNGEQKGKNIVNLMCH

SEQ ID NO: 164965 - protein, 142 aa, Heterodera glycines
  Homolog annotation: Hit_ID=NP_491198.1; Match level="QueryCoverage =99%, HitCoverage=82%, E-value=4e-24, Identity=43%"; Hit description =ferritin (19.5 kD) (ftn-2) [Caenorhabditis elegans] gb|AAK21364.1| Ferritin protein 2 [Caenorhabditis ele
  Gene Ontology: Mol. function=iron ion binding; Cellular component =ferritin complex; Biological process=iron ion homeostasis
  Coding regions on vcDNA: vcDNA=SeqID_91388; Strand=+; Position=2-427
YTGYIDMNMSFNFYQEGVALHKIAKRVQKRSDEDHVPGTTFMRDLISPGGRPVAYNVHNPDNDKWGRALEAFQAVLALEKFNNESQLELHNLATQQGDSQKGDSLEDTYLRGDGQLIEDIGSIVTYLGGVGYGSGESLSDKN

SEQ ID NO: 164966 - protein, 205 aa, Heterodera glycines
  Homolog annotation: Hit_ID=NP_957220.1; Match level="QueryCoverage =100%, HitCoverage=32%, E-value=2e-65, Identity=57%"; Hit description= similar to excision repair cross-complementing rodent repair deficiency, complementation group 2 [Danio
  Gene Ontology: Mol. function=ATP dependent DNA helicase activity; Cellular component=nucleus; Biological process=post-embryonic development
  Coding regions on vcDNA: vcDNA=SeqID_91389; Strand=+; Position=6-620
MRLHIDGLSVLFPYEYVYPEQLLYMEQLKKVLDAPGHCLLEMPSGTGKTVSLLALVVAYMRKYPERLHKLIYCSFFIPEIEKCVEELKRLFRYYTNVTGSAPDFLALTLSARKNLCINKSVVSFRYGSAVDGACQRLTASYVRAKRRLNPNLPCCSFFEKFDEKRDMTLPKGVYNLSDLRGWGKEHGMCPYFVARHLVNRADIIV

SEQ ID NO: 164967 - protein, 132 aa, Heterodera glycines
  Coding regions on vcDNA: vcDNA=SeqID_91390; Strand=-; Position=2-397
VSFVEFTQALRLGEVIGLFLALQKTDYHPKNLVMKLGVQMSLVQLVQGVHKNCRCTPAVLRNRVISSLNHVSCSRVQGGAKKQSVLFELQVSIENAVVEVLNDRWGFSARKLDIFVSVKSLWYDPVAIQSVM

SEQ ID NO: 164968 - protein, 165 aa, Heterodera glycines
  Homolog annotation: Hit_ID=XP_346518.1; Match level="QueryCoverage =49%, HitCoverage=5%, E-value=9e-09, Identity=39%"; Hit description =hypothetical protein XP_346517 [Rattus norvegicus]
  Coding regions on vcDNA: vcDNA=SeqID_91391; Strand=+; Position=102-596
MAAAASSDDNNTSLDTESITTTPPRTPRRGKQQQFNLSPATPPAKNISSNSTNGSGGGTPVPRSALRRRGSRTSPRLAPVVEKGDNEEDIAEEEEEKQQQTNEEVEQQQNTVEQTDNETKMVDEADKATTEAQKEKESEEAGGSEQKQEDEEKMELDNDNAGPDG

SEQ ID NO: 164969 - protein, 167 aa, Heterodera glycines
  misc_feature (69)..(69): Xaa can be any naturally occurring amino acid
  Homolog annotation: Hit_ID=EAL38940.1; Match level="QueryCoverage =74%, HitCoverage=45%, E-value=5e-15, Identity=36%"; Hit description =ENSANGP00000026469 [Anopheles gambiae str. PEST]
  Coding regions on vcDNA: vcDNA=SeqID_91392; Strand=+; Position=2-505
LDYAFICRKGFTALNAMGVCDHQKRFIAFFCNYPGSCHDSYVLRYFITVDKKHCLKFQSSSQFFSRMYXGGLDGIILGDSAYPQKNWLFTPVRFPRNQKEEAYNAAHAVTRVTIEQCFGIYKNRWRCLMNKCRLQPGINLFFAFFTFKLRKIGKSSNSLQYASQHCH

SEQ ID NO: 164970 - protein, 170 aa, Heterodera glycines
  Homolog annotation: Hit_ID=CAE60358.1; Match level="QueryCoverage =95%, HitCoverage=94%, E-value=2e-67, Identity=74%"; Hit description =Hypothetical protein CBG03955 [Caenorhabditis briggsae]
  Gene Ontology: Mol. function=calcium channel regulator activity; Cellular component=cytoplasm; Biological process=regulation of action potential
  Coding regions on vcDNA: vcDNA=SeqID_91393; Strand=+; Position=34-546
MQAPQPLPNLHQIFQAVDRDRSGQISADELQRALSNGTWQPFNPETCRMMISMFDNNNDGGISFAEFQSLWNYINDWTRVFRTFDRDNSGNIDKTELTNALTQFGYRLSGPFYDMLMRKFDRTHTGHINFDDFIQLCVVLQTLTAAFREKDTDLDGWIRIRNMPFLPIIF

SEQ ID NO: 164971 - protein, 199 aa, Heterodera glycines
  Homolog annotation: Hit_ID=CAE65113.1; Match level="QueryCoverage =97%, HitCoverage=24%, E-value=6e-39, Identity=42%"; Hit description =Hypothetical protein CBG09978 [Caenorhabditis briggsae]
  Coding regions on vcDNA: vcDNA=SeqID_91394; Strand=+; Position=3-599
PVYSSKVRSFLAQVDDSEMLRPDFDLTTYINTIFPTEQSLVHLDSFVKKIDEEIANYDRELSEAVAEHGRCALEANNALLQAQTTITELEQKVQEIRDRTLCSENSVHELTKDIRQLDVAKKNLTESIATLHHLQLLLNGVNLLTQWVTERRYNEITTELPAVLNVLLLFEDYQHIEHVKQLTDKVQKIREQLTVQLAA

SEQ ID NO: 164972 - protein, 205 aa, Heterodera glycines
  Homolog annotation: Hit_ID=CAE59919.1; Match level="QueryCoverage =88%, HitCoverage=27%, E-value=5e-70, Identity=66%"; Hit description =Hypothetical protein CBG03405 [Caenorhabditis briggsae]
  Gene Ontology: Mol. function=adenylylsulfate kinase activity; Cellular component=cell; Biological process=nucleotide metabolism
  Coding regions on vcDNA: vcDNA=SeqID_91395; Strand=+; Position=10-624
MRRLGDIDDSESVLLLLNSPRKRSRFPAIASGATNVTFQQHKVTREERANALGRFPGFRGCTLWFTGLSGAGKTTIAFALEKALVQLGVPAYALDGDNIRHGLCKNLGFSAEERAENIRRVAEVAKLFSDLGMVVLASFISPFRAGREEARRIHSKENIPFFEIFVDTPIEVCEARDPKKLYKKARAGKIRGFTGVDSDYEVPLQ

SEQ ID NO: 164973 - protein, 210 aa, Heterodera glycines
  Homolog annotation: Hit_ID=AAH63256.1; Match level="QueryCoverage =94%, HitCoverage=42%, E-value=2e-50, Identity=53%"; Hit description =Unknown (protein for MGC:66809) [Mus musculus]
  Coding regions on vcDNA: vcDNA=SeqID_91396; Strand=+; Position=1-630
QTVGEMSCNPSFGGIGKGHLMREIDALDGVCPRICDQTGTHFHALNRSHGPAVIGLRALIDRKLYKKAMQAEIFHNTPNLDVLEAAVEDLLLLESTSPVASTSPSASAVPGDDGTEMATHCVKGCALANGRLIIAPTVVITTGTFLNAELVWGAQRKPGGRMGEATSSGLAGTFRRVGFRTGRLSTGTPPRLLASTIDFARFTTQPSDAV

SEQ ID NO: 164974 - protein, 79 aa, Heterodera glycines
  Coding regions on vcDNA: vcDNA=SeqID_91397; Strand=-; Position=91-330
QHLFWLKTKHFYCCSKYTTIWRNQQRTCSTSSGEKKHQILFSGQSKKPRRQNKFTEKPGLAVNCFEAESAHSKSSQRNC

SEQ ID NO: 164975 - protein, 187 aa, Heterodera glycines
  Homolog annotation: Hit_ID=EAL46915.1; Match level="QueryCoverage =85%, HitCoverage=31%, E-value=7e-12, Identity=27%"; Hit description =conserved hypothetical protein [Entamoeba histolytica HM-1:IMSS]
  Gene Ontology: Biological process=N-linked glycosylation
  Coding regions on vcDNA: vcDNA=SeqID_91398; Strand=+; Position=65-625
MDPRHFWVQSLQHELELELNGTISYLDEASRLATEGNRTLNEIRIRLEKRDEFRRASNELDRRRRMDHLEVHKRWKQKFGELEKEMNERMASIEMEFHRRIEQLEEERKTQDAQVEREWHQKKAALESTDWLTANSQRNESDGNGQMEDIERRREEKKEQTNNEEKVEEKEKEEKKEQKSEEKVEEE

SEQ ID NO: 164976 - protein, 114 aa, Heterodera glycines
  Homolog annotation: Hit_ID=NP_490837.1; Match level="QueryCoverage =52%, HitCoverage=9%, E-value=1e-10, Identity=58%"; Hit description =predicted CDS, protein grainy-head (1B734) [Caenorhabditis elegans]
  Coding regions on vcDNA: vcDNA=SeqID_91399; Strand=+; Position=196-540
MALARRKIGISTPVQARNKDGICQSREWVGAQIFPFQSNQISLYSHFSATNSPIPFQSHHRESQHREQSLPIVIPKLENPLGFQYALEAPISTSILKEDDRMTYVNKASDLLRR

SEQ ID NO: 164977 - protein, 188 aa, Heterodera glycines
  Homolog annotation: Hit_ID=CAE62553.1; Match level="QueryCoverage =99%, HitCoverage=42%, E-value=1e-48, Identity=50%"; Hit description =Hypothetical protein CBG06663 [Caenorhabditis briggsae]
  Coding regions on vcDNA: vcDNA=SeqID_91400; Strand=+; Position=1-564
TGQARLLSFFESIGWKVYTVPETASFFLGPGRIRFPDLSSEQAAQFQTDLLKALIQNEDVFFNQAEFSEAEKIMIILDRGAMDGSAYIDMESWSDVLSACKVTNEQLRERYHQICHLVTAADGAQSFYQLANNQARTESMDEAIQLDKKTKEAWVGHEYLSIVDNSSGSFDEKISKLIADVCERFGIS

SEQ ID NO: 164978 - protein, 194 aa, Heterodera glycines
  Coding regions on vcDNA: vcDNA=SeqID_91401; Strand=+; Position=26-607
QFNSHSENIKFTFFPNCSINNFRCFGEGNLTIGTPIYCREHDCFKNNSFKQKYGTKFCFYEPYEKIYLVKSDEELIQIKAWGTTEKIFYLPNNLNQSFIENRRNKREENSSINEEATIECLKGGIIIKAINDIQELQISIENYTIIKKNPQKEEIIYLPPKLTSFEYKPVIKFISNPDKSNEKQITCQSSPVCE

SEQ ID NO: 164979 - protein, 179 aa, Heterodera glycines
  Homolog annotation: Hit_ID=NP_496416.1; Match level="QueryCoverage =72%, HitCoverage=26%, E-value=1e-14, Identity=34%"; Hit description =putative protein, with at least 5 transmembrane domains, of bilaterial origin (66.3 kD) (2L595) [Caenorha
  Coding regions on vcDNA: vcDNA=SeqID_91402; Strand=+; Position=3-539
FREDGDYNCCISSQFYAPEQPKRYCTTTSPDLLNSSRGHVNGLCERCNKNQQIIVERLNKFEAIDEENYFDELETYKYRLNKAYPLCRRCETYTAKKLLDVQAKFSTPKRSVKSTKTFSTKTFSIGGKTASIVGSVKRSISGSIFGDEHVSHVSSTKLKQHNHTGKRLFASGFYTNCVN

SEQ ID NO: 164980 - protein, 157 aa, Heterodera glycines; identical to SEQ ID NO: 130811
  Coding regions on vcDNA: vcDNA=SeqID_91403; Strand=-; Position=3-473

SEQ ID NO: 164981 - protein, 155 aa, Heterodera glycines
  Coding regions on vcDNA: vcDNA=SeqID_91404; Strand=-; Position=16-483
NVFGGATDGNTYSRRTTSLLLLLTILMGVSMQKPTIPQKIIEKARRIKMGKKVVITPYFPKPKSCDGPGTRTEFQTKFLFFNRTLGLLHHFPKFIQDPETRAVGKAVKRILVFEKVRKKYKYRLYCSGSICVSAFHSFDHSLFSIEFTFSSIFNT

SEQ ID NO: 164982 - protein, 72 aa, Heterodera glycines
  Coding regions on vcDNA: vcDNA=SeqID_91405; Strand=+; Position=134-352
RQFQTLETKFADELATQERFYGADGGTTAAAALMSSSTSTSSSSNGGGGICPPAVPQHQQFSLSGGSHQRHF

SEQ ID NO: 164983 - protein, 216 aa, Heterodera glycines
  Coding regions on vcDNA: vcDNA=SeqID_91406; Strand=-; Position=0-647
DRQDGERANAAQQTKTKKGMDAQGLGTSQTGVTPAASKNLRSGAITVRSARDRIERAAETLSSRIAEARELMDSDFTRGEAPEHAARLMAMERGLGQVTRIFEGHFDKGIAEAGAAPEERQDFLYDFVAAPLPASTKYLQLREHPTPAELLQIAAEHLGDLQAMRQTFEDEEREQSISRSSRSVDTEDSHLSKELPRTMARRSMPEWETSFRDALA

SEQ ID NO: 164984 - protein, 105 aa, Heterodera glycines
  Coding regions on vcDNA: vcDNA=SeqID_91407; Strand=-; Position=250-567
LKNPTKSGTYSPNRANAGFSTQNNILNSQSVSSGSFFILEPIFFAKFKHLIMTTYFRLARVGRAHRQLAAPAMVPAVPLMAHPRWMSVTLLAVVLTELAAESLTH

SEQ ID NO: 164985 - protein, 148 aa, Heterodera glycines
  misc_feature (140)..(140): Xaa can be any naturally occurring amino acid
  Homolog annotation: Hit_ID=CAE56800.1; Match level="QueryCoverage =100%, HitCoverage=42%, E-value=1e-47, Identity=63%"; Hit description= Hypothetical protein CBG24612 [Caenorhabditis briggsae]
  Gene Ontology: Cellular component=membrane; Biological process =intracellular protein transport
  Coding regions on vcDNA: vcDNA=SeqID_91408; Strand=+; Position=2-445
TAAAKLNRFFRRLVHVRQIYFEFAAWQMLYLLVNPQKVYRNFMYRKKAKDQWARDDPDFLLLLALSLLGSSVLFALPLNLSFSSFCAFFLWVVFIDCIRIGIANATALWFNSNHFLRRTTDCDVIERAYCFHVDLNVFFXLLILLHVI

SEQ ID NO: 164986 - protein, 207 aa, Heterodera glycines
  Homolog annotation: Hit_ID=NP_510044.1; Match level="QueryCoverage =95%, HitCoverage=30%, E-value=1e-27, Identity=28%"; Hit description =tissue factor pathway inhibitor family member (XM883) [Caenorhabditis elegans] emb|CAA93531.1| Hypothetic
  Coding regions on vcDNA: vcDNA=SeqID_91409; Strand=+; Position=3-623
IGGVPKVISKCLKDGSLPFFALGSRVPQQCATERDDECPEEYECSLATDDNYYCCPAWDRCPPGASPFLVEGSRKLLGCNWMANNCPDGYTCEGSKDRAICCRTRASQLQCPHERAPYLYGKRPLACPKGSKRSCPSGYECTASKNGPNQHLCCSVVDHHLPECVSGFAFVDPMNGKNRICDPSSESCPVGYRCKRSTLANTHVCCS

SEQ ID NO: 164987 - protein, 146 aa, Heterodera glycines
  Homolog annotation: Hit_ID=CAE59483.1; Match level="QueryCoverage =97%, HitCoverage=10%, E-value=1e-23, Identity=41%"; Hit description =Hypothetical protein CBG02868 [Caenorhabditis briggsae]
  Gene Ontology: Mol. function=phosphatidylinositol 3-kinase activity; Cellular component=1-phosphatidylinositol 3-kinase complex; Biological process=aging
  Coding regions on vcDNA: vcDNA=SeqID_91410; Strand=-; Position=2-646
ACELLDGRYVDAKLRAMAVHHLDNALNDDQLQLYLLILVQAIRFEPHAFSPLVRLLLMRALMDYRVGHTLFWLLRAELAHLLAVDQSKTTLFSRYALLLEAYCRGNSVHLHSMIKQVEMVSTLTALSSLVRACGNKEMGTKVNKMK

SEQ ID NO: 164988 - protein, 166 aa, Heterodera glycines
  misc_feature (42)..(42): Xaa can be any naturally occurring amino acid
  Homolog annotation: Hit_ID=NP_356175.1; Match level="QueryCoverage =99%, HitCoverage=33%, E-value=8e-56, Identity=63%"; Hit description =hypothetical protein AGR_L_776 [Agrobacterium tumefaciens str. C58] gb|AAK88960.1| AGR_L_776p [Agrobacter
  Coding regions on vcDNA: vcDNA=SeqID_91411; Strand=+; Position=104-601
MFLGIDLGTSAVKVLLISADQSVVGSASVPLKVSRPFDGWFXQCPSDWHRATREVIDQLRHSNPKAFCALRGIGLSCQMHGAVLLDAAGVTLRPCILWNDMLSHREADELNADARFRSITGNAVFPGFTAPKLAWVRPNEPEIFAKIAKVLLPNDYLRFWLTGAYF

SEQ ID NO: 164989 - protein, 133 aa, Heterodera glycines
  Homolog annotation: Hit_ID=NP_872153.1; Match level="QueryCoverage =100%, HitCoverage=47%, E-value=1e-46, Identity=69%"; Hit description= lactate/malate dehydrogenase and Lactate/malate dehydrogenase precursor (29.1 kD) (5G996) [Caenorhabditi
  Gene Ontology: Mol. function=malic enzyme activity; Cellular component=cytosol
  Coding regions on vcDNA: vcDNA=SeqID_91412; Strand=+; Position=2-400
EAAFKDIDYSFLVGAMPHKEWMERKDLLAANVRIVKSHGEALARFSKPTVKVLVVGNPANTNALICAKYTASKIPAKNFSGMTRRDHDRAMAQVAHKCAYGTTVGMVNNVIIWGHHSSTQFPDIPHATIADGG

SEQ ID NO: 164990 - protein, 91 aa, Heterodera glycines
  Coding regions on vcDNA: vcDNA=SeqID_91413; Strand=+; Position=90-365
ELGKMLGLGWESNPLVHPFHGQALPLSYRGTSALSFMDYQARFPRFNRPASFFFQSYRMILRMFNLDASRRSFEALKLSFYFVVMFIFMIV

SEQ ID NO: 164991 - protein, 95 aa, Heterodera glycines
  Coding regions on vcDNA: vcDNA=SeqID_91414; Strand=+; Position=244-528
KSAENCLNNLLQQNVRQPKRSRIKNGKSNVKLKCQFSISILNFIFLFFSFISGDGWLCVFDLLEPSQLGLGIALVSNRFDCYVDEHFKTRRWALK

SEQ ID NO: 164992 - protein, 198 aa, Heterodera glycines
  Coding regions on vcDNA: vcDNA=SeqID_91415; Strand=+; Position=2-595
NIRQQIFHPIPLNAHRINQVSVNAQRNIDVQYVPNNCVNAPPNVQRHCDIQYTAPNPVAAPSNAQQIYFGSRLIQNIPMQAQLWQGPDGKMILVYPQDQQQQVLIEQPNLAQNHQKFTRQVFQIPETNQEPRHFPTYPQPNVAPSNLEFNLILERIPDLNGNEGTDSVRRFFKKFDAYTDGWPNAKRISALESKVYNK

SEQ ID NO: 164993 - protein, 162 aa, Heterodera glycines
  Coding regions on vcDNA: vcDNA=SeqID_91416; Strand=+; Position=42-530
MNRSEYYQKFLEKMWFEFWHKSASFNHTAHFFRVGRELGVPFTEMDDIVMRIEERTNKEDFSMRHMQLLFDDRIVAVPWLRIDSVPGHQKLFAFTEILRLEMLDEMIAQPCYNPLNHNVDNPLYFPPDYEESEEMEEGAEDENIAKIERRWIKRKKRMAITH

SEQ ID NO: 164994 - protein, 133 aa, Heterodera glycines
  Homolog annotation: Hit_ID=NP_499756.1; Match level="QueryCoverage =71%, HitCoverage=47%, E-value=3e-12, Identity=38%"; Hit description =polyposis locus protein 1 family member (3O468) [Caenorhabditis elegans]
  Coding regions on vcDNA: vcDNA=SeqID_91417; Strand=+; Position=13-414
MHVIYFDDLLPRAPMWLIQLPFYITSFLVLLVFMLCPGNMFLYTLIAVAYPMYASLLTLNTQNTSEYTQWLVYWCVFAVLGQLDFLFGSINGLLLLYVPLKTVFLLSLAFPQIYGAHNIYVKPDVLDKMKKML

SEQ ID NO: 164995 - protein, 77 aa, Heterodera glycines
  misc_feature (36)..(36): Xaa can be any naturally occurring amino acid
  Homolog annotation: Hit_ID=AAA28932.1; Match level="QueryCoverage =100%, HitCoverage=19%, E-value=2e-13, Identity=48%"; Hit description= potential zinc-finger domains centered at aa 135 and aa 364; 43 kDa protein; putative
  Coding regions on vcDNA: vcDNA=SeqID_91418; Strand=+; Position=2-232
IKRRFSPEAVDTIFQTDETGTIDWIPMLIRVQCWRXLVFELAEQFPHCLMLTFAITLISDACFPHNSSNVNTAAQQL

SEQ ID NO: 164996 - protein, 217 aa, Heterodera glycines
  Coding regions on vcDNA: vcDNA=SeqID_91419; Strand=+; Position=1-651
QLPTNVWCTPSAIGRMATILRQMHAVVSEEMGRELMGRQRLMDHLCLVHGYFFMLRGDFASALEHILFIKTAKTTATKKCATPFSSRKNVSHSTKIAEKCVNDALAMCSPPANVANLMHLLCGVKLTKREQMKCKIFSEKFMLKSRLREGQRNEFQAVAEFFSTNALRAYKRVFGFVSNLQLQRAQLDYTGQNLLRVVRQRLATRSEYRSSFYSMLI

SEQ ID NO: 164997 - protein, 66 aa, Heterodera glycines
  Coding regions on vcDNA: vcDNA=SeqID_91420; Strand=+; Position=2-202
FSSPFVSLIRPLICGIKLYTTKMVICLVHFCEWPPPRCVVNSSSFSASSHHIFNYNYHNRFFLSHS

SEQ ID NO: 164998 - protein, 199 aa, Heterodera glycines
  misc_feature (179)..(179): Xaa can be any naturally occurring amino acid
  Homolog annotation: Hit_ID=NP_998184.1; Match level="QueryCoverage =100%, HitCoverage=92%, E-value=1e-70, Identity=66%"; Hit description= zgc:73214 [Danio rerio] gb|AAH71458.1| Zgc:73214 [Danio rerio] gb|AAH59560.1| Zgc:73214 protein [Danio r
  Gene Ontology: Mol. function=cyclosporin A binding; Cellular component=cytoplasm; Biological process=signal transduction
  Coding regions on vcDNA: vcDNA=SeqID_91421; Strand=+; Position=1-596
VLLLNFAFIFFAFLSSIYAEEEDPKVTHKAFFDISIGGVKKGRIVIGLFGEVVPKTAKNFLELAKGTHGYGYKDSKFHRVIRNFMIQGGDFTRGDGTGGKSIFEGKSFEDENFKLHHYGAGWLSMANAGPDTNGSQFFITTVHTPWLDGRHVVFGKVLEGMNIVREIEDGETAGGDRPXKDVVIVDSGELTVSEPFKVA

SEQ ID NO: 164999 - protein, 126 aa, Heterodera glycines
  misc_feature (35)..(35): Xaa can be any naturally occurring amino acid
  Homolog annotation: Hit_ID=CAE69821.1; Match level="QueryCoverage =100%, HitCoverage=40%, E-value=2e-14, Identity=31%"; Hit description= Hypothetical protein CBG16139 [Caenorhabditis briggsae]
  Coding regions on vcDNA: vcDNA=SeqID_91422; Strand=+; Position=2-379
IENIGVVGTGLTGSGIVQIGVESAVQTCLMGRTQXKCDQTRLNINTGVQKLIHKRMANDTAEAQQQVGPATMESLELANNLDEVDLPDADIDIEALVEHLKVKQKMLTELEANVSENCLLGTNTST

SEQ ID NO: 165000 - protein, 163 aa, Heterodera glycines
  misc_feature (104)..(104): Xaa can be any naturally occurring amino acid
  Homolog annotation: Hit_ID=CAE69837.1; Match level="QueryCoverage =96%, HitCoverage=93%, E-value=3e-22, Identity=38%"; Hit description =Hypothetical protein CBG16161 [Caenorhabditis briggsae]
  Coding regions on vcDNA: vcDNA=SeqID_91423; Strand=+; Position=25-516
MNFSPITLFLLSSLAIFYAAVAFRQQTVAVRGRLMCGDKPLTDTKVKLWNKNKIGRDDQLADVKTDAQGNFALDGGVGSIFGMNVHLKSWALHFCKCEIRANPXHFLPVYHDCDRGILPCQRKVNLGIPGEYVTRTSTVQRWLDAGTMNMQLKFHDESTSCIN

SEQ ID NO: 165001 - protein, 210 aa, Heterodera glycines
  Coding regions on vcDNA: vcDNA=SeqID_91424; Strand=+; Position=1-630
IVCCLNMNRRRKFAPVPNMVAAQQQQPQQPIKTERAPEPTGGETVPPELDQQLQALQAVTNVGGTSGSGQQVGAVSTAAQPQKQGPSSASSAPTAAAGPLIGAVPFKTAALALATSAASVLPPVASLLNRSPPSSPPLQLFAETDPMLCGGGGVRQHLYIDRHLQPRAYTPEALAALDNAVLTAAGHQRDAAAVVAQHQQLLQGQGQLGA

SEQ ID NO: 165002 - protein, 82 aa, Heterodera glycines
  misc_feature (7)..(7): Xaa can be any naturally occurring amino acid
  Coding regions on vcDNA: vcDNA=SeqID_91425; Strand=-; Position=287-535
QSEWPIXHSFFVSEFFDPSQTTVLFLGPVGDQKVSDYGEEEHPPVGQLLFDRLNKRIKEKALPYFLFNRSNANVIPTVSLKQ

SEQ ID NO: 165003 - protein, 206 aa, Heterodera glycines
  Homolog annotation: Hit_ID=NP_496426.1; Match level="QueryCoverage =98%, HitCoverage=42%, E-value=3e-36, Identity=42%"; Hit description =phosphatidylinositol glycan class M (2L639) [Caenorhabditis elegans] emb|CAA90090.1| Hypothetical protein
  Gene Ontology: Cellular component=membrane; Biological process=signal transduction
  Coding regions on vcDNA: vcDNA=SeqID_91426; Strand=+; Position=3-620
PIKVNFTDIDYEVFTEAALLAREGHSPYEQPEYRYTPLIAWLLVPNGQFADFGKLVFCAIDVLVAFLHLLILESRQQNQRNPSSQNEGKTIHSSSVVFRHFGVLFWLFNPFTAIISARGNCDAIICALVLLALFLLIRVWQRKNDGITATFLRLALAAVVHGAGATHFRIFPLIYLPSIFLSFAHSSQNHQRRLTKCNDFKSFIWM

SEQ ID NO: 165004 - protein, 199 aa, Heterodera glycines
  Homolog annotation: Hit_ID=NP_001007983.1; Match level="QueryCoverage= 98%, HitCoverage=44%, E-value=3e-26, Identity=38%"; Hit description =similar to S-phase kinase-associated protein 2 isoform 1; CDK2/cyclin A-associated protein p45 [Gallus
  Gene Ontology: Biological process=G1/S transition of mitotic cell cycle
  Coding regions on vcDNA: vcDNA=SeqID_91427; Strand=+; Position=37-633
MTTAQLTHLDLSQAKFGSSDTLLRLLIRCESLQALSLESCELLDEECCRAIANNSALRHLDLVYAKRLTAAGVEVILRACQKLVELNLSWAEVDVDAMLAVCRLMPSGVRRLNLSGFRQLSSLNDRSVAQLCEVCPHLVELDLSDNALLTENCLDSICNRLKYLRRLTLSRCYGIEPMAFLQLNTLDELNIFGCITNDG

SEQ ID NO: 165005 - protein, 112 aa, Heterodera glycines
  Coding regions on vcDNA: vcDNA=SeqID_91428; Strand=-; Position=235-573
IKKHRDYYEKGTKFVADFGEWAGGNKQKKGNKNVPKHKLMINQINRSSSLSGSANDDWEEREKSHQVSSVGTEEGGNGAVVDEGGEEQIAKCCGQTTTDDEDEERRNERRQS

SEQ ID NO: 165006 - protein, 81 aa, Heterodera glycines
  Coding regions on vcDNA: vcDNA=SeqID_91429; Strand=+; Position=245-487
FFYYELSFPFPLFLLWNYIGLSLPIFIFLTNSSSVINLFLIQLIVHVFPCVHLRFCLGSSLLTDFLSFFPSFSSFLFEHLS

SEQ ID NO: 165007 - protein, 69 aa, Heterodera glycines
  Homolog annotation: Hit_ID=CAB88203.1; Match level="QueryCoverage =100%, HitCoverage=23%, E-value=2e-17, Identity=63%"; Hit description= putative cuticular collagen [Globodera pallida]
  Coding regions on vcDNA: vcDNA=SeqID_91430; Strand=+; Position=2-208
VLWIASACSLLPIIATVATLPSLYSEMSNMNSKVCDVLDAFLVNTDSAWTDLMDAQAAADAPAQLRREP

SEQ ID NO: 165008 - protein, 213 aa, Heterodera glycines
  Homolog annotation: Hit_ID=AAG23991.1; Match level="QueryCoverage =98%, HitCoverage=39%, E-value=7e-50, Identity=50%"; Hit description =Hypothetical protein C50H11.1 [Caenorhabditis elegans] ref|NP _503845.1| AMP-dependent synthetase and ligas
  Coding regions on vcDNA: vcDNA=SeqID_91431; Strand=+; Position=3-641
KFETMTGMRILERYGMTETLVSTSNPYEPINARTSGSVGQPVKGVQARINVDGVIEVKSPSLFNGYLNLPEKTKQEFTADGFFITGDMGEIDQNGFVWIKGRQKDLIITGGLNVYPPEVEDVVTNIFGEKLKECAIIGVPHPDFGEAVVAVCEPSDAFAEKLSGVAHQLTDDEKSAFRQTLAPYKIPKAVQYMPLPRNHLGKVQKNVLRAMPE

SEQ ID NO: 165009 - protein, 195 aa, Heterodera glycines
  Homolog annotation: Hit_ID=CAE59001.1; Match level="QueryCoverage =95%, HitCoverage=19%, E-value=4e-50, Identity=52%"; Hit description =Hypothetical protein CBG02276 [Caenorhabditis briggsae]
  Gene Ontology: Mol. function=alpha-glucosidase activity; Cellular component=lysosome; Biological process=glycogen catabolism
  Coding regions on vcDNA: vcDNA=SeqID_91432; Strand=+; Position=3-590
KSVATATRVANLFRYRHLPYLYSLHFRASLYGGTVIRPLFFEFPSDTNTHTLNFQFMWGPAMVIVPVVNPNVDSVHGYLPVNETWYSMSEAHEYSARIMPGFSTFKAPRDTPLPTFLRGGHIIPRQEPDLTTTASRKKPFQLLIGLKPLACPCKLVAAGEMFWDDGETIVDDFGNHSYYRFEFSTTRTAHWTPLL

SEQ ID NO: 165010 - protein, 127 aa, Heterodera glycines
  Homolog annotation: Hit_ID=NP_501211.1; Match level="QueryCoverage =90%, HitCoverage=39%, E-value=1e-25, Identity=50%"; Hit description =voltage-dependent anion channel 2 (30.0 kD) (4I272) [Caenorhabditis elegans] gb|AAB00622.2| Hypothetical
  Gene Ontology: Mol. function=voltage-dependent anion channel porin activity; Cellular component=mitochondrial outer membrane; Biological process=apoptotic program
  Coding regions on vcDNA: vcDNA=SeqID_91433; Strand=+; Position=3-386
ISIGRKTAEYSLHSHTTDGTDFGASLYHRVHQNLEYGVQMGWKMGDAMASWAIATKYNMSPELTLRAKMDHNSLVSVSAVHNLNGTLKLTLSSHFAMAAFPDAQNKFGFGLEYCPGGTCCAKDKEDA

SEQ ID NO: 165011 - protein, 194 aa, Heterodera glycines
  Coding regions on vcDNA: vcDNA=SeqID_91434; Strand=+; Position=3-584
DLLTKQLTAVEECKSVTATYKPIRVSDMPIQLCEHGRVMPGPFIRGEIKAVNTSAARRLIREFNVNTTLYTGANICVNCCSRLRDHQETRRRGRTEAILYYPEGATLFIKLNGDENDGNTTKGKKTTTGPSAAVTRRAASKGLIKIRICSDETINALKLRIYEKIDQSPVDQLLYMGGQVLDGNLTLERARVPA

SEQ ID NO: 165012 - protein, 195 aa, Heterodera glycines
  Homolog annotation: Hit_ID=NP_502317.1; Match level="QueryCoverage =99%, HitCoverage=35%, E-value=3e-62, Identity=60%"; Hit description =proline HYdroxylase (61.5 kD) (phy-2) [Caenorhabditis elegans] emb|CAA93469.1| Hypothetical protein F35G2
  Gene Ontology: Mol. function=protein binding; Cellular component =cell; Biological process=embryonic development
  Coding regions on vcDNA: vcDNA=SeqID_91435; Strand=+; Position=1-585
HPRADGNLQWYKERMSAEEFDDQTDLPELQNEYKRYKDIPERDSFESLCRGEFEIPPENVTQLNCYYKKDKPFLKLAPHKVEIVRFEPLVVLFRGVISDAEISVIKELATPKLRRATVHDPATGQLVFASYRISKSAWLKDEEHEVVARVNKRISDMTNLNLDTAEELQVANYGIGGHYDPHFDFSRREEKNQFD

SEQ ID NO: 165013 - protein, 203 aa, Heterodera glycines
  Homolog annotation: Hit_ID=CAA74204.1; Match level="QueryCoverage =100%, HitCoverage=74%, E-value=1e-114, Identity=100%"; Hit description=serine proteinase [Heterodera glycines]
  Coding regions on vcDNA: vcDNA=SeqID_91436; Strand=+; Position=42-650
MQSLSHILFTFFSILFAAHCQSDESKSAGAQMQTVDENKIRHGKPLTSIVKYPFMATVWQNDRKLCTASIVSPNYILSAGHCFVKMSEENYIILVGTVNAKLEKGNGQQFKVEKAHVYSETVFGQDIAIVKLKNSIDFSDNATQPITLSRRSNFTKTDLAFIAGWGRITDWSSPVTLQGANVLIWPKDEARCDGIMESEVCAF

SEQ ID NO: 165014 - protein, 195 aa, Heterodera glycines
  Homolog annotation: Hit_ID=CAE64717.1; Match level="QueryCoverage =96%, HitCoverage=77%, E-value=1e-54, Identity=55%"; Hit description =Hypothetical protein CBG09503 [Caenorhabditis briggsae]
  Gene Ontology: Mol. function=electron transporter activity; Cellular component=mitochondrion; Biological process=carbohydrate metabolism
  Coding regions on vcDNA: vcDNA=SeqID_91437; Strand=+; Position=12-596
MFPAKYKAFRLENKVAVITAATNGIGLAIAERLGHEGARLVVSSRDEDNVKRAIDRLVSSGLKRSDLAGCTCHVSNSEDRSRLLKLTIQRFGSDLLDVDESAWDKLFDVNVKAGFMMAKLFAPEIEQSGGGSIVFNSSIGAYRSPQGIAAYGITKTALLGLTRALAESLAPKGIRVNAIAPGIIKTKMSKALWEG

SEQ ID NO: 165015 - protein, 197 aa, Heterodera glycines
  misc_feature (79)..(79): Xaa can be any naturally occurring amino acid
  misc_feature (115)..(115): Xaa can be any naturally occurring amino acid
  misc_feature (158)..(158): Xaa can be any naturally occurring amino acid
  Homolog annotation: Hit_ID=CAB88203.1; Match level="QueryCoverage =100%, HitCoverage=65%, E-value=1e-44, Identity=48%"; Hit description= putative cuticular collagen [Globodera pallida]
  Coding regions on vcDNA: vcDNA=SeqID_91438; Strand=+; Position=2-595
VLGIATKGSLLAMITSPDSLPSLYSEMIPMNRQGRHGFEVFHVISDSAWTDLMDGLMAMTAPSKPRDNPFNSMYRDEHXLPGHCRRAVLRHANCPPVAPGPAAPAVHPGHPGCAXPPGEPVYGVQTWPPCPLHNIPCPRYPAGPTRRPQGLAPPGLLXSAGPPGTPCSRRMTLQLLVTPGPQRQPGQCRHPGSAGQP

SEQ ID NO: 165016 - protein, 102 aa, Heterodera glycines
  Coding regions on vcDNA: vcDNA=SeqID_91439; Strand=-; Position=1-306
LKQRFLFFWDRVYHFSLQISQFSDGLRPKLGGNGRAEFLGNLGKVRGALFVQLSLRLGPDFLRLALGRQVEFLDGVTVSGGRAPIVAPTRRQVPGRVENARH

SEQ ID NO: 165017 - protein, 109 aa, Heterodera glycines
  Coding regions on vcDNA: vcDNA=SeqID_91440; Strand=+; Position=1-330
GNFSSRIEALKAAFANASSPVNFIVVIWQLPSPVDPNLAFDRINELTREQLTLKRMNGVGHYFLIRCPIARDESKWTKWEEEAIGWRIYDQWNIIDIRINDEGEIGDGP

SEQ ID NO: 165018 - protein, 129 aa, Heterodera glycines
  Coding regions on vcDNA: vcDNA=SeqID_91441; Strand=+; Position=2-391
GGRVEYRIKWMGYDDSWNSWEPSKSVKHLDVVKQYEKEWKQQHQQEKQQPVSAKRSLRLSRTEQTPTTKGTTPSSSVSVSTKRIRVVVRKEQDDGPAHVEQTEMDAVSVETKELAPKTPSKKKKKRSRY

SEQ ID NO: 165019 - protein, 71 aa, Heterodera glycines
  Homolog annotation: Hit_ID=NP_492117.1; Match level="QueryCoverage =100%, HitCoverage=11%, E-value=6e-11, Identity=43%"; Hit description= atp-dependent clp protease atp-binding clpx like (63.6 kD) (1I153) [Caenorhabditis elegans] emb|CAA98115
  Gene Ontology: Cellular component=mitochondrion
  Coding regions on vcDNA: vcDNA=SeqID_91442; Strand=+; Position=2-214
YCKDCDIIFNRSSSNDASANKFNILKNGTIQSPPDPTEISVYLDKYVVGQQHAKKAMSVGIYQHYKRLENN

SEQ ID NO: 165020 - protein, 110 aa, Heterodera glycines
  Homolog annotation: Hit_ID=CAG09386.1; Match level="QueryCoverage =100%, HitCoverage=11%, E-value=6e-16, Identity=40%"; Hit description= unnamed protein product [Tetraodon nigroviridis]
  Coding regions on vcDNA: vcDNA=SeqID_91443; Strand=+; Position=2-331
IHPLRDVNLDFGKAVREDARPGIDIQAQCRVRILDRPASYLMNAPEVLYPWVSIIDASMKLAICNLVLDTTTRPNFVADYLLYFMNRYRDFSYVDFITITEPSYDIQQVL

SEQ ID NO: 165021 - protein, 168 aa, Heterodera glycines
  Coding regions on vcDNA: vcDNA=SeqID_91444; Strand=+; Position=113-616
TVVMLFWGLYLMDPATVTRKEARFIFDFKWFNYALVGGRIDLLQKSTCFFYSRINVPVESKKFIRKKNLNFIFIGTPILQYYHFFSEISCVLFSFLVILPLLVNPSISAHFPPLRHASRLFHLAPSSPLKSLCAKGDLVFLPVLHHPHPLFLCLLQLLGLSHPCPNVL

SEQ ID NO: 165022 - protein, 116 aa, Heterodera glycines
  Homolog annotation: Hit_ID=CAE74225.1; Match level="QueryCoverage =79%, HitCoverage=28%, E-value=1e-25, Identity=48%"; Hit description =Hypothetical protein CBG21909 [Caenorhabditis briggsae]
  Coding regions on vcDNA: vcDNA=SeqID_91445; Strand=+; Position=201-551
LFNTLIKSPCFNEHECCAKWAADGQCESNSEYMSQFCKASCKKCQYSYNMQEECADRHKNCKALSYQMKCDSSWMAENCRKYCNKCNVKRMQTCAGGSPGGEKRKKNSEINFINFY

SEQ ID NO: 165023 - protein, 181 aa, Heterodera glycines
  misc_feature (70)..(70): Xaa can be any naturally occurring amino acid
  misc_feature (84)..(84): Xaa can be any naturally occurring amino acid
  misc_feature (92)..(92): Xaa can be any naturally occurring amino acid
  Homolog annotation: Hit_ID=NP_497750.1; Match level="QueryCoverage =100%, HitCoverage=43%, E-value=2e-48, Identity=53%"; Hit description= tumor suppressor like (3E797) [Caenorhabditis elegans] emb|CAA85493.1| Hypothetical protein C14B1.5 [Cae
  Gene Ontology: Cellular component=cytoplasm
  Coding regions on vcDNA: vcDNA=SeqID_91446; Strand=+; Position=26-568
LQQDMTILPHNYNFDIPNTIWKIRTIDAKIVALQFPEGITMYACVIADILEKHTGAEFIILGDVTYGACXVHDFTARALGLSAXLVHYGHSXLVPIHDTVGIHLLYVLANIDMGTAHLLDTLGHNFLHTAGDGMEKVPKLALNSTVQFVATLQIVKRELAKDSFYIVIPQCSPMSTGELLG

SEQ ID NO: 165024 - protein, 86 aa, Heterodera glycines
  Coding regions on vcDNA: vcDNA=SeqID_91447; Strand=+; Position=2-262
QIVLRQHVACRSPAAIPTSNETHDAPSKRYGGCCCGCGVSAPGPPGPPGPSVQPDRHRQPVGSRQPGVPGQAAPRPYPSRRGCMPK

SEQ ID NO: 165025 - protein, 189 aa, Heterodera glycines
  Homolog annotation: Hit_ID=CAE73113.1; Match level="QueryCoverage =62%, HitCoverage=80%, E-value=7e-18, Identity=36%"; Hit description =Hypothetical protein CBG20494 [Caenorhabditis briggsae]
  Coding regions on vcDNA: vcDNA=SeqID_91448; Strand=+; Position=80-649
MSSFFHGHQRTHSQAQQLIPRGPSDPDDPCSTASPYDSDPVLIPSCAFPSGTDRLPQLTNSRILPAGRASAMRFSTLGSDCSSSYYGLPGGVEGVEEPITTRSVLRANFRVVLGSAALALLGSVLLVFGSCVMLFPNDMDVHGWIFLVVGVLFAIPGFYHVWYIGCTLCGRPGYSFENLPTFTKPNFPY

SEQ ID NO: 165026 - protein, 180 aa, Heterodera glycines
  Homolog annotation: Hit_ID=NP_492072.1; Match level="QueryCoverage =96%, HitCoverage=48%, E-value=1e-80, Identity=79%"; Hit description =EATing: abnormal pharyngeal pumping EAT-11, G Protein, Beta subunit (eat-11) [Caenorhabditis elegans] emb
  Gene Ontology: Mol. function=signal transducer activity; Cellular component=shmoo tip; Biological process=signal transduction
  Coding regions on vcDNA: vcDNA=SeqID_91449; Strand=+; Position=88-627
MVEDAGTRAGFDQIDALAREAEELRQKLEQERHKLNDIPIQQAAERLELLSQLAIKQRRVLKGHGSKVLCMDWAQDKRHLVSSSQDGKVIVWDGFTTNKEHALTMPTTWVMACAYAPSGQMIACGGLDNKCSVVPLDPQEDILQKKRSVATHTSYMSCCTFIRSDNLLLTGSGDSTCAMW

SEQ ID NO: 165027 - protein, 213 aa, Heterodera glycines
  Coding regions on vcDNA: vcDNA=SeqID_91450; Strand=+; Position=3-641
FFTLKLITMMLRNRDLNVQPAAGAGAPLPKRQSAHLVKVVGGASGRASSQSSAGSDRDSKYEPRPKRACSQKDKENSHYNNNNHNKSSHNKSKKNTSGGTVVPVTAFSRSLLIDSAKKDVTVVSTAVDAGGGGVLAAPIVGRKRSSALLSTRDSNVGEHMSSTQKEEKQDDEQKMEQDSGERQQQQEEGLFDFDKENDRDMSALSQYAQDIFT

SEQ ID NO: 165028 - protein, 169 aa, Heterodera glycines
  Coding regions on vcDNA: vcDNA=SeqID_91451; Strand=+; Position=1-510
AMSTAQGDHDERRDASSPPPPPLAASIRPNAMAASSSRIGHSLLGEGALRPSPFSQLATSSFIQPSPLAAIVQPRAIQESNFRALEMSMHALLINQMLFANSFASPALRSSRHRPFGYGSIPFGSVSRRGPVDSIVDSNIFGVPAGASQIQLMDELENEFDPLSNNRRV

SEQ ID NO: 165029 - protein, 205 aa, Heterodera glycines
  Coding regions on vcDNA: vcDNA=SeqID_91452; Strand=+; Position=2-619
CAQFGTSVTSFLQIDTTDPIALSELRFDVLPLLLANAWPLRRNIHFLRRLVFILAYSSNLNYHLVLDPLLMGLSKCSTRENVFLCCSPENVTITDVKIFLVQLSSYMKLCKLYDEGVFVFPWIFHCAPNVQQQQFWSYINSLLDGKQESESLPTLVSITTRIAQKWSNEAMSKKLEDINSLMTRLTLHNRSLAKLFALNQTGSLF

SEQ ID NO: 165030 - protein, 147 aa, Heterodera glycines
  Coding regions on vcDNA: vcDNA=SeqID_91453; Strand=-; Position=3-443
MGQFIQEIQQNNGTKSGENVTNEERHENQSKRQENGAVLVEQQQENAIEQSAKLQKERNVDEQKKRDDQFGQQNGTVQEALDDQTDELQLVMSMSRVIRKPMRQLNIKPIENGTELQHGPGVIYYHACLRDNDGIEKDVILNCMQPL

SEQ ID NO: 165031 - protein, 141 aa, Heterodera glycines
  Homolog annotation: Hit_ID=CAE58388.1; Match level="QueryCoverage =69%, HitCoverage=74%, E-value=9e-33, Identity=66%"; Hit description =Hypothetical protein CBG01517 [Caenorhabditis briggsae]
  Coding regions on vcDNA: vcDNA=SeqID_91454; Strand=+; Position=68-490
MFLFLPPSLPSRLCLPFLFLLFYAYFGDGFRRRWRDDSFINRTFKPRRYKLTLSIRNHNVTDVRFFRLIGVDNTADFYVAPGDTFTNTYTVNRKGAWVLFVEFPGNRYAKSQRKMISRDSFPQWMMEVYLFPPDNVGFSEW

SEQ ID NO: 165032 - protein, 82 aa, Heterodera glycines
  Homolog annotation: Hit_ID=NP_498806.1; Match level="QueryCoverage =100%, HitCoverage=31%, E-value=3e-16, Identity=48%"; Hit description= proteasome Beta Subunit, required for meiotic division progression (28.9 kD) (pbs-6) [Caenorhabditis ele
  Coding regions on vcDNA: vcDNA=SeqID_91455; Strand=+; Position=2-247
ILTRQILLTSCGSYGDVLQLRSILELRISHFQFFYQRAMSLDHCGEMLSRTLYSRPLFPYFTVTIICGITMDGRDDLYSYDP

SEQ ID NO: 165033 - protein, 102 aa, Heterodera glycines
  misc_feature (37)..(37): Xaa can be any naturally occurring amino acid
  misc_feature (65)..(65): Xaa can be any naturally occurring amino acid
  misc_feature (75)..(75): Xaa can be any naturally occurring amino acid
  Homolog annotation: Hit_ID=CAA65474.1; Match level="QueryCoverage =99%, HitCoverage=34%, E-value=5e-17, Identity=43%"; Hit description =collagen [Globodera pallida]
  Coding regions on vcDNA: vcDNA=SeqID_91456; Strand=+; Position=23-328
GWNDLRDAKLVLTLPAKHPVTTYLSNFRAKRQLPGLXRSPGLLHPRCPPDPLGSAGTPAQPGHPXSHDSPDLSYXPRQFDDPCTRQNIPCTACNAGPHGPLG

SEQ ID NO: 165034 - protein, 108 aa, Heterodera glycines
  Homolog annotation: Hit_ID=CAB88203.1; Match level="QueryCoverage =100%, HitCoverage=36%, E-value=5e-44, Identity=81%"; Hit description= putative cuticular collagen [Globodera pallida]
  Coding regions on vcDNA: vcDNA=SeqID_91457; Strand=+; Position=2-325
QETHIVLGIASESSLMDIIATDGTQASLYSEMTQMNNKVRDGVEAFRVNTDSACTDLMDVQVDVTPPSNPRDNPFNSIFRAKRQLPGHCQCAGLQQPSCPPGPPGPCG

SEQ ID NO: 165035 - protein, 137 aa, Heterodera glycines
  Homolog annotation: Hit_ID=XP_391993.1; Match level="QueryCoverage =84%, HitCoverage=7%, E-value=3e-13, Identity=35%"; Hit description =similar to Hypothetical protein CBG01854 [Apis mellifera]
  Coding regions on vcDNA: vcDNA=SeqID_91458; Strand=+; Position=85-498
MSDMSAYMGSGPAEPAPSSGAAEASPSSGVASAYMGSGPAEPAPSSGAAEASPSSGVASAYMGSGPAEPAPSSGAAEASPSSGVASAYMGSGPAEPAPSSGAAEASPSSGVASAYMGASPAYEPPAQEKSPDQSAYM

SEQ ID NO: 165036 - protein, 183 aa, Heterodera glycines
  misc_feature (128)..(128): Xaa can be any naturally occurring amino acid
  Homolog annotation: Hit_ID=AAH65093.1; Match level="QueryCoverage =83%, HitCoverage=14%, E-value=3e-13, Identity=36%"; Hit description =Ankrd27 protein [Mus musculus]
  Gene Ontology: Mol. function=transcription factor activity; Cellular component=membrane; Biological process=regulation of transcription, DNA-dependent
  Coding regions on vcDNA: vcDNA=SeqID_91459; Strand=+; Position=84-633
MADDIPPPPAVAADGGDVVVDLEQHVRQLIMSIGQGSEDAVHELSILIESFNQEQLVDFLEIMARMYVESGFSVDMPGGQEGITMLMVAASSGRVDFARYLLAHGATVGHLDATGSVFPLMLAAESGXLEVCRLLVEEWAAEVNQQAIDGTTPLMSASSEGRLDVVIYLIDHGAEIQHANAEG

SEQ ID NO: 165037 - protein, 175 aa, Heterodera glycines
  Homolog annotation: Hit_ID=XP_421074.1; Match level="QueryCoverage =88%, HitCoverage=18%, E-value=7e-19, Identity=32%"; Hit description =PREDICTED: similar to Liprin-alpha 1 (Protein tyrosine phosphatase receptor type f polypeptide-interactin
  Gene Ontology: Mol. function=signal transducer activity; Cellular component=cytoplasm; Biological process=cell-matrix adhesion
  Coding regions on vcDNA: vcDNA=SeqID_91460; Strand=+; Position=2-529
LSESNERLQIHLKERMQAQIDKNKLMQRLDQAKKIFDQTERFKERLLRENDDLRNDPGKVQTLGEQEWKRIQQANVLASIQQAFSTSSSMLNVNEAPPPALDQSTTDPLDAINNEIRMIQEQKQQAERVAAEQSQEWPPNGTVYEYGNNNNASNGGYSPRQQHDQQKKQKMRSHK

SEQ ID NO: 165038 - protein, 198 aa, Heterodera glycines
  Coding regions on vcDNA: vcDNA=SeqID_91461; Strand=+; Position=2-595
HLPIFFLFLSVRLPFLFSYPQFPSPFAHPPMSPMAGIEPIMPTNFALDGFARHVSPSGGFGGGATTHPMNSLIIRNSPYQMPMPTMPGGASPFPMSQQMGTDGPQQPIFPNGMSIDKNGMGSANAVLPSDIPMDVLVGRQITQNRLDEMGQSVVGSAAMNGRHPFPLGPFLGGSNGGGGRNAPPFGAGGGAFSGDSLT

SEQ ID NO: 165039 - protein, 174 aa, Heterodera glycines
  Coding regions on vcDNA: vcDNA=SeqID_91462; Strand=+; Position=29-553
MLGRNIGNGRGRPLGSAHKAVGKAVDGSSSGDSSDDDSSIDQHVQLASESRDVKLNGGGESTIMKGTGRRGRRKGRTRDESSPDLATTTVAEDWTGGNGDPELCAHKKCQRPLHMSINWVQCDDCDKWFHSTCVFGTNSTPEDDADFHCGCERNTKKNSTETTHRKSLSLSPPT

SEQ ID NO: 165040 - protein, 180 aa, Heterodera glycines
  Homolog annotation: Hit_ID=NP_872104.1; Match level="QueryCoverage =97%, HitCoverage=28%, E-value=2e-39, Identity=48%"; Hit description =c2, putative phospholipid binding domain containing protein (69.8 kD) (4S226) [Caenorhabditis elegans] em
  Gene Ontology: Mol. function=calcium-dependent phospholipid binding; Biological process=vesicle-mediated transport
  Coding regions on vcDNA: vcDNA=SeqID_91463; Strand=+; Position=106-645
MQLAYRSRYHEQNLNPKWKPFEILTQQLCYGDRDRPFLIECFDWDQDGDHDLVGACQTTVNRLMCGMDKELPLINEKKLKKHKKYVDSGQIHFHRVFLWQDYTFLDFIRGGTELDFTVAIDFTRSNLPMKDQSSLHRFDHSNRPNQYEIAIGAIAEICQHYSKNKLFNAYGFGARIPSLD

SEQ ID NO: 165041 - protein, 108 aa, Heterodera glycines
  Coding regions on vcDNA: vcDNA=SeqID_91464; Strand=+; Position=281-607
NANNLSLISLGSFSLIATVKMELSPKLCQKIKGLMETRRIACVVPVPVFSCTFVQKKKQVHAIFGTQITGTVTGTRQLGARTFSNIAFLFVIQIQQSWYHSKVINMLS

SEQ ID NO: 165042 - protein, 201 aa, Heterodera glycines
  Homolog annotation: Hit_ID=NP_502269.1; Match level="QueryCoverage =99%, HitCoverage=53%, E-value=3e-55, Identity=56%"; Hit description =zinc-containing alcohol dehydrogenase superfamily (40.2 kD) (4M724) [Caenorhabditis elegans] emb|CAA98080
  Coding regions on vcDNA: vcDNA=SeqID_91465; Strand=+; Position=2-604
RLISLGAPKDQNESHFSDEEELPDVPFNGARDKACYAATRLTDNEIKNTKQARITHRVKDTSLFPLYEVSGVIQDFETTATPADYDFALGDEHIVWPSENMRQNGYADFVAETNLALLVKSADTLTMHVAPNLPADATWALSASDHARSAVEAIAGTNGCYLILPVGAGGLALWIPTLAEHTPTARHEKRIKLIDAHSKEN

SEQ ID NO: 165043 - protein, 202 aa, Heterodera glycines
  Coding regions on vcDNA: vcDNA=SeqID_91466; Strand=+; Position=3-608
QIDTDENGGKGGRSAIEQSQKRAKMGSESNGQIKEEDKSEKSASEGTLAEEKANANGSVGNAFLDEVIRNYMPKPHAPIQCIAMEDAHFALNTTPISSNSPSKSPVRTGNDRLLEESIALMMPHPNRKREGKAFARPKDQQKFGQKMDDLLTADEEEEEAVLEQQQKVTAELPADVNAEFAAHWMVVECGTTKSPKTDDEER

SEQ ID NO: 165044 - protein, 213 aa, Heterodera glycines
  Homolog annotation: Hit_ID=CAE68590.1; Match level="QueryCoverage =100%, HitCoverage=32%, E-value=8e-78, Identity=66%"; Hit description= Hypothetical protein CBG14460 [Caenorhabditis briggsae]
  Coding regions on vcDNA: vcDNA=SeqID_91467; Strand=+; Position=2-640
QSFWRLINKPRIDDWSPLAKFYYADDTLNAIANELDSFDGRRDPERCNQLVNKLRQAQDRVLHIISEMLMLIFPLESERATRDFRVKFPDEIMHDNLPGQLWFGAECLAAGSNIDDHETESEAIQPMAKSFTRHLEKLREMLKEQALKDPTYYPDGIKTSLKVFDQLFADFEFAYVSAMVPGKSAKEYDRQLDVTVLFSECLTRAIKMRYITR

SEQ ID NO: 165045 - protein, 214 aa, Heterodera glycines
  Homolog annotation: Hit_ID=CAE70292.1; Match level="QueryCoverage =100%, HitCoverage=17%, E-value=2e-72, Identity=62%"; Hit description= Hypothetical protein CBG16813 [Caenorhabditis briggsae]
  Gene Ontology: Biological process=glutamate metabolism
  Coding regions on vcDNA: vcDNA=SeqID_91468; Strand=+; Position=3-644
SGTRNLRDNLADLNAQIAANQKGIGLLHELVREYSLPIVKAYMKHIQRNAVEAVRQLLKNVAEESQQKGQKVLRAKDWMDDGTEIKLEVEIDRDSGDALFDFTGTGLQVHSSCNAPPAVLMAALIYCLRCLVGRDIPLNQGCLEPVKVRVPPGTILSPSENAAVVGGNVLTSQRLCDVILRAFNAVAASQGCMNNVTFGDSQFGYYETIGRGAG

SEQ ID NO: 165046 - protein, 191 aa, Heterodera glycines
  Coding regions on vcDNA: vcDNA=SeqID_91469; Strand=+; Position=45-617
MEAPSSLNDLNKFPTVSDNRKLNENTEEPSEWNKCIELLDRKKETDEKISQQVTLVANLGKAFDEGIQQNEGEEQREEKEKEEVEKEEEKEQTPTHSQFEFGMDSKRKHSSARHQQTNPKNNANSTRARRSKRLYSPSPPPSLISETNRKKKKENSADEVGDFSLGSLPNAPSSSLLKWAKCLRRRLRFSR

SEQ ID NO: 165047 - protein, 108 aa, Heterodera glycines
  Homolog annotation: Hit_ID=CAE59800.1; Match level="QueryCoverage =100%, HitCoverage=13%, E-value=1e-51, Identity=87%"; Hit description= Hypothetical protein CBG03262 [Caenorhabditis briggsae]
  Gene Ontology: Mol. function=chloride channel activity; Cellular component=integral to plasma membrane; Biological process=transport
  Coding regions on vcDNA: vcDNA=SeqID_91470; Strand=-; Position=166-624
KYGLNEGKKREFLSASAAAGVSVAFGAPIGGVMFSLEEASYYFPLKTMWRSFFCALVAGVILRFVNPFGSDQTSLFHVDYSMRWTFMELIPFAMLGIFGGVLGSLFIW

SEQ ID NO: 165048 - protein, 160 aa, Heterodera glycines
  Homolog annotation: Hit_ID=XP_454605.1; Match level="QueryCoverage =96%, HitCoverage=10%, E-value=6e-09, Identity=33%"; Hit description =unnamed protein product [Kluyveromyces lactis] emb|CAG99692.1| unnamed protein product [Kluyveromyces lac
  Coding regions on vcDNA: vcDNA=SeqID_91471; Strand=+; Position=160-639
MSVISGSISGISDRSRRQMPASSSGTVNSVGNQTAMSASNALWKAPDGTVGGNGSSIGTAGGPGPSSVLAGSNAKVGGQSANGETGALSLGGTRSESFGSSSSMLNGNQTASQSGTSSSNAVGTGDVFVYSVGNGNLTNSAQSAVPKVAAAGMGGATGNQ

SEQ ID NO: 165049 - protein, 122 aa, Heterodera glycines
  misc_feature (46)..(46): Xaa can be any naturally occurring amino acid
  Homolog annotation: Hit_ID=NP_506709.1; Match level="QueryCoverage =100%, HitCoverage=42%, E-value=5e-16, Identity=36%"; Hit description= ubiquitin-specific protease otubain (32.3 kD) (5P547C) [Caenorhabditis elegans] emb|CAB02772.1| Hypothet
  Coding regions on vcDNA: vcDNA=SeqID_91472; Strand=+; Position=2-367
EFDEKTSSQYFKKATELAGLYSDIRGIRGDGNCFYRDELTAQLERXFEDAEELKRFNELVKGWRARLMTDSCFHELTTGDFCHSMEQLMTSLLNGTMLPQILLDDLNKDGIADYYVVFIRLM

SEQ ID NO: 165050 - protein, 178 aa, Heterodera glycines
  misc_feature (24)..(24): Xaa can be any naturally occurring amino acid
  misc_feature (68)..(68): Xaa can be any naturally occurring amino acid
  Homolog annotation: Hit_ID=CAE65006.1; Match level="QueryCoverage =95%, HitCoverage=61%, E-value=3e-55, Identity=56%"; Hit description =Hypothetical protein CBG09844 [Caenorhabditis briggsae]
  Gene Ontology: Mol. function=phosphatidylinositol transporter activity; Cellular component=membrane fraction; Biological process =nonselective vesicle transport
  Coding regions on vcDNA: vcDNA=SeqID_91473; Strand=-; Position=3-598
FGRLFFSRKVPAFLRTIMPRGSTXLHERSWNAFPYCKTEVTNPDYMKDDFLIRIETMHLSDRGTTKNXYGWNDHHHHKDVLKERKVVRINIANDNEFLRAADILDNTRPSTFRSMKTGRGPLKQQWQTNCKPVMCAYKVVTVKFKWFGLQTMVESSMQKSFPRLFCKFNREVFCWMDR

SEQ ID NO: 165051 - protein, 54 aa, Heterodera glycines
  Homolog annotation: Hit_ID=CAE73457.1; Match level="QueryCoverage =100%, HitCoverage=6%, E-value=4e-22, Identity=85%"; Hit description =Hypothetical protein CBG20907 [Caenorhabditis briggsae]
  Coding regions on vcDNA: vcDNA=SeqID_91474; Strand=+; Position=3-164
FYFADVCAGPGGFSEYMLWRKAFYNAKGFGFTLTGKDDFKLERFKAASSDYFET

SEQ ID NO: 165052 - protein, 65 aa, Heterodera glycines
  Coding regions on vcDNA: vcDNA=SeqID_91475; Strand=+; Position=232-429
IEFIEGFMRTKVRRNAGNSQGKSLKISIVFYKHRKVAKIIEDSANRREKEAPVGGESAELQGKVA

SEQ ID NO: 165053 - protein, 89 aa, Heterodera glycines
  Coding regions on vcDNA: vcDNA=SeqID_91476; Strand=+; Position=338-604
FFLNFCGVGPKGHAFLKLAKFFAIKKQNAKHEMINIPPDPTQAQQKDNIFSIVGRQALNRPAFTDTPFWRFVLPKISAHFMVFQLTFFH

SEQ ID NO: 165054 - protein, 36 aa, Heterodera glycines; identical to SEQ ID NO: 143266
  Coding regions on vcDNA: vcDNA=SeqID_91477; Strand=-; Position=107-217

SEQ ID NO: 165055 - protein, 112 aa, Heterodera glycines; identical to SEQ ID NO: 152812
  Coding regions on vcDNA: vcDNA=SeqID_91478; Strand=+; Position=223-558

SEQ ID NO: 165056 - protein, 211 aa, Heterodera glycines
  Coding regions on vcDNA: vcDNA=SeqID_91479; Strand=+; Position=2-634
WRYSVGRARELYSEMTSIGLIPFEEVFNSLLSAQIPFNSSSSSFDVTHWLHEMSRLGVRPSVKTFNAALSSLLQIKEKGANSFDYGTEEMAAAVTPSTEESSYDKEHLWKTASDLVHEMRSLGIEPTLATFSYTLKLAPTKMSLDALLNEILTRLEYKLSRSEPIERVGDDDAIFYRNAISMARILNNELQMDRLVKIYRSEHNKVFFENY

SEQ ID NO: 165057 - protein, 195 aa, Heterodera glycines
  Homolog annotation: Hit_ID=NP_871644.1; Match level="QueryCoverage =99%, HitCoverage=22%, E-value=1e-50, Identity=46%"; Hit description =putative cytoplasmic protein of ancient origin (3H529) [Caenorhabditis elegans]
  Gene Ontology: Biological process=proteolysis and peptidolysis
  Coding regions on vcDNA: vcDNA=SeqID_91480; Strand=+; Position=1-585
EGKNSGVVYSEMQARDSEMDSMLDKKRKELFYPAGSSYGAMTGGTLSDIRELCSLERVRNFHKNFYHLSNMYITVCGKIDHQQLLNAIEPIEQENLDAIPRQFATPFQARTPPLTEPRTARIVCPSDDESIGMVEMSWHGPPGFDFKTTQALTILFDYLTDTAVAPLRKDFVQIEDPFCTSVSFCLMEQRDCEIV

SEQ ID NO: 165058 - protein, 123 aa, Heterodera glycines
  Coding regions on vcDNA: vcDNA=SeqID_91481; Strand=+; Position=146-514
PISRIPSLICLLKQCTHSPAAVSPPCHCFLRANSFEFTPQPMANALALCRVLWPILFASSFAQSNTSPSNFPPNSLQNHNKVNDCVYNSSHRKSVLTDIMKGYDKTVVPSNESVTVQVELTVQ

SEQ ID NO: 165059 - protein, 107 aa, Heterodera glycines
  Homolog annotation: Hit_ID=NP_495512.1; Match level="QueryCoverage =82%, HitCoverage=10%, E-value=3e-28, Identity=63%"; Hit description =thyroid peroxidase precursor (97.1 kD) (2H539) [Caenorhabditis elegans] gb|AAK68357.1| Hypothetical prote
  Gene Ontology: Mol. function=peroxidase activity; Cellular component =integral to plasma membrane; Biological process=thyroid hormone generation
  Coding regions on vcDNA: vcDNA=SeqID_91482; Strand=+; Position=134-579
GGPDPIIRGMMSQQLKRPQRLTRTITEQMFGTTDLGTINIQRGRDHGVPSYMRFRQLCGLSTATTFDQLSREIMSVEARQNLQRIYGTPGWYCSLTYCQCVHLFDLF

SEQ ID NO: 165060 - protein, 127 aa, Heterodera glycines
  Homolog annotation: Hit_ID=NP_113788.1; Match level="QueryCoverage =78%, HitCoverage=10%, E-value=3e-11, Identity=37%"; Hit description =protein tyrosine phosphatase, receptor type, N polypeptide 2 [Rattus norvegicus] emb|CAA90600.1| phosphot
  Gene Ontology: Mol. function=transmembrane receptor protein tyrosine phosphatase activity; Cellular component=extracellular space; Biological process=exocytosis
  Coding regions on vcDNA: vcDNA=SeqID_91483; Strand=+; Position=7-387
MRRHRQEGPILAPCRDGGGKAGGSVCDDLCRQRIAEEGNISQRISSGRSAGDRSKHSSTSSWPDELSAPTGADQQLDIGTGHVLLAFLKEHMEKPGEVSKEWESVKDYANAAGEATVARRAENAAKN

SEQ ID NO: 165061 - protein, 166 aa, Heterodera glycines
  Homolog annotation: Hit_ID=NP_955136.1; Match level="QueryCoverage =90%, HitCoverage=86%, E-value=2e-38, Identity=51%"; Hit description =CNPV113 thymidine kinase [Canarypox virus] gb|AAR83459.1| CNPV113 thymidine kinase [Canarypox virus]
  Coding regions on vcDNA: vcDNA=SeqID_91484; Strand=+; Position=26-526
MSDCQCHQRGSIHLIIGPMFSGKTTELFRLAQRYILAGRKVAVVKYALDTRYDESHACTHDKRKMEAISATKMEDAFEELNKFDVIGIDEGQFFKDIVKYAQELANTGKTVIIAALNGDYRQEPFQNVAMLIPLAEKIEKLSAVCRCGQSASFTFRMSECTKHVIL

SEQ ID NO: 165062 - protein, 220 aa, Heterodera glycines
  Homolog annotation: Hit_ID=CAE73333.1; Match level="QueryCoverage =100%, HitCoverage=25%, E-value=4e-67, Identity=55%"; Hit description= Hypothetical protein CBG20762 [Caenorhabditis briggsae]
  Coding regions on vcDNA: vcDNA=SeqID_91485; Strand=+; Position=2-661
GFMPLELYQEVEKNANQLPKYQRTDYLCRRCYLLKEHNFLLNLNVSPVDYESMMGHLKMVHEALILLIVDMTDMEASINRQLPSIIGTKKPMIVVGNKIDLLPPDFHKGYLRHFLASLKAAMHKAGVAQQFNILKYLLLSAKTGFGVEDLITNIYQKWVSPRGSIRSDIYVVGSTNAGKSTLFNAFLQSDLCKVRAMDLVERVTTSIWPGTTSSLLKFPI

SEQ ID NO: 165063 - protein, 152 aa, Heterodera glycines
  Homolog annotation: Hit_ID=NP_502164.1; Match level="QueryCoverage =100%, HitCoverage=24%, E-value=4e-35, Identity=52%"; Hit description= white family member (67.1 kD) (4M237) [Caenorhabditis elegans] emb|CAB05682.3| Hypothetical protein C10C
  Gene Ontology: Mol. function=ATP-binding cassette (ABC) transporter activity; Cellular component=mitochondrion; Biological process =transport
  Coding regions on vcDNA: vcDNA=SeqID_91486; Strand=+; Position=2-457
SNYGAMSPTKSVQEVQPVALSWFFLTVIHAKSGRKILDNVSGMDDAGQLVALMGASGAGKTTLLNTLLNRYLKSLSVEGQVLVNGHFLGRSITYVRGYVQQDDLFMGTLTVKEHLMRQGQLRMDGHFKLSMRKRVDEIIDEPGLPKCPPGRI

SEQ ID NO: 165064 - protein, 161 aa, Heterodera glycines
  misc_feature (29)..(29): Xaa can be any naturally occurring amino acid
  Homolog annotation: Hit_ID=NP_498886.2; Match level="QueryCoverage =97%, HitCoverage=39%, E-value=1e-23, Identity=37%"; Hit description =putative protein, with at least 4 transmembrane domains, of bilaterial origin (43.8 kD) (3J669) [Caenorha
  Coding regions on vcDNA: vcDNA=SeqID_91487; Strand=+; Position=2-484
MHKAFTDGVPFPVLKALEYFSMGQQSFAXGRQFRNAGNFTGTMLWAAFFVWLVQCLLLLFLPHHFAKAGIFCGLLTLLADVLFLVFCPSDLLIPFPSADAPASIAFLHFRLGACFWMSIAAAILELLFSATLCSLQSLRLYSLNTVLSASLDNSVGPPKCR

SEQ ID NO: 165065 - protein, 38 aa, Heterodera glycines
  Coding regions on vcDNA: vcDNA=SeqID_91488; Strand=+; Position=353-469
TPTRSGRLLADSKRLRDINISKDQMLDVRKDVGEPVTD

SEQ ID NO: 165066 - protein, 85 aa, Heterodera glycines
  Coding regions on vcDNA: vcDNA=SeqID_91489; Strand=+; Position=297-551
MTALCLQSFSLSLFTSHTLKCLALSFSLILFFRSISFSSSLSLSLSSSVFRFRLPEEMPILTNHGGRHNKARHNQNSNHQNNGHQ

SEQ ID NO: 165067 - protein, 191 aa, Heterodera glycines
  Homolog annotation: Hit_ID=CAE66545.1; Match level="QueryCoverage =95%, HitCoverage=3%, E-value=1e-40, Identity=43%"; Hit description =Hypothetical protein CBG11853 [Caenorhabditis briggsae]
  Gene Ontology: Mol. function=dynein ATPase activity; Cellular component=cytoplasmic dynein complex; Biological process=oocyte cell fate determination (sensu Insecta)
  Coding regions on vcDNA: vcDNA=SeqID_91490; Strand=+; Position=1-573
AKWREICQLPAAFDLLNFLASETVQLRWKSDGLLANKLAMENGAILFAVKNTPFVVDPSGTVCTFLANHFKGNSTEILRANQTDLMTKIELGVRFGKTLIIDEIDERIEPALVPLLRRDFHTIGARLAVQLGEKQVDFNDQFRLFLCSRNEHCHLASHVSAVVSEINFSVTRSGLASQFLSLAIELEKPEL

SEQ ID NO: 165068 - protein, 207 aa, Heterodera glycines
  Coding regions on vcDNA: vcDNA=SeqID_91491; Strand=-; Position=1-621
ERDDETDTHRKRKIEDEEIDPLQNQSLTKKARIEALEEAARQRDDGKEEKEERTGQEFLEMYSVNYREKLNEVRLELIRDLFNIQDHMKKYQGVTDGRTIQELNETALKMRTAMKHRRKNLNDINKAVLKKDLQISAEEYERTSYEQNKDYVEPFFDSHPTDYWEHIHKKYEGLQDDYKKIRELRKQQQFLNDEQKKQSIQDEIDQL

SEQ ID NO: 165069 - protein, 63 aa, Heterodera glycines
  Coding regions on vcDNA: vcDNA=SeqID_91492; Strand=-; Position=295-486
WTKEMLAKETEFDPFGRRVKHRHGIIGGFLYIRQNCSIIVIFRCGNYTFFAFLRIKQFPLINR

SEQ ID NO: 165070 - protein, 193 aa, Heterodera glycines
  Homolog annotation: Hit_ID=CAE63329.1; Match level="QueryCoverage =100%, HitCoverage=21%, E-value=2e-31, Identity=34%"; Hit description= Hypothetical protein CBG07728 [Caenorhabditis briggsae]
  Gene Ontology: Mol. function=structural constituent of muscle; Cellular component=endoplasmic reticulum membrane; Biological process=muscle contraction
  Coding regions on vcDNA: vcDNA=SeqID_91493; Strand=+; Position=3-581
LLEKHDFDAALKHYEQILATNEHSPRALFGRGRLHQLKAEFGAEHDDDSEKFIKMALSDYNSLLENEDTPNELFKMTVQYFVECARQMGGYHHKILQAQRALVDRFPDDADIKCDFGATWLGMARPEKAADIFRNVLDNEPGHALALAYLGYIQKVHEDELERRVHALRRAMATGDERVTGDARIYFPLGDGI

SEQ ID NO: 165071 - protein, 205 aa, Heterodera glycines
  Homolog annotation: Hit_ID=NP_502437.1; Match level="QueryCoverage =41%, HitCoverage=7%, E-value=2e-24, Identity=62%"; Hit description =UNCoordinated locomotion UNC-31, EGg Laying defective EGL-22, Ca2+ -dependent activator protein for secreti
  Coding regions on vcDNA: vcDNA=SeqID_91494; Strand=+; Position=2-616
YISQSKLDDTLDVLLSDMGTIIKEKLLSIMDLTLGRLARYDEGNPIGALLSMASTKPNTLFNKMRNLVGEQSSNMLGNIAGCCGGAGTQLSSQHRPSTAQFHHFNAGASAGGGTAAGANNSAQLGQQYVNFLRASSEQLQQVIADEVWVNRLLEEWYDGQTQMLNEWLTERLQQSLSNTQLTSLLLIVKKIYSDFELHGIDEERL

SEQ ID NO: 165072 - protein, 207 aa, Heterodera glycines
  Homolog annotation: Hit_ID=NP_215085.1; Match level="QueryCoverage =97%, HitCoverage=44%, E-value=1e-49, Identity=58%"; Hit description =hypothetical protein Rv0571c [Mycobacterium tuberculosis H37Rv] ref|NP_854246.1| hypothetical protein Mb0
  Coding regions on vcDNA: vcDNA=SeqID_91495; Strand=+; Position=14-634
MATDGVEEVHIEPKGLLGLLGVPPGARAIVVFAHGSGSGRLSPRNTHVASELRRSGLATFLLDLLTPEEEADRRNVFDFPLLAKRLQLASEWLRSRPNTATLSQGYFGASTGAGAALTAAAALTDTSTPIGAVVSRGGRPDLAMNVLDRVCAPTLLLVGGLDGQVIGMNERALNALVNCKHKKLHIVPGATHLFEEPGTMEEVVRLA

SEQ ID NO: 165073 - protein, 161 aa, Heterodera glycines
  Coding regions on vcDNA: vcDNA=SeqID_91496; Strand=-; Position=1-483
EEKRLLLVGGKINRHRWVSSCGGGVCQCFVRLFVDFVDDGIILLRRFRNYCWCRCRCRRYRRGGKAKAIGRKQIVRSKGAQSVAIFAAQLGKVEQRQQLLLHTAHCGCCCCCAISGQLLRLAVRKRRRDQRAADNGRCRMGRTVGKFGLIGYRKSLQGTLK

SEQ ID NO: 165074 - protein, 108 aa, Heterodera glycines
  misc_feature (59)..(59): Xaa can be any naturally occurring amino acid
  Coding regions on vcDNA: vcDNA=SeqID_91497; Strand=+; Position=176-502
RRGHRRKRRRKGRSANWHGKRTLRNWRWRAQRNSQRRAHHRQKSRCCERKRATWKGRRXSRRRRTRRKRYFCRRDCARRASSREWRREGPNLGTKRRSPRGKNAAKRQ

SEQ ID NO: 165075 - protein, 70 aa, Heterodera glycines
  Coding regions on vcDNA: vcDNA=SeqID_91498; Strand=+; Position=118-330
MKFLQFTFNWVLKYLYKKIGIVEFNSGTIHTLIKQPFLIHLQFFFIKNQIYNKLVQGYIDQISIFLILFC

SEQ ID NO: 165076 - protein, 85 aa, Heterodera glycines
  misc_feature (76)..(76): Xaa can be any naturally occurring amino acid
  Homolog annotation: Hit_ID=NP_505074.1; Match level="QueryCoverage =97%, HitCoverage=27%, E-value=1e-25, Identity=71%"; Hit description =COLlagen structural gene (29.5 kD) (col-43) [Caenorhabditis elegans] gb|AAC48270.1| Collagen protein 43 [
  Gene Ontology: Mol. function=structural constituent of cuticle; Cellular component=extracellular; Biological process=cuticle biosynthesis (sensu Nematoda)
  Coding regions on vcDNA: vcDNA=SeqID_91499; Strand=+; Position=2-256
TESDSRIWAYKFVAYSAVTFSIVAVLSVVVTLPMVYNYVAHVRRQMQHELGFCKGSAKDIYVEVNHMKSTPDMDLXVHRTARQTG

SEQ ID NO: 165077 - protein, 74 aa, Heterodera glycines
  misc_feature (30)..(30): Xaa can be any naturally occurring amino acid
  Homolog annotation: Hit_ID=CAE59952.1; Match level="QueryCoverage =89%, HitCoverage=5%, E-value=6e-11, Identity=51%"; Hit description =Hypothetical protein CBG03440 [Caenorhabditis briggsae]
  Gene Ontology: Biological process=reproduction
  Coding regions on vcDNA: vcDNA=SeqID_91500; Strand=+; Position=2-226
DKGCFDKLAELNDSVNCALCVENLSEDFVXRFDLVVLTDAPFSTQTEVNGWMRNPRKMINSEDAFGRFSQASVD

SEQ ID NO: 165078 - protein, 172 aa, Heterodera glycines
  Coding regions on vcDNA: vcDNA=SeqID_91501; Strand=-; Position=0-515
ETEWPDELTFATPADSPSADLPFEESETKTLMAKQSPLPPPLIDPARFSTMLTLLGTTILVLQFIGRRRPKWLRSGISSIPRSGPPTGKTFRAARTFLIRQDQRSSLDGYDKHPTVFNEDGLLCLKTRLLHANGPPTLASPVLLDRHSSLTRLIVQEIHADLRHAGVDWTLT

SEQ ID NO: 165079 - protein, 144 aa, Heterodera glycines
  Homolog annotation: Hit_ID=AAL27236.1; Match level="QueryCoverage =93%, HitCoverage=32%, E-value=9e-20, Identity=37%"; Hit description =Hypothetical protein C56C10.7b [Caenorhabditis elegans] ref|NP _741010.1| putative protein of eukaryotic or
  Coding regions on vcDNA: vcDNA=SeqID_91502; Strand=+; Position=34-465
MTALTPADVREQHLALRVMRLSNPKFHETICLGRDPADPFSMAICDSIGKLSGQSSVDLPLDSYLIAPHAMFFFYLGEMFTLYISIINISSVICKEIAIKVDIQTQNQRVSLEELAFAGIALEPNQQIGQILKHDIRELRQHNL

SEQ ID NO: 165080 - protein, 83 aa, Heterodera glycines
  Coding regions on vcDNA: vcDNA=SeqID_91503; Strand=-; Position=43-294
WQLRHLKLAGACQCHHVHSRRKNGELDESVHFRCPTASAPYSERTQFPSFFRWTTKKNLREPLLALCCCFFLLSKQKKKTKLR

SEQ ID NO: 165081 - protein, 135 aa, Heterodera glycines
  misc_feature (75)..(75): Xaa can be any naturally occurring amino acid
  Homolog annotation: Hit_ID=AAT85577.1; Match level="QueryCoverage =82%, HitCoverage=22%, E-value=2e-20, Identity=49%"; Hit description =U2 small nuclear ribonucleoprotein auxiliary factor large subunit [Alvinella pompejana]
  Gene Ontology: Mol. function=pre-mRNA splicing factor activity; Cellular component=nucleus; Biological process=mRNA processing
  Coding regions on vcDNA: vcDNA=SeqID_91504; Strand=+; Position=27-434
MDDENFHQANMERVREDEDEKIAIGRQTEDGETEPKAERERERKSDRERERKKKSKRTSRDRSRSKSRERKRSLXRRRSRSRSKERHRERERSREKERGEKRSKVKSNKYWDVPPAGYEHMSPKEYKELQVVVVH

SEQ ID NO: 165082 - protein, 97 aa, Heterodera glycines
  misc_feature (51)..(51): Xaa can be any naturally occurring amino acid
  Homolog annotation: Hit_ID=AAL78224.1; Match level="QueryCoverage =94%, HitCoverage=42%, E-value=5e-39, Identity=88%"; Hit description =hypothetical protein Hgg-30 [Heterodera glycines]
  Coding regions on vcDNA: vcDNA=SeqID_91505; Strand=+; Position=1-293
KEDRKAQLASQYMQRLAAMRMQNPAGLMGTMYAPASGGFFLPQAIQNQRAXAVHANTESVRGTNAWRCPSLEQYGRFQSSNARLHDGSSWWRSVRRR

SEQ ID NO: 165083 - protein, 182 aa, Heterodera glycines
  Coding regions on vcDNA: vcDNA=SeqID_91506; Strand=+; Position=3-548
TFYIYPNQNCSRILTSSWLLMEFLRPHIERWKKIFKILLNELIDLHKLCKEEIPCFTFTALAEKDKNCNAFVAALLELVKEDAYASIDGSGSNALLIRLRELYPSVIETLAWTGLQTLNAELFPSTQRMVQALRELIETTGLYFGAVPKASSSKEHFYHSVACVGDVLPNVDDHPPPQLKKI

SEQ ID NO: 165084 - protein, 171 aa, Heterodera glycines
  misc_feature (81)..(81): Xaa can be any naturally occurring amino acid
  Homolog annotation: Hit_ID=EAL24286.1; Match level="QueryCoverage =88%, HitCoverage=34%, E-value=3e-33, Identity=46%"; Hit description =ankyrin repeat and MYND domain containing 2 [Homo sapiens] ref|NP _064715.1| ankyrin repeat and MYND domain
  Gene Ontology: Mol. function=structural constituent of cytoskeleton; Cellular component=membrane
  Coding regions on vcDNA: vcDNA=SeqID_91507; Strand=+; Position=9-522
MLNQKDNFTLKELTNQTDEEKQLFQLINEDKIEEAEELVKSGKVRVNSLDNSGMNALDHACFKGNEALVEFLLGNGSDSDXRAHSDGYTALMFAALAGNGRICQLLLDAGANAHAQNNIGKTAAELAAFVGQHECVSIISNYISLRDVDAILHPQGADSAVLYPPELAKFI

SEQ ID NO: 165085 - protein, 82 aa, Heterodera glycines
  Coding regions on vcDNA: vcDNA=SeqID_91508; Strand=-; Position=2-247
NYSFAQQSSVLSEARLLADFFGVEQHKQRTPVQLVLGQIRCFNADQRAAFDRIANALHGRGDQKCLVSRVQEDVVTDFFNIF

SEQ ID NO: 165086 - protein, 109 aa, Heterodera glycines
  Coding regions on vcDNA: vcDNA=SeqID_91509; Strand=+; Position=174-503
PTNSLLTLAEPRPNMAIVVATLDALRSAASAGGRSLGLSLPMALLLLTLLFWHWHRGRRAHRHTFPPGPTPLPLIGNLAQVSLKWSKRRGDKMPKREGEVGQNAKKGGT

SEQ ID NO: 165087 - protein, 131 aa, Heterodera glycines
  misc_feature (78)..(78): Xaa can be any naturally occurring amino acid
  Homolog annotation: Hit_ID=EAL24801.1; Match level="QueryCoverage =98%, HitCoverage=37%, E-value=7e-17, Identity=31%"; Hit description =GA10823-PA [Drosophila pseudoobscura]
  Coding regions on vcDNA: vcDNA=SeqID_91510; Strand=+; Position=2-394
LENIRRIDQFARKVIEHCTHAALVHFSIEQNNWLKTEEDGPLFIYERLDQPLNSMIVFFRQAPKKYVEPITDGMQLRXEPPYIFVQREDGCIRGLWAFGENKCEPVFDTPTNVSMELKKKSAGATASSPKN

SEQ ID NO: 165088 - protein, 79 aa, Heterodera glycines
  Coding regions on vcDNA: vcDNA=SeqID_91511; Strand=-; Position=121-360
ESCQGKASDCLRLKLEYSVQCLDYFMGPNCDLICAREGKSQNSKLHGGINRISTDQQENRKQTGTVSLAFWEHGTGKHT

SEQ ID NO: 165089 - protein, 78 aa, Heterodera glycines
  Homolog annotation: Hit_ID=NP_741633.1; Match level="QueryCoverage =100%, HitCoverage=16%, E-value=6e-11, Identity=39%"; Hit description= OSMotic avoidance abnormal OSM-6, protist raft-like and intraflagellar transport protein component IFT52
  Coding regions on vcDNA: vcDNA=SeqID_91512; Strand=+; Position=2-235
FEVIHQFLSDGFELNQIHDAEPNISDFHPIADSLQLSNQPKMCLPESEIEHTFTGDLIELIGTSLCSISLEHWTEVIR

SEQ ID NO: 165090 - protein, 65 aa, Heterodera glycines
  Coding regions on vcDNA: vcDNA=SeqID_91513; Strand=-; Position=264-461
TLLINSCRMISNLSGFDHFKRLEVPHFVQFFEFSTGTKNIFLPFPHLRSSFPDKGRSPGVRGISK

SEQ ID NO: 165091 - protein, 120 aa, Heterodera glycines
  Coding regions on vcDNA: vcDNA=SeqID_91514; Strand=-; Position=8-370
GALFSRKRTTPMSFLKSGRYDSKHLKMNATPRESSLKRRPFFRGALFSRKRTTPMSFLKSGRMTQTKHLKMNATPRESSLKRRPFCRGALFSRKRTTPMSFLKSGRYDSKHLKMNATPRD

SEQ ID NO: 165092 - protein, 186 aa, Heterodera glycines
  misc_feature (130)..(130): Xaa can be any naturally occurring amino acid
  Homolog annotation: Hit_ID=NP_506192.1; Match level="QueryCoverage =100%, HitCoverage=29%, E-value=9e-68, Identity=68%"; Hit description= ATP-binding cassette sub-family F member like (69.2 kD) (5N242) [Caenorhabditis elegans] emb|CAA99835.1|
  Gene Ontology: Mol. function=translation factor activity, nucleic acid binding; Cellular component=cytosolic ribosome (sensu Eukarya); Biological process=protein biosynthesis
  Coding regions on vcDNA: vcDNA=SeqID_91515; Strand=+; Position=2-560
GEQFTVSQQTKTDAQLSLMETAVDIKVENFDISADGRQLFNKASLTIAIGRRYGLVGPNGMGKTTLLKHIAARKLAIPPNIDILYCEQEIEADKTSAIETVLRSDKVRTELLEREKALIIQLEAGDISAXEKLQEVTSELKNIGAEAAEPRARRILAGLGFNKQMQEKAGEDFSGGWRMRVSLARA

SEQ ID NO: 165093 - protein, 211 aa, Heterodera glycines
  Homolog annotation: Hit_ID=NP_871680.1; Match level="QueryCoverage =99%, HitCoverage=26%, E-value=8e-77, Identity=62%"; Hit description =FYVE type zinc finger containing protein (88.3 kD) (3O443) [Caenorhabditis elegans] emb|CAD45596.2| Hypot
  Gene Ontology: Mol. function=protein tyrosine/serine/threonine phosphatase activity; Biological process=cell growth and/or maintenance
  Coding regions on vcDNA: vcDNA=SeqID_91516; Strand=+; Position=3-635
QFNTNYAHCDTYPEQLWIPRGATTQILIASCRFRSRARLPVLTYFYGNNGAALGRSSQTLAGFSARCLEDESLMEVIMATNPFSTHLYLIDTRPRVNAMVNKVQGKGFEDTRNYTNIQFHFFDIENIHVMRASLNKLLEACQRTQTMTQYLKIVDACGWLRHLKTLIDCSVFIAESILRGISCDIHCSDGWDRTSQTVSLAQLVIDPFYRT

SEQ ID NO: 165094 - protein, 122 aa, Heterodera glycines
  Coding regions on vcDNA: vcDNA=SeqID_91517; Strand=-; Position=1-366
SFPRRYDNYYTIPNILCNTEPSSTAVEHHQSLAHIANNKNNNNENIATTVSQRWDSSGEPCPARESLPAGEPDNNHLPLMMREMPSGKMDDDDDDDDADDEQSSMGAAAEQLELQLVDSWSM

SEQ ID NO: 165095 - protein, 38 aa, Heterodera glycines
  Coding regions on vcDNA: vcDNA=SeqID_91518; Strand=+; Position=47-163
VLTMSPQCLECALLDQQTQCPLALACANKVNFFIYSSY

SEQ ID NO: 165096 - protein, 199 aa, Heterodera glycines
  Coding regions on vcDNA: vcDNA=SeqID_91519; Strand=+; Position=2-598
SHLSSVSPILPSPPLWPLWSTRPPVFAAPSTANSLHTPNSAAVRFPFSTCIGPMMSHFEMIGTDNQMFPQNVRLNPGLALCSSAPFGGHIGTSLPSAVTVSPAAVASVGGGELQQFAIPRISQQSQAQPVQGLQFALGQSAIFGGESARDGGGQQTQHLFDLSNSIICTNGSSMANASVISMAAAISKGSLLSQCQSQQ

SEQ ID NO: 165097 - protein, 209 aa, Heterodera glycines
  misc_feature (75)..(75): Xaa can be any naturally occurring amino acid
  Coding regions on vcDNA: vcDNA=SeqID_91520; Strand=-; Position=2-630
SIIIYLCINFFLLWHLFTHLPITFCHLLFMCQIGIIITMAPFFVPFCRNFLALFCPLISQFISCQFLALLCPNFXLYFANFAHFCAKFPYLFLANFWHSFATIFNPFFCQFLHIFVPNFPIYFLPNFCTFLCQISLFISGQFLAFVFPIFSFKKYLKSWRSVFFKIKLWHSVFSNLKIISTLCIFFSNLKIILTLDILFFSNLKIIFTL

SEQ ID NO: 165098 - protein, 202 aa, Heterodera glycines
  Homolog annotation: Hit_ID=CAE66976.1; Match level="QueryCoverage =95%, HitCoverage=29%, E-value=6e-20, Identity=30%"; Hit description =Hypothetical protein CBG12372 [Caenorhabditis briggsae]
  Gene Ontology: Cellular component=nucleus
  Coding regions on vcDNA: vcDNA=SeqID_91521; Strand=+; Position=7-612
MKISEETIRKRLQSINQTQEAVQTCSKWVLHNREMIDRIATCWMDIYKKAPEKLRIALIYLLNDVVQKAASKKDNNVTLALHPHWINATAMSNVNVKKAISRCVEVLEQRNVYPAHIIEEMKAALVSRIATEKDDSQSGEIDFSQMARSIDSFFKNEVLTEKAREILARSSFNFKESVQSRVKDREEGVKALADMDTSRQKM

SEQ ID NO: 165099 - protein, 189 aa, Heterodera glycines
  Homolog annotation: Hit_ID=CAE73347.1; Match level="QueryCoverage =73%, HitCoverage=33%, E-value=6e-14, Identity=32%"; Hit description =Hypothetical protein CBG20779 [Caenorhabditis briggsae]
  Coding regions on vcDNA: vcDNA=SeqID_91522; Strand=+; Position=67-633
MSTIIRKNEQRANDKNPGKKLEYEASVFILSEVFGEIFDQQKGVHLFMNGVLSIVEKSTGVFIEWKPCGTTPLTALPDHDDTEWVIEGEEAGEEENGTRGKQQKNADSNLRQSLSLDLNSIRSFIHGNLKKAPIWLRFICKDGTESDTYYFRGGGYESLVNCLQRYVFLTRSAKSDNLILISDSRTDAL

SEQ ID NO: 165100 - protein, 214 aa, Heterodera glycines
  Coding regions on vcDNA: vcDNA=SeqID_91523; Strand=+; Position=1-642
TNRRRESMDQHWPRSVNAHLNNHASHQQLQHSVGSPYMVASIPSTPSCSALVGPHCAVVEPLTPSAISSAFSHNNLATTAAHHQQQHNNSNHYASCNSTNAMSSSNLMVAASPYTRSASSVIHSHGARFGSDQPQTQQLQQHCIYHADGSMYNNSTLVEPGGVHGLHPLSTATSSSTLVVNINNNNGTGNAAVGANAATTPGSTPNTQRKQHRR

SEQ ID NO: 165101 - protein, 197 aa, Heterodera glycines
  Coding regions on vcDNA: vcDNA=SeqID_91524; Strand=+; Position=1-591
AKPTELEEISSDLSTVPTQIHVSIPENLMNFDGTELIDLPIDKCVIVYHCGISYGIEPELWKAKTMEKIDGDQIKQTQEMDTKQLEDYVTVYHHGWYGRFEDEQQQQLIDEEEEQKRQFDKSETDRIALSVEQKKEQLAAVDHKKKSHELSDNSVEPMEDKIEDGIKTIDTFEKKPAEKEEQTLIIDQQKRTDGRVT

SEQ ID NO: 165102 - protein, 156 aa, Heterodera glycines
  Homolog annotation: Hit_ID=NP_001004509.1; Match level="QueryCoverage= 91%, HitCoverage=9%, E-value=2e-19, Identity=37%"; Hit description =si:busm1-180o5.3 [Danio rerio] emb|CAD60788.1| novel protein similar to DNA polymerases [Danio rerio]
  Coding regions on vcDNA: vcDNA=SeqID_91525; Strand=+; Position=30-541
MKKFFESVPDKGPINPRDAYAGGRTMPFCLYAKATEEIEISMFDIISLYPFVNYDTPYPVGVPKIVVSRNFNVNWTVPDDIPYDGLLKVKVVPPKNLLYPLLPVHIDDMLLFPNCWACAKRAKNEFVMTKDVKKCNHRPAQRAFLGTFTSIELRKA

SEQ ID NO: 165103 - protein, 29 aa, Heterodera glycines
  Coding regions on vcDNA: vcDNA=SeqID_91526; Strand=+; Position=204-293
QTLMFIKNMTHIIVSLLTQITNTNVLSKT

SEQ ID NO: 165104 - protein, 211 aa, Heterodera glycines
  Homolog annotation: Hit_ID=NP_991215.1; Match level="QueryCoverage =74%, HitCoverage=21%, E-value=1e-13, Identity=37%"; Hit description =hypothetical protein zgc:77390 [Danio rerio] gb|AAH65662.1| Hypothetical protein zgc:77390 [Danio rerio]
  Gene Ontology: Mol. function=small GTPase regulatory/interacting protein activity; Cellular component=actin filament; Biological process=regulation of protein activity, epigenetic
  Coding regions on vcDNA: vcDNA=SeqID_91527; Strand=+; Position=2-634
ARHTDELVTPGTSPIPPPPPPPAPRPFHSPPLPPQGNRNFSPPCLLPPSPSGTVNFLHTPPPPPPPRPAIHQPHTSPMPPRMAPPDTMMRFNTPRLAPMSLRLEPWQMFPSATPRQRMMAPTVPSHPQIQPMLPATTGGTMSHFSNKELLEDNRVGCSSAGGGRGGGAGSKRKAGEFFEELTTSPMPPRMAPPDTMMRFNTPRPAPMSLRM

SEQ ID NO: 165105 - protein, 89 aa, Heterodera glycines
  Coding regions on vcDNA: vcDNA=SeqID_91528; Strand=+; Position=346-615
FHFSSLFLRIFKSANVASGHWHAMATICTNLACISITYYCTFKFFRLFMGFLTNDKINICELKRSKPRSMEFLSLKYFCPISISKKEPT

SEQ ID NO: 165106 - protein, 108 aa, Heterodera glycines
  Coding regions on vcDNA: vcDNA=SeqID_91529; Strand=-; Position=326-652
TNLEKFLFEVSLDEPFAFASIWVLKFLVSRYSSYAKYYLFKLRHLLSCNSNSSLYKLLSLIKLTDVTLHPIDNLFKDRNCNTRHREDKIVRQLIGVHVQRLEKIHIKV

SEQ ID NO: 165107 - protein, 106 aa, Heterodera glycines
  Coding regions on vcDNA: vcDNA=SeqID_91530; Strand=+; Position=103-423
RSQFLSLFVPKRQPGTLNLLKSCFLIFFITYNISLYIYLIYFFLFDKKINFKKVPIKAYCNHENKNELIFQHNFISFFHMYSIKFDDRKKTLSLKKCVGKSIFLKF

SEQ ID NO: 165108 - protein, 183 aa, Heterodera glycines
  Coding regions on vcDNA: vcDNA=SeqID_91531; Strand=+; Position=9-557
SSNFPLFVTVKMNTSTAFTDKDLQLKLPFGMIISGPSSSGKSTFLLKLIAESKDLIDPSPVEILYCFGEMSSTVPVLQKAGISVYAGVPPEEFIRSQSKPLLLILDDLLTSIDEKYLSELFTKKSHHQNFAVIFVTQNLFERKIKVARQNAQYVVLMRSPNSTLAVRNLGVQLFPRQLDYFLD

SEQ ID NO: 165109 - protein, 94 aa, Heterodera glycines
  Coding regions on vcDNA: vcDNA=SeqID_91532; Strand=+; Position=327-608
IIIFVKLLICGISLLLPQFSAFSLLRLLSPRNSSTIRTKFWIFPGWTLSQTLSIIRVIMEMIKQIILIGFLGYLKVSEEHQLFYWLVTSQRNAS

SEQ ID NO: 165110 - protein, 115 aa, Heterodera glycines
  Homolog annotation: Hit_ID=NP_499891.1; Match level="QueryCoverage =100%, HitCoverage=30%, E-value=3e-26, Identity=50%"; Hit description= parvin alpha, Paralysed Arrest at Two-fold PAT-6 (43.0 kD) (pat-6) [Caenorhabditis elegans] gb|AAC48090.
  Gene Ontology: Mol. function=actin binding; Cellular component =lamellipodium; Biological process=cell adhesion
  Coding regions on vcDNA: vcDNA=SeqID_91533; Strand=+; Position=2-346
DDQAEIVQKMGKDAIDSCLILPQPDLRHLEDGQSLRTLTIESRDDPKVQEICQLMLYWLNNELAEERIVVRNLQEDIYDGQVIQKLTDKLAQVKIEVPEVSQSEEGQKQKWRIIV

SEQ ID NO: 165111 - protein, 118 aa, Heterodera glycines
  Coding regions on vcDNA: vcDNA=SeqID_91534; Strand=+; Position=69-422
QNILREWPIRGNVVFPGILSLSAALPHFGSLLFPDDVHSALRQQLLRVFSEYVTIIKYQIARHNRLFGRRVVQFQRNFFLGLNKSRGLCNNTEKWTLDTLNRVGPNTFEIFSNEAKLR

SEQ ID NO: 165112 - protein, 49 aa, Heterodera glycines; identical to SEQ ID NO: 141744
  Coding regions on vcDNA: vcDNA=SeqID_91535; Strand=+; Position=2-148

SEQ ID NO: 165113 - protein, 115 aa, Heterodera glycines
  Homolog annotation: Hit_ID=CAE62309.1; Match level="QueryCoverage =82%, HitCoverage=6%, E-value=8e-37, Identity=76%"; Hit description =Hypothetical protein CBG06373 [Caenorhabditis briggsae]
  Gene Ontology: Mol. function=phospholipase C activity; Cellular component=inaD signaling complex; Biological process=response to abiotic stimulus
  Coding regions on vcDNA: vcDNA=SeqID_91536; Strand=-; Position=288-635
SGQKEYLTRERLLQFLNEEQRDPRLNEILFPHFDQERVQQLIAKYESDESYIAQGKMSGDGFLRFLLSDENAPVFLSWNERYQDMDQPLCHYFINRWRRMAMDILWLLGIRIWHF

SEQ ID NO: 165114 - protein, 142 aa, Heterodera glycines
  Coding regions on vcDNA: vcDNA=SeqID_91537; Strand=+; Position=1-426
IGTSKAKPPKLIRLLIDRVGPVSLFLHFLAFAYAVFVISHFGTEKAKIQENALLAGLVEENWKDTSKLDHFLRDLRRNVGDKNSELRDYIVNALVEMGVEVAKHSFRLTPSSFLNNSSVDKVNVYGIVRSFRANPAESILLA

SEQ ID NO: 165115 - protein, 145 aa, Heterodera glycines
  Coding regions on vcDNA: vcDNA=SeqID_91538; Strand=+; Position=3-437
SLRPIDIFGSTSSILELSNFQMANESAPYEFILSVSFEDGHSYNSTLKLFVHAYPQIPVIDAQNLTVNLRADSVMLKAHISNGSADVFLNFTWMQTDGPSRVDLANRHSLSSASIVGPFNASGIYSFRVKAVTIAEDVVEASLFV

SEQ ID NO: 165116 - protein, 212 aa, Heterodera glycines
  misc_feature (81)..(81): Xaa can be any naturally occurring amino acid
  Homolog annotation: Hit_ID=CAE59694.1; Match level="QueryCoverage =100%, HitCoverage=42%, E-value=2e-39, Identity=40%"; Hit description= Hypothetical protein CBG03118 [Caenorhabditis briggsae]
  Gene Ontology: Mol. function=sodium-dependent phosphate transporter activity; Cellular component=integral to membrane; Biological process=phosphate transport
  Coding regions on vcDNA: vcDNA=SeqID_91539; Strand=+; Position=3-639
FVNETEKQKIARGRDTEIAKAQTHVPYREILCSGAVWAVFFGGIGNFTAINLLYQFTPTYLYKVQGFEVVKTGFMAALPPXVLAVMKECAGLINDRIPARIMSETVKTKLFNSIAFMSMSAVIVAVSFVPSGYGNLALFLLTFSAFTLGFNIGGFYKSGSMIAGPYSPFVMGQISTAMTVTMLTVPVIVNPLTINNTREEWALAFYVNAAII

SEQ ID NO: 165117 - protein, 179 aa, Heterodera glycines
  Coding regions on vcDNA: vcDNA=SeqID_91540; Strand=-; Position=51-590
HSFAFFPSPFSFPITFLCSSPSCTTIVSPLLCFCTPAALLCCPKCVPFVSFGIGRVHGGRRKQMLPLLCWSMFVYLLSFDCCSPHRSLKWRFFLALALANEATNVPFQVVERCEKKQTTTKKIGPILRDRRGKKGEEKKPKGDIRRRRVKSEVIGGSGTEKWGGGGESAWGGGIRVKRN

SEQ ID NO: 165118 - protein, 122 aa, Heterodera glycines
  Coding regions on vcDNA: vcDNA=SeqID_91541; Strand=+; Position=3-371
FLFSETEDGDFASFKLLLLRKPLFVDILQNFLERLLRNWPLDESYCLLIEIWQTLIYHKLLNRCSDEKYKLFVQMSSQYFVDLIETQIQRMLTTDPKNLVESPVLSYAKENIFRCEPILGFF

SEQ ID NO: 165119 - protein, 148 aa, Heterodera glycines
  misc_feature (60)..(60): Xaa can be any naturally occurring amino acid
  misc_feature (73)..(73): Xaa can be any naturally occurring amino acid
  Homolog annotation: Hit_ID=NP_001003255.1; Match level="QueryCoverage= 100%, HitCoverage=40%, E-value=1e-22, Identity=41%"; Hit description =annexin XIIIb [Canis familiaris] emb|CAA56507.1| annexin XIIIb [Canis familiaris] pir||B57076 annexin
  Gene Ontology: Mol. function=phospholipid binding; Cellular component= cytoplasm; Biological process=skeletal development
  Coding regions on vcDNA: vcDNA=SeqID_91542; Strand=+; Position=2-445
IHLLPSPTTAQRPKLLPNYRTTYGGADLASALNFELPPSEVATHTLYLALMDTPTEHDAXLLADAMKGLGTNXYMLIEILVTRSDAQLRAVNAAYQKLYCHGLDNDLSADTNGSYWTLLLDLVEANRDESYRTDLDKAKTDANKLFQA

SEQ ID NO: 165120 - protein, 140 aa, Heterodera glycines
  Coding regions on vcDNA: vcDNA=SeqID_91543; Strand=+; Position=174-593
MNIQGVFSSEAVSKIAYKMTPILDVLFVDELLKVSIGQTEGKLGLQLTQNPEIPDEEANFAAIQFDFSKNIHIELEMLAEGDAKIANFDHIFTRKLETFSNKFDEIFPIDHQEGSDSFNRLGKIALSNLLGGIGVWHGYS

SEQ ID NO: 165121 - protein, 186 aa, Heterodera glycines
  Coding regions on vcDNA: vcDNA=SeqID_91544; Strand=+; Position=3-560
FSMTGTFPSEPTFAAASSNAVVDDGGESHQTERPTETEDTSAAFLPHNISLRSVIERFGEENVLKEWTEEDCAGLLVQLLKNFCDYEVAKRIVRCFRETSVDEINDCFNLCKELNKRAANERVRMGNCVSCAPLPQESLPTFPNWSSVLAQAKKSQGIPDDSSAVVAKMLSEISAKYNDANFAPDS

SEQ ID NO: 165122 - protein, 66 aa, Heterodera glycines
  Coding regions on vcDNA: vcDNA=SeqID_91545; Strand=+; Position=3-203
LIVPSGEDTEKAAEQGQHSGAWNLDGEILLQPSDRPLHFRLHPGLIRYFGLAEEVELDKRGSCCCC

SEQ ID NO: 165123 - protein, 89 aa, Heterodera glycines; identical to SEQ ID NO: 131732
  Coding regions on vcDNA: vcDNA=SeqID_91546; Strand=-; Position=261-530

SEQ ID NO: 165124 - protein, 142 aa, Heterodera glycines
  misc_feature (26)..(26): Xaa can be any naturally occurring amino acid
  Homolog annotation: Hit_ID=CAA65506.1; Match level="QueryCoverage =92%, HitCoverage=47%, E-value=6e-45, Identity=60%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Coding regions on vcDNA: vcDNA=SeqID_91547; Strand=+; Position=95-524
MQNEVDFCKMRPGPEGQNGQPGIFGXPASPGRPGPQGPPGPDGQPGNPGESGQPGQPGKLTQGPPVVGPPGPSGPPGQPGQPGENGQPGQPGNPGPQGYPGDGGSPGQPGNPGGSGEPGQPGAQGSSGQCYHCPPPRTAPGY

SEQ ID NO: 165125 - protein, 63 aa, Heterodera glycines
  Homolog annotation: Hit_ID=CAB88203.1; Match level="QueryCoverage =100%, HitCoverage=21%, E-value=8e-10, Identity=52%"; Hit description= putative cuticular collagen [Globodera pallida]
  Coding regions on vcDNA: vcDNA=SeqID_91548; Strand=+; Position=2-190
CSLVTIGGPVLPLDSLYSWMSLMSWKMSHSVEAFRINPSSDWTALVDVQLVVTPRSNPRENSF

SEQ ID NO: 165126 - protein, 193 aa, Heterodera glycines
  Coding regions on vcDNA: vcDNA=SeqID_91549; Strand=+; Position=2-580
KTEGKATKKGRLQKRRTTPYDIWEDEGEQITATTKCKRVKYVPNLLPAVVPPPEGMSYNPPIDSYLRMAVIIANEERQIEKKRRRTERRIGIGTDEVATLPALREEVTYSVRGGGGVTVRMEEEKVKDEMAGGEDEKVSPNELRLQKRKTAKEKKRRKLRMEEERKKTAEKEVEGKMRRQLDSLKSLKAQVLK

SEQ ID NO: 165127 - protein, 172 aa, Heterodera glycines
  Coding regions on vcDNA: vcDNA=SeqID_91550; Strand=+; Position=73-588
MARLHSCDWEPQKWRRKSSKDIATPVPRKCRTANCSFAKTAISQPKSSSSVPSVLFVRIFQHTVVTLDCLASERDRELAALRIEEILNHAQRMVDESRGMQNDIAKQFETMRENLLAKLSFFYALQNECLNGEQILLKEHIEEKVYSAIHKCEQLNEHFLRLRELKSEFEQH

SEQ ID NO: 165128 - protein, 96 aa, Heterodera glycines
  Coding regions on vcDNA: vcDNA=SeqID_91551; Strand=+; Position=3-293
ICFWGTLTTVSYGICAALFLWQFFTRFRHNVLLSEHTSAGFSSEGCVRLGFSFWLLISAVLAQFASCVLLFWALKGRFKQTNEEQKSKEQDTVFLY

SEQ ID NO: 165129 - protein, 185 aa, Heterodera glycines
  misc_feature (62)..(62): Xaa can be any naturally occurring amino acid
  Homolog annotation: Hit_ID=CAE60450.1; Match level="QueryCoverage =98%, HitCoverage=27%, E-value=8e-58, Identity=59%"; Hit description =Hypothetical protein CBG04058 [Caenorhabditis briggsae]
  Gene Ontology: Mol. function=oxysterol binding; Cellular component =cytosol; Biological process=Golgi to plasma membrane transport
  Coding regions on vcDNA: vcDNA=SeqID_91552; Strand=+; Position=3-558
ASVLERRSLLEMYADFFAHPDELVSAAYETTPEKRFLAVLKYYLNSFFPARKSGVAKKPYNXILGETFRCRWTLPDVPLNTEQTTRGPFPGSASNQLTFIAEQVGHHPPISAFYAEHPASGVCCTSYIYTESYVAGFSSLGVRNIGRATVVLGNHNETYTATFPDAVARNCHATPWFELTGKVKV

SEQ ID NO: 165130 - protein, 105 aa, Heterodera glycines
  Coding regions on vcDNA: vcDNA=SeqID_91553; Strand=+; Position=19-336
MEVWPTFHLLTDYVPEYGKVRVEGGVRYKLVFDNSGGTFFSREVKYGLRVKKVEESEEEEREHGAKEAEKTNGVTSWGEERQSVARDTEEEKENTIRDGEGKAKN

SEQ ID NO: 165131 - protein, 57 aa, Heterodera glycines
  misc_feature (38)..(38): Xaa can be any naturally occurring amino acid
  misc_feature (46)..(46): Xaa can be any naturally occurring amino acid
  misc_feature (52)..(52): Xaa can be any naturally occurring amino acid
  Homolog annotation: Hit_ID=CAB88203.1; Match level="QueryCoverage =100%, HitCoverage=54%, E-value=3e-22, Identity=63%"; Hit description= putative cuticular collagen [Globodera pallida]
  Gene Ontology: Mol. function=structural constituent of cuticle; Cellular component=extracellular; Biological process=reproduction
  Coding regions on vcDNA: vcDNA=SeqID_91554; Strand=+; Position=2-172
VVSRPIPGPKGPPGAPGQNGNPGKQSQPGQPGGQGPPXGPSGAPGXPGQPGXSGQPG

SEQ ID NO: 165132 - protein, 162 aa, Heterodera glycines
  Homolog annotation: Hit_ID=CAB40412.1; Match level="QueryCoverage =78%, HitCoverage=26%, E-value=2e-31, Identity=56%"; Hit description =hexokinase [Haemonchus contortus]
  Gene Ontology: Mol. function=glucokinase activity; Cellular component= soluble fraction; Biological process=cell glucose homeostasis
  Coding regions on vcDNA: vcDNA=SeqID_91555; Strand=+; Position=49-534
PLRQLASKCFRRTSARLLLAKKRANSWHWTSAEPIFVSDIEGFMHSTDGNPFAKVGEMLRAIGISNSSAADCANVAYVSSLIGTRAAHLCACGLAAILNRMQRPRVTIGVDGSVFRFHPTFKFNLDQKIKALLAVKCEFFMVLSEDGSGRGAAVAAAVALRM

SEQ ID NO: 165133 - protein, 105 aa, Heterodera glycines
  Coding regions on vcDNA: vcDNA=SeqID_91556; Strand=+; Position=75-392
RHTHHNPHDHSSKRGEGPDCQGEAARCQAEEGGSWTRRIHKKSAAGERCAICMTNVSFFTRTTLGCTHPFHRRCLYRWIRYHTNCPVCRYNFARTIPRGERNQPL

SEQ ID NO: 165134 - protein, 158 aa, Heterodera glycines
  Homolog annotation: Hit_ID=AAL78214.1; Match level="QueryCoverage =94%, HitCoverage=75%, E-value=7e-10, Identity=28%"; Hit description =putative esophageal gland cell protein Hgg-20 [Heterodera glycines]
  Coding regions on vcDNA: vcDNA=SeqID_91557; Strand=+; Position=85-558
MNRRWICNDVWMDIFPSFDRAQLGLKLALLSPRFNALVDKHFDGKSELTIWRSIFISKDKGPEPKLSVRIDDKFVPFPFPDDRPLPSKIRFKDLRIDYIDHSVIAFLRSNHQIFDKRGINLYLWIPSPHNTDGQPIWDIFGREIWPIFSANIRCLGFT

SEQ ID NO: 165135 - protein, 129 aa, Heterodera glycines
  Homolog annotation: Hit_ID=XP_416168.1; Match level="QueryCoverage =93%, HitCoverage=21%, E-value=6e-15, Identity=36%"; Hit description =PREDICTED: similar to AIDA-1a [Gallus gallus]
  Gene Ontology: Biological process=reproduction
  Coding regions on vcDNA: vcDNA=SeqID_91558; Strand=+; Position=180-569
AEGAFEGGQCSRFSAHYLGSTEISNVEGTEDCRRAMQSAKNRVRQMADVPWVVLEISVTGINIRENDNKLFYRHPIANIQVVCQDEVDLNCFAYIYQEGDRHFCYVFCVLTAIIAKEIIVTLGETFNLA

SEQ ID NO: 165136 - protein, 76 aa, Heterodera glycines
  Coding regions on vcDNA: vcDNA=SeqID_91559; Strand=+; Position=66-296
TESGRWWSSATEHRRGHRAVATGHPSAGTKRKRQNCRVGIAERGRHGAVRNLRKDSDRSVLHHHNHHFSDLRVHVY

SEQ ID NO: 165137 - protein, 133 aa, Heterodera glycines
  Homolog annotation: Hit_ID=AAH48327.1; Match level="QueryCoverage =75%, HitCoverage=20%, E-value=4e-18, Identity=47%"; Hit description =KIAA0934 protein [Homo sapiens]
  Coding regions on vcDNA: vcDNA=SeqID_91560; Strand=+; Position=26-427
LIFIFKVIANPKTLGQCAGKIQKYLKSEFASITPSVSFVCSDTHLGEIWVSSGHNASGFFSLFSEEAHLQTNHFNAKLKTGDTNTAFARTGYLGFLRQTQAITADGGGRRERTTGRGAKGMANDMRHLRRNNI

SEQ ID NO: 165138 - protein, 92 aa, Heterodera glycines
  Coding regions on vcDNA: vcDNA=SeqID_91561; Strand=+; Position=75-353
MGGTRNYEYESAAGVVGTSAASGAAVTHQWPDDLIEIVHEPMGHTLDRMRRFSTSLSNVEGREGAAAESEKVEEKYRRTYREEYSGNGAERR

SEQ ID NO: 165139 - protein, 108 aa, Heterodera glycines
  misc_feature (88)..(88): Xaa can be any naturally occurring amino acid
  Homolog annotation: Hit_ID=EAL28191.1; Match level="QueryCoverage =65%, HitCoverage=22%, E-value=5e-17, Identity=61%"; Hit description =GA11580-PA [Drosophila pseudoobscura]
  Gene Ontology: Mol. function=glyoxylate reductase (NADP) activity; Biological process=metabolism
  Coding regions on vcDNA: vcDNA=SeqID_91562; Strand=+; Position=18-341
MAQNSSTKAKIVVTDSTVSVKKLAEFGDVCQFSGNGQMPREMLLRELADAEALFCLLRDKIDDELLARAPKFFVLSTMSVGYEHIDFXACTKRGIRIGYTPGVLTDAT

SEQ ID NO: 165140 - protein, 47 aa, Heterodera glycines
  misc_feature (8)..(8): Xaa can be any naturally occurring amino acid
  Coding regions on vcDNA: vcDNA=SeqID_91563; Strand=-; Position=202-343
PPQPPPPXPTPLLPTCFFIGSHQSRLNRKVSFICNLLFFLKPIFSKF

SEQ ID NO: 165141 - protein, 90 aa, Heterodera glycines
  Coding regions on vcDNA: vcDNA=SeqID_91564; Strand=+; Position=2-274
CLPGSAFSLPNWFRLVLAFPEETTREACERIAAFCTRHMRPCRKQLALWGSQLDEEDGRGSEGAERTAAEESTSGEEEEDGHILSERSAE

SEQ ID NO: 165142 - protein, 170 aa, Heterodera glycines
  Homolog annotation: Hit_ID=AAG21338.1; Match level="QueryCoverage =37%, HitCoverage=73%, E-value=6e-09, Identity=49%"; Hit description =hypothetical esophageal gland cell secretory protein 9 [Heterodera glycines]
  Coding regions on vcDNA: vcDNA=SeqID_91565; Strand=+; Position=3-512
YYCSPNFVDHFLRNQQHKTMMMMSSAAMLFVMITLALISFGCSIGAVKSEGDDESGAVRHSHELISRIKRYGYWYNSYGYGGGCACAPVPVTSSCYSCGSGGGGYGYSSYQPVPPPPPPMQPSYSSCATCGGGYGGYGGGLSGYSSSWNNGGSASSSWNNYGSSSSMSVG

SEQ ID NO: 165143 - protein, 57 aa, Heterodera glycines
  Coding regions on vcDNA: vcDNA=SeqID_91566; Strand=+; Position=1-171
SGGGGEAAAPAPEAAPAAEAAAPAPAEQPAAEQPAPAPAAEPAKQQASGYRRKRNQN

SEQ ID NO: 165144 - protein, 194 aa, Heterodera glycines
  Homolog annotation: Hit_ID=EAL47348.1; Match level="QueryCoverage =53%, HitCoverage=63%, E-value=4e-25, Identity=53%"; Hit description =ubiquitin-conjugating enzyme, putative [Entamoeba histolytica HM -1:IMSS]
  Gene Ontology: Mol. function=ubiquitin-protein ligase activity; Cellular component=cytoplasm; Biological process=establishment and/or maintenance of chromatin architecture
  Coding regions on vcDNA: vcDNA=SeqID_91567; Strand=+; Position=3-587
FPASFPFYPPTMTFLTDILHPNIDTSGKVCISILHPPGIDPLGYEQAAERWNRNRTVESILVSIQLLLVEPNFNSPANVDAAVLFRSDPARYREEVRRRVEMEIARTAPILPGAQPPPEEQGTQPPEEQGTTQAAEEQRAQPPEEQGTQPPEQQGTTQPLEQQVTTQAVEEQGTQQPATPPPEGPQQQTDEWYM

SEQ ID NO: 165145 - protein, 93 aa, Heterodera glycines
  Coding regions on vcDNA: vcDNA=SeqID_91568; Strand=+; Position=6-287
MLSSSACCTLLAALISAAFFAMANAQTVKQCLCSEIQPCSEKYMNTWKTCMQQCKGHFSSVGGDVEKLGHCLDSNQALLQSIIRCTQSHGDES

SEQ ID NO: 165146 - protein, 71 aa, Heterodera glycines
  Homolog annotation: Hit_ID=JS0167; Match level="QueryCoverage=100%, HitCoverage=21%, E-value=2e-20, Identity=70%"; Hit description =collagen col-6 - Caenorhabditis elegans gb|AAA27991.1| collagen
  Coding regions on vcDNA: vcDNA=SeqID_91569; Strand=+; Position=2-214
QETDEHRQMRRVTFEADVVSTGAVNASVATLTMLYNYGQTFFICLMAETDYCKARARDMWLEMTSLRIGKG

SEQ ID NO: 165147 - protein, 168 aa, Heterodera glycines
  Homolog annotation: Hit_ID=AAL78214.1; Match level="QueryCoverage =83%, HitCoverage=75%, E-value=8e-10, Identity=29%"; Hit description =putative esophageal gland cell protein Hgg-20 [Heterodera glycines]
  Coding regions on vcDNA: vcDNA=SeqID_91570; Strand=+; Position=87-590
MNRRWICGDVWMDILPSFDRPELGLKMALLSDRFDVLVDTHFDGKNELTIWRTINISKDKGPKAKLLGYWMDFPMPDRPLPNKIRFKDLRIEYIDHSVIKFLRANKQIWDRNGIKLELSIANVQYILDVFVREIWPIFATNIRYLSCRSVGQFASLYSPTILTDLNQL

SEQ ID NO: 165148 - protein, 189 aa, Heterodera glycines
  Coding regions on vcDNA: vcDNA=SeqID_91571; Strand=+; Position=1-567
AIADLREGGGRDGANGRVEVRIGRRIVDGHGRASGEGNETRDEGGGGRGRVRRTVSKRIQNNSNGHRNTHCRGFSPLAFRLTDQRQSVPFLLHFCKYFRLLGIPNRMHRSSLLSAWEPPTSSASILKNPEQQQPSLLSDITEVFSAQQNVLGPSTSIGKITEMTHNVPSQFNAQVTVKELISQSFGETK

SEQ ID NO: 165149 - protein, 205 aa, Heterodera glycines
  Coding regions on vcDNA: vcDNA=SeqID_91572; Strand=+; Position=24-638
MSSHPKPFWASSAEARQKRKEWRQERAQKGGSTPKSPRQTTEAPSTTGEGTSTETMPSTSNAEPRKCKNHKRLLLFSTEIRSIGTPFSMDIAALLGEIRELHVFGRADLLTTEQITDFSNKCLGIHGYFKKLWETYPTAFDTNNAAGFIPKLHWSLAHGPDFAKRWGWFAWISEQGIEHLHHVLNKQSERFFRYKGDELLLKIGE

SEQ ID NO: 165150 - protein, 210 aa, Heterodera glycines
  Coding regions on vcDNA: vcDNA=SeqID_91573; Strand=+; Position=1-630
PISKCTRCNIFKRPRQTSKFFTNTPMKSVVSPTPFRRPLSLRCVCSVLVLLICAFDVSLAAKDKEKNGKEEPGGPFNTLSIILLIPLVIVTGAFVYLLFMKPQSEGTGEDDGEGEGDADVEKGPTEETKTEPRIESPATLLGVTVPLEQDEEEQKKDDEGGDQTAEKKEEDAAAADEQPKEGAAEAAEAEKSATKEETTEDTEETTEGST

SEQ ID NO: 165151 - protein, 160 aa, Heterodera glycines
  misc_feature (60)..(60): Xaa can be any naturally occurring amino acid
  misc_feature (65)..(65): Xaa can be any naturally occurring amino acid
  misc_feature (79)..(79): Xaa can be any naturally occurring amino acid
  misc_feature (95)..(95): Xaa can be any naturally occurring amino acid
  misc_feature (101)..(101): Xaa can be any naturally occurring amino acid
  misc_feature (117)..(117): Xaa can be any naturally occurring amino acid
  Homolog annotation: Hit_ID=NP_510788.1; Match level="QueryCoverage =99%, HitCoverage=38%, E-value=4e-36, Identity=47%"; Hit description =Acyl-CoA dehydrogenase, medium chain, mitochondrial (XR828) [Caenorhabditis elegans] gb|AAB52493.1| Hypot
  Gene Ontology: Mol. function=acyl-CoA dehydrogenase activity; Cellular component=mitochondrial matrix; Biological process=fatty acid beta-oxidation
  Coding regions on vcDNA: vcDNA=SeqID_91574; Strand=+; Position=2-481
LIRFDLSEQHNDIRDGALKLTKQVVAPQAVDYQQTMASPCDIIKQAHHLGLMNPTLPAEXGGPGXSNFETALIAEALSXGCSAIQLAVTDSSVAXRSASLXGIQTEKRQYASMLATXPLIATDCVTHPRACSHMSGMKTNGELTRDKWMLNGSKACITGG

SEQ ID NO: 165152 - protein, 144 aa, Heterodera glycines
  Homolog annotation: Hit_ID=NP_501248.1; Match level="QueryCoverage =56%, HitCoverage=15%, E-value=5e-23, Identity=63%"; Hit description =inorganic phosphate family member (4I419) [Caenorhabditis elegans] gb|AAK29824.1| Hypothetical protein F4
  Coding regions on vcDNA: vcDNA=SeqID_91575; Strand=+; Position=3-437
GIKFLIKKNGYSWPRVSTSTKQSKTNFGKFQGVQTALLQLAPPFSGIITGIAFFVVSIFSIGNKVLTKWIVQNGTKDEWAVVFYVSAVVAALPVVVFSMWGSDQPQLWARSSSMKRTQNSIASTITTATTISVKRKECPDTAKI

SEQ ID NO: 165153 - protein, 76 aa, Heterodera glycines
  misc_feature (40)..(40): Xaa can be any naturally occurring amino acid
  Homolog annotation: Hit_ID=XP_214296.2; Match level="QueryCoverage =98%, HitCoverage=25%, E-value=2e-14, Identity=53%"; Hit description =similar to 6-phosphogluconolactonase [Rattus norvegicus]
  Gene Ontology: Biological process=pentose-phosphate shunt
  Coding regions on vcDNA: vcDNA=SeqID_91576; Strand=+; Position=2-229
AFHLLLLGLDPDGHTCSLCPGQPLLKEESVWIAPIDDSTXPPPRRVTDTILLLNADSNLTLNSHGRSKAACFPGIL

SEQ ID NO: 165154 - protein, 135 aa, Heterodera glycines
  misc_feature (106)..(106): Xaa can be any naturally occurring amino acid
  Coding regions on vcDNA: vcDNA=SeqID_91577; Strand=+; Position=66-473
AAARRMAGAPQPTRAKQYSPASGATAGGGGGALGPGYLAAAVGVATLLLFTMPDEPAYERPLEEWRERHNQNIENNIHPPPAPPQEEEEEHWAQAWPEEEEEAAPXAALNRGDFYLIGGVHDPISLRFEAAICAR

SEQ ID NO: 165155 - protein, 46 aa, Heterodera glycines
  Coding regions on vcDNA: vcDNA=SeqID_91578; Strand=+; Position=2-139
KKCNHIITFIISANTNSLCLTMPLAWTSVDTHNALLCAAVPSIGAF

SEQ ID NO: 165156 - protein, 160 aa, Heterodera glycines
  Homolog annotation: Hit_ID=XP_316911.1; Match level="QueryCoverage =79%, HitCoverage=12%, E-value=6e-10, Identity=32%"; Hit description =ENSANGP00000006552 [Anopheles gambiae]
  Coding regions on vcDNA: vcDNA=SeqID_91579; Strand=+; Position=2-484
DSQQKGRLTLKIEKFSDFSRGGESGTERYSDAVNIRGFSFKILANTYTMSADKSKKCLGFFIECNKNEPNWCCTCSATLQIVVQKKQKCSPPYIKQFKDNNFSAEKDDWGFKEFISIERLLNPANGWYNEKDDSVILVAEVFPYSPAYPPSWSQKRQWTD

SEQ ID NO: 165157 - protein, 162 aa, Heterodera glycines
  Homolog annotation: Hit_ID=CAE75352.1; Match level="QueryCoverage =96%, HitCoverage=63%, E-value=4e-40, Identity=49%"; Hit description =Hypothetical protein CBG23332 [Caenorhabditis briggsae]
  Gene Ontology: Biological process=glycolysis
  Coding regions on vcDNA: vcDNA=SeqID_91580; Strand=+; Position=1-489
EIWTQQDKKLTALKKLQGLIWEEGYRNGSLQSHVFPDVPKAFQTLSELGIPIFIFSSGSVHAQRLLFSHTQFGDISKFISGYFDTETGPKLESDSYRNIAKQINCPVGNVLFLTDVEKEAVSADEAGLQVRLFVREGNAPLSEDAAKKFKTLESFQNLLRID

SEQ ID NO: 165158 - protein, 208 aa, Heterodera glycines
  Homolog annotation: Hit_ID=CAE61802.1; Match level="QueryCoverage =76%, HitCoverage=54%, E-value=2e-47, Identity=61%"; Hit description =Hypothetical protein CBG05768 [Caenorhabditis briggsae]
  Coding regions on vcDNA: vcDNA=SeqID_91581; Strand=+; Position=24-647
MRYLLRIRNYNFLTKIGKSSVVQSQESPPSLLTDSKPFKKVLNSAVQYYEECIGLVEVHKARDEVNRCENNLFLAQQARREKQGEIKSLQNRLKDIHSELDRTQRGEDRYLHLLTEEHAAIKSERELLSSFEQLEANERDAFNLLSNKVRISHERERERDERTKYWSLTGSLLGAFLGIFGTTIANELRMKHIREMIPSGQQIQPLLK

SEQ ID NO: 165159 - protein, 107 aa, Heterodera glycines
  Coding regions on vcDNA: vcDNA=SeqID_91582; Strand=+; Position=1-324
AILWTLSLAEDPAEATRLFTKFVPASSEKCSKADFNRKAMPTGRKPHTQQKGAKIKGKRRCLSVYRSSHLIISHRCNFTGLFNFSMNCFKNPSEYSLQRDLQWVRVD

SEQ ID NO: 165160 - protein, 152 aa, Heterodera glycines
  misc_feature (67)..(67): Xaa can be any naturally occurring amino acid
  Homolog annotation: Hit_ID=NP_740998.1; Match level="QueryCoverage =93%, HitCoverage=54%, E-value=2e-29, Identity=44%"; Hit description =failed axon connections family member (31.6 kD) (2F956) [Caenorhabditis elegans] gb|AAM81113.1| Hypotheti
  Gene Ontology: Cellular component=integral to membrane; Biological process=response to cadmium ion
  Coding regions on vcDNA: vcDNA=SeqID_91583; Strand=+; Position=1-457
ISPFCLKVETFLRANEITYEVIGSWNLRNAPQKRFPFIELNGERISDSQIILWRLSDYFKIEDGLFXEQRAKARAIERLIEGSLYYSLIRFLSYENATKMVNSEISGLRLPAFLSRFLARRLTEATRKRLLAESTLLHPRDITLESLSLDLH

SEQ ID NO: 165161 - protein, 196 aa, Heterodera glycines
  Coding regions on vcDNA: vcDNA=SeqID_91584; Strand=+; Position=58-645
NIMDISRLRRICAIYASDGINGYPFSLAVIKKALESKLNVCSLLFLHLRRDLPDTLKNNPKFVALECFGFDSLEAIRKRLAKEDISRESLVFIDSLPVLIEQFSLPSTSWFLTQIAELSACVLALVHSSESEDDQNSEDWRRIESIASTVFELRARDKHTLCRTKTKKRNGTAEEKLEQFSIEEDYSITFSPFDYS

SEQ ID NO: 165162 - protein, 177 aa, Heterodera glycines
  Homolog annotation: Hit_ID=CAE58029.1; Match level="QueryCoverage =97%, HitCoverage=44%, E-value=3e-15, Identity=33%"; Hit description =Hypothetical protein CBG01103 [Caenorhabditis briggsae]
  Gene Ontology: Mol. function=peroxidase activity; Cellular component =extracellular space; Biological process=embryogenesis and morphogenesis
  Coding regions on vcDNA: vcDNA=SeqID_91585; Strand=+; Position=3-536
NEAQNYWTAVGHKNFVIMDRKPFKKMANGPIETPKQQKKTQQRKANKSASALPSKFDARKQWPECADFIGMVNHIGYNGNGGCASAWAISAAAVLTDRICIERLKKGIRSYTNHASSFASAQDILDSHLDNKCSCSTEISTAIVWKWFAETGVVTGTNYSMGLGCKPYIYPPQKNCL

SEQ ID NO: 165163 - protein, 123 aa, Heterodera glycines
  misc_feature (54)..(54): Xaa can be any naturally occurring amino acid
  misc_feature (60)..(60): Xaa can be any naturally occurring amino acid
  Homolog annotation: Hit_ID=AAD27589.1; Match level="QueryCoverage =97%, HitCoverage=20%, E-value=7e-25, Identity=55%"; Hit description =chaperonine protein HSP60 [Onchocerca volvulus]
  Coding regions on vcDNA: vcDNA=SeqID_91586; Strand=+; Position=2-370
APNLVSDQPNCTPDAPGDGTTSATAVQPAIAKEGFKNISTCANPSYVPNAMMNXTALIVXELQAMSKTGTTPKEITHVDTIAATLDENNRKLISDAMNKDRNKGVITAKDVKTLLDQLQMIEG

SEQ ID NO: 165164 - protein, 146 aa, Heterodera glycines
  Homolog annotation: Hit_ID=NP_510032.1; Match level="QueryCoverage =97%, HitCoverage=51%, E-value=4e-41, Identity=55%"; Hit description =reductase (29.2 kD) (XM767) [Caenorhabditis elegans] emb|CAA91943.1| Hypothetical protein M153.1 [Caenorh
  Gene Ontology: Mol. function=pyrroline 5-carboxylate reductase activity; Biological process=proline biosynthesis
  Coding regions on vcDNA: vcDNA=SeqID_91587; Strand=+; Position=192-629
MSLKIGFIGAGKMAQALARGFINSGRYPAEQLMASCPKTEVATIEQFKKMGVKMTDDNTQITRENEVIILSVKPMQIGKVTPEIAPHVKQSHLLISLALGIRLLSIEQFLPSNSRVVRAMPNTPAVVCAGVSAYTMGSACRDGNSN

SEQ ID NO: 165165 - protein, 212 aa, Heterodera glycines
  Homolog annotation: Hit_ID=NP_494441.1; Match level="QueryCoverage =100%, HitCoverage=22%, E-value=2e-55, Identity=54%"; Hit description= coatomer protein complex 1 (107.5 kD) (2D377) [Caenorhabditis elegans] gb|AAD12836.1| Hypothetical prote
  Gene Ontology: Cellular component=Golgi apparatus; Biological process= ER to Golgi transport
  Coding regions on vcDNA: vcDNA=SeqID_91588; Strand=+; Position=2-637
SALANTLAKLVLRYAELNKGVPSTVNKLASGALLLIASIIHLGKSGLCKQPITEDDLDRLSTTVRLIVDQWPKAVDVFLRECRASLESMLKAKGDVDRHERDTKAPKKKIVQPDKTIMFTQLSTRVSENVTDTNLFDLSLSQALGTAPKTTKYTFASSKLGKVIQLAGFSDPVYAEAYVNVNQYDIVLDVLVVNQTSDTLQNLSLELSTVGD

SEQ ID NO: 165166 - protein, 83 aa, Heterodera glycines
  Homolog annotation: Hit_ID=CAE59587.1; Match level="QueryCoverage =90%, HitCoverage=39%, E-value=1e-15, Identity=44%"; Hit description =Hypothetical protein CBG02988 [Caenorhabditis briggsae]
  Gene Ontology: Mol. function=structural constituent of cuticle; Cellular component=extracellular; Biological process=cuticle biosynthesis (sensu Nematoda)
  Coding regions on vcDNA: vcDNA=SeqID_91589; Strand=+; Position=2-253
GLPGPPGPPGFYATNGQPGQSAPPSSPGRPGPQGPPGPDGQPGNPGESGQTGQPGKLTQRPTVVGPTGSSRTSGEPRTFFYNG

SEQ ID NO: 165167 - protein, 217 aa, Heterodera glycines
  Homolog annotation: Hit_ID=NP_503037.1; Match level="QueryCoverage =76%, HitCoverage=15%, E-value=2e-10, Identity=26%"; Hit description =intersectin 2 (4S71) [Caenorhabditis elegans] emb|CAB55138.1| Hypothetical protein Y116A8C.36 [Caenorhabd
  Coding regions on vcDNA: vcDNA=SeqID_91590; Strand=+; Position=1-651
ILEITQEIERMRGQRDQKLAKINELERNNKELAVQCERFSHENLQHQSEVQRQLARAHEISEIRAEIVQLNDQIQQGENEIQTIAIRSQNQEKLVEEKRPSWEESCKNIQLARNLFTELLVRYNKGRSDAGALYELPPDAKASPFGHGTSNAQPKRTFGTSFDDDFKPNLSTAVDVNVQQKPVDKTSAVGDIEVKNNEIVQNGNQLSKESVSTVPYE

SEQ ID NO: 165168 - protein, 136 aa, Heterodera glycines
  Coding regions on vcDNA: vcDNA=SeqID_91591; Strand=+; Position=3-413
SFSLNVFQFIFFLMTEATKIYNRLSAFQKFRINLNCHLRRVRSNWLYQLSTALVFVTALNHASIYLTYGPDHPRCMQQWKERKQRGLLTDELLWKERLLYARRREFLTAVDGYGTVDNWKHPRATMGASTLSSKLF

SEQ ID NO: 165169 - protein, 97 aa, Heterodera glycines
  misc_feature (1)..(1): Xaa can be any naturally occurring amino acid
  Homolog annotation: Hit_ID=CAB88203.1; Match level="QueryCoverage =97%, HitCoverage=31%, E-value=1e-25, Identity=66%"; Hit description =putative cuticular collagen [Globodera pallida]
  Coding regions on vcDNA: vcDNA=SeqID_91592; Strand=+; Position=2-292
XENHIGLGIGFVRSQMAIIATGVTLPSLYWEMSEMNSKVRDGVEDFGVGADSDWTDLMDVQVDVTPPSKPRDNPGNSIFFFGRRLDRSCQWAGPRQA

SEQ ID NO: 165170 - protein, 126 aa, Heterodera glycines
  misc_feature (29)..(29): Xaa can be any naturally occurring amino acid
  misc_feature (69)..(69): Xaa can be any naturally occurring amino acid
  Homolog annotation: Hit_ID=S34665; Match level="QueryCoverage=99%, HitCoverage=43%, E-value=2e-19, Identity=42%"; Hit description =collagen, cuticular - root-knot nematode (Meloidogyne incognita) emb|CAA80860.1| cuticular collagen [Meloidogy
  Coding regions on vcDNA: vcDNA=SeqID_91593; Strand=+; Position=2-379
LVVIHQLYTQINQMNNLEMDCVQVFRVNXDSTRTDLMEVHIGVAPHTHSPDNPFNSIFLHQKHQGLPSXCVCQLNAAIWPHGPPGPPGPPGTHDYADGVVIPEHAALSDKQISPCTPPRYTCPKCA

SEQ ID NO: 165171 - protein, 204 aa, Heterodera glycines
  Homolog annotation: Hit_ID=CAF89377.1; Match level="QueryCoverage =85%, HitCoverage=50%, E-value=2e-14, Identity=28%"; Hit description =unnamed protein product [Tetraodon nigroviridis]
  Coding regions on vcDNA: vcDNA=SeqID_91594; Strand=+; Position=9-620
MCSSADEQISRHAMLADLELLCRNRCGFYGTPQCDGLCSRCWRDFQLESKRQNDYQNNIKVLRQHQQHATGPSGAGGGSAVAPSSAAAVTRKGSDARFNSLKTLLKKSPCVFSASTYDQSPLIILGPRPPSPDTVTAQEHLHQFLEANFAHVYAKELDKQCQVFIDNLFKSEFLPSDELSLLVQAFYQSIQESAVKFAAQMPPP

SEQ ID NO: 165172 - protein, 207 aa, Heterodera glycines
  Homolog annotation: Hit_ID=AAH77353.1; Match level="QueryCoverage =100%, HitCoverage=22%, E-value=1e-60, Identity=54%"; Hit description= Mars-prov protein [Xenopus laevis]
  Gene Ontology: Mol. function=methionine-tRNA ligase activity; Cellular component=cytoplasm; Biological process=protein biosynthesis
  Coding regions on vcDNA: vcDNA=SeqID_91595; Strand=+; Position=2-622
FPSTLLATNEPFTQPRHICATDFLNYEGQKFSKSRGIGVFGDAVASIGIPPDVLRFYLLYIRPEGQDATFSWDDLTQKVNSELLANIGNFIHRSLTFLSKNFAGVQPSVVPTSAEYSLFAAVDEEMEQYTKAMEEVRLREALKHILAISRKGNQYIQAGEPWALVKGTAEERKRAETIIGVSANLSALLSVLLYPFMPSISAQIQHQ

SEQ ID NO: 165173 - protein, 206 aa, Heterodera glycines
  Homolog annotation: Hit_ID=CAE69157.1; Match level="QueryCoverage =99%, HitCoverage=80%, E-value=6e-13, Identity=27%"; Hit description =Hypothetical protein CBG15188 [Caenorhabditis briggsae]
  Coding regions on vcDNA: vcDNA=SeqID_91596; Strand=+; Position=23-640
MEQEAFYTVGEFDRSKIDLNKPAMTVEEYMQQVVVGRELLPDVAVASPEVLKRFSATPLRKSLTNLPGICDDSRTFTSRFGPNKEWCVAKSNEFSQSRSEFECVKVPDDDPLKDVQLPPMNDWMRWCQVCFESRLEGFAIAPENEKRFAHHKGTPPTVSLITSLKDHQVNELIIHQIKYMLNKGQTRATLQWLYALLLVVKKPLLP

SEQ ID NO: 165174 - protein, 54 aa, Heterodera glycines
  misc_feature (12)..(12): Xaa can be any naturally occurring amino acid
  misc_feature (15)..(15): Xaa can be any naturally occurring amino acid
  Homolog annotation: Hit_ID=CAB88203.1; Match level="QueryCoverage =100%, HitCoverage=18%, E-value=9e-15, Identity=70%"; Hit description= putative cuticular collagen [Globodera pallida]
  Coding regions on vcDNA: vcDNA=SeqID_91597; Strand=+; Position=2-163
VTLPSLNSEMSXMNXEVRDGVEAFRVNTDSAWTDLMGLSVGLAPPSKPPDKPFN

SEQ ID NO: 165175 - protein, 155 aa, Heterodera glycines
  Homolog annotation: Hit_ID=CAB88203.1; Match level="QueryCoverage =100%, HitCoverage=91%, E-value=6e-65, Identity=64%"; Hit description= putative cuticular collagen [Globodera pallida]
  Gene Ontology: Mol. function=structural constituent of cuticle; Cellular component=basement membrane; Biological process=cuticle biosynthesis (sensu Nematoda)
  Coding regions on vcDNA: vcDNA=SeqID_91598; Strand=+; Position=2-466
ASVCSLLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGGAGQPGQPGQPGQPGQPGANGVVSRPIPGPKGPPGAPGQNGNPGSQG

SEQ ID NO: 165176 - protein, 93 aa, Heterodera glycines
  misc_feature (75)..(75): Xaa can be any naturally occurring amino acid
  Homolog annotation: Hit_ID=CAB88203.1; Match level="QueryCoverage =98%, HitCoverage=30%, E-value=8e-23, Identity=55%"; Hit description =putative cuticular collagen [Globodera pallida]
  Coding regions on vcDNA: vcDNA=SeqID_91599; Strand=+; Position=2-280
VSMCSLSTIIAYVVTLPSLYSQISDMNRKKRNRFEAFRAYTDSGCTDLTDLMVVMTPPSQPQDHPYNSLFPAILXLPGLCQCAGLRLPSCPPG

SEQ ID NO: 165177 - protein, 104 aa, Heterodera glycines
  Coding regions on vcDNA: vcDNA=SeqID_91600; Strand=-; Position=186-500
FFFKFFGRVALSPSAQKSPHPSCWLFRLSISERFISNMVNGPFRKGPFMISMTICHHRWTQASITKNLLLCYSLGFHNGNKNQPVLPMIHHFMNSKCSLILLNF

SEQ ID NO: 165178 - protein, 59 aa, Heterodera glycines
  Coding regions on vcDNA: vcDNA=SeqID_91601; Strand=+; Position=1-177
CSFRHFATASATKRGPKVEPSRLPNGLSVASVELQGPISQLMFAFRSGARFEQHDEAGL

SEQ ID NO: 165179 - protein, 173 aa, Heterodera glycines
  Coding regions on vcDNA: vcDNA=SeqID_91602; Strand=-; Position=122-643
RRHAYWRHKMRDGVPNSAGMEKRMCAVGFVPEFPVFSSISSRAASSLLSVISSSICFAASASIVSSRFTVPTGEDQPPPGGCSLLLIICSAVIRNGGTTPATFSLPTTAAQRLTGIGRQDKAADECPERKNAPRIAATGAGTVQHSNAISSNREAASLSIQRRLFARGFNSFF

SEQ ID NO: 165180 - protein, 111 aa, Heterodera glycines
  misc_feature (60)..(60): Xaa can be any naturally occurring amino acid
  Homolog annotation: Hit_ID=CAB88203.1; Match level="QueryCoverage =100%, HitCoverage=84%, E-value=4e-45, Identity=68%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_91603; Strand=+; Position=1-334
MMQMNCKLRYGGEAFRVITYSAWTDLMDVQVVSTPPAKSRDNPFNSIFRAKRQLPGHCSXSGLQQASCPPGPPGPSGPPGQPGQPGGAGQPGQPGQPGQPAPPWPPQNIPC

SEQ ID NO: 165181 - protein, 189 aa, Heterodera glycines
  Coding regions on vcDNA: vcDNA=SeqID_91604; Strand=+; Position=1-567
SYFSPTIRYEYADESNISQPSSMYADPPLFKEEMSDESHFFLHSNNSNQSLPFPASTFVQAHDDENLQPPVAAFSPFAIADTSQELHYSQPAPSSVDYFFWQSDEASSSSVCAEERRQMYEQYGGQKQMRRTENDKNTEQCQRNAQRNIGERMPTMDDNNDQQPSILRRMPLQSMENASLLKLSEFSSS

SEQ ID NO: 165182 - protein, 214 aa, Heterodera glycines
  Coding regions on vcDNA: vcDNA=SeqID_91605; Strand=+; Position=1-642
ITYSGSFATTVHYVNTPLANSLNELLETTVSEKGISSAMSLQEKNSPLYASCEKFIEADATSLRSLSICSELNARIIQRGGRTRVSGRSNKDKMIRRPSPPSLPPPLPPRKQSSQPCFSKYIPPVFDGDYVDIDAIMEINQSEYINKSMLISSNAGREMPKYQSHNATDYIQVYPNATSELRKTDDSLRAPMRRSSSLYDFFVSQQPPVHSLAK

SEQ ID NO: 165183 - protein, 196 aa, Heterodera glycines
  Homolog annotation: Hit_ID=NP_498537.1; Match level="QueryCoverage =95%, HitCoverage=61%, E-value=6e-36, Identity=34%"; Hit description =low density lipoprotein-receptor, class A (59.2 kD) (3I146) [Caenorhabditis elegans] gb|AAA50645.1| Hypot
  Gene Ontology: Mol. function=copper ion binding; Cellular component =integral to membrane; Biological process=gametogenesis
  Coding regions on vcDNA: vcDNA=SeqID_91606; Strand=+; Position=3-590
QTSLSCPSKSRPEHLFCLTPEHLCDGVTHCANGEDEDSKTYCRAKCDDKKEFSCRVSEICLPKEVFCDGIKHCPFGDDELNCTECRGEAKRCGDHCLPKRKLCDGEVDCQVDGGSDEKDCDCPSCSGMNSALCDGEQKFCVDRRRLCDGRADCPGGEDENDCHGICPSLPKGASRTEDKNTDGMGQCSDGVTRLWA

SEQ ID NO: 165184 - protein, 192 aa, Heterodera glycines
  Homolog annotation: Hit_ID=A34476; Match level="QueryCoverage=100%, HitCoverage=94%, E-value=2e-93, Identity=63%"; Hit description =collagen alpha 2(IV) chain - Caenorhabditis elegans  (fragment) gb|AAA27989.1| alpha-2 type IV collagen
  Gene Ontology: Mol. function=extracellular matrix structural constituent; Cellular component=collagen type IV; Biological process= extracellular matrix organization and biogenesis
  Coding regions on vcDNA: vcDNA=SeqID_91607; Strand=+; Position=2-577
GFPGMDGEKGDAGYPGPAGPALRDGFVVVTHSQTTQVPNCPQGTEKLWDGFSLLYIEGNERAHYQDLGDAGSCLPRFSTMPFLFCDFNDVCNYASRNDKSYWLSTGEALPMMPVNEREIQPYISRCSGCETPANVIAVHSQSIQIPNCPNGWSSLWIGYSFAMHTGAGAEGGGQSLSSSGSCLEDFRTTPFI

SEQ ID NO: 165185 - protein, 164 aa, Heterodera glycines
  Homolog annotation: Hit_ID=CAE68967.1; Match level="QueryCoverage =96%, HitCoverage=20%, E-value=2e-66, Identity=77%"; Hit description =Hypothetical protein CBG14947 [Caenorhabditis briggsae]
  Gene Ontology: Mol. function=chaperone activity; Cellular component =mitochondrion
  Coding regions on vcDNA: vcDNA=SeqID_91608; Strand=+; Position=1-495
IFFGRITTGAQDDLRKITQIAYSQVVKFGMSEKVGPVSFDTPEPGEMAFDKPYSEATAQLIDQEVRDMVSAALRRTRELLMSKVEQIERVALRLLEKEILAREDMIELLGPRPFAEKHTYEEFVAGTGSMDEDTTLPKGLDSWNREREKEEKKDGEKEQKKEAA

SEQ ID NO: 165186 - protein, 196 aa, Heterodera glycines
  Coding regions on vcDNA: vcDNA=SeqID_91609; Strand=+; Position=3-590
VLTFLRSNKPIWDRMGTKFELEVYSYETDQIWDVFVREIWPIFATNIRHLSFAGADALDNLRRRISPTLLTDLVQLYSITSYGLCPDGISDDGPNATAGQALSKWLHTPSKNGKANELYCCAYFCEITWINTFKETFLRATTSVAYNVRLELLVANEMNTVEQFELVNEMTQEKLTLTKDEEICLLKRCPIVGETA

SEQ ID NO: 165187 - protein, 133 aa, Heterodera glycines
  Homolog annotation: Hit_ID=AAA98565.1; Match level="QueryCoverage =79%, HitCoverage=65%, E-value=1e-15, Identity=47%"; Hit description =fatty acid binding protein homolog As-p18 [Ascaris suum] sp|P55776|FABH_ASCSU Fatty acid-binding protein h
  Coding regions on vcDNA: vcDNA=SeqID_91610; Strand=-; Position=180-581
RAGGFRLIPAVRWSSCPPRAEFGTRVKLAGITKTFSKNESGTYACKIETTKKNVEWPSFKLGEEFQAEYLDDSVPKITFDYNPTTDELIETHKKVDSEEKPDIYKYNIDSDGFLVMQMEYNGVKTKRFYKKNE

SEQ ID NO: 165188 - protein, 144 aa, Heterodera glycines
  Homolog annotation: Hit_ID=AAP30770.1; Match level="QueryCoverage =95%, HitCoverage=53%, E-value=5e-39, Identity=60%"; Hit description =putative gland protein G17G01 [Heterodera glycines]
  Coding regions on vcDNA: vcDNA=SeqID_91611; Strand=+; Position=3-437
KLPPAGRLCIPITISPSDIGQDKMLLDNGTLIFFSAQLLSALLSLVPLGLGIMAMLCSVYLYKFTVYFHALPSVMAWCASAWFSAKLLLDWTDFWICVNFQADHTNVPLVSLVLSIVLACSFVFEIFFKNSLLKKQLATECAIV

SEQ ID NO: 165189 - protein, 186 aa, Heterodera glycines
  Coding regions on vcDNA: vcDNA=SeqID_91612; Strand=+; Position=1-561
RREKRSIGKRTTKNLGKKRRKDEAVTAPPVTGVVLPSSTTAAADVPPPPCPSETANGQGPSTTTANAKSTTTTASNSNEHQEKEEATAMLLKMQLGTPVPMSHNVCADKPDYAVEKPALEKWSIGIQAFQHQPPASSTGFFKRMHKIVKSVRKNGPAGVEDGADNENNNKKDNEENGKKAKEHQKR

SEQ ID NO: 165190 - protein, 187 aa, Heterodera glycines
  misc_feature (30)..(30): Xaa can be any naturally occurring amino acid
  misc_feature (58)..(58): Xaa can be any naturally occurring amino acid
  misc_feature (64)..(64): Xaa can be any naturally occurring amino acid
  misc_feature (136)..(136): Xaa can be any naturally occurring amino acid
  Homolog annotation: Hit_ID=CAB88203.1; Match level="QueryCoverage =100%, HitCoverage=56%, E-value=1e-26, Identity=43%"; Hit description= putative cuticular collagen [Globodera pallida]
  Coding regions on vcDNA: vcDNA=SeqID_91613; Strand=+; Position=2-559
LVAIIATVVTLASLYFEMRPMNSQVRDRVXGFPGKTESGWNDFMDTQMGLTPPPQTPXINPFNXIFRGKKQMAGHCQRGGLPQTKMFPRFGPVPPGSLDKPRQTCKGQDNPEQLDKTGQTRFLLVPAPKKLTCPPXGPGGPNPARPPQEIGTPPAHKRKTPVTTRVNTPLQGGREPGNKLGSGPGPP

SEQ ID NO: 165191 - protein, 191 aa, Heterodera glycines
  Homolog annotation: Hit_ID=NP_508855.1; Match level="QueryCoverage =58%, HitCoverage=23%, E-value=2e-18, Identity=41%"; Hit description =n/apple PAN family member (50.7 kD) (XF645) [Caenorhabditis elegans] gb|AAK39382.1| Hypothetical protein
  Coding regions on vcDNA: vcDNA=SeqID_91614; Strand=+; Position=3-575
FPFFFLFFFFVPSISSFQFARCFQKLERHSIDNSQPLTEIFRSAPTDCLEQCISHTGNGDEQENPGYCRSVVYDHLQHSCRLYGHDGSKVPALIHPANGFDLYRRTSSMQECVGPTQRLLALNAKKGAVFAAPSQQVQSVKGKTAIPVTTPMAEDETLSDEELATLLDQLERKDEKGTEIVRQRHEGEGKV

SEQ ID NO: 165192 - protein, 201 aa, Heterodera glycines
  Homolog annotation: Hit_ID=CAE63756.1; Match level="QueryCoverage =90%, HitCoverage=18%, E-value=6e-24, Identity=35%"; Hit description =Hypothetical protein CBG08291 [Caenorhabditis briggsae]
  Coding regions on vcDNA: vcDNA=SeqID_91615; Strand=+; Position=3-605
QEQIQHMEFSLVTGGKGMERELASHRLDDNVATELKLVLAAGLYPQFGVVDPTNNFREGHDQFAHTPSKPFVVLHPNSALGLRPEVLRSDDLDSEGHSVQHQLIYFGLLLETTKPYLCNSCRIPASFLLVIARNITCVSPSVLCCDGFVEFHFVKARHCDDSLAFACRVRSLFLQSLEHKLRSDDYGDCRELERLIIFARL

SEQ ID NO: 165193 - protein, 185 aa, Heterodera glycines
  Coding regions on vcDNA: vcDNA=SeqID_91616; Strand=-; Position=2-556
VGGVAATCIRGIRCCFVEMSVASAGPATGFMTCFASMPFSRPFAIIGMPFSMPSIRRIGIVCSLNSSGPDLVNKHFSLASAYLATRVLSPMDSNCGNGLKFTLASDSPSSSFDLSKEMYNEVNAVIGLDDVLKRFAFDFSNSASVSSESSCFRFRVFGFSVEGVAATCIRGIRCCFVEMSVASAG

SEQ ID NO: 165194 - protein, 142 aa, Heterodera glycines
  misc_feature (31)..(31): Xaa can be any naturally occurring amino acid
  Homolog annotation: Hit_ID=CAB88203.1; Match level="QueryCoverage =100%, HitCoverage=47%, E-value=4e-43, Identity=59%"; Hit description= putative cuticular collagen [Globodera pallida]
  Coding regions on vcDNA: vcDNA=SeqID_91617; Strand=+; Position=23-448
VRSLMAIIPTDFTLPSLYSEMIQRTSNCADXVEALRVNTHSGWTDLMDVQLVVTSPSNSPDNAFNSIFRVKQQLPRHCHCTGLQEPRCDPGPPGPYEKPVQTGQPEGEGHPGHAGQPEQSAHSCQHQKIPCPRCPAGSHCRP

SEQ ID NO: 165195 - protein, 107 aa, Heterodera glycines
  Homolog annotation: Hit_ID=CAB88203.1; Match level="QueryCoverage =95%, HitCoverage=37%, E-value=5e-25, Identity=54%"; Hit description =putative cuticular collagen [Globodera pallida]
  Coding regions on vcDNA: vcDNA=SeqID_91618; Strand=+; Position=2-322
LDTRIVLVSAPMCTLLAIIATAFTLPYLYSEMSQMNNKVPDGVEAIHVPSDSFWNDQMDVHAALTPPANPRDNPFLSIFRVRRQLPGHVVRPGQSGQAGQGGQAAPA

SEQ ID NO: 165196 - protein, 159 aa, Heterodera glycines
  Homolog annotation: Hit_ID=CAE64843.1; Match level="QueryCoverage =73%, HitCoverage=28%, E-value=3e-25, Identity=52%"; Hit description =Hypothetical protein CBG09639 [Caenorhabditis briggsae]
  Coding regions on vcDNA: vcDNA=SeqID_91619; Strand=+; Position=1-480
VGQYLMNPFGEDDDDFELNYVLDRNTYIAHMIASELADQIPSKISDEMEVTLPHTRASFKIQDIIPKGHLSDFQIAPKDMQLIRANELANAMMELEQKRKKLSAIFRAAGRKQTPNSLTIVPGAADSSSIEENRRLTSTIEEEAVPPPTTPTKKEHPGP

SEQ ID NO: 165197 - protein, 81 aa, Heterodera glycines
  misc_feature (46)..(46): Xaa can be any naturally occurring amino acid
  Homolog annotation: Hit_ID=CAA65474.1; Match level="QueryCoverage =100%, HitCoverage=27%, E-value=3e-10, Identity=49%"; Hit description= collagen [Globodera pallida]
  Coding regions on vcDNA: vcDNA=SeqID_91620; Strand=+; Position=14-256
IASKSSLMNSLHTNKCRATLYAYTSQRNTSTRQLFEAFRGNIKSYXTELMYKLGTKTPTTNARDNPLGSIFRVKLQLTGHC

SEQ ID NO: 165198 - protein, 201 aa, Heterodera glycines
  misc_feature (160)..(160): Xaa can be any naturally occurring amino acid
  Homolog annotation: Hit_ID=CAE69590.1; Match level="QueryCoverage =99%, HitCoverage=9%, E-value=6e-28, Identity=35%"; Hit description =Hypothetical protein CBG15812 [Caenorhabditis briggsae]
  Coding regions on vcDNA: vcDNA=SeqID_91621; Strand=+; Position=3-605
FSDRFSDDQFSLFDAIHQPRPLVKNNVREIIDMANNRRLTVVEAEDANILRMRVGRFIELNGRTEMSLHDAYQLKLVQKPQTLAEVIDSGSLDNNGRFIDGVKPRTLLEAICSGMLDPDVAHIKAGPGDELISIGEALKRGRLTPKGEIVLTLGEVGIHXGEKINLFMAHERGLLTSRVQHTIFDVKGVRNAADGSIMSFK

SEQ ID NO: 165199 - protein, 157 aa, Heterodera glycines
  Homolog annotation: Hit_ID=CAE60264.1; Match level="QueryCoverage =98%, HitCoverage=84%, E-value=2e-22, Identity=41%"; Hit description =Hypothetical protein CBG03840 [Caenorhabditis briggsae]
  Coding regions on vcDNA: vcDNA=SeqID_91622; Strand=+; Position=2-475
RGEAKDPQGEPTAGTVSREKLLEILLMNKLASTGKLPPKSARNFLHKKLQQRKFFDSGDYNMNNNKPIPPPIGHNLTAATTPKLAVPVETEPDKKMEQSAPIIGSQLLPMMRPLAGSISGCSMDDGESDDEGGKLQIPRPDTLPQRESTILHPAAHS

SEQ ID NO: 165200 - protein, 89 aa, Heterodera glycines
  Homolog annotation: Hit_ID=CAA65506.1; Match level="QueryCoverage =56%, HitCoverage=17%, E-value=8e-13, Identity=66%"; Hit description =cuticular collagen [Teladorsagia circumcincta]
  Coding regions on vcDNA: vcDNA=SeqID_91623; Strand=+; Position=2-268
FFGVCLSTVATVIAVLSVPFAYQHFQQIGAQMQNEVDFCKMRSGNMWREVKPKRRIGKAGKFQKNFNKFSGHPHPGLLQGVARQPSQAS

SEQ ID NO: 165201 - protein, 212 aa, Heterodera glycines
  Coding regions on vcDNA: vcDNA=SeqID_91624; Strand=+; Position=2-637
FDAVVLEDVAALKSAEDWRSFLPLAPLLRVFSDPHHSIALPPSADSEETPFQCSVVQQIAPNREESTVFILDQQYRSNMNAQIWSGRAFYAPLYKELDLARPVAHAQQELRLNHLMDRLVLDERTVNTDTLTLVDTGALEGHWTETMFKPYKMAAWAGDSSAPSLVNWGEALLAAMHIDSLLSYGIWPFQIACFTHSSAHGEAIRRILFSLN

SEQ ID NO: 165202 - protein, 85 aa, Heterodera glycines
  Homolog annotation: Hit_ID=NP_499343.2; Match level="QueryCoverage =82%, HitCoverage=31%, E-value=1e-17, Identity=57%"; Hit description =MtN3 and saliva related transmembrane protein family member (3L716) [Caenorhabditis elegans] emb|CAA21014
  Coding regions on vcDNA: vcDNA=SeqID_91625; Strand=+; Position=246-503
PFPATIASPLLDVGQVLRTKSTESLPFLLCLANLAVCVQWLLYGVLVDDFYMKVPNGIGTFISTMQLSLFIVYPRTYKQLTVGNV

SEQ ID NO: 165203 - protein, 72 aa, Heterodera glycines
  Coding regions on vcDNA: vcDNA=SeqID_91626; Strand=+; Position=1-216
GQQKPNNSSYYSPKGIMPIRRGVQKKIDRTSTSKLQGSAANLQLLRRTSGLGNGQAQETRLRSVSSVAASHR

SEQ ID NO: 165204 - protein, 172 aa, Heterodera glycines
  Coding regions on vcDNA: vcDNA=SeqID_91627; Strand=+; Position=2-520
FESPSQRLSNMRQRKEFVTEQQQKAFPSPAVAVQIKVRADNRTDIQIKEAFCEQKTNEMAMPKVEHYAEHSSADVFSTDGKQTFGQNESEKRQNGKYVLSGLSPEISPPPYQKMNMSHSSRTNSPEEQKGNFHEIFALSAQEARQRMKGRKRDPRKEGKMTLEEKHRLILNL

SEQ ID NO: 165205 - protein, 101 aa, Heterodera glycines
  Coding regions on vcDNA: vcDNA=SeqID_91628; Strand=-; Position=136-441
KKRGIGLFIFTNKIQTESTKGLISTDQPAFDLHSLLIYSLIVHCSPFVTCKFCEKHVPLVLLFCYFPVTLFSPSFSIVNRQKQTNKFHFLTCAGDERCFIR

SEQ ID NO: 165206 - protein, 206 aa, Heterodera glycines
  Homolog annotation: Hit_ID=NP_937814.1; Match level="QueryCoverage =92%, HitCoverage=33%, E-value=3e-30, Identity=40%"; Hit description =hypothetical protein LOC234669 [Mus musculus] gb|AAH58815.1| Hypothetical protein LOC234669 [Mus musculus
  Gene Ontology: Mol. function=carboxylesterase activity; Cellular component=endoplasmic reticulum; Biological process=acyl-CoA metabolism
  Coding regions on vcDNA: vcDNA=SeqID_91629; Strand=+; Position=27-644
MPSALPLSLPFCLALLFLLLLSPSPCFSSSPPDDSPIVSTKFGKIRGQLLHVVDPVDGQPVALTAFLGVPFARPPLGKLRFEKPLKPEKWSGVFNASEMAPACWPIARAEIYAEPDQLSEDCLYMNIFGPEKLPSDDANLAPVLVYIHGGGFQAGTSRQFKPEAIAKFVRRGLLFVTIQYRLAMLGFATTGDASFAGNYGLWDQAM

SEQ ID NO: 165207 - protein, 203 aa, Heterodera glycines
  misc_feature (92)..(92): Xaa can be any naturally occurring amino acid
  misc_feature (104)..(104): Xaa can be any naturally occurring amino acid
  misc_feature (122)..(122): Xaa can be any naturally occurring amino acid
  misc_feature (152)..(152): Xaa can be any naturally occurring amino acid
  Homolog annotation: Hit_ID=CAB88203.1; Match level="QueryCoverage =100%, HitCoverage=92%, E-value=6e-76, Identity=59%"; Hit description= putative cuticular collagen [Globodera pallida]
  Gene Ontology: Mol. function=structural constituent of cuticle; Cellular component=extracellular; Biological process=reproduction
  Coding regions on vcDNA: vcDNA=SeqID_91630; Strand=+; Position=1-606
ETHIVLGIASVCSLLAIIATVVTLPSLYSEMSQMNSKVRDGVEAFRVNTDSAWTDLMDVQVVVTPPSKPRDNPFNSIFPCKRQLPGHCQCAXAQQASCPPGPPXPSGRPGQPGQPGGAGKPXQPGKAGQPGLPWPAQKIPWPPCPVGPPGRXPGGKGTARNKREPLEHWGPPPKGEGLGNPGGPGTQEKPWKPGKPPRNLGQP

SEQ ID NO: 165208 - protein, 164 aa, Heterodera glycines
  Homolog annotation: Hit_ID=NP_492680.1; Match level="QueryCoverage =98%, HitCoverage=13%, E-value=9e-30, Identity=40%"; Hit description =isoleucyl tRNA Synthetase (irs-2) [Caenorhabditis elegans] pir||T19442 hypothetical protein C25A1.7a - Ca
  Gene Ontology: Mol. function=isoleucine-tRNA ligase activity; Cellular component=mitochondrion; Biological process=tRNA modification
  Coding regions on vcDNA: vcDNA=SeqID_91631; Strand=+; Position=2-493
EGEEEEEEDTWWTMPMPELAKLKGFPFDADQLDKVEKLTEVMDVWLDSGLAWQTLTSNADDFDGESGAKLVADLVVEGADQFRGWFQTSMLTSMALQDSVPFRRILVHAMAVDDRGKKMPKSKGNVVDPKTITGCEESAPSDAGALGVDPLRLWRAWLASESSG

SEQ ID NO: 165209 - protein, 165 aa, Heterodera glycines
  Coding regions on vcDNA: vcDNA=SeqID_91632; Strand=+; Position=1-498
MNFAVRLPLSPLKSFLLPRLWPPFCCCSVSSSSVCSVPLFAYPSLVSFPSPVAAFLCQRAGVAGQSLPLRLFDVRSRQKQHFYHHHHGTFSARFSAFLRRLFPFGRGGAVVLMAFNIKQLFSFNRTDVLDDDPLKDKVKRAMLHRKYGEWAAAVQVLNEALNEAV

SEQ ID NO: 165210 - protein, 216 aa, Heterodera glycines
  misc_feature (126)..(126): Xaa can be any naturally occurring amino acid
  Homolog annotation: Hit_ID=NP_499447.1; Match level="QueryCoverage =85%, HitCoverage=31%, E-value=6e-75, Identity=74%"; Hit description =s6 kinase (3M341) [Caenorhabditis elegans] emb|CAB55075.1| Hypothetical protein Y47D3A.16 [Caenorhabditis
  Gene Ontology: Mol. function=protein kinase activity; Cellular component=nucleus; Biological process=signal transduction
  Coding regions on vcDNA: vcDNA=SeqID_91633; Strand=+; Position=2-648
KEAIEGDQKTHTFCGTIEYMAPEILMRTGHGKAVDWWSLGALTFDMLTGGPPFSAENRKRTIDKILKGRLTLPPYLSFEAKDLIKRLLKRHVDTRLGAGPGDAEEIKKHAFFTHHVENWTNVYRRXIEAPYKPNITSEEDASLFDSKFTKMTPVDSPTAELPPMSVNPFEGFTYIAPSVLEQVSQPTLVRPRQQRKIHGPAIFHSFHPHQSTTDNG

SEQ ID NO: 165211 - protein, 202 aa, Heterodera glycines
  Homolog annotation: Hit_ID=NP_497046.1; Match level="QueryCoverage =82%, HitCoverage=20%, E-value=4e-26, Identity=37%"; Hit description =basement membrane proteoglycan (2O938) [Caenorhabditis elegans] emb|CAB07706.1| Hypothetical protein ZC10
  Coding regions on vcDNA: vcDNA=SeqID_91634; Strand=+; Position=1-606
RCWVPGVPGAVLTWRPSHGGPLPSGANQSGGYLDFPSVSQHHPGQYVCAAYDPSRDPIGSRPVDSDNVRLKLRPKKPFQVLVEPPYQIVDEEQPLPRPYRCWVPGYPQAVLKWRPALDEMLPSGVEEQHNGALLNIPRAELRHAGDYICTAYDPHDESPEENTAQRGRGGGQKEAAEAEEDGTRTAQAEEEHRGSAQGKLAE

SEQ ID NO: 165212 - protein, 184 aa, Heterodera glycines
  misc_feature (118)..(118): Xaa can be any naturally occurring amino acid
  Homolog annotation: Hit_ID=NP_499861.1; Match level="QueryCoverage =98%, HitCoverage=33%, E-value=6e-71, Identity=67%"; Hit description =tetradecanoyl Phorbol Acetate resistant TPA-1, TPA-1 (64.9 kD) (tpa -1) [Caenorhabditis elegans] gb|AAC269
  Gene Ontology: Mol. function=protein binding; Cellular component =cytoplasm; Biological process=intracellular signaling cascade
  Coding regions on vcDNA: vcDNA=SeqID_91635; Strand=+; Position=2-553
RGAIKLSKGHEIRGHQFVATFFRQPTFCSLCSEFMWGLNKQGYRCRLCTLAVHKKCHEKTLSQCPGSAKNSKETIYLKERFKIDVPHRFKQDNFKSLTFCDHCGSLLYGLFKQGMKCXVCGVNCHNRCERHMPNLCGVNQKQLSDALLEIKRSTPPGSVGGGTAQQQQMFNGMGNKFKALFRPQ

SEQ ID NO: 165213 - protein, 208 aa, Heterodera glycines
  Homolog annotation: Hit_ID=NP_524695.2; Match level="QueryCoverage =61%, HitCoverage=27%, E-value=1e-22, Identity=42%"; Hit description =CG18455-PA, isoform A [Drosophila melanogaster] gb|AAF59147.3| CG18455-PA, isoform A [Drosophila melanoga
  Gene Ontology: Mol. function=transcriptional repressor activity; Cellular component=nucleus; Biological process=eye morphogenesis (sensu Drosophila)
  Coding regions on vcDNA: vcDNA=SeqID_91636; Strand=+; Position=10-633
MDCSSKIKLPNELKAELANAFRFDFRWSVLRVSSSVFDHFLAKRQHKILQNVDLKFRQSCEQHVELDNVGQKLANFRNEISLPMSNVPIHEAVIAARILISLHTRNFNELYAFLESHKFPRQIHPKQQKIWWDIHFLEAEQTLGKSQLSLLEKYKVREEHPLPPTIWDGQRKNGLLNENTLTLLNEQYAESRYFYAGRWEIAEATGLS

SEQ ID NO: 165214 - protein, 76 aa, Heterodera glycines
  Coding regions on vcDNA: vcDNA=SeqID_91637; Strand=-; Position=3-230
MTSISNKLTSVQVNNSMVWPNFQWPSSWPSTATTSSSSMPIWRFVCCPSSAFPSSLFCPSSSSSMFCCCCGCCTFS

SEQ ID NO: 165215 - protein, 66 aa, Heterodera glycines
  Coding regions on vcDNA: vcDNA=SeqID_91638; Strand=+; Position=109-309
IFVRVRVRGSKWAEMISASNSTAHIKQFYFETFFENFLFQKRGVHFFLLPSLGIIQKWSNKAVRTQ

SEQ ID NO: 165216 - protein, 93 aa, Heterodera glycines
  Coding regions on vcDNA: vcDNA=SeqID_91639; Strand=+; Position=45-326
INCNLNLNIKAKAVAITNSPNAIRAIIERNDDFVQIVRLFILPLKRPPNLLSLQQPNLAPLQRPIAISIFVFFLQCQLFVGPFVHQFKRLNWR

SEQ ID NO: 165217 - protein, 92 aa, Heterodera glycines
  Coding regions on vcDNA: vcDNA=SeqID_91640; Strand=+; Position=48-323
CTMIILHSLRLLYYYCRALTNTACAVVVMMILTGTIYMLYISVSTCCTYSIHPLISKHRYSKNGFKLILKKLKIKTINIEINILFCINHIHR

SEQ ID NO: 165218 - protein, 142 aa, Heterodera glycines
  Homolog annotation: Hit_ID=AAA27901.2; Match level="QueryCoverage =91%, HitCoverage=21%, E-value=6e-11, Identity=29%"; Hit description =Hypothetical protein B0303.9 [Caenorhabditis elegans] sp|P34260|SLP1_ CAEEL Protein slp-1
  Coding regions on vcDNA: vcDNA=SeqID_91641; Strand=+; Position=85-510
MNVSDEEIHFSRTVRHLNQRLFFGLLSQFSGNIAIVWDGKAMTTQFDMIVTPILLQEHNVTKNYKLELVAQPDTQHVVYLIYATRQSVLLLMRNWLHQLPDDDLRLHHVVFIPDASLTLRQQLREDQRVWDRLQSVDSLPLH

SEQ ID NO: 165219 - protein, 58 aa, Heterodera glycines
  Coding regions on vcDNA: vcDNA=SeqID_91642; Strand=+; Position=171-347
IHILKEKQNRHTKHSKAFDYISSQQRLGHVHTMIRKNLSVCLPPDVAALASHDLLQQQ

SEQ ID NO: 165220 - protein, 75 aa, Heterodera glycines
  Coding regions on vcDNA: vcDNA=SeqID_91643; Strand=-; Position=1-225
QMRTNSKTFSTRGGRPNQLVGRCAEKGSINGEQFVVHFSKDSKKRAQSAKTTCRCKPERTRIGEQTTTTTNDLTD

SEQ ID NO: 165221 - protein, 167 aa, Heterodera glycines
  misc_feature (64)..(64): Xaa can be any naturally occurring amino acid
  misc_feature (116)..(116): Xaa can be any naturally occurring amino acid
  Homolog annotation: Hit_ID=NP_490700.1; Match level="QueryCoverage =99%, HitCoverage=21%, E-value=5e-16, Identity=30%"; Hit description =RNase H integrase-like protein family member (1A698) [Caenorhabditis elegans] gb|AAK68496.1| Hypothetical
  Coding regions on vcDNA: vcDNA=SeqID_91644; Strand=+; Position=1-501
KLVKDCFKRTLGRRILSFDQLNTFAAEVEATLNYRPITAVSDAVDGPVPLRPIFLLQPEIHINXETTTDPIDSEEMFSSTHERLTSRIQALREANDIFWAKWHSEYLTLLRERAQXDHKGPRHQNFGEPKKGMVVLISQDLVPRNQWPMGRIVETHGRPGAIRSVKV

SEQ ID NO: 165222 - protein, 59 aa, Heterodera glycines
  Homolog annotation: Hit_ID=XP_417816.1; Match level="QueryCoverage =91%, HitCoverage=7%, E-value=7e-09, Identity=53%"; Hit description =PREDICTED: similar to dJ1174N9.1 (novel protein with IBR domain) [Gallus gallus]
  Coding regions on vcDNA: vcDNA=SeqID_91645; Strand=+; Position=297-473
SLFRFQYLNLEIMESRTNISCPNCSALLHASDIYALLDHQPELLDRYEKFSLRRALSTD

SEQ ID NO: 165223 - protein, 46 aa, Heterodera glycines; identical to SEQ ID NO: 150977
  Coding regions on vcDNA: vcDNA=SeqID_91646; Strand=-; Position=204-344

SEQ ID NO: 165224 - protein, 178 aa, Heterodera glycines
  Coding regions on vcDNA: vcDNA=SeqID_91647; Strand=-; Position=1-534
KCIDFFQKNGSPAEKRQLEAIMAKSGAIRHAKTQEYTGPDIPLFLFFESILGDHMKRLLLASTEIRSIGTPFSMDIAALLDEIRELHVFGRADLLTTEQITDFSNKYLGIHGYFKAKNFFAFFSHSPFKNWETYPTAFDTNNAAGFTPKLHWLLAHGPDFAKRWGWFAWISEQGIEHL

SEQ ID NO: 165225 - protein, 97 aa, Heterodera glycines
  Coding regions on vcDNA: vcDNA=SeqID_91648; Strand=-; Position=324-617
FLCFSNGNFMYYFFENIRVKNFFILNQIQRRNQQEHQIKTFFINCAKSKNKKKMPECRFKIPTFLGLESRLPKFLRTSAKSLDGINVSFHSILLALI

SEQ ID NO: 165226 - protein, 123 aa, Heterodera glycines
  Coding regions on vcDNA: vcDNA=SeqID_91649; Strand=-; Position=247-618
VPSGVSVVPNEFPGDSIVATVVESATPAATAEHFDYSTKITAPIRPYSLFVSFSSFPFVGLLGFGSELFPWGVVVIICSPPPNPFICDGPSKGATVVSVTEGGMPLTETFIYPFVSFMSVHPL

SEQ ID NO: 165227 - protein, 211 aa, Heterodera glycines
  Homolog annotation: Hit_ID=CAE59952.1; Match level="QueryCoverage =100%, HitCoverage=19%, E-value=5e-48, Identity=43%"; Hit description= Hypothetical protein CBG03440 [Caenorhabditis briggsae]
  Gene Ontology: Mol. function=ubiquitin activating enzyme activity; Cellular component=cytoplasm; Biological process=reproduction
  Coding regions on vcDNA: vcDNA=SeqID_91650; Strand=+; Position=1-633
ARAKFTDYFTSVAETVNQYLDNVNDFLHRVNQMTFSQRIEVLSTLERALVVEYPKNAEECVSWARELFDTLYHNDIAQMLHNFPSSMLTAQGDKFWSGTKRCPHTLNFDVNNPEHFEFVFSASILRAQSYSLAPITDRKKVAQLAMAYCSKPFRPQEGVRIAVTDAEATANDGNTANGDADETELRLNDLNVKLARLKLENIRRMTPIDFE

SEQ ID NO: 165228 - protein, 116 aa, Heterodera glycines
  Coding regions on vcDNA: vcDNA=SeqID_91651; Strand=+; Position=1-348
MSRNRLPPELLLEIVLCVRRGHNTPNICFSSRILRTFMEPRVALWRRVWISMLRKLSDAYLKALLTSIWNYVPLDENCQMFFGTLNGVFRQLEDREIAANCLISGPGGIKGQIPLA

SEQ ID NO: 165229 - protein, 183 aa, Heterodera glycines
  misc_feature (68)..(68): Xaa can be any naturally occurring amino acid
  Homolog annotation: Hit_ID=AAF39972.5; Match level="QueryCoverage =100%, HitCoverage=11%, E-value=4e-41, Identity=46%"; Hit description= Drosophila sos homolog protein 1 [Caenorhabditis elegans]
  Gene Ontology: Mol. function=Rho GTPase activator activity; Biological process=RAS protein signal transduction
  Coding regions on vcDNA: vcDNA=SeqID_91652; Strand=+; Position=2-551
LDAHQKEEEKRIPLIIPTVSEYRYAEPDTDENIIFEDYTHNSGIPVVRAGTVLKLVERLTYPQYTDFXFVKTFMTTFRSFCSPAELLALLIERFVIPTPHIFMALDPQHLLSSVMANSSCNDSASLSNGSLQHSQLHSFAHNLSQSQLEQAFHKFRQEYQKPIQLKVLSIINHWVSNHFYDFE

SEQ ID NO: 165230 - protein, 185 aa, Heterodera glycines
  Coding regions on vcDNA: vcDNA=SeqID_91653; Strand=+; Position=48-605
MKEKEDAWETVRTEMIEQGFVNFERKSWRDVRNHDWQYLRRSAVAKYEHNQKAGVEMIQYNEVDKLVFEIMGNEVSSFDNTNNDSVFLHNFPNDEGQQNEVADPPFFPTFATNALRTPKLEELQQMNSNLSHSISVGSSRDPPAQTKGFSVETIKFFGICRTKRFSSLWRNSVRPFAQSSFRHPL

SEQ ID NO: 165231 - protein, 97 aa, Heterodera glycines
  Homolog annotation: Hit_ID=CAE64130.1; Match level="QueryCoverage =76%, HitCoverage=6%, E-value=5e-13, Identity=48%"; Hit description =Hypothetical protein CBG08746 [Caenorhabditis briggsae]
  Coding regions on vcDNA: vcDNA=SeqID_91654; Strand=-; Position=198-491
MPPFAPLLSDFGIAGESVGGSNRCAFRFRDSVGSFNSPRYPSNVRHPFCLPFLLLPFQYPLDAECTYHIVGPSNAQILLFFKVWPNSSPITAAFPFN

SEQ ID NO: 165232 - protein, 207 aa, Heterodera glycines
  Coding regions on vcDNA: vcDNA=SeqID_91655; Strand=+; Position=3-623
KMCEPIGNNNDVSASQHFPGASGSGGLTSVSPLEPLDPTKFRNIMVEKHEVPSAFGNFCDNSEMTSDLAPLGQQQQSSTGPFLHPCFPPAAVSALHQSNPQPFKVQQSPSIGQQQQQQLYFVQQNAQGNFGPMHSFSSTSPLFGVRQMSYFGPGGVSVQPNWNQQRQAQYINNPQLGQQNNIMSPPKQQQQFVVANCKPSQPCQISS

SEQ ID NO: 165233 - protein, 60 aa, Heterodera glycines
  Coding regions on vcDNA: vcDNA=SeqID_91656; Strand=+; Position=7-189
YTVSLFLCLFDFFQPFFLTIPKLEIGPLIFLEFFMVSYNKNECLIYNLDRSNTNMAIFAT

SEQ ID NO: 165234 - protein, 78 aa, Heterodera glycines
  Coding regions on vcDNA: vcDNA=SeqID_91657; Strand=+; Position=192-428
QAPKNKKIIIMILLFFSGHPFITRVSVDKRTQLKRWYNTLEMTNSLVKYFLHLLMAGTFSDHLFCTNFQFLLISFVSF

SEQ ID NO: 165235 - protein, 190 aa, Heterodera glycines
  Coding regions on vcDNA: vcDNA=SeqID_91658; Strand=+; Position=1-570
LKKGQRKEWAEETAAGQANGRTAPPFATLQRGNRTQRKQFCVYPRGVAVQFGGCEEEQLDNRNIGEENTEQKQRQSESEGRGFLKETKRSERSSQKPRDPRFITPLCSSSSEPVKRRSLLVEPMAPLEDHHELPVVVLQEERLNSQPPVSKEYLQELFVQLDVSFNELHNRRPPSSACSSGAAPSAQSAG

SEQ ID NO: 165236 - protein, 183 aa, Heterodera glycines
  misc_feature (13)..(13): Xaa can be any naturally occurring amino acid
  misc_feature (111)..(111): Xaa can be any naturally occurring amino acid
  misc_feature (123)..(123): Xaa can be any naturally occurring amino acid
  misc_feature (128)..(128): Xaa can be any naturally occurring amino acid
  misc_feature (156)..(156): Xaa can be any naturally occurring amino acid
  misc_feature (159)..(159): Xaa can be any naturally occurring amino acid
  Homolog annotation: Hit_ID=AAQ12016.1; Match level="QueryCoverage =100%, HitCoverage=64%, E-value=1e-62, Identity=69%"; Hit description= tropomyosin [Heterodera glycines]
  Gene Ontology: Mol. function=structural constituent of muscle; Cellular component=muscle thin filament tropomyosin; Biological process=pole plasm oskar mRNA localization
  Coding regions on vcDNA: vcDNA=SeqID_91659; Strand=+; Position=2-550
DAIKKKMQAMRIXNDKGINRADAAEEKCHQTQERLERVEDELRDSQNNMMATENYLDTAQEDLTAANYLLEEKENNVLDAEVQMVSLNPRLGLLAQEMDKLEECLKLATDXMEESTDHCDKSXACHKXMENRSLLDDERANAIQDQLKEALSLEEXTGXKYHHVARKLAMVESDLERAEELTE

SEQ ID NO: 165237 - protein, 65 aa, Heterodera glycines
  misc_feature (20)..(20): Xaa can be any naturally occurring amino acid
  Homolog annotation: Hit_ID=NP_498596.1; Match level="QueryCoverage =92%, HitCoverage=10%, E-value=2e-09, Identity=53%"; Hit description =prolyl tRNA synthetase (65.8 kD) (prs-1) [Caenorhabditis elegans] gb|AAA50660.1| Prolyl trna synthetase p
  Gene Ontology: Biological process=reproduction
  Coding regions on vcDNA: vcDNA=SeqID_91660; Strand=+; Position=95-289
IDGRRNVGRCKLKHPTPFLXTLESLWQERHTAYAIQHDAEEERHNFLNLNGRLLTDSLVMPEMKG

SEQ ID NO: 165238 - protein, 117 aa, Heterodera glycines
  Coding regions on vcDNA: vcDNA=SeqID_91661; Strand=+; Position=220-570
YILYMNELPSHIGNLKGGGGAHWGIDLSDSYVCTINYFKLFIKILEKLRNVRNKFCIQINGFRVYVTRIHIFAIFGIPIREFDEQSLAQTFIELLDTFGATIEGDHDGDEHCNFLPV

SEQ ID NO: 165239 - protein, 140 aa, Heterodera glycines
  Coding regions on vcDNA: vcDNA=SeqID_91662; Strand=-; Position=75-497
LIFLYRKFFRFFVKSNFCDLLFKFGNIGGNGSTSSIFYCFFQTNFPYFSHFQLHYAARVSTQMLETLLEQEAGRALINSLNNAGETPSMVALLAVSPLYMKTLFDHGGELLNKSTDKNPLIELIKSMKGSTPEYVGFLGI

SEQ ID NO: 165240 - protein, 172 aa, Heterodera glycines
  Homolog annotation: Hit_ID=NP_491190.1; Match level="QueryCoverage =83%, HitCoverage=18%, E-value=1e-13, Identity=33%"; Hit description =MDIG like (86.0 kD) (1E200) [Caenorhabditis elegans] gb|AAB53055.2| Hypothetical protein T28F2.4a [Caenor
  Coding regions on vcDNA: vcDNA=SeqID_91663; Strand=+; Position=17-532
MGRKNLKTSKSLRPLENVNDSVGKIGEDLEDEELEEADDNESLEDEIGAESGEEPFELEFVGYKSATKSAKCLLLEALEDNTIATSRFVLFKFSDGIDHSVQVANKALQWIVSPVDWETFFNDFFNKRVLVVNRKTKDYFEGFFGTVDLFEMLQKFDLDVGTDVNFSLYENY

SEQ ID NO: 165241 - protein, 61 aa, Heterodera glycines
  Coding regions on vcDNA: vcDNA=SeqID_91664; Strand=-; Position=217-402
TKIETRNKSFLLTFYNDHLMGKKQIFEFKTYCSNLASAIQKILSWSATLKSIVAIKNVRIN

SEQ ID NO: 165242 - protein, 110 aa, Heterodera glycines
  Coding regions on vcDNA: vcDNA=SeqID_91665; Strand=-; Position=281-613
KASNFCSKASNFWLNSRLISSLISSNLFINFCSISSLNWSNSSIILSSIAFSFHLMTRGSKSLCSSEQDESALGAAFSAGMKGTISYRSSSGRHLLANVGIRGQFVIWGN

SEQ ID NO: 165243 - protein, 145 aa, Heterodera glycines
  Coding regions on vcDNA: vcDNA=SeqID_91666; Strand=-; Position=1-435
LGSPSPSSMPAGTHRTTNSCTSGPAMPSLISPSGTPGHCTSVDCSTWCTKSATNWPYGANATESASLNGFNSLAKDWDNCGNLATFFEGSASSGGMPRRRTLIGTHSINFTKVEHERVRPGRVRPKLEQRIYISVPRIKFELALQ

SEQ ID NO: 165244 - protein, 203 aa, Heterodera glycines
  Homolog annotation: Hit_ID=NP_510443.2; Match level="QueryCoverage =76%, HitCoverage=11%, E-value=3e-25, Identity=38%"; Hit description =attractin family member (140.8 kD) (XP337) [Caenorhabditis elegans] emb|CAA93653.2| Hypothetical protein
  Coding regions on vcDNA: vcDNA=SeqID_91667; Strand=+; Position=2-610
ECLRLSNGVRCVFHNKSCTKTLPNSSFRQSFLSIAKGETAMVSYQEHCTGTAMGDKDAVELRTCTLLTDCNNCLLQKGCGWCESSQSCLGSYANCADGLLGDRSLCPFGGAKQRRTDVVEQRPCSLATNCFSCNRLPHCTWFAIDTKHICVSLADEAILIEEHNRMQTERLSLAPMADDAPSTNVQQQSNPSSTLSPQSIISN

SEQ ID NO: 165245 - protein, 152 aa, Heterodera glycines
  Coding regions on vcDNA: vcDNA=SeqID_91668; Strand=-; Position=164-622
SDDATSTESSGIAFASSSSISSCCCCCGCSRVSLGGAASNATARRKRMPPRATAEFIVFCTKTTFWSWSSKLLFSFRSSCNLFASMALPRALASPLRLSPVHLQQPSLEHVSWEANGCTTFAAGMLERKALLSQTSVALAVSYSNTKFHDIM

SEQ ID NO: 165246 - protein, 132 aa, Heterodera glycines
  Homolog annotation: Hit_ID=NP_501491.2; Match level="QueryCoverage =100%, HitCoverage=15%, E-value=4e-30, Identity=45%"; Hit description= heparan SulphoTransferase, N-deacetylase N-sulfotransferase (99.1 kD) (hst-1) [Caenorhabditis elegans] d
  Gene Ontology: Mol. function=heparin N-deacetylase/N-sulfotransferase activity; Cellular component=integral to membrane; Biological process= protein amino acid sulfation
  Coding regions on vcDNA: vcDNA=SeqID_91669; Strand=+; Position=2-400
ENIFHIDIDDVYIGAIGTRMVADDVDYLSILHGKLHEHIANFHFTLGFSGNFFRRGDAAQIQGDNILDINANKFHWFPHMWRHNHPPELSADYLLALMTRNRVFDENGGICANLSYAGSPQHSGVYPIYQAL

SEQ ID NO: 165247 - protein, 67 aa, Heterodera glycines
  misc_feature (12)..(12): Xaa can be any naturally occurring amino acid
  misc_feature (56)..(56): Xaa can be any naturally occurring amino acid
  Homolog annotation: Hit_ID=AAF26678.1; Match level="QueryCoverage =100%, HitCoverage=17%, E-value=1e-13, Identity=65%"; Hit description= beta-actin [Rivulus marmoratus]
  Gene Ontology: Cellular component=actin filament; Biological process =embryogenesis and morphogenesis
  Coding regions on vcDNA: vcDNA=SeqID_91670; Strand=+; Position=32-232
QLAALVANNGSXMGKACFAVHDALRAVLPIIVGRPRDLGVMVSMGHNDSYARYYAXLKRGILTLKSP

SEQ ID NO: 165248 - protein, 101 aa, Heterodera glycines
  Coding regions on vcDNA: vcDNA=SeqID_91671; Strand=-; Position=214-519
LCSKWAHFGGHRKDDLREQIRELINDNLIVNYVNKLNGQFPMFPFELISDFGCPFRFLPQIVFWKDRRENPANSVGRECEGRAEFRATDPHDGTNEFGVGW

SEQ ID NO: 165249 - protein, 130 aa, Heterodera glycines
  misc_feature (24)..(24): Xaa can be any naturally occurring amino acid
  Coding regions on vcDNA: vcDNA=SeqID_91672; Strand=+; Position=177-566
RSRKACRHFKCGGHTVGAEAFNVXPTSPDQSEAVASRRYFLAWPCHNFLKFTKFPQILAEKMGIFLYSKSTIPKRHKTGIFCQIFFINNSSNVQIGPLKSGPHYMSTNFSVFCHFLLKYFEFVALNLLLF

SEQ ID NO: 165250 - protein, 98 aa, Heterodera glycines
  Homolog annotation: Hit_ID=NP_569117.1; Match level="QueryCoverage =100%, HitCoverage=24%, E-value=7e-17, Identity=45%"; Hit description= acetyl-Coenzyme A acyltransferase 2 (mitochondrial 3-oxoacyl-Coenzyme A thiolase) [Rattus norvegicus] em
  Gene Ontology: Mol. function=3-oxoacyl-[acyl-carrier protein] reductase activity; Cellular component=mitochondrion; Biological process=lipid metabolism
  Coding regions on vcDNA: vcDNA=SeqID_91673; Strand=+; Position=2-295
ATKSGEIAAAAGLKSTSIADEHIDRITSSNVIQPPKDAAYLSRDIAPRVGVPVHVTARTVNRLCSSDYNAIAPGGQQILAGDSKVVLAGGTETISEAP

SEQ ID NO: 165251 - protein, 156 aa, Heterodera glycines
  Coding regions on vcDNA: vcDNA=SeqID_91674; Strand=+; Position=150-617
KTEKRRNACCNWRKRRGTAANRSRRSRASFAWRAAWNVPEGPSARMAFAVALRVRLLLARPLAIHLSSRCLFYPPFFSLGHTLFRNECLPPRALPISIEKIHTHSALFAPQSAVMDSPSSVGTNFDPNLQDPIPSKTVSPGAMCRLVFSLPMFHVY

SEQ ID NO: 165252 - protein, 43 aa, Heterodera glycines
  Coding regions on vcDNA: vcDNA=SeqID_91675; Strand=+; Position=34-165
QCSISYCIFVDNNFPKNPKISTKIGRDSRIGIPSKSPIPINPQ

SEQ ID NO: 165253 - protein, 74 aa, Heterodera glycines
  Coding regions on vcDNA: vcDNA=SeqID_91676; Strand=+; Position=47-271
LSIGYPIFTLIFNCPTLNFLQFNPLNFLAVLIFFFSSQNKHNEIPNTKHIFDCFLIMHSSKFDQSQFFVLLFVI

SEQ ID NO: 165254 - protein, 161 aa, Heterodera glycines
  Homolog annotation: Hit_ID=NP_492839.3; Match level="QueryCoverage =53%, HitCoverage=3%, E-value=4e-11, Identity=45%"; Hit description =ankyrin and protein kinase and Leucine-rich repeat and Protamine P1 (1L480) [Caenorhabditis elegans] gb|AA
  Coding regions on vcDNA: vcDNA=SeqID_91677; Strand=+; Position=72-624
MVGLFLQQLAHHDNENCVNSARSPRQKKEHGQQQQQVKKMNKWSLANYLLHFKDHSLALSFVESLLNASNKVPLSDHLPSTKGCQLNWQSTGIRELRSEWIVDAALKLNPQIPRHLSKSLALNAISRIDLSSNQLCSVPHILFTHLSSLRSLDLSKNCILR

SEQ ID NO: 165255 - protein, 119 aa, Heterodera glycines
  Coding regions on vcDNA: vcDNA=SeqID_91678; Strand=+; Position=284-640
FFCRNPSAVVELVFADLATQPFALGSINSRIKAWRETVPFDLCLLFHNAGTVGEMAKKSSELSDEAQWHEFLQANLVSAILLNNGVYAALNNAESVRLFIVNITSLLSVKAFPSFTQYS

SEQ ID NO: 165256 - protein, 122 aa, Heterodera glycines
  Coding regions on vcDNA: vcDNA=SeqID_91679; Strand=+; Position=203-568
HHSASFWCPRTSRPIFVLFMYPFERRVSPHSAHINSREKCHEHKDSVVSMIGKDVPKLGGGGTPDDVPCQPAAIDSGDQQQQRLCDGIALDGISTGFPVKMLAPLLVAKGSNGNGTPFDIKV

SEQ ID NO: 165257 - protein, 208 aa, Heterodera glycines
  misc_feature (157)..(157): Xaa can be any naturally occurring amino acid
  Homolog annotation: Hit_ID=AAC26944.3; Match level="QueryCoverage =100%, HitCoverage=27%, E-value=1e-47, Identity=44%"; Hit description= Sodium:neurotransmitter symporter family protein 6 [Caenorhabditis elegans] sp|O76689|SNF6_CAEEL Sodium-d
  Gene Ontology: Mol. function=amino acid transporter activity; Cellular component=integral to plasma membrane; Biological process =transport
  Coding regions on vcDNA: vcDNA=SeqID_91680; Strand=+; Position=2-624
AFFVPYIVLFLLIALPICFIELSLGQFISLCPLSAWKMSPLFKGIGVSMVFISCIISIYYNMITSWAFYYMINLLKFPLPWATCGNSWNTENCSVWNKGAVETCRLLSGVILANGSCANFGENLATEFGKGNDSAVTSFTDGPKAGGVMPSVEYFQXNQVLMLSSGIVDFQTVNWQLAICLLISWLFVFLCSFKGIKTSGKVVYFIVI

SEQ ID NO: 165258 - protein, 194 aa, Heterodera glycines
  Homolog annotation: Hit_ID=CAE67940.1; Match level="QueryCoverage =43%, HitCoverage=8%, E-value=3e-12, Identity=40%"; Hit description =Hypothetical protein CBG13540 [Caenorhabditis briggsae]
  Coding regions on vcDNA: vcDNA=SeqID_91681; Strand=+; Position=44-625
MSGEGHYDPSRTDAHHNCISRPCYGWTVPENRRVFLEGDVRVDIFQKSQLKLFNVKQEKKKIGHIWFNTMFTCPGFCGDAYTHGDEEYSYPEAMIVRRCYKRNPRQPKNTEKRQGQHDDSNSEKEDTGRGRERSVPAANRLGGLRLNGTAETAIVPEKKRSARSPCRQLIEMESRNWQSQDGEEHPHKTHQSGC

SEQ ID NO: 165259 - protein, 177 aa, Heterodera glycines
  Homolog annotation: Hit_ID=NP_508136.1; Match level="QueryCoverage =79%, HitCoverage=20%, E-value=1e-21, Identity=37%"; Hit description =RUN domain containing protein (XB278) [Caenorhabditis elegans] gb|AAK39294.1| Hypothetical protein T19D7.
  Coding regions on vcDNA: vcDNA=SeqID_91682; Strand=+; Position=55-585
ADDDSVCADIDRWACSSLEEEENCANGAFRQSSESTGRIKELEQQQQRLSESVMQLSTHFAQVQFRIQQIAKAPDEQRNEMIKQLQEFASRSCIDVGTLRPAKGSEGAAEEGQQQQRETDYRTAQMRQLIADLRQQLTELEQFAWQNGQLGPGELPLRELRSRQMLLLDKLREKIRL

SEQ ID NO: 165260 - protein, 99 aa, Heterodera glycines
  Coding regions on vcDNA: vcDNA=SeqID_91683; Strand=-; Position=155-454
IYISGKILFFAYKVCGELTTKRKRSKELRNGSPRDRYHSKELGFFYRSILVEKLATSRHFRENRVRTKKTRLFTTGQKWVVKCVFSPYFSGTLRATLLR

SEQ ID NO: 165261 - protein, 87 aa, Heterodera glycines
  misc_feature (37)..(37): Xaa can be any naturally occurring amino acid
  misc_feature (72)..(72): Xaa can be any naturally occurring amino acid
  Homolog annotation: Hit_ID=NP_498777.1; Match level="QueryCoverage =98%, HitCoverage=7%, E-value=4e-21, Identity=59%"; Hit description =phosphorylase kinase (3J230) [Caenorhabditis elegans] sp|P34335|KPBA_ CAEEL Probable phosphorylase B kinase
  Gene Ontology: Mol. function=phosphorylase kinase, intrinsic regulator activity; Cellular component=phosphorylase kinase complex; Biological process=glycogen catabolism
  Coding regions on vcDNA: vcDNA=SeqID_91684; Strand=+; Position=2-265
LIPELFKVLGEKVEMERQKHGSQDRVPGGTIPFLWVXSLYVLGGLLHDRYLTPAELDPLSKRLLATEKRPPXEVQVVILAERPNVKE

SEQ ID NO: 165262 - protein, 154 aa, Heterodera glycines
  Homolog annotation: Hit_ID=CAE56320.1; Match level="QueryCoverage =84%, HitCoverage=15%, E-value=2e-39, Identity=65%"; Hit description =Hypothetical protein CBG23985 [Caenorhabditis briggsae]
  Gene Ontology: Mol. function=transporter activity; Cellular component= integral to membrane; Biological process=transport
  Coding regions on vcDNA: vcDNA=SeqID_91685; Strand=+; Position=190-651
KISLCESFAKLRPLHTHTEILILAGLCCLCVSSVIFLSVPRILGKLMDEMNKEKEKKSDFISKLVRLLKENPFALLVMLIVGAGAIGLRAYLMHTAGQLVVNDLRTKVFNSVLRQDMAFFDRNKVGEIVSRLSTDAFVVGYSVSTNLSEGIRAI

SEQ ID NO: 165263 - protein, 130 aa, Heterodera glycines
  Homolog annotation: Hit_ID=NP_741285.1; Match level="QueryCoverage =100%, HitCoverage=33%, E-value=3e-46, Identity=57%"; Hit description= putative protein of ancient origin (44.8 kD) (4A969) [Caenorhabditis elegans] gb|AAM97969.1| Hypothetica
  Coding regions on vcDNA: vcDNA=SeqID_91686; Strand=+; Position=245-634
MGWPDWLQPHIDAFVLWVNGLLEYWHLGYLEYLVWLLLPIFIVFVLPIVFLFFSYGCVIFLRIYKHRNRIREAYASSVWDGARASIASFWEGVGYLWHGYEIDGLENIPDEGPGMIIAYHGPTPIDLYYV

SEQ ID NO: 165264 - protein, 210 aa, Heterodera glycines
  misc_feature (45)..(45): Xaa can be any naturally occurring amino acid
  misc_feature (134)..(134): Xaa can be any naturally occurring amino acid
  Homolog annotation: Hit_ID=XP_308192.1; Match level="QueryCoverage =97%, HitCoverage=52%, E-value=1e-61, Identity=54%"; Hit description =ENSANGP00000021557 [Anopheles gambiae]
  Coding regions on vcDNA: vcDNA=SeqID_91687; Strand=+; Position=1-628
GALTYYGKFIKEMRELRSPLDELLKKDIKWEWSRQQQEEFEKAKXIMLSDLLLTHYNPKLPIIVAADASKDGIGATISHILADKSERVVEHASCTFTAAQKNYSQIEKEALGLVFAVQKFHRMLYGRKFTLLTXLAIFGSKKGIPIYSASRLQRWALILSNYEFDIRYVSTTAFGNVDVLSRLIANYPRPNEDILIANICNKTECFVNLV

SEQ ID NO: 165265 - protein, 136 aa, Heterodera glycines
  misc_feature (130)..(130): Xaa can be any naturally occurring amino acid
  Homolog annotation: Hit_ID=A53530; Match level="QueryCoverage=98%, HitCoverage=18%, E-value=3e-43, Identity=57%"; Hit description =protein kinase C (EC 2.7.1.-) epsilon-related - Caenorhabditis elegans gb|AAA18259.1| protein kinase C
  Gene Ontology: Mol. function=protein kinase C activity; Cellular component=membrane fraction; Biological process=signal transduction
  Coding regions on vcDNA: vcDNA=SeqID_91688; Strand=+; Position=212-619
MVLFNGTAKIRVVEARDLQPTEWSKRFNQSDDPDSQLVDAYVNVDCDEYHVGKTVTRPKTKSPVWNEDYQTEVRNGKELGFTVFHDCALPPDDFVSNCRITFDHLKLMGVNDIWADLEPHGQLHLQIELXGKTAEG

SEQ ID NO: 165266 - protein, 183 aa, Heterodera glycines
  Coding regions on vcDNA: vcDNA=SeqID_91689; Strand=+; Position=40-588
MDNENFSSSNSKQQSRNGGGRVGSPFRNGYSNSGSNGKHGGSNDSRKRRTVIRRVNETASSSHAWDSSHVWLSGEEKSRLEAVQREWRLSRPKAKQQLWSKQQMGGSGGRVGSLMELTTDSAERKSLDALTESVASSSSVHPSPNSVFTRNRKVTSPPALAGDSVLKKSSPPAASSIFNSADK

SEQ ID NO: 165267 - protein, 81 aa, Heterodera glycines
  misc_feature (15)..(15): Xaa can be any naturally occurring amino acid
  Coding regions on vcDNA: vcDNA=SeqID_91690; Strand=+; Position=205-450
QHFKNKCIMVSSYIXFISYQKKGLYQGWAKLKNKKRNAKSEICETEKCEMKKKSEMRKAKICENAESEMRKAKFFLQLFNS

SEQ ID NO: 165268 - protein, 66 aa, Heterodera glycines
  Coding regions on vcDNA: vcDNA=SeqID_91691; Strand=+; Position=45-245
CDLWHFLNQFFIRFDDITQNFKKNEKKFFLKYYSVASKCSQLTIERLFILIAKVKSYGQLFFDFED

SEQ ID NO: 165269 - protein, 206 aa, Heterodera glycines
  Homolog annotation: Hit_ID=NP_505929.1; Match level="QueryCoverage =96%, HitCoverage=51%, E-value=1e-45, Identity=45%"; Hit description =pleckstrin-like (42.2 kD) (5M31) [Caenorhabditis elegans] emb|CAA98477.1| Hypothetical protein F38B7.3 [C
  Coding regions on vcDNA: vcDNA=SeqID_91692; Strand=+; Position=27-644
MSSNPALIKEGFVEKYKSGFLSSKWKSVFARLYSDSTLALYSDRADSRPSETIFLKNVIPYVCIGFMTDRMPVCCPSLPPGTAVQRLIGIGMDPRAEKVHWILFPSEQILEEWLNGIMSTLPPPPNPPPQQPTVPQQNIGFVPPPKYPDQPPPYGGQPIQPQQQSPYYPPPAAGGYGAQPQYPQQQYPGPQTVVIDRATTPSGGYG

SEQ ID NO: 165270 - protein, 129 aa, Heterodera glycines
  Coding regions on vcDNA: vcDNA=SeqID_91693; Strand=+; Position=3-392
LLSLFFLRFGFICFRMLFVLFFCHHFLLKIFFTMAFPIAFSIFGIFSVLFGNKNDGPKLRVKRSSSVASSASAAGAIAGGANANSNANNAFASFYADDDNTVLCCVCPAPMTLGDLKKSSSKKNNEKLF

SEQ ID NO: 165271 - protein, 160 aa, Heterodera glycines
  Homolog annotation: Hit_ID=NP_497509.2; Match level="QueryCoverage =100%, HitCoverage=27%, E-value=3e-50, Identity=46%"; Hit description= yeast translation activator GCN1 like (3D287) [Caenorhabditis elegans] gb|AAK29920.2| Hypothetical prote
  Gene Ontology: Mol. function=translation factor activity, nucleic acid binding; Cellular component=ribosome; Biological process =regulation of translation
  Coding regions on vcDNA: vcDNA=SeqID_91694; Strand=-; Position=2-626
VSPSSSWDRQGAAQGLSEVISALGDQFLSDNLPGVIRITESPTTQPHIRDGYIQLYIYLPMAFGDRFIPFLSKIIPSILKALADETEYVRESALIAGKRLITASSTHARKLLIPQLQSALIHENWRIRQASVKLLGDFLFFVSGVSGKMTSETTGEDDTM

SEQ ID NO: 165272 - protein, 208 aa, Heterodera glycines
  Homolog annotation: Hit_ID=CAE72860.1; Match level="QueryCoverage =100%, HitCoverage=16%, E-value=5e-71, Identity=61%"; Hit description= Hypothetical protein CBG20159 [Caenorhabditis briggsae]
  Gene Ontology: Mol. function=leucine-tRNA ligase activity; Cellular component=cytoplasm; Biological process=tRNA modification
  Coding regions on vcDNA: vcDNA=SeqID_91695; Strand=+; Position=3-626
EETIQNKWQKAKVFEKEAPEEDKSSTPKYVVTFPFPYMNGRLHLGHTFSLTKCEFSVGYHRLRGRRCLFPFAFLCTGMPIKACADKLLREIEQFGNPPVFGYQSSEEMSKNGTELAKQEEEVDQIIKDKSKGKKSKALAKTVAAKFQWQIMQSLGLNDAEIAEFSKSEHWLTYFPPKCMADLRKMGLAVDWRRAFITTEGNAYFDSFV

SEQ ID NO: 165273 - protein, 194 aa, Heterodera glycines
  misc_feature (67)..(67): Xaa can be any naturally occurring amino acid
  misc_feature (69)..(69): Xaa can be any naturally occurring amino acid
  Homolog annotation: Hit_ID=NP_006382.1; Match level="QueryCoverage =99%, HitCoverage=18%, E-value=1e-33, Identity=35%"; Hit description =importin 7 [Homo sapiens] gb|AAC68903.1| RanBP7/importin 7 [Homo sapiens] sp|O95373|IPO7_HUMAN Importin 7
  Gene Ontology: Mol. function=RAN protein binding; Cellular component =cell cortex; Biological process=signal transduction
  Coding regions on vcDNA: vcDNA=SeqID_91696; Strand=+; Position=2-583
AILSLFLFLIHILRYKRQKEKTPLVGLMESALPLLQERLSTLLPNQSQPSCILQKQILKIFYCLNHXMXNLQILSMDQFSKWLHLFLAILEREVPNECNTLPEDERAETLWWKCKKWAIKIIQRIFERYGNKGNVDLSYSDFATQYSKDLVLPVITSLMVHVLNNFINGHFVSDEVSYFTLSHLSDAMNQAQVW

SEQ ID NO: 165274 - protein, 139 aa, Heterodera glycines
  Homolog annotation: Hit_ID=AAO85453.1; Match level="QueryCoverage =100%, HitCoverage=95%, E-value=9e-73, Identity=97%"; Hit description= putative gland protein G16A01 [Heterodera glycines]
  Coding regions on vcDNA: vcDNA=SeqID_91697; Strand=-; Position=1-478
MATYLFIAAAAFGAGIYCWKAYLGPMLDQPKSDDEEKPKPEGGEEATTAGDKEEKKAGSKGDKHKKKDKKGEGAAAAPAADKKEEKRKDKHRSKEAGKSDDNKAGKKDKHGKKDKKGKKKDTADASTVDEALGEQSTAE

SEQ ID NO: 165275 - protein, 86 aa, Heterodera glycines
  Coding regions on vcDNA: vcDNA=SeqID_91698; Strand=+; Position=291-548
NHTEKENNGIWIKYLIENRIGIGISVQDLIIIHRMAFLCEEWQEKALVFTNVQLSLTRCQIQLIYKEIMFEAAFALFYLPIFLFSL

SEQ ID NO: 165276 - protein, 79 aa, Heterodera glycines
  Coding regions on vcDNA: vcDNA=SeqID_91699; Strand=+; Position=3-242
TKSFTHAKKKITPISRHKQHDHRRGWQIKNRAVHQSVCCEPPRPPPPPGAIWGKEFGCVCDCDPFTAQPLKVPGGGRGD

SEQ ID NO: 165277 - protein, 77 aa, Heterodera glycines
  Coding regions on vcDNA: vcDNA=SeqID_91700; Strand=-; Position=112-345
IFLYLNWTWISGTKTQETQVQESPGLLEPGPGRAQITIIVKYFYNVFNYLTSFCSSNGIKKIKKVKNCISKHSNGLK

SEQ ID NO: 165278 - protein, 66 aa, Heterodera glycines
  Coding regions on vcDNA: vcDNA=SeqID_91701; Strand=+; Position=394-591
MAEFFGDEEAMKSILHAQNVQQAEEAMKNIKGFDVAEWDKVKLKHWEDGQRLKLEQVRWIENLLVL

SEQ ID NO: 165279 - protein, 194 aa, Heterodera glycines
  Homolog annotation: Hit_ID=CAE66231.1; Match level="QueryCoverage =100%, HitCoverage=41%, E-value=5e-72, Identity=68%"; Hit description= Hypothetical protein CBG11474 [Caenorhabditis briggsae]
  Coding regions on vcDNA: vcDNA=SeqID_91702; Strand=+; Position=24-605
MKLDESEAFRTLFTPELTRLSQLFEGHGFEIRIAGGAVRDLLMGTRPSDVDFATDATPTQMKEMFEREQIRMFNKRGEEHGTVTCRINDRENFEVTTLRVDVVCDGRRAKVNFTTDWELDAFRRDLTINSLFLGLDGLIYDYTGGIEDVKQRRIIFVGDPIQRLQEDYLRILRYFRFFGRFSQLDAPHEQKNLE

SEQ ID NO: 165280 - protein, 121 aa, Heterodera glycines
  Homolog annotation: Hit_ID=NP_506181.1; Match level="QueryCoverage =81%, HitCoverage=22%, E-value=9e-12, Identity=38%"; Hit description =apoptosis-inducing protein D like (5N211) [Caenorhabditis elegans]
  Coding regions on vcDNA: vcDNA=SeqID_91703; Strand=+; Position=28-390
MSPSALFVCFGTRQKGGRKMPCTNCMAEYTRRRKEIGCAVCRFGFCERCVSQKCAVPSVSPTKPVPVCNNCYTLLTDPKRQCPQASRLGAEKSRDLPPIGVPFEQNAWGTDRLPPPSLRSL

SEQ ID NO: 165281 - protein, 116 aa, Heterodera glycines
  Homolog annotation: Hit_ID=AAC33318.1; Match level="QueryCoverage =95%, HitCoverage=9%, E-value=8e-18, Identity=41%"; Hit description =pol polyprotein [Drosophila virilis] pir||T13933 pol polyprotein - fruit fly (Drosophila virilis) retrotran
  Coding regions on vcDNA: vcDNA=SeqID_91704; Strand=+; Position=32-379
FGRAFTIECDASKKAIGAVLLQENGPVAYISRALNRHETNYPSIEREALALVYAVKEFSPYIVGSGVTKVITDCSALTGMMKAKELKGRLEKYQVTLQSFELEIIYRPGKKKKKKK

SEQ ID NO: 165282 - protein, 208 aa, Heterodera glycines
  Homolog annotation: Hit_ID=CAG10411.1; Match level="QueryCoverage =98%, HitCoverage=48%, E-value=7e-20, Identity=31%"; Hit description =unnamed protein product [Tetraodon nigroviridis]
  Coding regions on vcDNA: vcDNA=SeqID_91705; Strand=+; Position=25-648
MINTSMLLAIDLHNGRLVRKSFPLNSRIPTPRDKTTSWVADDKFFIFGGYGMSWHRLDHAHHQYFFRPHDFLDDYMGSCWNNQLLFYDLLLELWLEAPHGGTKPSARAAAASAYSATLNKVFLFGGRHDQTRLNDLFVFDLDQMLWTQIESSLPSEVSLSPGGLPPLRPEGRSWCTFTLVEAQKKILCFGGLDTAGRPLSDLWELDIA

SEQ ID NO: 165283 - protein, 212 aa, Heterodera glycines
  Homolog annotation: Hit_ID=NP_504187.1; Match level="QueryCoverage =89%, HitCoverage=15%, E-value=7e-25, Identity=39%"; Hit description =predicted CDS, integrase, catalytic domain containing protein family member (5E782) [Caenorhabditis elega
  Coding regions on vcDNA: vcDNA=SeqID_91706; Strand=-; Position=3-638
KEAELTPLKREDILVFRYSRVSFGLTVSPFLLNATIREHLSLFDNDLAKRIDENLYVDNILIEMKADEQLKSVVNEAKSIFKAAGMIIREFYGTDIEGLKQLPAEDLAKELEETKVLGIAWKPKHNRIAFKLPIFEGTITKRTILSHIAKVYDPLGLMSPALLSAKLFLQEVQNANSKWDETLSSHLVKTWLKIVETWSHSGTPINVEFPRF

SEQ ID NO: 165284 - protein, 105 aa, Heterodera glycines
  Coding regions on vcDNA: vcDNA=SeqID_91707; Strand=-; Position=327-644
LLDPVNTESCKYLYPDPICLTLFPGSENIEELLVHFIMDARVLHVDYVVVGGGVAGVCVVQELCDLLERDEVAGTSNHRIVFISGAEGFVKRVANQRQVEMSVQA

SEQ ID NO: 165285 - protein, 44 aa, Heterodera glycines
  Coding regions on vcDNA: vcDNA=SeqID_91708; Strand=-; Position=3-134
SDYPPNWWRNAQSMAHWLSEMMPTLVQRLAGDFHSTVLGSDQRF

SEQ ID NO: 165286 - protein, 133 aa, Heterodera glycines
  Homolog annotation: Hit_ID=CAE72551.1; Match level="QueryCoverage =90%, HitCoverage=15%, E-value=2e-23, Identity=43%"; Hit description =Hypothetical protein CBG19735 [Caenorhabditis briggsae]
  Gene Ontology: Biological process=chromosome segregation
  Coding regions on vcDNA: vcDNA=SeqID_91709; Strand=+; Position=34-530
VPILKIELAFPYHGINVDINCNCVAGIFNSHLIYHYSRLDERFVQMNIILKEWGKVRQVIDPRFGKINSYTMTLMVMHFLQCGVFPPILPNLYALFPKLFDGSGNVEDLRYDVNIKPNLPSLSYFLGSWQFVQ

SEQ ID NO: 165287 - protein, 91 aa, Heterodera glycines
  Coding regions on vcDNA: vcDNA=SeqID_91710; Strand=+; Position=64-336
FDSNSAIEALFCASHNFSVAEFALCCQFGLMITIMKLKIQREAVVCVNCVQREQRMDGLNCFFWRKRLKRTAKEWPRHSQWALRPFFVRED

SEQ ID NO: 165288 - protein, 122 aa, Heterodera glycines
  Homolog annotation: Hit_ID=CAE60185.1; Match level="QueryCoverage =63%, HitCoverage=37%, E-value=2e-16, Identity=58%"; Hit description =Hypothetical protein CBG03741 [Caenorhabditis briggsae]
  Gene Ontology: Mol. function=RNA binding; Cellular component=nucleus; Biological process=locomotory behavior
  Coding regions on vcDNA: vcDNA=SeqID_91711; Strand=-; Position=38-406
EGYITNYSPFANTFSYVCHISSSFAYIQFADVDAVNTSTSLNDSLFLGRQIKVMPKRTNVPGLSSTNRPPRGMRGGRGTGRARVIVKYIYPGMRSRGRPPRLADNGCVYILVQYVCFGKQLI

SEQ ID NO: 165289 - protein, 195 aa, Heterodera glycines
  Homolog annotation: Hit_ID=NP_495690.1; Match level="QueryCoverage =71%, HitCoverage=36%, E-value=4e-11, Identity=30%"; Hit description =putative prenylated protein (2I349) [Caenorhabditis elegans] pir||T24558 hypothetical protein T05H10.8 -
  Coding regions on vcDNA: vcDNA=SeqID_91712; Strand=+; Position=53-637
MTATSTTIVSELEEEEEKEQKIRAIVVLPAPEIIDARQGTAARDANEAMEEMAKAMREKTRDCAKLISAHSAVIFTANFLQSRVVINDIGGQLAKLYDALEVKKAEEFEQRMNELASAGDERRGRKIAELREAFREWETLLARLDVELERVAGPNIQTELGETGREIQLVSSNKMFKGGSLLSYVQSSSYPLMFL

SEQ ID NO: 165290 - protein, 54 aa, Heterodera glycines
  Coding regions on vcDNA: vcDNA=SeqID_91713; Strand=+; Position=346-510
KLLKNQSASSIKFQYKIFICAFIGLFIFFFIHTPKNQMLYIEWFSFLCLQNYLF

SEQ ID NO: 165291 - protein, 150 aa, Heterodera glycines
  Homolog annotation: Hit_ID=AAH60357.1; Match level="QueryCoverage =70%, HitCoverage=47%, E-value=7e-09, Identity=31%"; Hit description =MGC68745 protein [Xenopus laevis]
  Coding regions on vcDNA: vcDNA=SeqID_91714; Strand=+; Position=102-554
IENCLDLDYFKVCTIKVEGEQSTTTISVKSTEPTDDEILFDIHEKCGRVRAVGFAPDMQIVSIQQEDSVIEFVLLQEGKVVGTFRHNCTAKGADVLGVHWLSNSQVAFVTDLGCEFFCVYAYKRTLKMTQRLPQICLFVPAVYRTTFLVS

SEQ ID NO: 165292 - protein, 141 aa, Heterodera glycines
  Coding regions on vcDNA: vcDNA=SeqID_91715; Strand=-; Position=53-478
QRQQQAEEELEQHEPASSSAVPPSPPQRQRPTTPEAKRTARPSTEMATTEEQRETPKGKIDKERPTTQGTTPAEVSRTFILITNSTNKANSPSPSIKRTKATTTAPKVKPNNPDGDEPMLMEFDNGNSNILAESAVNGNSE

SEQ ID NO: 165293 - protein, 210 aa, Heterodera glycines
  Homolog annotation: Hit_ID=AAM97979.1; Match level="QueryCoverage =100%, HitCoverage=18%, E-value=1e-106, Identity=92%"; Hit description=Membrane calcium atpase protein 3, isoform c [Caenorhabditis elegans]
  Gene Ontology: Mol. function=calcium-transporting ATPase activity; Cellular component=integral to plasma membrane; Biological process =transport
  Coding regions on vcDNA: vcDNA=SeqID_91716; Strand=+; Position=3-632
IATSCGILKPGEDFLALEGKEFNDRIRDEHGEVCQEKLDQIWPKLRVLARAQPTDKYILVKGIIDSKLSANREVVAVTGDGTNDGPALKKADVGFAMGIAGTDVAKEASDIILTDDNFTSIVKAVMWGRNVYDSIAKFLQFQLTVNVVAVVVAFVGACAIQDTPLKAVQMLWVNLIMDTLASLALATELPNEDLLKRKPYGRTSPLISRT

SEQ ID NO: 165294 - protein, 105 aa, Heterodera glycines
  Coding regions on vcDNA: vcDNA=SeqID_91717; Strand=+; Position=2-319
RNESFLETLSNSKKAKIVIRDASDEQLLCLVEICLNILKGRVPLRPRHLKKLKAHAQMLRRLARTRCSRSAKNVLLQHGDGLPAIVGLIASIALPLIANVIENYT

SEQ ID NO: 165295 - protein, 206 aa, Heterodera glycines
  Homolog annotation: Hit_ID=NP_497190.1; Match level="QueryCoverage =30%, HitCoverage=10%, E-value=6e-11, Identity=50%"; Hit description =putative nuclear protein family member, with a coiled coil domain, GEX (Gut on EXterior) Interacting prot
  Gene Ontology: Biological process=regulation of protein activity, epigenetic
  Coding regions on vcDNA: vcDNA=SeqID_91718; Strand=+; Position=1-618
MSSSNRQQIYYQSRHHPQPHRVPGLSLPIASSSHHDIGSISPRHDHRQMVIVSGSDSCTDCVADYHSSCDCPACESKNLASVGHDAGLDDHQLYSYSLEPTQLEDDDEGIVHEFTTDSGERHVVIMTKNDEHFQEGITIQERVRRQKLSEAARSRYAQLSDEEKRAVTERRIIMRQRRKQKEREMEELEAILRASNDITDDLIPLD

SEQ ID NO: 165296 - protein, 217 aa, Heterodera glycines
  Coding regions on vcDNA: vcDNA=SeqID_91719; Strand=+; Position=2-652
QGMFRSATLSPNGRGELEKTAHDGRCPRYLFARPPLNGEETTKNKKKRVEEKPKGKEKQSKKEAKTDEKGKNKGNDELDVFASLGTLQKSLVTRDLMSRFCGQQRSSLAEEAIVSHSTKADKSMDNGYPLRGTNSFLPQSPSVGPRSTATPLTNSSGSSESDSSSLGRFRRGLSIGPAFSGISDSVEDPSLAEKITRNYESIFLKTLEQVNITRRCS

SEQ ID NO: 165297 - protein, 204 aa, Heterodera glycines
  misc_feature (74)..(74): Xaa can be any naturally occurring amino acid
  Homolog annotation: Hit_ID=AAH53311.1; Match level="QueryCoverage =96%, HitCoverage=32%, E-value=3e-35, Identity=36%"; Hit description =F-box protein 42 [Danio rerio] ref|NP_997904.1| F-box protein 42 [Danio rerio]
  Coding regions on vcDNA: vcDNA=SeqID_91720; Strand=+; Position=3-614
GIGFGVPSIQQLPDNVLELIFTYVSPYEDYNSIKLVSRRWYYLATATLRRMNHFFNKCINFSWHFVEGDHLLSXRCSHAACFHPRHCVVYIFGGCTNTYTAFNDLWLFDLSRREWERVMVARPPLPSPKALASMVRFGDNLLLFGGFSKSSMNPIHQTNTFYNELHLFNTASTCWEEIISENTAPHLGGHSASILSYFMLGFGG

SEQ ID NO: 165298 - protein, 196 aa, Heterodera glycines
  Coding regions on vcDNA: vcDNA=SeqID_91721; Strand=+; Position=3-590
MSPSRGVGAVRGRCGAKIFFCFIFCPIFFKFFAASTAVEEIAQCFEQQYANRMVKFGALHVVRRVGIISPLGAFYLAHFIDEADTTKELRRYPSLRQRHLARQENGEILVIYSGHSAHSLEWARVDLLASALRLEPILDGDDFQPHVSPVLLVTACPAPAVSAPVSLPAPYSLKTRSSTTSGEEQQRMVNNNNITP

SEQ ID NO: 165299 - protein, 131 aa, Heterodera glycines
  Homolog annotation: Hit_ID=AAH67919.1; Match level="QueryCoverage =74%, HitCoverage=12%, E-value=2e-27, Identity=53%"; Hit description =Hypothetical protein MGC69291 [Xenopus tropicalis] ref|NP_998853.1| hypothetical protein MGC69291 [Xenopus
  Coding regions on vcDNA: vcDNA=SeqID_91722; Strand=+; Position=2-580
STHNGKGTDNRELIFPSLANCHYVKSKDNLYKFKDDFANNQEYITVMVYKNDGKRVYLPFDPKPILEGTRINSPHYLCQLIVREPGIQRFTLVIAQYEKMKTIYYSLRVYSSADFRCGNMPMPYKFHRKVG

SEQ ID NO: 165300 - protein, 102 aa, Heterodera glycines
  Homolog annotation: Hit_ID=AAQ23180.1; Match level="QueryCoverage =56%, HitCoverage=10%, E-value=3e-21, Identity=79%"; Hit description =forkhead transcription factor 1 isoform b [Strongyloides stercoralis] gb|AAQ23178.1| forkhead transcriptio
  Gene Ontology: Mol. function=transcriptional activator activity
  Coding regions on vcDNA: vcDNA=SeqID_91723; Strand=-; Position=1-306
MALIRPKPKRVRRRTADGGTAPTGVTDDGAVGIGGQAAQQHSHKKPNPWGEESYSDLIARALGCAIDGRLKLSEIYQWFSDNIPYFAHRSSQEDAQGWKVKA

SEQ ID NO: 165301 - protein, 57 aa, Heterodera glycines
  Coding regions on vcDNA: vcDNA=SeqID_91724; Strand=+; Position=191-364
NFHIKNFQRFSSLKFFFLNFCGDILRRTPIHDKGCASQTLIRRTFGAGGGCARTNFS

SEQ ID NO: 165302 - protein, 176 aa, Heterodera glycines
  Coding regions on vcDNA: vcDNA=SeqID_91725; Strand=+; Position=3-530
FPPTSDQAPPSLISGLWHNDAEASPDNSPLFDQHPWHPTDGAIPADHSSPPGHPWHSADAMPGHAHTTAVDQPTWDQQVKAMSDQRPPLGPDPQYLVTTATSINKHPPAAPQQKPSPISAPHSATLPRTQSTPSAAASRPWTPSTVIHTTINTTYQGSHGHHHQQLPTPPATPSPR

SEQ ID NO: 165303 - protein, 73 aa, Heterodera glycines
  Coding regions on vcDNA: vcDNA=SeqID_91726; Strand=-; Position=91-312
LIKYDHFFAVCCIVANSIHLKQFCDFVDRRIRLQLLHFDQLTDVVSFSHIMTEGVSKFECPNSILMPSLAMNR

SEQ ID NO: 165304 - protein, 161 aa, Heterodera glycines
  misc_feature (42)..(42): Xaa can be any naturally occurring amino acid
  Homolog annotation: Hit_ID=NP_508386.1; Match level="QueryCoverage =92%, HitCoverage=53%, E-value=3e-42, Identity=46%"; Hit description =COLlagen structural gene (38.6 kD) (col-164) [Caenorhabditis elegans] gb|AAA81693.1| Collagen protein 164
  Gene Ontology: Mol. function=structural constituent of cuticle; Cellular component=extracellular; Biological process=cuticle biosynthesis (sensu Nematoda)
  Coding regions on vcDNA: vcDNA=SeqID_91727; Strand=-; Position=15-598
CPPGPKGSPGYPGEPGRTGKPGLPGGIGVTGGGRRRIRWPTXGGGQCAPCPAGPPGPPGYKGKRGFRGEKGAKGAPGSPGREGQPGEEGPEGEIGLQGEIGEAGPRGPPGEQGIGYAKGEPGPKGEIGPHGEAGEEGPPGERGEDSPPGDGVSRQILIFTV

SEQ ID NO: 165305 - protein, 217 aa, Heterodera glycines
  Coding regions on vcDNA: vcDNA=SeqID_91728; Strand=+; Position=3-653
STPSFADGTTAHSNGKDSLAEGQGHAKKPKLTQKVIISKEKALPLKQAIPNTTRTLKKLFNECKTDKEQSQPILKRKIPKSKVEPNGVTVKAEESTELCLQSVVHPHHSPEVPSTSGSMCYDSRTTIPISAWEGNQMERMDGDNDKKDNVNRIENLLPMVRGEFREHLEGLDEAIRQQNYPKAGEEVQALADSLFDADEFDNEQAECISLCLLHIFL

SEQ ID NO: 165306 - protein, 53 aa, Heterodera glycines
  Coding regions on vcDNA: vcDNA=SeqID_91729; Strand=+; Position=2-160
SLPTFSGDCTNYTSFWNTFKAGVHDLNIPNSLKFTYLKQCLSGPPLTLINSLP

SEQ ID NO: 165307 - protein, 119 aa, Heterodera glycines
  Coding regions on vcDNA: vcDNA=SeqID_91730; Strand=+; Position=119-478
KRKIIFAPHQLVRGWNNHWPQIKEKYDDVRKGLNTKRVEKIGEQVRQNVATDFSHESRWKLKQIVEEDKEEQNYLQQNQQHEKLKEEYEKQDEDADSDGRIDTEIRNGIFKGANCQVEL

SEQ ID NO: 165308 - protein, 174 aa, Heterodera glycines
  Homolog annotation: Hit_ID=XP_422495.1; Match level="QueryCoverage =57%, HitCoverage=17%, E-value=6e-12, Identity=36%"; Hit description =PREDICTED: similar to 24-dehydrocholesterol reductase; seladin-1; 3 beta-hydroxysterol delta 24 reductase
  Coding regions on vcDNA: vcDNA=SeqID_91731; Strand=-; Position=1-522
IKIEYMPSGDYFRRHWRSLFWSIEQMVPLIGFFPLRLLVGWLLPPEIPLLTSQRSRRLFSPRQILQNFLVPLKALPKFTASLHQQFCVGFCFVFWFFLLMNHRPLSLPSLIFSQFDHLSFLLPFLPFYRPIFLCFSFYHLFYLFGQLFLSHFLCLFLSSDLSPLALPRFFARSA

SEQ ID NO: 165309 - protein, 48 aa, Heterodera glycines
  misc_feature (43)..(44): Xaa can be any naturally occurring amino acid
  Coding regions on vcDNA: vcDNA=SeqID_91732; Strand=-; Position=141-287
RTLMGSLNDTKKILGNTADGPPFLENCRENTFYGVFRVTDHEXXTHSF

SEQ ID NO: 165310 - protein, 202 aa, Heterodera glycines
  Coding regions on vcDNA: vcDNA=SeqID_91733; Strand=+; Position=1-606
QQQQQNMMQFARKHSSSSLAEQRMAMDRDHLDLAFHHGSTVSLYAGTGVRNQPMLPLSNSANRMVPLTTPASRAKQRKQHIMNAYFGGFGSALNKLAAANNWTINGVKMMGSNEEVSSSVEIHQNHPASGINFCPNPSQPLRQTRGTFSQRKLQNHQQWTARSVVGIYTDEEDEEEEDDDNVDEDADDDDDIADDVDVSTEE

SEQ ID NO: 165311 - protein, 99 aa, Heterodera glycines
  Coding regions on vcDNA: vcDNA=SeqID_91734; Strand=-; Position=245-544
THQFCRIFPGAVRFRADALCRRVGFVFVVRNGEHNPGQGGHRLQRRGDFGQSADHDCRPRWCEGTGPLALWLKPAQVKRLVRALFQNTERRAILLAQIN

SEQ ID NO: 165312 - protein, 153 aa, Heterodera glycines
  Coding regions on vcDNA: vcDNA=SeqID_91735; Strand=+; Position=2-460
EKMEVLSDEEEGMALSDLKETAKKNNEEAKRREFDRRLPIIHSYLGDVNQGELSGQEIKQRQFEEPGNTIKISVFVINEVCLFPGQKMPIQFHQRSGIQFVHNAHRQQNILALFTAEDPNFEFHNDEEFSSVPCHQTGTLFQMQNILENGEND

SEQ ID NO: 165313 - protein, 75 aa, Heterodera glycines
  Coding regions on vcDNA: vcDNA=SeqID_91736; Strand=-; Position=2-226
RLGCSRGSSCSRGSSCSCGSSCSRGSGSSRVGGAGGGGHGVRGVVEGVGGAQHTHGGCGGGAAVVGGPHAVGVAV

SEQ ID NO: 165314 - protein, 146 aa, Heterodera glycines
  Coding regions on vcDNA: vcDNA=SeqID_91737; Strand=+; Position=27-464
IFSNCFFMLWRRSGNSSSVGRSGGESFGQRDTMGQLSSAELPTVANAVDVQSEEPSTDSKTGPEIGNEAGRLEKLVIRPSQPIDICRAPSQNEPRNFHLQHLQKPMAQRLLQRSASEMTTAVPKCASTDRWASAGTQKGHHQPRVI

SEQ ID NO: 165315 - protein, 167 aa, Heterodera glycines
  Coding regions on vcDNA: vcDNA=SeqID_91738; Strand=+; Position=3-503
AASAAEAAPDAQSGEAHAAGIAYKIRLAVPHVLIFSTTILYNLFGALAFQSLERPFELAHLQKHSLAISQAQNALLQLGLSSASNDSSFAADDSAFNVTLMVTIDELIRVSMNAFEEGIRADEILLAGASHGNWQNLALPSVDGSPPLGHWSSDHHQHKSKWNFHSS

SEQ ID NO: 165316 - protein, 140 aa, Heterodera glycines; identical to SEQ ID NO: 134012
  Homolog annotation: Hit_ID=NP_492115.1; Match level="QueryCoverage =93%, HitCoverage=16%, E-value=6e-42, Identity=62%"; Hit description =FAD dependent oxidoreductase and Calcium-binding EF-hand (80.8 kD) (1I143) [Caenorhabditis elegans] emb|C
  Gene Ontology: Mol. function=calcium ion binding; Cellular component =mitochondrion; Biological process=glucose catabolism
  Coding regions on vcDNA: vcDNA=SeqID_91739; Strand=-; Position=95-517

SEQ ID NO: 165317 - protein, 119 aa, Heterodera glycines
  Homolog annotation: Hit_ID=NP_827559.1; Match level="QueryCoverage =100%, HitCoverage=42%, E-value=5e-22, Identity=47%"; Hit description= putative secreted lyase [Streptomyces avermitilis MA-4680] dbj|BAC74094.1| putative secreted lyase [Stre
  Coding regions on vcDNA: vcDNA=SeqID_91740; Strand=+; Position=2-358
LILGQNWADGIHCYDGSALQNVWWEKVGEYAATFPSSTECKENSFSDTSGGAKNGKDKVFQMNGGGTLTIKDFEAERIVNLARACCNCKTQCQKLKFVLENIKATELKTLLSGLNKNYG

SEQ ID NO: 165318 - protein, 73 aa, Heterodera glycines
  Coding regions on vcDNA: vcDNA=SeqID_91741; Strand=-; Position=319-540
IFSVCPRQKKMAPSQQHLHKNLFTVSDFSFQSRHMDIHSSPSCFVLFSAKSAGQKECHHNAKPMNGNWLILKT

SEQ ID NO: 165319 - protein, 216 aa, Heterodera glycines
  Coding regions on vcDNA: vcDNA=SeqID_91742; Strand=+; Position=1-648
QKIKPHWMFTLDDLIRNAVQQAIKFLRPQEPTSRDEGFANSKQCSSVHQLLPVPQQSSLLAPASSFDLLGKAYTDQIKSLWDDLVSVERKLLSVLEVAFVERQERIRSLCTSASDLTPGNPNGVQQQQLWATLASQQTMGQGQMPNNGSNHQQQGAGGGTHFASPLLSVDDSGIDMERLSDDDEPLREWLLRIGCDDYSIELLERERYTKRDILEF

SEQ ID NO: 165320 - protein, 149 aa, Heterodera glycines
  Coding regions on vcDNA: vcDNA=SeqID_91743; Strand=+; Position=215-661
MKPLNLVRIILATTQYVSGRSFCLQILFKQTKDSNNERTNSPSCPIYFFQIYRNIKGVIDIKYEEIALFADVPGGRWQLLSGNFMPKIRFQCSPDWDELAAEKWIQTALEAGFRMFDLTFFSHNQGQISKAIKKYLPWFGLNRTDVFIT

SEQ ID NO: 165321 - protein, 160 aa, Heterodera glycines
  Coding regions on vcDNA: vcDNA=SeqID_91744; Strand=+; Position=167-646
MGQRPSMQQSEVARRPRAGSELGSSAQTTGSSSATAHIHNHRRANGTRSRQPQNDTSSPSSASSASPASAHSSRSFTEEAAEGVTGGGAAELARFFNQLGFVPVQSSSNRHRTSAEILIGGTSTSPSGSGGLAQPQQQNGDAASSAPSTSVRHASSSSSN

SEQ ID NO: 165322 - protein, 209 aa, Heterodera glycines
  Homolog annotation: Hit_ID=CAE64402.1; Match level="QueryCoverage =95%, HitCoverage=26%, E-value=1e-34, Identity=44%"; Hit description =Hypothetical protein CBG09094 [Caenorhabditis briggsae]
  Gene Ontology: Mol. function=transmembrane receptor protein tyrosine phosphatase activity; Cellular component=trans-Golgi network transport vesicle; Biological process=exocytosis
  Coding regions on vcDNA: vcDNA=SeqID_91745; Strand=+; Position=2-628
IRQLQNVVQNVEETVNEAQEEQLQEEAPPPLLAEAEAAQPTEEDAVDHVLLLKKDSEQFNNADMGLANTVHKIVKGGIQRVEGNRVYLKVAKEQLTEEELYKLIGYLDKKIAQPNNLYFDEFLYENGQLSFRISRLGVLQPNKDKKDGNADAALENASGVAQAVYKRRKDIQTLAGIRVDETGIGSGVYVVPVERSQRDWLFVPIMAVS

SEQ ID NO: 165323 - protein, 195 aa, Heterodera glycines
  Homolog annotation: Hit_ID=XP_309989.1; Match level="QueryCoverage =61%, HitCoverage=42%, E-value=2e-11, Identity=29%"; Hit description =ENSANGP00000015194 [Anopheles gambiae] ref|XP_319667.1| ENSANGP00000022407 [Anopheles gambiae]
  Coding regions on vcDNA: vcDNA=SeqID_91746; Strand=-; Position=1-585
RSTANIRDTISPTQPDQVNWNDITSQLKQLFAETRSLFVRRFECFKIRQQQGQDISSLIAQINASCENADLSLTKEQLKCIILVIALNDEHHDLRQKALKMLDDSQKNGTDISLKKIEEELRAIQLVKESALSLVNPPIATNAIRTRCKFKRKANAWSTDASMRIMWQIRPLALRLHIQGRHLPQVQQKKKKKKT

SEQ ID NO: 165324 - protein, 79 aa, Heterodera glycines
  misc_feature (34)..(34): Xaa can be any naturally occurring amino acid
  Homolog annotation: Hit_ID=NP_499741.1; Match level="QueryCoverage =100%, HitCoverage=13%, E-value=1e-15, Identity=49%"; Hit description= phosphomannomutase 45A (66.6 kD) (3O391) [Caenorhabditis elegans] emb|CAA16334.1| Hypothetical protein Y
  Gene Ontology: Biological process=growth
  Coding regions on vcDNA: vcDNA=SeqID_91747; Strand=+; Position=2-238
TPVVSCAVASLGCDAVIMNSASHNPKDDGGFHAXWAKEAPILSPHHAEICRIVSEEPKPEQGYCDIGQLGTSVFLHSDD

SEQ ID NO: 165325 - protein, 100 aa, Heterodera glycines
  Coding regions on vcDNA: vcDNA=SeqID_91748; Strand=+; Position=49-351
FITHFEMVIGHLRFGHLRSGHLRPAGNRTFAARQMRSDFCGPDICGPFLKGHFRTFAAGHLRPKGKSDICGHQNAKLSFLFQINYTKYFYLTHFTNYFVQ

SEQ ID NO: 165326 - protein, 67 aa, Heterodera glycines
  Coding regions on vcDNA: vcDNA=SeqID_91749; Strand=-; Position=399-602
PNSKRYFVALDKPVAELAKALCCSSTACSKVWKQYTFSNSINNTLTLRKFCFFLMRKKIKGCTNSGF

SEQ ID NO: 165327 - protein, 114 aa, Heterodera glycines
  Coding regions on vcDNA: vcDNA=SeqID_91750; Strand=-; Position=2-343
KKIKIKKGHQTTKKKAKNGRSRRPLRAMLSIKTGDRGASGGAGVWRWAPGAAVARCCICWECVMLSNISSLASSSTWVAVRPNRIEWRQLGGRDTRLLNEAVRRRRCTKETTRP

SEQ ID NO: 165328 - protein, 94 aa, Heterodera glycines
  Coding regions on vcDNA: vcDNA=SeqID_91751; Strand=-; Position=347-631
DQVPCSDQFESQINIHFSFCLFRVISLSVLPSLSFCVRLFTLQLSLPFLCYLIPISSDHSLPIHSFFCIFLCCLFVVFFTTIAPTHHHQFNSIE

SEQ ID NO: 165329 - protein, 218 aa, Heterodera glycines
  Homolog annotation: Hit_ID=NP_921502.1; Match level="QueryCoverage =94%, HitCoverage=12%, E-value=5e-38, Identity=39%"; Hit description =hypothetical protein [Oryza sativa (japonica cultivar-group)] gb|AAP53789.1| hypothetical protein [Oryza
  Coding regions on vcDNA: vcDNA=SeqID_91752; Strand=-; Position=3-656
EWLRCPFGWAGAPTTFQRAMEEVRQLCSATFFVYLDDCIIGSMTEDEHLKDIETFLKTMAEVGFRLKPEKCRFALGEIRYLGHLISEKGVRIDPKDLEPIQKIKKPKNITELRSLIGVLSYFRKFIYGFAEILQPIYELTKNESTTEWGQLHEQALEELKERLMTAPVLAPPRFGHPFVVETDASTKAIAGCLLQKNKKEEIHPICYFSRVLTKHEKR

SEQ ID NO: 165330 - protein, 103 aa, Heterodera glycines
  misc_feature (42)..(42): Xaa can be any naturally occurring amino acid
  misc_feature (54)..(54): Xaa can be any naturally occurring amino acid
  misc_feature (65)..(65): Xaa can be any naturally occurring amino acid
  Homolog annotation: Hit_ID=BAB33421.1; Match level="QueryCoverage =84%, HitCoverage=30%, E-value=6e-30, Identity=71%"; Hit description =putative senescence-associated protein [Pisum sativum]
  Coding regions on vcDNA: vcDNA=SeqID_91753; Strand=+; Position=323-633
CLPTPGSKNIAILPRRDSDLEAFSHNPSDGSFAPLVYRPSTXTKCLNLRFLSYXQDYYHSNRSLXGKTNLSHDGLNPAHVPYWGVNNPTLGEFCFAMIGRADI

SEQ ID NO: 165331 - protein, 67 aa, Heterodera glycines
  Coding regions on vcDNA: vcDNA=SeqID_91754; Strand=-; Position=27-230
GSDQRTQQHHQEAERRHFCFLRDLLVFVFGDPFYGMIFFVGSAHFYSKKKKKKFQPVREMVLRRLIN

SEQ ID NO: 165332 - protein, 97 aa, Heterodera glycines; identical to SEQ ID NO: 149606
  Coding regions on vcDNA: vcDNA=SeqID_91755; Strand=-; Position=254-547

SEQ ID NO: 165333 - protein, 212 aa, Heterodera glycines
  Coding regions on vcDNA: vcDNA=SeqID_91756; Strand=-; Position=2-637
AGVDQAKVNVTVVGAESGQNGAEQFNLQRVNAGLGAKALLQFVNKLLDGCSSLIRQAIGFVEGGDHFVKPCRERMRQWHFVVVAVVCGISVHTAAIRIGFWLIGNPYPCVNALDQEVSNGTDIARSGWHNPNFQSLRQFVYRYVRILCRLLLPNRGLFLIRHPVVQLGTGQLQHAEPAFVQEGVVGETIASVCCSDEKHHLLVPYACGQPTL

SEQ ID NO: 165334 - protein, 78 aa, Heterodera glycines
  Coding regions on vcDNA: vcDNA=SeqID_91757; Strand=+; Position=3-236
NVTLFSTTSVFPNKTDDSLPSLLINDIEMMAHFNKSGAIGNTSISFNFTTNSSTNLLSHPNATDHHQMKLNPVLVDEH

SEQ ID NO: 165335 - protein, 150 aa, Heterodera glycines
  Coding regions on vcDNA: vcDNA=SeqID_91758; Strand=+; Position=85-534
QPNPTAFPMGSYYGVVDHQQFMSQPCSIPSENVQNDPSAQQQVGVHQLKKTQSMLFTAPSDMTHQQQFGCGNPSSVTFPSPSASFVHPSPSQDFSVVRTHHKHQQPMVRLPPSQQTPHAHLMHQISSQSLQFFGHDPLLAATLNPDICLA

SEQ ID NO: 165336 - protein, 116 aa, Heterodera glycines
  Coding regions on vcDNA: vcDNA=SeqID_91759; Strand=-; Position=179-529
RAPPPPFSLSQMNFAQNPTGHNHIPQNISPTFCVTFSAVLCKNCAFSIESANFLIHSLLLILSVNQRINFLNIIFLIFSIKKLKCCAAAFCFNCLYNYSPSLQQQSPAMSQKVIKN

SEQ ID NO: 165337 - protein, 97 aa, Heterodera glycines
  Coding regions on vcDNA: vcDNA=SeqID_91760; Strand=-; Position=0-290
TKATKGEAKGCGTLTETDGKGKKKIGGGGEAKAMDDRSDAFIRPTAEAQRRKIAAPMPSAVMGCRHVNGQLNLANYCDDFLPLNGQPNRIRTFISPR

SEQ ID NO: 165338 - protein, 190 aa, Heterodera glycines
  Homolog annotation: Hit_ID=NP_569117.1; Match level="QueryCoverage =100%, HitCoverage=47%, E-value=2e-56, Identity=57%"; Hit description= acetyl-Coenzyme A acyltransferase 2 (mitochondrial 3-oxoacyl-Coenzyme A thiolase) [Rattus norvegicus] em
  Gene Ontology: Mol. function=3-oxoacyl-[acyl-carrier protein] reductase activity; Cellular component=mitochondrion; Biological process=lipid metabolism
  Coding regions on vcDNA: vcDNA=SeqID_91761; Strand=+; Position=2-571
FIVRAKRCTFCAFGGSLKNHTPTDLGEIAAAAAHKSASIAAEHIDHVIFGNVIQSSKDAAYLARHIGLRGGVPDHDPAVTDNRLCGSGFKAIAQGGQPILAGDSKVVLAGGTDSMSQAPFAERGARFGTQLGAKIEFEDVLWLGLTDAHANMPMGITAENLGAKYNGTQQDADANAIRSQNRWRLANNAG

SEQ ID NO: 165339 - protein, 93 aa, Heterodera glycines
  Coding regions on vcDNA: vcDNA=SeqID_91762; Strand=+; Position=79-360
SFSFLLSSCTNFAFSVGIRKALIGEGRSSRNPRGNCPRATMVRSSIRTNSNCGDGGKGHHLQGVRGRGCPTRAGTCQGGLTREHIELYVSKSL

SEQ ID NO: 165340 - protein, 191 aa, Heterodera glycines
  misc_feature (175)..(175): Xaa can be any naturally occurring amino acid
  Homolog annotation: Hit_ID=CAE63310.1; Match level="QueryCoverage =99%, HitCoverage=9%, E-value=4e-47, Identity=53%"; Hit description =Hypothetical protein CBG07699 [Caenorhabditis briggsae]
  Gene Ontology: Mol. function=acetyl-CoA carboxylase activity; Cellular component=cytosol; Biological process=nuclear membrane organization and biogenesis
  Coding regions on vcDNA: vcDNA=SeqID_91763; Strand=+; Position=3-574
KIVLIANDITFQMGSFSMREHRLYQKASEYSRKHQMPRIYVAANSGARIGFASDVKNRLKIVWNDEERPEDGFKYLSMDCGEEESDILSQVESTFTDGRHRIDAVIGKENDIGVENLVGSGFIAGETSAAYREVPTYCLVSGRAVGIGAYVARLSQRIWPGGNSHINLTGAGALXFMLGREGYTSNNPFGG

SEQ ID NO: 165341 - protein, 47 aa, Heterodera glycines; identical to SEQ ID NO: 133285
  Coding regions on vcDNA: vcDNA=SeqID_91764; Strand=-; Position=492-635

SEQ ID NO: 165342 - protein, 189 aa, Heterodera glycines
  Homolog annotation: Hit_ID=NP_495301.1; Match level="QueryCoverage =75%, HitCoverage=14%, E-value=2e-44, Identity=58%"; Hit description =diacylglycerol kinase zeta (2G748) [Caenorhabditis elegans] gb|AAC24300.2| Hypothetical protein K06A1.6 [
  Coding regions on vcDNA: vcDNA=SeqID_91765; Strand=+; Position=55-621
IQALVVEEKNRPKFSLTEPELSPEQLRQLFPELSDHWRRALAKSPVVKRAAAIQEQEQKRVSKHRTSRYWLDEQLSPSEHIWLPSSASSASSSAVDTECYLGEKDCQKMGEKRRCSGCHIVAHTACFPLLAKMNLSCKMTFRDCAQSANAKSPSSMAARKQRHSKSEQNNGNELVSNNSTTTTTITTCS

SEQ ID NO: 165343 - protein, 78 aa, Heterodera glycines
  Coding regions on vcDNA: vcDNA=SeqID_91766; Strand=+; Position=2-238
DRWGRGFESHRASYLLCSTKVAAPKWPRQSDPDPNLTAIEYLVAQNFSQNSSMMPAYGTEGQNAKVPFFLNGKAHKWC

SEQ ID NO: 165344 - protein, 117 aa, Heterodera glycines
  Coding regions on vcDNA: vcDNA=SeqID_91767; Strand=+; Position=2-355
PYHPSLIYSFSVRTTAADAMASLLLMSRSVIGDFTHVSDANQPGRERDNGSNNGKLLTHLAKQRPKPARLNRSRIQPTMATVTSPTVDDEQQHCVDDTPPTSSSTGEILPDLASKTK

SEQ ID NO: 165345 - protein, 155 aa, Heterodera glycines
  Coding regions on vcDNA: vcDNA=SeqID_91768; Strand=-; Position=1-465
MIHLFFGRFSNRRLFKPFSGHYSSHFSEIYSKIPSNIPKFSPPIMSLPEKKAALKRAKDDLAQAERRHSRRPTPAVPNRPRPQLVLPANRSPIRRPTRPAPPLSFVPHRRRQLSPSPAPVCPVMRSSTPSPPNRPLARRRLLSPSPVRSARRQST

SEQ ID NO: 165346 - protein, 217 aa, Heterodera glycines
  Homolog annotation: Hit_ID=CAE75060.1; Match level="QueryCoverage =100%, HitCoverage=11%, E-value=2e-46, Identity=48%"; Hit description= Hypothetical protein CBG22974 [Caenorhabditis briggsae]
  Gene Ontology: Mol. function=bidentate ribonuclease III activity; Biological process=RNA interference
  Coding regions on vcDNA: vcDNA=SeqID_91769; Strand=+; Position=2-652
SNSRLFCLGRQRNIPFLMETAKFDPHVNWLPPCYASTSEFYAVNPLDQTDLEEESGKEIGTSQNTPSGEKKAESTGWGALDDERQHYKCENGIETITFPQQTKQKIDLDLPPLPYNMLTQQWISDKSIADAVEALIGAHLIQLGQDAALKFMNWLGIRVLTQRPCLRSSLDDHSLKSLFLLYNKFDFATVENTIGYKFANKAYLVQAFTHASYFNNR

SEQ ID NO: 165347 - protein, 210 aa, Heterodera glycines
  Coding regions on vcDNA: vcDNA=SeqID_91770; Strand=-; Position=1-630
FSDDESILKVVNKTLFQGKQQNSTVRFEDVEKVFGELIRLEEGVSRTIRQVNRKANNVQNHLGTLANEVNAGFQTFTDEISKVAGKVKTLENLTLANKNIQQAMAITQPPVPHLPVPPPVQQLVHQARQTLNQSQESSSSDDEDNDQQRNALSFQSVNMITDAYPMALEGYKDDCVVTFDRWAKRFREYMDAFGRKLDEKDKLARLVIYL

SEQ ID NO: 165348 - protein, 56 aa, Heterodera glycines
  Coding regions on vcDNA: vcDNA=SeqID_91771; Strand=-; Position=2-169
IHRLTFLIFLCRKKPKKKKYFICFIIFKTFFNLLLYLPLISNLQTIFVFYLFFLFF

SEQ ID NO: 165349 - protein, 46 aa, Heterodera glycines
  Coding regions on vcDNA: vcDNA=SeqID_91772; Strand=-; Position=173-313
FFFFFKGAGGKFYGIKSYLNSFYHTPTVVEEIESGKAQEGTTTWSV

SEQ ID NO: 165350 - protein, 77 aa, Heterodera glycines; identical to SEQ ID NO: 132494
  Coding regions on vcDNA: vcDNA=SeqID_91773; Strand=-; Position=177-410

SEQ ID NO: 165351 - protein, 201 aa, Heterodera glycines
  Homolog annotation: Hit_ID=AAP78945.1; Match level="QueryCoverage =46%, HitCoverage=17%, E-value=3e-18, Identity=43%"; Hit description =interferon regulatory factor-2 binding protein 2B; IRF-2BP2B [Homo sapiens]
  Gene Ontology: Cellular component=nucleus
  Coding regions on vcDNA: vcDNA=SeqID_91774; Strand=+; Position=11-613
MQPISATEFASLNMQQQTNGNSNAQQMHEGQNQQTMGGAKKIGASNSHQISHRLVTSVPNSAFGQSNGIASNALGASASASSFLLRNSKANCFLCDLPRMPWAIVLDYAEPVCRGCVNYEGAEKIEAVIESARRMKQVHATLSAGICPSVISNSVPMGPLDLLNGTSSQLRSHLFSAQPAQQISVNGNGIGLANAAASAHH

SEQ ID NO: 165352 - protein, 118 aa, Heterodera glycines
  Coding regions on vcDNA: vcDNA=SeqID_91775; Strand=+; Position=3-359
EEDDADQEIRRGHSRIRAIAMLSDPFSIFVNIFTPLYLNFPFLFIFSHLHNVFFNSTICPFLFNFSAIHICLRIFVSLFTLSQITFFHLAILSSHFSLCLAFFLPADFCTLRRRSFAS

SEQ ID NO: 165353 - protein, 128 aa, Heterodera glycines
  Coding regions on vcDNA: vcDNA=SeqID_91776; Strand=+; Position=233-616
MSAPFPGGHSSSNVQSPVTTPSRGQQTLSLAAALVQQQQQSGTNTPNVPQGMEQQLQQTDLRSLQLQQQFTALMQSQPQQPPAAHAHAAHQTAQQNVHQHHQQQQASQLSSAFLPHQQHLLEGTAQSS

SEQ ID NO: 165354 - protein, 99 aa, Heterodera glycines
  Coding regions on vcDNA: vcDNA=SeqID_91777; Strand=-; Position=18-317
FFLLNVCLFLLLPNVLTLPIANSFLSSLFLLLLQNNAFLSLSSVKFPFYHFPYFFIFYHFPFITNCSFSVCCPSAVCLFLLPYVFFYSTEKGQCNCEFY

SEQ ID NO: 165355 - protein, 130 aa, Heterodera glycines
  Coding regions on vcDNA: vcDNA=SeqID_91778; Strand=-; Position=199-591
VPASPGPGFFGPGKSRSRFCPKFPVPAHSRLEKSGQTVKASKKEGHRGTGGRWTTRHRLIRSDLRLLTNSPYIFALSPPVLHLLLEAERVVQQQLVHLLLVHLKGPFSEANRTETRAEENKKDRGNRTEK

SEQ ID NO: 165356 - protein, 59 aa, Heterodera glycines
  Coding regions on vcDNA: vcDNA=SeqID_91779; Strand=+; Position=79-255
VSIHYPAWNSGHIRIFATYRAHSNERINALLGVRIGLTHVNITLGSEFEMGINNMPKFK

SEQ ID NO: 165357 - protein, 146 aa, Heterodera glycines
  Homolog annotation: Hit_ID=EAA77849.1; Match level="QueryCoverage =65%, HitCoverage=16%, E-value=6e-27, Identity=58%"; Hit description =hypothetical protein FG07251.1 [Gibberella zeae PH-1] ref|XP _387427.1| hypothetical protein FG07251.1 [Gib
  Gene Ontology: Mol. function=cAMP-dependent protein kinase activity; Cellular component=cAMP-dependent protein kinase complex; Biological process=RAS protein signal transduction
  Coding regions on vcDNA: vcDNA=SeqID_91780; Strand=+; Position=12-505
MPNMIFSWDTAKDRANLYMVMEFLPGGELFAYFRALRKFSSTVVKFYSAEIILALEYLHSKQIAYRDLKPENLMVSIHGHIKLTDFGFAKVIQNKSVIEFVLHFFSFFLSLLNLPINPWPSSPGTFFQMIFRPIENRIIQKCFPIG

SEQ ID NO: 165358 - protein, 207 aa, Heterodera glycines
  Homolog annotation: Hit_ID=NP_504187.1; Match level="QueryCoverage =96%, HitCoverage=15%, E-value=2e-32, Identity=42%"; Hit description =predicted CDS, integrase, catalytic domain containing protein family member (5E782) [Caenorhabditis elega
  Coding regions on vcDNA: vcDNA=SeqID_91781; Strand=+; Position=12-632
MEKVILADIEKAFLQLGVREQDRDATRFLWLANPKEANLEQLKQEDFRVFRFCRVSFGLTVSPFLLNATIREHLALHDTDVAQRISDNLYVDNIMVEVKPSESINQLVTEAKIIFESAGMRIREFFGSQIDELKELDSSELAKDLENTRVLGIEWKPRHDQLIFKMPLFTSPTTKRNILSHIAKVYDPLGLISPALLPAKHFLQIVQ

SEQ ID NO: 165359 - protein, 181 aa, Heterodera glycines
  Homolog annotation: Hit_ID=NP_491604.2; Match level="QueryCoverage =90%, HitCoverage=17%, E-value=3e-31, Identity=48%"; Hit description =DEAD H box polypeptide (1G42) [Caenorhabditis elegans]
  Gene Ontology: Mol. function=pre-mRNA splicing factor activity; Cellular component=nucleus; Biological process=ribosome biogenesis
  Coding regions on vcDNA: vcDNA=SeqID_91782; Strand=+; Position=30-572
MREHNNCNGNVQEKKSVTFVSSRPSSSLSVASTNTNSNDSKQPFKRCPLKIDRYRKHLSEILHSLEKVAIFIGETACGKSTQIPQLCLQAPWSSEGTIVVTQPRRVAAKMLGTRVAQELGTAVGELVGYKFRFEDQTSERTRLVYMTEGILLRELLHNCRLNAYSAVIVDEVHERSLNPMC

SEQ ID NO: 165360 - protein, 150 aa, Heterodera glycines
  Homolog annotation: Hit_ID=NP_495469.1; Match level="QueryCoverage =85%, HitCoverage=22%, E-value=3e-41, Identity=60%"; Hit description =cation-chloride cotransporter 9 (2H398) [Caenorhabditis elegans] gb|AAA82423.1| Hypothetical protein F10E
  Gene Ontology: Mol. function=sodium:chloride/potassium:chloride symporter activity; Cellular component=plasma membrane; Biological process=transport
  Coding regions on vcDNA: vcDNA=SeqID_91783; Strand=+; Position=22-526
MNPQNNCPTAAVIAQQSPPNAEPDSLFAQQSVAGEDIPWWQRNFLLQQPTLVNAWNAVFPTVVVNIFGIVIFLRMGWIVGTAGLFQAFVVLALCTLFSSVTVLSAIGICERCQIRSGGIYFLVSHVLGKRIGGAVGLIYTFGQACATALV

SEQ ID NO: 165361 - protein, 154 aa, Heterodera glycines
  Coding regions on vcDNA: vcDNA=SeqID_91784; Strand=+; Position=1-465
GRRPQFPKIEQQLFELVQHQLTAGECASNKWIRKMVKKLTTVGTENANGKRMKEDKEKEREKERMGEEQRGEDREAEGGKERCQFSERWLNNFKRRYGIQTTMEGTVNAEGDEETEDDEAERERRGGDTILVEGTLSLVIAGGVACLLTSLITG

SEQ ID NO: 165362 - protein, 203 aa, Heterodera glycines
  Coding regions on vcDNA: vcDNA=SeqID_91785; Strand=+; Position=1-609
PLSLDGRAGGSSIMTRSVVGALGNEIGTTPNRKNNFNKPPAQPTKQTPNSIKKQRKMANQGMIQTNEGMLTAGQNITKEVQQEKQNSPTLTATNKTNEGMLTAEQNIINEVQQEKQNSPTLTATNTSFYTAHESSSIGEVSMYEHVPLTENEPIITPPKSTTPPVLIVIPNQEEKEERRRHIKELLARTRQEANGPPNAQNNG

SEQ ID NO: 165363 - protein, 82 aa, Heterodera glycines
  Coding regions on vcDNA: vcDNA=SeqID_91786; Strand=-; Position=23-271
IRLLPVVSYLCKISKNFDTGHEANARIPIFSLIFFIYFFINHSLCNIGRLLACRLLNKWVHLHCSGQIFWTVRWHNHWFKTL

SEQ ID NO: 165364 - protein, 181 aa, Heterodera glycines
  Homolog annotation: Hit_ID=NP_491242.2; Match level="QueryCoverage =95%, HitCoverage=47%, E-value=2e-46, Identity=52%"; Hit description =transcription factor B1 mitochondrial (1E420) [Caenorhabditis elegans] gb|AAB42235.2| Hypothetical protei
  Coding regions on vcDNA: vcDNA=SeqID_91787; Strand=+; Position=2-547
GGPHFPTLPALRDFIYMYRMDADKTLSQNYLMDMNLTRKMVRRAGDLTNAFDVEVGPGPGGITRAILEQPCKRLDVVEIDKQFLMPLQHLSNHSMERMNVHREDVLKFDFEQVWTDAGAAKCSWVEEHPNFHIIGNLPFHISTTMVIKMMRQMSILRGPFEFGRVPLTFTFQYELAKCVVR

SEQ ID NO: 165365 - protein, 68 aa, Heterodera glycines
  Coding regions on vcDNA: vcDNA=SeqID_91788; Strand=-; Position=3-206
HENANEHRLSQMNERCEFCDALHFAEEKIHGRGNSFKDCCHYGKVFVPEIPEQDFPEELRDLFMKFDA

SEQ ID NO: 165366 - protein, 125 aa, Heterodera glycines
  Coding regions on vcDNA: vcDNA=SeqID_91789; Strand=+; Position=71-448
MPTDDTNSYQEKLDEYFSKLSEKNLSILDELGMTKLTAEIKNLSEEERAILEATKEMGTEAWIQAYREIRLVCQFNYDVNRNRFVLNTDPRYVKRSKSRLSSLTFSVSTTRSLFNLKTRQDSCRT

SEQ ID NO: 165367 - protein, 80 aa, Heterodera glycines
  Homolog annotation: Hit_ID=BAC06575.1; Match level="QueryCoverage =100%, HitCoverage=24%, E-value=3e-25, Identity=71%"; Hit description= As37 [Ascaris suum]
  Coding regions on vcDNA: vcDNA=SeqID_91790; Strand=+; Position=2-241
DNRASEAFSAILQIKDLADSDAGAYRCAIVNLFFYGNANFNLKLTGFGSPPFVEKPQISSHDHGRLMIMEGEDTPVWKPT

SEQ ID NO: 165368 - protein, 50 aa, Heterodera glycines
  Coding regions on vcDNA: vcDNA=SeqID_91791; Strand=+; Position=1-150
VCFRPLIFSFMQNRWMKGLKKQSNKFRQLPMLSPVTNNDENCSQKSRRFS

SEQ ID NO: 165369 - protein, 102 aa, Heterodera glycines; identical to SEQ ID NO: 133836
  Coding regions on vcDNA: vcDNA=SeqID_91792; Strand=+; Position=10-318

SEQ ID NO: 165370 - protein, 221 aa, Heterodera glycines
  Homolog annotation: Hit_ID=NP_495741.1; Match level="QueryCoverage =85%, HitCoverage=36%, E-value=1e-62, Identity=64%"; Hit description =pyridoxal-5'-phosphate-dependent enzyme, beta family and Amino acid -binding ACT (2I557) [Caenorhabditis e
  Gene Ontology: Cellular component=mitochondrion
  Coding regions on vcDNA: vcDNA=SeqID_91793; Strand=+; Position=3-665
SASSISVPDFVRVEEIPEECAIKRVPSALCSFVDPFCDPKKPVKTTFSDISTAAFNIRDGILRTPTIKSDALSSMFGVDLFFKQEYLQVTGSFKERGARFALLRLTEEQRRIGVIAASAGNHALSLAYHGSKLGIPVTVVMPKFAPLMKISCCESYKAKVILHGLNIQESKIFAYELAKEKNLKYVNGFDNPDVIAGQGTIGLEILDQVGDVDAIVVPVGG

SEQ ID NO: 165371 - protein, 108 aa, Heterodera glycines
  Coding regions on vcDNA: vcDNA=SeqID_91794; Strand=-; Position=248-574
FIFRWFSPNSSLFLPKFPRFSSFSSFCCFTSIIIPRKLLGRWRRNARPMGEKKLDEDTAERAGRKRRRGSICVSFQRHRQISESALWHSLLNHYYSFSHIPFLPPSTD

SEQ ID NO: 165372 - protein, 85 aa, Heterodera glycines; identical to SEQ ID NO: 131320
  Coding regions on vcDNA: vcDNA=SeqID_91795; Strand=-; Position=396-653

SEQ ID NO: 165373 - protein, 135 aa, Heterodera glycines
  Coding regions on vcDNA: vcDNA=SeqID_91796; Strand=-; Position=254-661
PVAEVPPPLPVPPGESSVEACEPMRFLRFRCAHSSESERSDRSVSVIWLSARWTTIDDEATLLLVGPPMVPLLVLFLVDAFYVVVLVAADCEQMDVAQKRCQMSSARASRRMMKWAVLANSVSALCSTGAGHHPP

SEQ ID NO: 165374 - protein, 206 aa, Heterodera glycines
  misc_feature (84)..(84): Xaa can be any naturally occurring amino acid
  Homolog annotation: Hit_ID=NP_503052.1; Match level="QueryCoverage =99%, HitCoverage=25%, E-value=3e-52, Identity=46%"; Hit description =cyclin M2 (89.5 kD) (4S142) [Caenorhabditis elegans] gb|AAK77203.1| Hypothetical protein C52D10.12 [Caeno
  Gene Ontology: Cellular component=mitochondrion; Biological process =embryogenesis and morphogenesis
  Coding regions on vcDNA: vcDNA=SeqID_91797; Strand=+; Position=3-620
FFMLITLPLAWPIGKLLDCILGEDLVGMDHEKLLEMLRMAHQHSEHHEELAEDLKIAVGAMEIAEKIVREVMTPIEDVFMLSDXAVLDSDCVADVVRRGYSRIPVFTNNDRNQITGLLFIKDLALLKPNERLTVSTICDFYARTLRFVTDDTPLQTMLEEFKEGEYHLGIVLSENHNRVVGIIPLEDIVEEILQSKIVDQSEVVYD

SEQ ID NO: 165375 - protein, 59 aa, Heterodera glycines
  Homolog annotation: Hit_ID=NP_495469.1; Match level="QueryCoverage =94%, HitCoverage=9%, E-value=5e-10, Identity=58%"; Hit description =cation-chloride cotransporter 9 (2H398) [Caenorhabditis elegans] gb|AAA82423.1| Hypothetical protein F10E7
  Coding regions on vcDNA: vcDNA=SeqID_91798; Strand=+; Position=2-178
PSKDPLKATDLVTAAAVLLALLANLNQMAILSSMPFLLAYAFVNYSYGSLAMSDDLDSL

SEQ ID NO: 165376 - protein, 135 aa, Heterodera glycines
  Coding regions on vcDNA: vcDNA=SeqID_91799; Strand=-; Position=244-651
MFSKVNFWVKLKMYVCVFKTLNAYQITDKKLHLILRDDEGAMKLATNLLGYNSMQCFAHKIQLVNKIHLILCIFGYFKAVGDGLKLLGGIFDVKERMKKAIRRIRKSRIIADDFKALQIENDLPLKTLQKVIKFK

SEQ ID NO: 165377 - protein, 188 aa, Heterodera glycines
  Homolog annotation: Hit_ID=NP_492809.1; Match level="QueryCoverage =95%, HitCoverage=53%, E-value=3e-34, Identity=42%"; Hit description =proteasome Regulatory Particle, Non-ATPase-like, Multi-ubiquitin Chain Binding protein homolog, S5 (37.3
  Gene Ontology: Cellular component=26S proteasome
  Coding regions on vcDNA: vcDNA=SeqID_91800; Strand=+; Position=3-566
GLLSLADRIDVLNSLTTEDRKLMVRLHSLEILGVSKVFDGIRTAYLALKHRKNRNHRQRIVVFLGSPLDPLLEEKETFIKFAKKLKKEKVSVDLVLFGEATAENNKIIADFVDLLNGAEEGNSHLLVVMAGDTKLYDVSLRSPIFAASGAALGARGEFGINEEDHPELAMPLPIPLEEERPPPPLSAG

SEQ ID NO: 165378 - protein, 84 aa, Heterodera glycines
  Coding regions on vcDNA: vcDNA=SeqID_91801; Strand=+; Position=1-255
EAGEIGSGEGTSNYSQENTDKPKRKRRTIEEIEQEKLNKEVNRICRQIQSAKNSKCEQFLFCHFSSKILDLDGFLFLQLKTLKY

SEQ ID NO: 165379 - protein, 148 aa, Heterodera glycines
  Homolog annotation: Hit_ID=CAE63921.1; Match level="QueryCoverage =94%, HitCoverage=33%, E-value=4e-37, Identity=51%"; Hit description =Hypothetical protein CBG08493 [Caenorhabditis briggsae]
  Gene Ontology: Mol. function=tRNA (cytosine-5-)-methyltransferase activity; Cellular component=nucleus; Biological process=tRNA methylation
  Coding regions on vcDNA: vcDNA=SeqID_91802; Strand=+; Position=3-446
LMHEHCPNPEGFVLANDSDYKRCYLLVRQTLKRMPTANVAVVSHDASHLLVLLDANGRPMLFHRVLCDLICSGDGTLRKNPELWRSWDPLTSVNLHKLQLPIARRCLELLDNDGLMGYSTCSLNPLQDEAVIGSLLRQSQRNSGTWGD

SEQ ID NO: 165380 - protein, 104 aa, Heterodera glycines
  Coding regions on vcDNA: vcDNA=SeqID_91803; Strand=+; Position=3-317
NGLSKNRNYAQKASQTILALPIPSTIAFIHPIMSAKIIRVPKIACDLSLEKNGLSKNRNYAQKASQTILALPIPSTFFFIHPIMSAKIIRVPKIACDLSLKKMV

SEQ ID NO: 165381 - protein, 84 aa, Heterodera glycines
  Coding regions on vcDNA: vcDNA=SeqID_91804; Strand=-; Position=144-398
KPIGRPRGSHSLPLAYLCLNVLELKFRKMLLAFRGGGKTLPTHSFILGSNFEEFKAILSSEALPRGATGENFMHILKKFMLHFP

SEQ ID NO: 165382 - protein, 127 aa, Heterodera glycines
  misc_feature (112)..(112): Xaa can be any naturally occurring amino acid
  Coding regions on vcDNA: vcDNA=SeqID_91805; Strand=+; Position=151-534
SGFATFKKVTNYELAILYSKILQLIIVAITTMCVCYINKYQKRYDCDIKFCNCLNEYPNCFLTKVCSPTHILNILFFRIYYAGQFIFLENVLKKDKNNYFILPSIDMHMYFXFLLLCKLLIYIYLYT

SEQ ID NO: 165383 - protein, 71 aa, Heterodera glycines
  Coding regions on vcDNA: vcDNA=SeqID_91806; Strand=+; Position=201-413
VKHLKQLSNRRHQQSNSGEKSRFLNNIWVNCKHFRHLDQPREIGLQSCARLTRHPQKANTHFKGKKKKKKK

SEQ ID NO: 165384 - protein, 161 aa, Heterodera glycines
  misc_feature (53)..(53): Xaa can be any naturally occurring amino acid
  misc_feature (85)..(85): Xaa can be any naturally occurring amino acid
  Homolog annotation: Hit_ID=CAE71050.1; Match level="QueryCoverage =99%, HitCoverage=36%, E-value=1e-37, Identity=43%"; Hit description =Hypothetical protein CBG17892 [Caenorhabditis briggsae]
  Gene Ontology: Mol. function=formaldehyde dehydrogenase (glutathione) activity; Cellular component=cytoplasm; Biological process=alcohol metabolism
  Coding regions on vcDNA: vcDNA=SeqID_91807; Strand=+; Position=83-564
KFPTIVGHEGAGVDESVGPGVQSVRACDHVIPLPLCQCRECDVCADPTSNLCXKISLFVRELIWRVFYYWKWLTKTTKKSQTFFXGGGTTRFSCRGQPIYHFVGCSTFSEYTVTPEIAVAKIDPSLPLDRMALLGCGVTTGYGSPIKGCPIRAGSTVGVWG

SEQ ID NO: 165385 - protein, 209 aa, Heterodera glycines
  Homolog annotation: Hit_ID=XP_325540.1; Match level="QueryCoverage =97%, HitCoverage=37%, E-value=1e-10, Identity=27%"; Hit description =predicted protein [Neurospora crassa] gb|EAA33811.1| predicted protein [Neurospora crassa]
  Coding regions on vcDNA: vcDNA=SeqID_91808; Strand=+; Position=43-669
MQQHPMHHHPHYQQPQFAYPPPPLSAPNAGTGAHMQQQPTPPPQAAQLHAMAASATPTGLFIYATNFGTFQQAAAAMGPVGEPPHQQPNELIGPMPGQHQQHPMHHHPHYQQPSFAYPPPPLSAPTVSTGGAHMQQQQTPPPQTAPPTHHQHVMPTALFGYNPNIGPFHPPPAMGPTVEQPHQQPNELIGQMPVRHQQQQHPMHHHPHY

SEQ ID NO: 165386 - protein, 74 aa, Heterodera glycines
  Homolog annotation: Hit_ID=NP_506570.1; Match level="QueryCoverage =95%, HitCoverage=21%, E-value=2e-11, Identity=49%"; Hit description =DeHydrogenase, Short chain (37.2 kD) (dhs-22) [Caenorhabditis elegans] emb|CAB02732.1| Hypothetical prote
  Gene Ontology: Cellular component=mitochondrion
  Coding regions on vcDNA: vcDNA=SeqID_91809; Strand=+; Position=201-422
MEEEAGWHPDMLYLFCIGLIVFIILFAIRQWIKGAQFREKVRARGAVAIVTGANSGIGKHLERELNLRYVKVYM

SEQ ID NO: 165387 - protein, 96 aa, Heterodera glycines
  Coding regions on vcDNA: vcDNA=SeqID_91810; Strand=+; Position=49-339
MLRYLRSRIGSSYQVKSDHFDDFVDFSKLTTHGFPQKASSMSVDEKLGYIAIGTKDGRLLIFCSNGAQHLSANFGSKLPICALYFVAAFCTVSNHF

SEQ ID NO: 165388 - protein, 67 aa, Heterodera glycines
  Coding regions on vcDNA: vcDNA=SeqID_91811; Strand=+; Position=186-389
FILFKRARSARLSSTKFKNELLAPVRAQQSLKRKARLSTKFKNRRQAPVQAQQRNFLRTITRFQKFF

SEQ ID NO: 165389 - protein, 181 aa, Heterodera glycines
  Homolog annotation: Hit_ID=XP_420199.1; Match level="QueryCoverage =97%, HitCoverage=36%, E-value=1e-16, Identity=29%"; Hit description =PREDICTED: similar to Transcription initiation factor TFIID subunit 1 (Transcription initiation factor TF
  Gene Ontology: Mol. function=general RNA polymerase II transcription factor activity; Cellular component=transcription factor TFIID complex; Biological process=G1-specific transcription in mitotic cell cycle
  Coding regions on vcDNA: vcDNA=SeqID_91812; Strand=+; Position=3-545
NLEAEQQQKPKEEAGEEGTENEKGPPTDRIAGTDPWALRIGPPPRREDCCTDEYELLCVENLDELLSSEKQKPTNEDDDESAPPWRFGPAQMWYDRFGVPANPSNFDYGLKRRGTALSKRSTDDGTMPLPSEDDRNFLPAHFLHWEDDIIIDPEQAREKLVKELSSAKLPRCGWIPTPYTR

SEQ ID NO: 165390 - protein, 53 aa, Heterodera glycines
  Coding regions on vcDNA: vcDNA=SeqID_91813; Strand=-; Position=87-248
FFFFFSRTSVSRAKCCAKMPTFCLTTSNPVPAKWRAHAVSAQECKLFNFSVVR

SEQ ID NO: 165391 - protein, 68 aa, Heterodera glycines
  misc_feature (12)..(12): Xaa can be any naturally occurring amino acid
  misc_feature (46)..(46): Xaa can be any naturally occurring amino acid
  misc_feature (55)..(55): Xaa can be any naturally occurring amino acid
  Homolog annotation: Hit_ID=AAS84611.1; Match level="QueryCoverage =100%, HitCoverage=17%, E-value=3e-18, Identity=72%"; Hit description= cathepsin L-like cysteine proteinase I variant form precursor [Heterodera glycines]
  Coding regions on vcDNA: vcDNA=SeqID_91814; Strand=+; Position=2-204
IESSFSDWNAFXFKHVKAYTDQEGANERMLTQLSAKQFIDKHNGAXKEGIVSFHXPGEIHIVYLPFSE

SEQ ID NO: 165392 - protein, 43 aa, Heterodera glycines
  Coding regions on vcDNA: vcDNA=SeqID_91815; Strand=+; Position=2-133
FYANSGSFLRTRADNIKARKSSARLCSLCTALGPTLYVSLILC

SEQ ID NO: 165393 - protein, 180 aa, Heterodera glycines
  misc_feature (117)..(117): Xaa can be any naturally occurring amino acid
  Homolog annotation: Hit_ID=CAE61942.1; Match level="QueryCoverage =98%, HitCoverage=49%, E-value=2e-65, Identity=65%"; Hit description =Hypothetical protein CBG05940 [Caenorhabditis briggsae]
  Gene Ontology: Cellular component=membrane; Biological process=meiosis
  Coding regions on vcDNA: vcDNA=SeqID_91816; Strand=+; Position=3-541
SYTEEPHATRRSQILERHPEVKEFFGIDQSFKYVVVSMVLFQLLMAFFLRDSHWLLVCLQAYFVGGTLSHSLTLAVHECSHNLGFGHSKMLQNRLLGFVANLPMAIPMSISFRKYHXGEHHRNLGEDVVDTDVPTEFEARFFTGKVGKFAWLFLQPVFYAIRPFAIYRKSVTDMEIVNAL

SEQ ID NO: 165394 - protein, 81 aa, Heterodera glycines
  misc_feature (19)..(19): Xaa can be any naturally occurring amino acid
  misc_feature (58)..(58): Xaa can be any naturally occurring amino acid
  Homolog annotation: Hit_ID=CAG06679.1; Match level="QueryCoverage =100%, HitCoverage=16%, E-value=7e-12, Identity=46%"; Hit description= unnamed protein product [Tetraodon nigroviridis]
  Coding regions on vcDNA: vcDNA=SeqID_91817; Strand=-; Position=378-624
EREEKRGEREREREERDRXNETEREREKIKGERSEERERRERVERDERKRIERKKRGXMEKEKIKKRREKEKSRQRDERKK

SEQ ID NO: 165395 - protein, 130 aa, Heterodera glycines
  Coding regions on vcDNA: vcDNA=SeqID_91818; Strand=-; Position=170-562
LDANQAVNSTSNRVIFVMRLANAGRKQTRLGMTHRRLLRGVHSLLQMTRASAGCALLSSSAALALLLPDHVFLVVLQHVLQLFFVCPLVVLIFFVLIAFIALRHWPIVLTDRLLSVHQLLLLCLYAGLVQ

SEQ ID NO: 165396 - protein, 211 aa, Heterodera glycines
  Coding regions on vcDNA: vcDNA=SeqID_91819; Strand=+; Position=1-633
GVLFSEAEAFALLNDGELEARFEKAIGSLNILECTLCDSAKMKALQRRVQQKNGPCEEQQTSRVPSRAPTLSQTTADQQMLSTSHTTTTATSASSSFTVQSANLTRPESTSSAKSSTTRDQQQQQHGRLQPNTSTVASNAPSLLQQQQQSQRAAAATYRPNAADFVSKAGCIPQATTSASSLSSSNHLHPQAASIQAQFYQQLSQLNHSQM

SEQ ID NO: 165397 - protein, 200 aa, Heterodera glycines
  misc_feature (146)..(146): Xaa can be any naturally occurring amino acid
  Homolog annotation: Hit_ID=CAE66569.1; Match level="QueryCoverage =60%, HitCoverage=25%, E-value=8e-36, Identity=57%"; Hit description =Hypothetical protein CBG11884 [Caenorhabditis briggsae]
  Gene Ontology: Mol. function=mannosyl-oligosaccharide 12-alpha -mannosidase activity; Cellular component=membrane fraction; Biological process=N-glycan processing
  Coding regions on vcDNA: vcDNA=SeqID_91820; Strand=+; Position=46-646
MGLRFYEKYFVLFGAFIGGCFLFSGILVYFGSDRINILPELQNRIINPKVRNVYDSQSIKQMEHRFGFASNLNVSMKENERRRNFTRNMMKFAWSNYVRYAWGENELRPIAKIGHSGSVFGRAPVGATIIDALDTLYIMGMNKEFXSDLSVFETNIRFVGGLLSAYALTKDQMFLNKARDVADLLMPSFNASPFGIPMSL

SEQ ID NO: 165398 - protein, 196 aa, Heterodera glycines
  Homolog annotation: Hit_ID=CAE71394.1; Match level="QueryCoverage =96%, HitCoverage=29%, E-value=9e-34, Identity=38%"; Hit description =Hypothetical protein CBG18301 [Caenorhabditis briggsae]
  Coding regions on vcDNA: vcDNA=SeqID_91821; Strand=+; Position=5-592
MLRKKITSRPTILHLVRLRAKHGGQQLLCANTHLYYDPKYEEVKIIQTLLCLRYIDKIRAQLSNDSSCQIQVIFAGDFNSTPESRPIALIGGDDQTLEMKPDEKNYETNAESLKVKAPFKSQLLSGSPDYTNFTCPPGSSLGFNGCLDYIWAHPPLRIEHIWPMPDHRLVTKYDALPSPIAPSDHLPILCDVQLDS

SEQ ID NO: 165399 - protein, 222 aa, Heterodera glycines
  Homolog annotation: Hit_ID=XP_320889.1; Match level="QueryCoverage =83%, HitCoverage=22%, E-value=6e-46, Identity=49%"; Hit description =ENSANGP00000012033 [Anopheles gambiae] ref|XP_313651.1| ENSANGP00000013044 [Anopheles gambiae] ref|XP_314
  Coding regions on vcDNA: vcDNA=SeqID_91822; Strand=+; Position=12-677
MYAFGLLDGIKAKINSPINLCSAGKESRGKNAPIKSNKVDGTPNKDAEKQISQLKQEYTNVFKNELGLCTKVKAHLELKPDAQPIYRKARPVPYNAKNAVDGELDRWEKMGVIGKVEHTEWAAPILVVKKVDGSARLCIDYSTGLNNALKDHQHPLPLPEDIFATLNGGQYFSQIDLRDAYLQVELDEASKKLCAIATHRGNYRVKRLPFGIKTAPGIFQSI

SEQ ID NO: 165400 - protein, 89 aa, Heterodera glycines
  Coding regions on vcDNA: vcDNA=SeqID_91823; Strand=-; Position=184-453
AKCPLILAQIWLISTSFGFDFCSSQPNVMPLRFRLSCPFQKQLFRHGRGIGKVQMMKSEQSNCRHKCKCKSTAVSKRHLISQLIDNPPN

SEQ ID NO: 165401 - protein, 58 aa, Heterodera glycines
  Coding regions on vcDNA: vcDNA=SeqID_91824; Strand=+; Position=81-257
LKTDQIAVVIFRFAVPTNFPLLYTPTDSVRRAGQGCPVTRSAALRQNEQRTTEKTNSS

SEQ ID NO: 165402 - protein, 154 aa, Heterodera glycines
  Homolog annotation: Hit_ID=CAE63510.1; Match level="QueryCoverage =61%, HitCoverage=4%, E-value=2e-11, Identity=35%"; Hit description =Hypothetical protein CBG07989 [Caenorhabditis briggsae]
  Coding regions on vcDNA: vcDNA=SeqID_91825; Strand=+; Position=3-467
ILIDVWAFTEQQRKGGATALDSFCSTNTSTPKVGTFRSLSTLILDILNPVAKRHKNALINSLGVVWMFRNSYGGGAKMADTCRCSFDYSAQQIEVANLALNLNALSLTSIICSVSDTLKESGNKTTKSSSSASSANSSEKLGVGGFSFLFKDED

SEQ ID NO: 165403 - protein, 119 aa, Heterodera glycines
  Coding regions on vcDNA: vcDNA=SeqID_91826; Strand=+; Position=3-359
RVVQEKAEKQRKLSAQLNKLLTLGSPISVNLLSISIFCSYASKIDVLHCYADLHKSIQQFLSSYGQELIQKVKFDCNFNIDFPSEFALSVCQPLGLSTLSFADNSSSHGIFLNCDPNSR

SEQ ID NO: 165404 - protein, 106 aa, Heterodera glycines
  Coding regions on vcDNA: vcDNA=SeqID_91827; Strand=+; Position=43-363
MKGAQSLRCAGPRQITAIGFDLGAVGCNLAIIIFVPNFMCGKCLHTVVFGLSGFDANGYQVHLFHMPKFRGFLKSALPERTNEIVWLQHMKFIVFDDTVLIRIAIC

SEQ ID NO: 165405 - protein, 220 aa, Heterodera glycines
  Homolog annotation: Hit_ID=NP_499251.2; Match level="QueryCoverage =73%, HitCoverage=26%, E-value=4e-50, Identity=58%"; Hit description =tubulin-tyrosine ligase (69.1 kD) (3L221) [Caenorhabditis elegans] emb|CAA87425.3| Hypothetical protein Z
  Coding regions on vcDNA: vcDNA=SeqID_91828; Strand=+; Position=6-665
MKSCSSSASTCSTGDTSSNTETAEEDKEGGGICSLYCLASCLGVPSELGFEFLRQKNALVLSGLTTHSDDALPFLRISTFDNVPPTILFYTKGAKVKKPPPHFASQLTWCNNSLLALVVRHSLAASHFKLVDESKKWIGYWGKHLKSPQYRTLKPFQKVNHFPGAFHLGRKDRLWLHIYEFMQRFEGDLFCIMPITYVLPRDARKLRLYLAGYTDRHVIL

SEQ ID NO: 165406 - protein, 220 aa, Heterodera glycines
  Coding regions on vcDNA: vcDNA=SeqID_91829; Strand=+; Position=1-660
EQLHHLGLFLAQKLTANDEKSRELALYYAHFYWRIRGDPLKSQQCLRLYLKRRPNCVAAKLQSGLVHLRIGDYPSAIELLQSVNSIVTNCVDCLMALGDAFVLDGNYKAGIQVFDMAFNTDPKEEMALKKASLLRCTLKLFEVMENQHKNLLEIIKDKEAYRDKTKRMQQLEAHIEQNRAVPEHRLQARLAHKFIEFGTFPYLKCREGTQWMNGIHERKR

SEQ ID NO: 165407 - protein, 216 aa, Heterodera glycines
  Homolog annotation: Hit_ID=NP_509585.1; Match level="QueryCoverage =100%, HitCoverage=48%, E-value=1e-120, Identity=95%"; Hit description=tubulin, Beta (49.8 kD) (tbb-4) [Caenorhabditis elegans] emb|CAA86310.1| Hypothetical protein B0272.1 [
  Gene Ontology: Mol. function=MHC class I protein binding; Cellular component=tubulin; Biological process=natural killer cell mediated cytolysis
  Coding regions on vcDNA: vcDNA=SeqID_91830; Strand=+; Position=3-650
REIVHIQAGQCGNQIGAKFWEVISDEHGIEPSGIYNGDSDLQLERINVYYNEATGGKYVPRAVLVDLEPGTMDSVRAGPFGQLFRPDNFIFGQSGAGNNWAKGHYTEGAELVDNVLDVVRKEAENCDCLQGFQMTHSLGGGTGSGMGTLLISKIREEYPDRIMATYSVVPSPKVSDTVVEPYNATLSVHQLVENTDETFCIDNEALYDICFRTLKL

SEQ ID NO: 165408 - protein, 132 aa, Heterodera glycines
  Homolog annotation: Hit_ID=XP_307485.1; Match level="QueryCoverage =96%, HitCoverage=66%, E-value=3e-23, Identity=45%"; Hit description =ENSANGP00000002164 [Anopheles gambiae]
  Coding regions on vcDNA: vcDNA=SeqID_91831; Strand=-; Position=170-608
SVTSAASTGIAALLLIGGGTVHRQFSVPNEVDDNTTPKMPFESAGAKRLRIVQLNIIDEISMLSKKVLRYVDRLLRDVCAVDKPFGGKVMVLGGDWRQLTPVVEHGTREDQVQESIKMDELFREHFQQIRYF

SEQ ID NO: 165409 - protein, 209 aa, Heterodera glycines
  Coding regions on vcDNA: vcDNA=SeqID_91832; Strand=+; Position=1-627
MISSSNSSVGTGGSKCLKNLDIVMESADEGQALLQDNPNNTTTITSVSAADGIPDGEGTSSSSAEQQQPNRTDSAQAQHAQPSTTMLKMKLISAISDDDDENKLATLKGRKKANQQQQPSRVKRSRLSVITFLNNITAPATRTDGGGGGKSWRRSLSVSASSVQQQKQPHHSHTPSSTSAEHSQMESDKQKMVPLTDSGTDKDGGGCSA

SEQ ID NO: 165410 - protein, 184 aa, Heterodera glycines
  Coding regions on vcDNA: vcDNA=SeqID_91833; Strand=+; Position=21-572
MGLAPVGSATNSLSSALSTSSLLSSSTIALHNISIGESSIELEELSREELIRRCNELTERCKMEIRSKNKEKQLKEETIKKLVVLGQQKGIIDTRNKSKKGEKEKRIWELAQHEKNLEINKYEDRYKEMQYALDSTRHELEEEYQNRIKTEEELRQYKDCFGQLPNSYLASANPHNNDRQRNQA

SEQ ID NO: 165411 - protein, 188 aa, Heterodera glycines; identical to SEQ ID NO: 127358
  misc_feature (132)..(132): Xaa can be any naturally occurring amino acid
  Homolog annotation: Hit_ID=XP_318284.1; Match level="QueryCoverage =99%, HitCoverage=25%, E-value=1e-21, Identity=34%"; Hit description =ENSANGP00000021965 [Anopheles gambiae]
  Coding regions on vcDNA: vcDNA=SeqID_91834; Strand=-; Position=1-563

SEQ ID NO: 165412 - protein, 93 aa, Heterodera glycines
  Homolog annotation: Hit_ID=NP_497235.2; Match level="QueryCoverage =100%, HitCoverage=13%, E-value=1e-39, Identity=84%"; Hit description= g protein-coupled receptor kinase w02b3.2 (80.9 kD) (3B295) [Caenorhabditis elegans] gb|AAA64322.2| Temp
  Gene Ontology: Mol. function=protein kinase activity; Cellular component=cytoplasm; Biological process=signal transduction
  Coding regions on vcDNA: vcDNA=SeqID_91835; Strand=+; Position=383-661
MADLEAVLADVSYLMAMEKSRSQPAARASKKIVLPDPSVRSIMQKYLEKTGEIRFEKIFSQRLGFLLLKDFAENVADTSCPQIKFYEAIKEYE

SEQ ID NO: 165413 - protein, 89 aa, Heterodera glycines
  Coding regions on vcDNA: vcDNA=SeqID_91836; Strand=+; Position=3-272
RLGSGIGKGLRALWPIPNLCLVPVRILAHGRGMPQGRRRPTGSLHQVVNELRNGSLRHGARCEEAQKKEECRKHRRLGYGLRRRRGCRR

SEQ ID NO: 165414 - protein, 120 aa, Heterodera glycines
  Homolog annotation: Hit_ID=NP_502175.1; Match level="QueryCoverage =70%, HitCoverage=20%, E-value=3e-22, Identity=56%"; Hit description =COLlagen structural gene (45.3 kD) (col-128) [Caenorhabditis elegans] emb|CAA97787.1| Hypothetical protei
  Gene Ontology: Mol. function=adhesive extracellular matrix constituent activity; Cellular component=collagen type XI; Biological process=morphogenesis of an epithelium
  Coding regions on vcDNA: vcDNA=SeqID_91837; Strand=-; Position=95-457
RAEFAGLPGVKGPPGQTGKQGERGKRNFVIGMPGPDGRVGKQGLDGLEGKPGQRGEKGPPGEDGADAKFCPCPSELNSVGGEAKANKRPLGQSLTSDQQKNAFLSQSLPFFCPIPKSTSS

SEQ ID NO: 165415 - protein, 140 aa, Heterodera glycines
  misc_feature (82)..(82): Xaa can be any naturally occurring amino acid
  misc_feature (99)..(99): Xaa can be any naturally occurring amino acid
  Homolog annotation: Hit_ID=AAK26375.1; Match level="QueryCoverage =99%, HitCoverage=31%, E-value=8e-56, Identity=77%"; Hit description =class V aminotransferase [Heterodera glycines]
  Gene Ontology: Mol. function=alanine-glyoxylate aminotransferase activity; Cellular component=extracellular space
  Coding regions on vcDNA: vcDNA=SeqID_91838; Strand=+; Position=2-421
PPHRLLRPLHINEKILFRPGPNNMPPLFQEGLFLPMLGHMHPEFIEIMDDVKAGIQYIFQTENALTFTVSDTGHAGMECAIXILLEAGQTIFQVQNGMXRLRTANVVERLAIKVHRLGVPAEEVINMDALAEAADYYRPH

SEQ ID NO: 165416 - protein, 216 aa, Heterodera glycines
  Coding regions on vcDNA: vcDNA=SeqID_91839; Strand=-; Position=27-677
PVIIFLVVHVTVGHFFRFPRGFVPLFLLSECVRKCRLYVLCIERCADAEHVAQLAARHMVPVVRVLLASDVRQLRGADAAHGAANLAQRMAEQRRRRLQMRKTLSQRNLHLILSKCSFCPKDGHHHSHDLSFTILITFLSREVPRIIKYAKCQQRMTNVMDDDEENCSGIYSFEGQALKKQWKGKKGQFYFQNVHHSNNNFFHFKLFSFLVTQFII

SEQ ID NO: 165417 - protein, 91 aa, Heterodera glycines
  Coding regions on vcDNA: vcDNA=SeqID_91840; Strand=+; Position=1-276
VLHRRVFGGPLHGQTSGQFVGICHGLAHRRGRGPSSNVPLLYKCHPFLQDTTFFELKVCDQWAFVGDYENEETAPLVNVYRRHGTQNNNNN

SEQ ID NO: 165418 - protein, 155 aa, Heterodera glycines
  Coding regions on vcDNA: vcDNA=SeqID_91841; Strand=+; Position=2-469
SANDKIVKHCTVEGGIFSSDHLAQLFVLSVPEIRAKPKEICLRRFTPSNVSHLNAVISARLSSLSLSHFSINEKCRAFNSALLNALNECIPIKKLLKKDLAPKYPQHLLASIKEKAKLYRQCKIDPTKKALYDSITLHIKIQTKKIHNLIEHKAI

SEQ ID NO: 165419 - protein, 110 aa, Heterodera glycines; identical to SEQ ID NO: 151655
  Homolog annotation: Hit_ID=CAE60688.1; Match level="QueryCoverage =94%, HitCoverage=16%, E-value=2e-39, Identity=72%"; Hit description =Hypothetical protein CBG04341 [Caenorhabditis briggsae]
  Gene Ontology: Biological process=cell organization and biogenesis
  Coding regions on vcDNA: vcDNA=SeqID_91842; Strand=-; Position=3-558

SEQ ID NO: 165420 - protein, 206 aa, Heterodera glycines
  Homolog annotation: Hit_ID=NP_504188.1; Match level="QueryCoverage =91%, HitCoverage=51%, E-value=2e-12, Identity=23%"; Hit description =predicted CDS, gag protein like (5E786) [Caenorhabditis elegans] gb|AAB63928.1| Hypothetical protein ZC13
  Coding regions on vcDNA: vcDNA=SeqID_91843; Strand=+; Position=1-618
TDPGSNKTFPSLVHLPKTTLPTFSGDCTSYKSFWNSFSSAVHDQSIPDSLKFVYLKQCLSGPPLNLVCALPVSDASYASAIDLLSDHYDDPEEIARALQNSLRKLPRVRTGETFCSDLRSLIEQLEAICVQMGQQQQPHNTINIQMEVEQRLPRYILDEIYLARESAGQWSTDRLRDKLRSILKRKEQIDTLLPKTDHGPRPKSSP

SEQ ID NO: 165421 - protein, 180 aa, Heterodera glycines
  Homolog annotation: Hit_ID=NP_505204.1; Match level="QueryCoverage =100%, HitCoverage=31%, E-value=5e-44, Identity=52%"; Hit description= asparagiNyl tRNA Synthetase (nrs-2) [Caenorhabditis elegans] gb|AAC25799.1| Asparaginyl trna synthetase
  Gene Ontology: Mol. function=asparagine synthase (glutamine -hydrolyzing) activity; Cellular component=soluble fraction; Biological process=asparagine biosynthesis
  Coding regions on vcDNA: vcDNA=SeqID_91844; Strand=+; Position=88-627
MCGIWVILGAEYVPTKHQREFLQIGGRGPDLTIISRVSSKVWLGFHRLAIVQPGDSPSEQPICADGLSVVCNGEIYNHRTLKDNSLLDNSSVRNGGSDCAAILHAFRSSGNDLRRCCASLDGVFSFAMADNKFLYLGKDPTGVRHPLIWLPWTKLLLIGSRGLKVLRTLWGKGSHFFPPG

SEQ ID NO: 165422 - protein, 124 aa, Heterodera glycines
  Coding regions on vcDNA: vcDNA=SeqID_91845; Strand=-; Position=264-638
SSSKMVRKWSSNNCHLCFHLLSMSRQRKGQRWIGLSHFSLSLSFSLTFHKVWVLMGRPSLVLVPPFNAYLGAVKGGRQAFLRVGPPIVFCFSFLSFSLTFPNIWVLMGRPSLVLVPPSMLISEL

SEQ ID NO: 165423 - protein, 179 aa, Heterodera glycines
  Homolog annotation: Hit_ID=CAE59770.1; Match level="QueryCoverage =83%, HitCoverage=38%, E-value=2e-29, Identity=42%"; Hit description =Hypothetical protein CBG03222 [Caenorhabditis briggsae]
  Coding regions on vcDNA: vcDNA=SeqID_91846; Strand=+; Position=131-667
MAEKKKKREKNSGRKGTDDGVDSNKLTKDEDSLARFLRFNCPTNSTMFEGNEVHYFSGRKAIDVLVESKKYGATAKTPKFLNSDAAEEFLQTLLAKGLFFRAKKLVPKKKEKPSSDQQQKGEKSGRDVSKSPPNAAKAEKRQRKEAEEVSKTEEDEAREEEEDEEGQQQEKPEANTKDE

SEQ ID NO: 165424 - protein, 131 aa, Heterodera glycines
  Coding regions on vcDNA: vcDNA=SeqID_91847; Strand=+; Position=2-394
KGSADAYPGQLQPDLYRRRGSVISVSSSGGGAQVVGRVQLQLSYDHSTSDVVIRLAQLNLHPSSASLGQCHKLLLLCTTPCSSSNNNGTNCSEETMGTARVGRRARETGALTFDTPKRTVQQFAKRVPIIS

SEQ ID NO: 165425 - protein, 102 aa, Heterodera glycines
  Homolog annotation: Hit_ID=NP_502564.1; Match level="QueryCoverage =78%, HitCoverage=13%, E-value=8e-13, Identity=41%"; Hit description =glutamate receptor (4O111) [Caenorhabditis elegans] emb|CAB05308.1| Hypothetical protein W02A2.5 [Caenorh
  Coding regions on vcDNA: vcDNA=SeqID_91848; Strand=+; Position=98-431
VISISKSAYCIIVLFIIPPPIQIRVVFAKNPPDAFTTCKSFPVLTPNMDCPFPGWLIEARPFSVVKMLADYLSLQVDPIIIQSEIGNVNWGHNVRGGEVEGG

SEQ ID NO: 165426 - protein, 167 aa, Heterodera glycines
  Coding regions on vcDNA: vcDNA=SeqID_91849; Strand=-; Position=3-503
VTDGRGREAEDGNEAEEGTVAAAGDGGVVPWSEEGRGGAEAENGDGLLLSPPAAFRSATFAEPSAAVVAEVRPFRRPIRRMMRWKTVFRAVPTLLRRRVSSSPFAPPFGSLRPSGVVPPIAPLPLPWAFPPLPPPWPFCVPRLNSPPLNSRPIAGPNRWNGPIAPIH

SEQ ID NO: 165427 - protein, 76 aa, Heterodera glycines
  Coding regions on vcDNA: vcDNA=SeqID_91850; Strand=+; Position=381-611
SSVHYRDMNINYFIRIRSLTGFFAIFELLHSRTRKAFRRCLGLFVTAEHSTLMTPSNRIKNGRSGRRFRLMIRHFQ

SEQ ID NO: 165428 - protein, 179 aa, Heterodera glycines
  Coding regions on vcDNA: vcDNA=SeqID_91851; Strand=+; Position=3-539
SLVLFNPLRSCFRPTRDELFRAVERLRESILLMDTERARFRRSNGALLRMIVRLSGGIPPNFNHAHFAAAAQPVVNVTAVLANANPTGQNYQRLLNLNADLTETIARLTVEISQLGYMNEQLTEQLEHLTEVPPNANFNLDDVVFHPPLDQQHEVPPNPNFNPALLEFDDVGLQPALDQ

SEQ ID NO: 165429 - protein, 77 aa, Heterodera glycines
  Coding regions on vcDNA: vcDNA=SeqID_91852; Strand=+; Position=1-231
VMSNHPHSLSIGQPQQKSRRQRWCGDGPFLLLTLTMSIGGALFCLFVAIWAVGIDVVFPLSLLLSASLGFLVASSLG

SEQ ID NO: 165430 - protein, 199 aa, Heterodera glycines
  Homolog annotation: Hit_ID=NP_731292.2; Match level="QueryCoverage =46%, HitCoverage=6%, E-value=4e-12, Identity=45%"; Hit description =CG31349-PC, isoform C [Drosophila melanogaster] gb|AAN13403.2| CG31349-PC, isoform C [Drosophila melanogas
  Gene Ontology: Cellular component=adherens junction; Biological process=regulation of JNK cascade
  Coding regions on vcDNA: vcDNA=SeqID_91853; Strand=+; Position=93-689
MTNSGGNYTPPAQTQPNYSCQHQSPYLAHSQRLSAHPSPVPSVRPLSQTPSSVHSMNNATIQQQQQQQTQFNQTATHSYEQHQRFLADQRLRMLDFQQQQQFVASHQSVSVSTFQQRKPREMHSITFHKGSHGLGIRVIGGNQSGIFVSAVQENSPADKNGIRVGDRIHVVNGVSMVGVTREEAFDFLLSTGEQPISIT

SEQ ID NO: 165431 - protein, 140 aa, Heterodera glycines
  Coding regions on vcDNA: vcDNA=SeqID_91854; Strand=+; Position=87-506
LPPPPYLRYVLDVVVTAGHGHRHSVPKSTSLPLLLPVHVCLVAVLTVFFCHLLVRRLGKMLLRPKLSSLLLLSSGGGGGTKHLAKKTTTAAAETRTNKPKLLGITTPAAEDDNWGKVTQSDPKDYRLKVSTISAVYARAA

SEQ ID NO: 165432 - protein, 185 aa, Heterodera glycines
  Homolog annotation: Hit_ID=CAE62539.1; Match level="QueryCoverage =82%, HitCoverage=47%, E-value=2e-17, Identity=34%"; Hit description =Hypothetical protein CBG06648 [Caenorhabditis briggsae]
  Coding regions on vcDNA: vcDNA=SeqID_91855; Strand=+; Position=1-555
SSRFSRLLFSGHRTLLWLFGCSLYALYWAVFVKPTVYSSVYFGWFFFPFVGYRPDNQHEFAVQLHTFHDILVAFLCPGIYLIFALVLCASSYDFNTMQKKTFLQVFLVSLINTLTGSLYVYMQHNDLRQQWMLTLAEFAWFHAHGFPPVIYLALNKTIRKDSCSLFMKVFQRDHISSVGVVAVSA

SEQ ID NO: 165433 - protein, 113 aa, Heterodera glycines
  Coding regions on vcDNA: vcDNA=SeqID_91856; Strand=-; Position=138-479
RVRLEMGGRQKRHTERGREKNEMKCHVKFKFGILTTVCLDNGLIFCWHLSFLTLLRRREVTAFFHSAGAEQSQLTGRKVKPFRRNKPNPPKFCCWPTATLTRATASKWEECVK

SEQ ID NO: 165434 - protein, 119 aa, Heterodera glycines
  Coding regions on vcDNA: vcDNA=SeqID_91857; Strand=+; Position=283-639
WLKRATRRRNTKGPSPSFDELRAKISSEQAENIAKIQLQHQKTVNELEKHVQKLGKKLAEQEEKHRRELAESASQSTNRLHKELESRNYELQMKNEEMFKLRQANRELQFEVDKLPEKE

SEQ ID NO: 165435 - protein, 194 aa, Heterodera glycines
  Coding regions on vcDNA: vcDNA=SeqID_91858; Strand=+; Position=5-586
MSTASPSPASSASASSSHQNRRPFSISSLLNPSQNATQKCPPLGSVAAFSDALQQCLPMLFAVRGMIGEGATNAMPKEEASAAPFRNAFQPLLMGKVRMCQEGAKEEEEEQEENGHEVPTSEESSQSEDDGILAKDGEQKVEMKDEEEEQDFGESELKMEQEHKQMKAEGKREGDEGDKGNTTPREGAFEQPYQ

SEQ ID NO: 165436 - protein, 56 aa, Heterodera glycines
  Coding regions on vcDNA: vcDNA=SeqID_91859; Strand=-; Position=249-419
EHSAASRPFFNFVENIQPLRGLRTGASRPFFNFVEDIGTLRGLKTGASRPLKCTEN

SEQ ID NO: 165437 - protein, 149 aa, Heterodera glycines
  Coding regions on vcDNA: vcDNA=SeqID_91860; Strand=-; Position=104-553
RRGDEKKATRKWKEMALRARFKPNLMDNSAETIRRPLAATSTPTSSRRSLTINALATTTTNGALKISKVKREEEKEGTRKSARSSSTTTETINSSSTRSGKLPGTPQRNWKKGATSSSAEVAQATTSSSSMLRNNKKQNHREKQQSGKR

SEQ ID NO: 165438 - protein, 129 aa, Heterodera glycines
  Homolog annotation: Hit_ID=CAE67776.1; Match level="QueryCoverage =68%, HitCoverage=7%, E-value=1e-13, Identity=46%"; Hit description =Hypothetical protein CBG13351 [Caenorhabditis briggsae]
  Coding regions on vcDNA: vcDNA=SeqID_91861; Strand=+; Position=131-520
MYNTVCSLRQQIGTRGPLFSEYLAVANTSVPDFHKLTFALLSGLPNEVSFGLNILTVLSHPGPFVLNFANCPQLIALLVALCGVCVNVEGPSNPFLLFDWWRRSSGYDFASFWANSGVEEAQRAATAKD

SEQ ID NO: 165439 - protein, 118 aa, Heterodera glycines
  Coding regions on vcDNA: vcDNA=SeqID_91862; Strand=-; Position=0-353
GCDSKSVELYMFGLFSSCAKVGLLRLALVNGEAERKSGRRRRPQQSAGIPPQGRRTERLAAAAHLFDGRKRCRLRRGRGKYVRFSLLLSLITLFLSLLLSLITLFLSLLLSLISLSLS

SEQ ID NO: 165440 - protein, 54 aa, Heterodera glycines
  Coding regions on vcDNA: vcDNA=SeqID_91863; Strand=-; Position=1-162
FFFFFDISPSANRSECQQKRMSKINNSQSGNKALAATRPTFGTAKFNLAVPLPF

SEQ ID NO: 165441 - protein, 180 aa, Heterodera glycines
  Homolog annotation: Hit_ID=NP_572311.1; Match level="QueryCoverage =40%, HitCoverage=8%, E-value=3e-13, Identity=46%"; Hit description =CG3815-PA [Drosophila melanogaster] gb|AAF46150.2| CG3815-PA [Drosophila melanogaster] gb|AAL39199.1| GH06
  Coding regions on vcDNA: vcDNA=SeqID_91864; Strand=+; Position=42-581
MEVQYNRRHVPRIKWNLAINSREFSLDKLCVDECFYKLPFDELFAKDEPNSKRCFYCKRFVEKRMVSCDFCDASFCFDCPNPPFTALPNERFMCSLHIEPFIDANLLDSKRVTDRIALWKRYTELPKSETPFRSVISCFYTKVREDNTKQHLKLKSMTTKKQQKTINKPFKIESLIKRAY

SEQ ID NO: 165442 - protein, 209 aa, Heterodera glycines
  Homolog annotation: Hit_ID=AAR11446.1; Match level="QueryCoverage =100%, HitCoverage=35%, E-value=1e-118, Identity=99%"; Hit description=matrix metalloproteinase [Heterodera glycines] gb|AAR11445.1| matrix metalloproteinase [Heterodera glyci
  Coding regions on vcDNA: vcDNA=SeqID_91865; Strand=+; Position=1-627
FLLLPILLLHLQQSQACFSRGNSGEPSDGNPEAQGLKSENDVRTVQLKKEKQTDETEEEKDEESSAEQKLPSELDPEFVKTYLREFGHLKHNENGLSHGVKHFQRFLGYRQTGNVDLATLQKMSWKRCANSDEGYTAQDPSQLWERSTLFWNLNASHPKQFTHGETKELIAQAFRAWEIVIKIDFLETNNADNAQIIFTFESDGAKRKK

SEQ ID NO: 165443 - protein, 164 aa, Heterodera glycines
  Coding regions on vcDNA: vcDNA=SeqID_91866; Strand=-; Position=17-511
CRFCWVKGTAGANDKNGRVNFDLQLQLLAHVNHVLKDCRRTADFGGLNTSIVHRRGMARKHHLHRFDAAHTDASPVSLRNKWEEVSGKSIRGVLIRWPQRLWPILGVAMRFWNLRSSLCPSVVWRSMECCLSVVLLRPPPLADLSVVPRARGLNDGGPGTGERV

SEQ ID NO: 165444 - protein, 149 aa, Heterodera glycines
  Coding regions on vcDNA: vcDNA=SeqID_91867; Strand=-; Position=162-611
MIVLDESGQAPFVQVCSVLSPLQEVQKLFITGDRYQLAVNMKDIPEQLRVGFGFDTVLLNTDSSAGVEKTTLEVNYRSHPEIVNGVEYAAYTPHGERLRSGPGIFRMLTSFAKIPIAESPIVLIHQDSPMEAGVFLRPILVKLGLSLTF

SEQ ID NO: 165445 - protein, 177 aa, Heterodera glycines
  Coding regions on vcDNA: vcDNA=SeqID_91868; Strand=-; Position=116-649
FSAATDIHLAEKGIAAALSSCFLKNRIKMEEFAIETTLHILDNNGRTVVATFEHFLDNKRKFVDLVEFWEEDAAIQARLKGVRKNCANGRILEVNKYVQGGVFQARILLAYQTAKNHDSDGDFEFICEGHEVVLNTCESATAMVNRMILFYSNSFSSISSEQSGTGQIWRALLSSSD

SEQ ID NO: 165446 - protein, 80 aa, Heterodera glycines
  Coding regions on vcDNA: vcDNA=SeqID_91869; Strand=+; Position=129-371
FAYFDETHSLISVILLIIFQQFLFIFIIFKFIFIIPFYTFNWSCDGTGKHSLNISTHSSFPIKLKKTKNYIFSPISRVPP

SEQ ID NO: 165447 - protein, 31 aa, Heterodera glycines
  Coding regions on vcDNA: vcDNA=SeqID_91870; Strand=-; Position=0-92
ANGKKPSDRRKSNPIVSPVKTDRTLGRPKIG

SEQ ID NO: 165448 - protein, 169 aa, Heterodera glycines
  Coding regions on vcDNA: vcDNA=SeqID_91871; Strand=-; Position=0-506
PNDDCYDYHLIEHAPAPMDARGQRQRQPICQWRRVCRDCGRIAYQGKHQCPRQQTADNGNCRRCDGPHTAEEPCFIQPICDLSARQRASVAVDNDDNSDDNGDDDGEDDVLPLRLCFFDAETSQDSPLQLNNRLVQKHVPLLIIAEVICERCLQVGISVNDGLGRRAPG

SEQ ID NO: 165449 - protein, 206 aa, Heterodera glycines
  Coding regions on vcDNA: vcDNA=SeqID_91872; Strand=+; Position=53-670
VMLSPQSLLFLFLFLLAFLFPSAQCLTLKRQKPSQLNRRNEELNAEKALNRTVAKLRTDGENGRLILLVCRGKCLKERAQIPNWLREFNTANNRSFLKRNNDKSISDEQSDQSVSDQQKNNASLGRDDELQKHWEGGVAFHFYAHRLPIPVMDIETALRQHSSWQSVLFYVVAGKAFPAAPEAVIREKNTFLDWLNSFEKTPIVRI

SEQ ID NO: 165450 - protein, 94 aa, Heterodera glycines
  Coding regions on vcDNA: vcDNA=SeqID_91873; Strand=+; Position=312-593
IFIKILNTQMEIGRNTNLAQNWREWQQTNANCQFRWKSIANSAKSVAKQSHRIRRHYNRVMPMFRDSIVVMFLNTIAFRRLRQLALLLLKINDW

SEQ ID NO: 165451 - protein, 176 aa, Heterodera glycines
  Homolog annotation: Hit_ID=CAA82797.1; Match level="QueryCoverage =83%, HitCoverage=22%, E-value=8e-14, Identity=32%"; Hit description =gag protein [Ascaris lumbricoides]
  Coding regions on vcDNA: vcDNA=SeqID_91874; Strand=-; Position=2-529
QALAPGPLHSAPTIRPTINLPALQLPDFDGHESNWPSFWAAFCHTIHDNQSLSGAQKLTYLVGRLRGGARTLVDGFALTDHNYPIVVDLLKGRFGDDNKRADRLRSELFHLSKPTGHSTSLRGFSEHVDRICRQLESLGSDLDDNPFLTVAIKEKLPTEIKAQLYDKEMEEGGPWT

SEQ ID NO: 165452 - protein, 197 aa, Heterodera glycines
  Coding regions on vcDNA: vcDNA=SeqID_91875; Strand=+; Position=5-595
MAHNQSESSTTDQKTPPEIDERAAGTVENSGNAAKKGGPPLAKCSVSSSQSSGGDQTDVADPPQSVPFLQDIKLIPTTTSSASSSPAFSQLSEQGDYRTPMAMIVKTEMDTNPKQQIVENTVAKAIKFYDNEIDGMNSKKRDAEMDRLKQAKDAQAQNILALNKLPFSSCPDRTSKESFVKKESVDSLAAKRPALVL

SEQ ID NO: 165453 - protein, 120 aa, Heterodera glycines; identical to SEQ ID NO: 140849
  Coding regions on vcDNA: vcDNA=SeqID_91876; Strand=+; Position=242-601

SEQ ID NO: 165454 - protein, 113 aa, Heterodera glycines
  Coding regions on vcDNA: vcDNA=SeqID_91877; Strand=-; Position=187-528
KIGDISDHWSDHFENLYSPLPSAFISFFHPYLLVSFFVSHEPTIFRDYVVRHPLRFIPTLQLLIRFLHLLLHFVHFFARCLLCHLVALCAAIFRCSSKRREGKEKILINLNYN

SEQ ID NO: 165455 - protein, 107 aa, Heterodera glycines
  Homolog annotation: Hit_ID=NP_495156.1; Match level="QueryCoverage =62%, HitCoverage=7%, E-value=1e-13, Identity=56%"; Hit description =tbc1 domain family member 2 (103.3 kD) (2G114) [Caenorhabditis elegans] gb|AAC71091.2| Hypothetical protei
  Coding regions on vcDNA: vcDNA=SeqID_91878; Strand=+; Position=354-674
STARRLWHSDGRGGKEFVHRNGGERPERNEGPELQQIVQSLEDRERKLIRQNFNIEAVYYQLKSRYIMLLNHFQPSMDRQKRLPVEPSMIQELIDEVTRPHSPMRTH

SEQ ID NO: 165456 - protein, 52 aa, Heterodera glycines
  Coding regions on vcDNA: vcDNA=SeqID_91879; Strand=+; Position=68-226
IIAIKMRIKMNSIIFFFEGQTNPGTICEGFANPFEPMRTWAPTFRDSHMACG

SEQ ID NO: 165457 - protein, 135 aa, Heterodera glycines; identical to SEQ ID NO: 153667
  Homolog annotation: Hit_ID=CAE57463.1; Match level="QueryCoverage =57%, HitCoverage=8%, E-value=2e-21, Identity=62%"; Hit description =Hypothetical protein CBG00428 [Caenorhabditis briggsae]
  Coding regions on vcDNA: vcDNA=SeqID_91880; Strand=-; Position=258-665

SEQ ID NO: 165458 - protein, 201 aa, Heterodera glycines
  Coding regions on vcDNA: vcDNA=SeqID_91881; Strand=+; Position=3-605
NIQMKSIDSTEKENSFGGGAEFGHSLFVSGIEQRFSVFVSPGTASLTAPSLLKLSLVQSSDGSIEFLNSDGNWTTEAQFLIPPLDVEEKHRILVRMCKGIDRLETYQSEQKNEGQIEEKCELKFEWFAASDCKSLLSDDFLIIRRSFPITFRPIMLLSWRTSFLSDRTLFHVDISRKDCVSAAFAVDVFPTFVSLLSLKLI

SEQ ID NO: 165459 - protein, 78 aa, Heterodera glycines
  Coding regions on vcDNA: vcDNA=SeqID_91882; Strand=+; Position=186-422
FLVEFINCTTNWHTWTECGDSNLKKINCGTLNGQLTCWSVGSLFKKLCYITFSIVMVKRTRKNTVFFVEHFWPNFLET

SEQ ID NO: 165460 - protein, 215 aa, Heterodera glycines
  Coding regions on vcDNA: vcDNA=SeqID_91883; Strand=+; Position=2-646
NDEDPECFSFYENLSFSPDGINLLAFARNARLGSHNASMALCRFKWDGAVSPANEQAEVLIPTLDSPQLVDIGRQSVPFPGCFDPSVPLRAWSRDSRFFFFTTVWHNKTKIIRVDLHNGGQWTCIPTEHLEGRKFSKTRQMERDRILFQRQRFPTVASIHHQPATSSASGVLVPIPTTDGAAAVPGSAGGYQRRYSTHREQQLQQRNRRDSKFSR

SEQ ID NO: 165461 - protein, 179 aa, Heterodera glycines
  misc_feature (179)..(179): Xaa can be any naturally occurring amino acid
  Coding regions on vcDNA: vcDNA=SeqID_91884; Strand=+; Position=28-564
KIEKPNQAAGMPAMSAAASEADLRNDLMRLIIGEEHLLKIKAQYLDERTALNLRRPVNYIEVEQYFQNKYGRLLNFYYTTSTRELMIQIHNQQDLDQVIQLHESTGGNQRRMRLILSQKRDQPAQVGPLFDQQRPPPSSPSPLGIHRNSQPNCGNDRVAGNRNIVEAPLSSCSSSVWSX

SEQ ID NO: 165462 - protein, 107 aa, Heterodera glycines
  Coding regions on vcDNA: vcDNA=SeqID_91885; Strand=+; Position=22-342
NMVCADPPPPPLFPILIRESTAVLCIAPRITIINRRTHNSNGRGWGGDRYVQKVHICGWAEGGGEWRLNLGCAMFLYDGRDNQFLLHIPAADEQQQVSFPEQFLLLL

SEQ ID NO: 165463 - protein, 179 aa, Heterodera glycines
  Homolog annotation: Hit_ID=NP_080752.1; Match level="QueryCoverage =100%, HitCoverage=16%, E-value=3e-41, Identity=48%"; Hit description= RIKEN cDNA 2610101N10 [Mus musculus] gb|AAH68265.1| RIKEN cDNA 2610101N10 [Mus musculus]
  Coding regions on vcDNA: vcDNA=SeqID_91886; Strand=+; Position=1-619
ERSKCAMHQETIRNCELRVSWARPVNMPPLPFFVPLPLRELAMPDPPSGLPFNARPLTEELRSFLQNYGDLPKLGVPLTEEEGERDTQMLEDYKKMIENATVRVVIPTERPLLTLIHRVVEFLVRSGPLFEAILMARERQNPMYRFLFDNHHPTHVYYRWRLYTILQGDDRQKWRLEKF

SEQ ID NO: 165464 - protein, 131 aa, Heterodera glycines
  Coding regions on vcDNA: vcDNA=SeqID_91887; Strand=+; Position=35-430
LKIKCNFGEMLCQIGTVGKNAKFLMHIFILFESGDISRLTIRPIKISAHAITVKWYAISRGCMENIPIHKYLLFYTLATDDYNWKKKKVNLRKGLSAILTTCVNTIFFWLVTWHLRWSHSKMFQERAIRNI

SEQ ID NO: 165465 - protein, 217 aa, Heterodera glycines
  misc_feature (33)..(33): Xaa can be any naturally occurring amino acid
  Homolog annotation: Hit_ID=NP_498777.1; Match level="QueryCoverage =98%, HitCoverage=17%, E-value=2e-90, Identity=74%"; Hit description =phosphorylase kinase (3J230) [Caenorhabditis elegans] sp|P34335|KPBA_ CAEEL Probable phosphorylase B kinas
  Gene Ontology: Mol. function=phosphorylase kinase activity; Cellular component=phosphorylase kinase complex; Biological process=energy pathways
  Coding regions on vcDNA: vcDNA=SeqID_91888; Strand=+; Position=1-650
ITASGLQVVRNFDEVAFVQNLVYYIETGYRTPXDFGTWERGDKTNQGIRELNASSIGMAKAALQAINDIGDLFGDGSNGSIVHVLPDEIQQCSAVLCNMLPHESFSKETDAALLSVISFPAFAVDDFSLATLTRETILATLGGRYGCKRFLRDGYKTVLEDPNRLHYINCELQKFENIECEWPLFFCYLYIDAAYRKDEKAENAFWKQLQTLIVADS

SEQ ID NO: 165466 - protein, 99 aa, Heterodera glycines
  misc_feature (19)..(19): Xaa can be any naturally occurring amino acid
  Homolog annotation: Hit_ID=T02995; Match level="QueryCoverage=100%, HitCoverage=18%, E-value=1e-24, Identity=64%"; Hit description =unspecific monooxygenase (EC 1.14.14.1) - common tobacco dbj|BAA10929.1| cytochrome P450 like_TBP [Nicotiana
  Coding regions on vcDNA: vcDNA=SeqID_91889; Strand=+; Position=180-480
MYRPSQTPRLTLSSARVAXHRVARLNTKMDTLSGALPFYRLSKESMKVVVFHWRLAAPTYATPLMILHKVRLESSSTGSSFPAKFAKPVPLAVVSLDSR

SEQ ID NO: 165467 - protein, 150 aa, Heterodera glycines
  misc_feature (99)..(99): Xaa can be any naturally occurring amino acid
  Homolog annotation: Hit_ID=XP_313191.1; Match level="QueryCoverage =64%, HitCoverage=21%, E-value=2e-23, Identity=54%"; Hit description =ENSANGP00000013339 [Anopheles gambiae]
  Coding regions on vcDNA: vcDNA=SeqID_91890; Strand=+; Position=144-593
MYMQCNSGLVAFLICVLLTFVFLFYNQFEFDITFKSIMLMVEQKPSSFFEKVIVHFDLKGAAPKPHYIKELLPFIKKLGFTEILMEYEDMFPYSFGLSXLRRKTAFDEMTTKQLKESANAIGLNIIPLIQTFGHFEFALKHQEFFSLRED

SEQ ID NO: 165468 - protein, 132 aa, Heterodera glycines
  Coding regions on vcDNA: vcDNA=SeqID_91891; Strand=+; Position=127-522
MANNAGSETAADEPFPRAFFEGKGTATLCPNDSKIFTVASIDILPPSETTPAICSGHIGTISAETVSFPLVVAALRPLKRVRFADDCGQCLETVRVMTEPSDYPPKISPAVLRRIRRAAAAASSAIAAAHSA

SEQ ID NO: 165469 - protein, 142 aa, Heterodera glycines
  misc_feature (31)..(31): Xaa can be any naturally occurring amino acid
  Homolog annotation: Hit_ID=CAB62280.1; Match level="QueryCoverage =85%, HitCoverage=83%, E-value=3e-15, Identity=38%"; Hit description =hydroxyproline-rich glycoprotein DZ-HRGP [Volvox carteri f. nagariensis]
  Gene Ontology: Mol. function=SH3-domain binding; Cellular component =lamellipodium; Biological process=signal transduction
  Coding regions on vcDNA: vcDNA=SeqID_91892; Strand=-; Position=143-571
MLPDPRTGDRKPIPMPRPRPRPRICAPPAPXPPRKKRPLPRPSPNPPPPPPINANAPLPPAAPPPPPLFALPKPPLPFPLLPLSIPRLLPVDELSITLTILTSLSRSSNRISTPPPAVPPFPIAWAISIAFLTPKVISSSCA

SEQ ID NO: 165470 - protein, 201 aa, Heterodera glycines
  Homolog annotation: Hit_ID=CAE68401.1; Match level="QueryCoverage =98%, HitCoverage=28%, E-value=5e-72, Identity=59%"; Hit description =Hypothetical protein CBG14172 [Caenorhabditis briggsae]
  Gene Ontology: Mol. function=alkyl sulfatase activity; Cellular component=cell surface; Biological process=metabolism
  Coding regions on vcDNA: vcDNA=SeqID_91893; Strand=+; Position=43-645
MIRPNIVLLITDDQDIELGSMAFMPKTLRLLQQRGTEFRNAFVSTPICCPSRSTILTGLYAHNHKVMTNNGNCAGEEWRSDFEKDTFAVYLERTGFLTGFFGKFLNNYDGSWVPPGWTKWAALVRNSRYYNYSLNKNGRNEWHGNRYENDYLTNLVANLSLQFIDESVLLNPHGQPFLVVLSFPAPHGPEDPAPQFGDLFE

SEQ ID NO: 165471 - protein, 71 aa, Heterodera glycines
  Coding regions on vcDNA: vcDNA=SeqID_91894; Strand=+; Position=73-288
KKRAAKKGSFKRQKSRRLVAKIGLFDENLLTNQNEITKKNFRRRLSAAGTPPPVPQKYLGKMRRKKKLLKT

SEQ ID NO: 165472 - protein, 82 aa, Heterodera glycines
  Coding regions on vcDNA: vcDNA=SeqID_91895; Strand=+; Position=259-507
HRHIFYFCRFLRNIYIYFIFAAFYEKILSSNLVADYNGYSIFEDLQLGDPTFKDPTFETNSMTINQGDLWVKNNLKSYLIFI

SEQ ID NO: 165473 - protein, 146 aa, Heterodera glycines
  Coding regions on vcDNA: vcDNA=SeqID_91896; Strand=+; Position=60-497
NYVFFAYMNSPTNFNNFHSTTKCVPLENGSDREKGSTSNNNHKRRKDNVKSELIDNAIGSPKSNKRAFFSADCALNPTALAEMMPSSRLSMGMAGRLRDIVAIFPQNDLASPGKLLFREQMTNSDQRVFSAKGQADVPGMNAKEIS

SEQ ID NO: 165474 - protein, 116 aa, Heterodera glycines
  Coding regions on vcDNA: vcDNA=SeqID_91897; Strand=+; Position=93-443
KKNEKPSNETKSHEKEIFKLRKEKRAKKKRKRKAIKKKINFKAKKKKKKKSSPSIKKCQFKCCHSHKKNFRSILIFYYIAFFLSEKIKLGFIVMAQQQQQQNVLGQMAPFGQVIKK

SEQ ID NO: 165475 - protein, 40 aa, Heterodera glycines
  Coding regions on vcDNA: vcDNA=SeqID_91898; Strand=+; Position=2-121
KKTQCGLWAIHKKTQCGRSTKILSVGDPHKNSVWAIHKKK

SEQ ID NO: 165476 - protein, 182 aa, Heterodera glycines
  Coding regions on vcDNA: vcDNA=SeqID_91899; Strand=+; Position=113-658
IAKICPEQHHLAMAIKLLQAGILILWSESAKNSGKLFGKWFTARTFIWPSVPTRPSQLSCAGSGMSALWGNTGDRMIGKKELKYSFICSICCLQPLTKAMDPTATDDEKRARWKQDYKCRSTGRLRCEFEDDTLDRWHEEMAKQRSRSASYSRARKEKAQLLPVAPVVKAKKYFCDKCPANF

SEQ ID NO: 165477 - protein, 215 aa, Heterodera glycines
  misc_feature (181)..(181): Xaa can be any naturally occurring amino acid
  misc_feature (186)..(187): Xaa can be any naturally occurring amino acid
  misc_feature (196)..(197): Xaa can be any naturally occurring amino acid
  misc_feature (206)..(206): Xaa can be any naturally occurring amino acid
  Homolog annotation: Hit_ID=NP_493532.2; Match level="QueryCoverage =98%, HitCoverage=19%, E-value=2e-67, Identity=60%"; Hit description =PDZ/DHR/GLGF domain and guanylate kinase and ZU5 domain containing protein (1P137) [Caenorhabditis elegan
  Gene Ontology: Mol. function=protein binding; Cellular component =adherens junction; Biological process=regulation of JNK cascade
  Coding regions on vcDNA: vcDNA=SeqID_91900; Strand=+; Position=3-644
EKEHWQLFAITLQRASQSGFGIAISGGPKESAILVSDVIKSGPAFGLLQVGDRIISVNGYPLEHANYASAVAVMKDAQQLNMVVKRRVPVPFVEFEQRTLKFTLSKSRKKDDFGIVLGCRFFIKEILNPKLAEKEPGLKEGDTVLRINGQTLDGFTLDEAARLLQRSREKLSLVVQRDVPXGNGRXXSRWPSQTTXXERFGSVPAXTPRQSPTPV

SEQ ID NO: 165478 - protein, 74 aa, Heterodera glycines; identical to SEQ ID NO: 127125
  Coding regions on vcDNA: vcDNA=SeqID_91901; Strand=+; Position=167-391

SEQ ID NO: 165479 - protein, 218 aa, Heterodera glycines
  Homolog annotation: Hit_ID=EAL26471.1; Match level="QueryCoverage =99%, HitCoverage=29%, E-value=7e-76, Identity=63%"; Hit description =GA17483-PA [Drosophila pseudoobscura]
  Gene Ontology: Mol. function=ATP-dependent peptidase activity; Cellular component=mitochondrial inner membrane; Biological process =mitochondrion organization and biogenesis
  Coding regions on vcDNA: vcDNA=SeqID_91902; Strand=+; Position=3-656
WYFGIQKVTVNTGGGSLLESLTDQPSWATDKVDVTFDDVRGMDEAKAEVEEIVDYLRDPRRYTSLGARLPKGVLLVGPPGTGKTLLARAIAGEADCPFFHAVGSEFDEILVGQGAKRVRELFRLAKENQPCVVFIDEIDSAGSKRTNSAIHPHANQTINQLLAEMDGFEQNQGVIVIGATNRVDNLDKALLRPGRFDVQVTVSRADLPSRKDIFRLYL

SEQ ID NO: 165480 - protein, 72 aa, Heterodera glycines
  Coding regions on vcDNA: vcDNA=SeqID_91903; Strand=+; Position=59-277
GSRIGLVQRTPFLSGWAFAVKPGLGLGRLLQRLYSFIGTGWASDTRNLLTVCAILYRVYISLIIRYFISHQH

SEQ ID NO: 165481 - protein, 225 aa, Heterodera glycines
  Homolog annotation: Hit_ID=CAE70652.1; Match level="QueryCoverage =100%, HitCoverage=69%, E-value=3e-67, Identity=40%"; Hit description= Hypothetical protein CBG17357 [Caenorhabditis briggsae]
  Gene Ontology: Mol. function=nucleic acid binding; Cellular component= mitochondrion; Biological process=embryogenesis and morphogenesis
  Coding regions on vcDNA: vcDNA=SeqID_91904; Strand=+; Position=3-677
RLATDAPNVQVAIDQRLAEVLQGVVSLLAGISVAFYFGWNVAPIGLGTSIILVILQSFVSNYLKRRGMRDLQAAEEASKMATESLEYVRTVQALNGQGKAYRTFSEAMRKPHRMAITRGLWTSLSFALTSSFVSFNFGFTYCLGMLLIRAGHTTPFVLFQVVEALNMASFMIMAAAAYFPEYLRARFSAGLMFAMIRLKPRINSLSDKGIKTPIEGRLELKSVQF

SEQ ID NO: 165482 - protein, 166 aa, Heterodera glycines
  Coding regions on vcDNA: vcDNA=SeqID_91905; Strand=+; Position=2-499
FARERPEKVRDCFSAALPFRAHLSASHRHTLAELNKIAAHLSSGSNPLQKKKSLHLSFRGTKSTHFSNEREAQKKQPKTHKRRPQTTKERDALTKICHAQKLTQQLRRVQSDWESASMVLRRGDAVVVKALRQDGFSLCDNAVSSGLVPVALLGPFDERFTAPVSP

SEQ ID NO: 165483 - protein, 93 aa, Heterodera glycines
  misc_feature (32)..(32): Xaa can be any naturally occurring amino acid
  Coding regions on vcDNA: vcDNA=SeqID_91906; Strand=-; Position=321-602
ADCAAEKPNPKKTPFIYPKKIFKGAPVKFLTXEKRQDFLAGLHQKRQVLPLWVKFSINNGTVSPSPSPGHGPGLYLNHFACFMQGFVRRLKRF

SEQ ID NO: 165484 - protein, 83 aa, Heterodera glycines
  Homolog annotation: Hit_ID=CAE62859.1; Match level="QueryCoverage =86%, HitCoverage=19%, E-value=4e-11, Identity=42%"; Hit description =Hypothetical protein CBG07042 [Caenorhabditis briggsae]
  Coding regions on vcDNA: vcDNA=SeqID_91907; Strand=+; Position=3-330
KTKFRKNFRRFEWLVFQSPIVRILLEILNITVFMELSSRSNLFFQLSNLIGIISLFVGSYGSYIIVPIGASLLHEYRHVYFKN

SEQ ID NO: 165485 - protein, 164 aa, Heterodera glycines
  Homolog annotation: Hit_ID=NP_496220.1; Match level="QueryCoverage =87%, HitCoverage=97%, E-value=1e-20, Identity=38%"; Hit description =brugia malayi antigen like (2K603) [Caenorhabditis elegans] emb|CAA88891.1| Hypothetical protein ZK970.7
  Coding regions on vcDNA: vcDNA=SeqID_91908; Strand=+; Position=13-507
MSSSSIFLSFASYSLIILALCRAQNESAAQGDAQPPPFLTEASQEKINEFYQYVTSLGHLKETETAEKVKEWVDKQSEEIQKKYVEFEQERERAKAEGEAAHEEAVRKFSEAAKKADKELTEIANNPNLSANDKAEMINRKVQSLPKKVRDEIGGAMGGGGGGQ

SEQ ID NO: 165486 - protein, 97 aa, Heterodera glycines
  Coding regions on vcDNA: vcDNA=SeqID_91909; Strand=+; Position=105-398
IIVNASADEFYKQPMFYFLAHFRLTKKKILIHSKIYVLVNLCRQIRRLFRQHFLTKKALNCQIIRWKIQFPTLLVIIKLIIFNNFDFIFNLVSFCFR

SEQ ID NO: 165487 - protein, 98 aa, Heterodera glycines
  Coding regions on vcDNA: vcDNA=SeqID_91910; Strand=-; Position=1-294
INTPINTAKQFFFFCFTTCRCLSPSAASSASRKESINIMCCIVKRKYYMSMYVCIMIVFCKPSLIVISRSLPFPSLISPLFSPSVLLLLLVPVCWLHS

SEQ ID NO: 165488 - protein, 41 aa, Heterodera glycines; identical to SEQ ID NO: 131599
  Coding regions on vcDNA: vcDNA=SeqID_91911; Strand=-; Position=235-360

SEQ ID NO: 165489 - protein, 192 aa, Heterodera glycines
  Homolog annotation: Hit_ID=CAE64757.1; Match level="QueryCoverage =91%, HitCoverage=17%, E-value=2e-26, Identity=35%"; Hit description =Hypothetical protein CBG09547 [Caenorhabditis briggsae]
  Gene Ontology: Mol. function=RNA polymerase III transcription factor activity; Cellular component=transcription factor TFIIIC complex; Biological process=transcription from Pol III promoter
  Coding regions on vcDNA: vcDNA=SeqID_91912; Strand=+; Position=44-619
MNSLLLSYLIICWVHLGRLDLVPQLIDCLLERPLGSSDEENAFLDIARSLHSTHQLVLAVEYMQKLRKERPEFNESTDFWFLIGCLHQALGQLGLARTAYETAISFQPGHIDARINLSTILQQLDQSELALETLKDLNYDSCSHIPDERLLCRQAEVLLEQRKADQYISCLRLLLIPHFYQIYRSDDACSVS

SEQ ID NO: 165490 - protein, 211 aa, Heterodera glycines
  Homolog annotation: Hit_ID=NP_504186.1; Match level="QueryCoverage =100%, HitCoverage=25%, E-value=5e-13, Identity=25%"; Hit description= vglm uuk m polyprotein like family member (5E780) [Caenorhabditis elegans] gb|AAB63927.1| Hypothetical p
  Coding regions on vcDNA: vcDNA=SeqID_91913; Strand=-; Position=1-633
CFLGGSACLFYRWYAQEKSKTVYEIMGCNSWEFIVYTIIRLETLGEKPKSTQVFLYPGRTLKWNNISITPIGVTFPPAPVLNSDFVFDGSNMALTREPLAIDFNCKNRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCY

SEQ ID NO: 165491 - protein, 167 aa, Heterodera glycines
  Homolog annotation: Hit_ID=NP_001001846.1; Match level="QueryCoverage= 99%, HitCoverage=60%, E-value=8e-21, Identity=35%"; Hit description =purine-rich element binding protein A [Danio rerio] gb|AAH81472.1| Purine-rich element binding protein
  Coding regions on vcDNA: vcDNA=SeqID_91914; Strand=+; Position=2-502
GKDIASKTLNIPSRGFYLYVKPTDRGRFVKLAEDAINGRKNRLFLSMQICNNINELLRNFEGLVPVSEDMNGTPYNVIIRSESIVTDRRQYYIDLPEGRRGSFLRITLLETHSAILNSVVLPLEGIGPLHHALDSILDDYGRRFLDEAPYLRHSLMIRTDAKRFFFD

SEQ ID NO: 165492 - protein, 177 aa, Heterodera glycines
  Coding regions on vcDNA: vcDNA=SeqID_91915; Strand=+; Position=3-533
YHKFCSFLVVMESADSKGGKDADLQKALCVSTMAVASAVFEHALPPPLLPLASTVVSNPNTSIYFLSSGGNADVRIRCNSVAEDSVISESGNETDTQMGKMREDDKMTEKMGGERKGKGEKKRRRRRRRNSAGQRQLAIHQQSLNSLFRHIQVFPLKQYRELRMDYLRIKKMRMGTL

SEQ ID NO: 165493 - protein, 138 aa, Heterodera glycines
  Homolog annotation: Hit_ID=AAS84455.1; Match level="QueryCoverage =100%, HitCoverage=95%, E-value=2e-63, Identity=65%"; Hit description= protein disulfide isomerase [Ancylostoma caninum] gb|AAS84454.1| protein disulfide isomerase [Ancylostoma
  Gene Ontology: Mol. function=procollagen-proline,2-oxoglutarate-4 -dioxygenase activity; Cellular component=endoplasmic reticulum; Biological process=protein folding
  Coding regions on vcDNA: vcDNA=SeqID_91916; Strand=+; Position=2-418
WNKQPVKVLVGKNFEQVARDDTKNVLVEFYAPWCGHCKQLAPIWDKLGEKYKDHESIVIAKMDATGNEVEDVKIQSFPTIKYFPANSKKAIDYTGERTLEGFSKFLESGGKDGAGPSEEEKAAKEGEEGGDEEGHTEL

SEQ ID NO: 165494 - protein, 150 aa, Heterodera glycines
  misc_feature (98)..(98): Xaa can be any naturally occurring amino acid
  Homolog annotation: Hit_ID=AAN33195.1; Match level="QueryCoverage =100%, HitCoverage=29%, E-value=5e-38, Identity=54%"; Hit description= At1g79470/T8K14_11 [Arabidopsis thaliana] gb|AAL58945.1| At1g79470/T8K14_11 [Arabidopsis thaliana] pir||J
  Gene Ontology: Mol. function=IMP dehydrogenase activity; Biological process=GTP biosynthesis
  Coding regions on vcDNA: vcDNA=SeqID_91917; Strand=+; Position=2-451
IKYIKAAHPGLDVIAGNVVTGAQARRLIEAGADGLRVGMGSGSICTTHEVCAVGRGQATAVYHDARVANELGVPIIDDGGFHNSGHIAKGLVLDVNDXLCGSMFATTTDAPDKHFMIPEDLVMKNHGEGSLQAVSNGFETHYDFDTQSLK

SEQ ID NO: 165495 - protein, 147 aa, Heterodera glycines
  Coding regions on vcDNA: vcDNA=SeqID_91918; Strand=+; Position=62-502
SKGVARDQCRVNSVCARHGTDRWHSFTSFTHPLKGLPAWVSSRIIDSFATQQQKNGCEALSSSALLLYTQAFCKFVQLIDAHSELLAPLKQCQNGRSLPRSLHLCELPGAFVAALKHSLHPEQSNALQWFINGLNPHWQWTAPTLPR

SEQ ID NO: 165496 - protein, 96 aa, Heterodera glycines
  Coding regions on vcDNA: vcDNA=SeqID_91919; Strand=-; Position=222-512
MVSNWMNCLGLISRRPTPPPMPPSPPSGPFSTTISAPSSSSSLITSSSSSSSSSSSSESITCTVTAGASSCCCCCFCLYCLPSSWPPSVPWAPPFL

SEQ ID NO: 165497 - protein, 78 aa, Heterodera glycines
  Homolog annotation: Hit_ID=NP_506478.1; Match level="QueryCoverage =100%, HitCoverage=13%, E-value=3e-10, Identity=39%"; Hit description= RNA helicase (5O490) [Caenorhabditis elegans] emb|CAB04518.1| Hypothetical protein F58E10.3 [Caenorhabdi
  Coding regions on vcDNA: vcDNA=SeqID_91920; Strand=+; Position=2-235
KNFYEVHENVVKREQLEIDEWLAKNSSTIRGKDAPSSSLGVDETGFPNKIIEHLGNIFDKPTAISNIAWPICFNGPEI

SEQ ID NO: 165498 - protein, 201 aa, Heterodera glycines
  Homolog annotation: Hit_ID=NP_847896.1; Match level="QueryCoverage =82%, HitCoverage=41%, E-value=2e-40, Identity=50%"; Hit description =APG4 autophagy 4 homolog B isoform b [Homo sapiens]
  Coding regions on vcDNA: vcDNA=SeqID_91921; Strand=+; Position=39-641
MDYVRTLTSMVDVCLTLEPGFSTLEDLAFLDLAGGAVHLLGTAYSSKDIEAIKEFSRSLIWFTYRKNWPAPIGGFDGPTSDRGWGCMIRVGQMVLAQALIKFHLGSDWRWANEMVDQRADNEQFQAYLRLLRMFQDKRTAQFSIHQIAQFGASEGKPIGEWLGPNSMAQVLKKIVVYDEWSNLVVHVAMDNVLISDHVHTM

SEQ ID NO: 165499 - protein, 226 aa, Heterodera glycines
  Homolog annotation: Hit_ID=XP_343327.1; Match level="QueryCoverage =79%, HitCoverage=3%, E-value=7e-13, Identity=35%"; Hit description =similar to myeloid/lymphoid or mixed-lineage leukemia 2; ALL1 -related gene [Rattus norvegicus]
  Gene Ontology: Mol. function=transcription factor activity; Cellular component=nucleus; Biological process=transcription from Pol II promoter
  Coding regions on vcDNA: vcDNA=SeqID_91922; Strand=+; Position=2-679
AAAAAVENQQQMLQQQQQQLHHQQSQGNLMSGGVLLPPGAHPPHFSSGAFPPLSSAGQQLSFPMESATHQQQQVLPLHHSQQQQQQPAALIGMFQRQSREDEGQQQQHQSRQNQAGQMQQQINQQQVEQMGTAGSNTTANQQQQQSTPAPLSVSSVSSAALSPHLMVPFSCPSTSSPIDPSTPLQFISHHPQHQGVPPPPPYKCIRWPCRKDPLGPSLLMLLFLPL

SEQ ID NO: 165500 - protein, 100 aa, Heterodera glycines
  Coding regions on vcDNA: vcDNA=SeqID_91923; Strand=+; Position=168-470
QTAGRPLPSPLSFLHHFPFALIFSSFHPSITPRSLLRSILPVFPICPLDGHSRLTFSRDKRIIHNLTLNEPNFQILISFVALNFSIILQNFKNSLSFKKS

SEQ ID NO: 165501 - protein, 225 aa, Heterodera glycines
  Coding regions on vcDNA: vcDNA=SeqID_91924; Strand=+; Position=1-675
TLVDALATNLKKVSSSLVARQMLAKRKQHVGESLDEFAQEIRTLVSKAYPDTSLEMNFDALVLGDMEEDAKREHDERLKRFRSGIAKDFFRSNMTASIKEKILFMDEPQSFEEAITQAKRVQQMQGALAEDLWKQTQGTKAEVALAEINAVRTELNEMREEQKKQEDQRVNFVQRTDEMAPQRYGQQTQNAYIQRGNSNRGFRGRTRGFQSYRGSFNPPNSNQTP

SEQ ID NO: 165502 - protein, 87 aa, Heterodera glycines
  Coding regions on vcDNA: vcDNA=SeqID_91925; Strand=+; Position=149-409
TVLILGQFAGRCADDPWALCASCNLRVCASQGGRARSSFELQLGAGFKGFGCLKWRKKSNFVQLWLFVDGQWEKKAMELGKALFGDR

SEQ ID NO: 165503 - protein, 182 aa, Heterodera glycines
  Homolog annotation: Hit_ID=CAE60244.1; Match level="QueryCoverage =93%, HitCoverage=38%, E-value=4e-50, Identity=52%"; Hit description =Hypothetical protein CBG03817 [Caenorhabditis briggsae]
  Gene Ontology: Mol. function=metalloendopeptidase activity; Cellular component=membrane fraction; Biological process=prenylated protein catabolism
  Coding regions on vcDNA: vcDNA=SeqID_91926; Strand=+; Position=139-684
MASWAWTGGAQIWHSIAFIWVSSVVETLISLPFSYYHTFFIEQKHGFNNETVPFFFKDRAMKLGVSLALSSPVVALLVWIIRNGGPNFPIYAWLALSLIIFVMMFVYPEFIAPLFDKYSPLPDSELKRKIEALAERVGFPLAKLYVVEDSKRSSHQNAYMYGFWKQQRIRSFHPFMSKAMNE

SEQ ID NO: 165504 - protein, 173 aa, Heterodera glycines
  Coding regions on vcDNA: vcDNA=SeqID_91927; Strand=-; Position=1-519
RPFHRPSHRRQSARNSLFVRQTSPPSGRYRANAESTVGVRAVFGRCFGCLASLAGVSFAALFSPSCCCSSTLCTTHFLRIRSLAISSTNARNESKTSSRLSAKRTFMCHSLSSRQSFHFLLHSADLRLNLAQHQIAHHLNHCLVIARFSDFVPPFAAAGHKGTGGTQHARLKP

SEQ ID NO: 165505 - protein, 182 aa, Heterodera glycines
  Homolog annotation: Hit_ID=S08405; Match level="QueryCoverage=92%, HitCoverage=14%, E-value=1e-35, Identity=42%"; Hit description =hypothetical protein 2 - silkworm transposon mag
  Coding regions on vcDNA: vcDNA=SeqID_91928; Strand=-; Position=3-548
NLSRKCNRRSASHAPVPFALRPEVEKVIDNWVKDGVLEQVTTSEWATPLVIVPKAGNKIRLCCDYKVTVNQWLDIHQYPLPRPEELFSVLIGGEKFSKLDLKEAYLHLMLDDKAKECLTICPHKGLYQFTRMPYGVASAPAIFQQVMEDVLRGMDGVAVCLDDIVVSAPNAAEHLKRLEMTL

SEQ ID NO: 165506 - protein, 225 aa, Heterodera glycines
  Coding regions on vcDNA: vcDNA=SeqID_91929; Strand=+; Position=3-677
YILLVPLKEHGMDEQIWKKLASNVVEALNASRQNPFQVDQAFKIDDLFNKNIPMGGQAQQHLAIIDQSCNFQQWVRVLYFFICDKIGDPLLRTLFASLCCVKHDASILGRTMCKNIPHMIIQALVEQNDAILDKFEQEALAVFCAVVGGQICWANDAMVAICAIVDAMERFFVGRTAAAIVGTRPKDKDVLSERFDALISKILAQPNPDSLTVVPLSVLAAQKCN

SEQ ID NO: 165507 - protein, 198 aa, Heterodera glycines
  Homolog annotation: Hit_ID=NP_506478.1; Match level="QueryCoverage =67%, HitCoverage=23%, E-value=1e-30, Identity=50%"; Hit description =RNA helicase (5O490) [Caenorhabditis elegans] emb|CAB04518.1| Hypothetical protein F58E10.3 [Caenorhabdit
  Gene Ontology: Mol. function=RNA helicase activity; Cellular component=nucleus; Biological process=cell growth
  Coding regions on vcDNA: vcDNA=SeqID_91930; Strand=+; Position=48-641
MQLNTSNYHFFNGQPSPAGATQSNNKNFFSGQPNYSNNNSNWNSPKANGTQPKAASSSFATQSAIKKDNYQAHELVLNRPKAEVDKWMADNEVKLSGHSLTGPVTSFQESTFPAPIVAQLSSVFSAPTAIQAISWPVALAGKDLISIAKTGSGKTLGFTLPAIVHVLNNQRPQQQRRPGESPAVVVLLPTRELGQQVE

SEQ ID NO: 165508 - protein, 158 aa, Heterodera glycines
  Coding regions on vcDNA: vcDNA=SeqID_91931; Strand=-; Position=0-473
RRTSARLMCRPGCCGRASSSSGSTLVNAALDRMSLYSSSNTFSTNSSRFWACSAAFLLLLLTLFVLFTRSFLIVRVSVVCHQSWGLNKRALPIRFFPNAAFLNVCSSSAEEAPPLPRIFLPLDLLVAVIATAAALLPLRLVNMPPRPPPPPPPPPCPS

SEQ ID NO: 165509 - protein, 175 aa, Heterodera glycines
  Homolog annotation: Hit_ID=CAE67086.1; Match level="QueryCoverage =100%, HitCoverage=38%, E-value=9e-24, Identity=34%"; Hit description= Hypothetical protein CBG12497 [Caenorhabditis briggsae]
  Gene Ontology: Biological process=positive regulation of growth rate
  Coding regions on vcDNA: vcDNA=SeqID_91932; Strand=+; Position=2-526
AIPVKDEKGRIVMKKVKVQRYMAGKIPEFAQDFDSDEDAQQAEEEVETDLRQFLEEKRERERREKDEHRHNRKDGKRHRERRDQQLDEFKKELKEEEALALGEVEEEDEQTREERHQRAMLRHRRTEREEAPLEQEDLEEEADEDERQRRRELLKRIPQRQEEEELLAKQPDAGE

SEQ ID NO: 165510 - protein, 51 aa, Heterodera glycines
  Coding regions on vcDNA: vcDNA=SeqID_91933; Strand=+; Position=174-329
KIIIKLCRPFLVNKAELVENCSSASHHINILYYKDNLNVYLKQFYNPRPHL

SEQ ID NO: 165511 - protein, 59 aa, Heterodera glycines; identical to SEQ ID NO: 129099
  Coding regions on vcDNA: vcDNA=SeqID_91934; Strand=-; Position=488-667

SEQ ID NO: 165512 - protein, 125 aa, Heterodera glycines
  misc_feature (48)..(48): Xaa can be any naturally occurring amino acid
  misc_feature (86)..(86): Xaa can be any naturally occurring amino acid
  Coding regions on vcDNA: vcDNA=SeqID_91935; Strand=-; Position=289-666
IIYIYEYAFLCSICHFICIDFVNMHVLRMCLSSVYIYEDALLCIYHPXVYIYEYTFLCSICHFICIDFVNMHVLRMCLSYVYIYEXCTLMHMPTHKCIFINPYAYALLFIFFHLISYICALHFYA

SEQ ID NO: 165513 - protein, 89 aa, Heterodera glycines
  Coding regions on vcDNA: vcDNA=SeqID_91936; Strand=-; Position=117-386
LPTPPLFAAISNIFLNFQHYFHAIAISDLLPNSFALDYLKTKMSEYMNPSDNAQFNQINADLLLRYTGEKKRGILNFKNLKVCLIEPLF

SEQ ID NO: 165514 - protein, 157 aa, Heterodera glycines
  Homolog annotation: Hit_ID=AAF68270.1; Match level="QueryCoverage =61%, HitCoverage=65%, E-value=4e-16, Identity=42%"; Hit description =ornithine decarboxylase antizyme [Onchocerca volvulus] sp|Q9NHZ5|OAZ_ ONCVO Ornithine decarboxylase antizym
  Coding regions on vcDNA: vcDNA=SeqID_91937; Strand=+; Position=67-537
ISRLVIPVVRIARASRGAPDIPNSENIDRDAVAGLVKSCTKISRPFLKFTHSLPPNSGACVAEGWCCHLAEKNTLALFIPSKLFSSTLSRENFVDLLEYCEEHLKVRRILACFNKSDINPCQGIPRALRCIGFTLLPPERYPAGIDKNTIFAMGYKI

SEQ ID NO: 165515 - protein, 191 aa, Heterodera glycines
  Homolog annotation: Hit_ID=NP_503306.1; Match level="QueryCoverage =99%, HitCoverage=19%, E-value=2e-66, Identity=68%"; Hit description =GEX (Gut on EXterior) Interacting protein GEI-7, bifunctional glyoxylate cycle protein, mainly expressed
  Gene Ontology: Mol. function=malate synthase activity; Cellular component=peroxisomal matrix; Biological process=glyoxylate cycle
  Coding regions on vcDNA: vcDNA=SeqID_91938; Strand=+; Position=3-575
QEFAAEKYGYTAVKHQREVGTGYFDYVGLAAAGGVSSTTALKDSTEEAQFYTATASADEDEIVKITAQEMPGDERILTPAALRFLRELHNKFEQRRQSLLAQRKILQHKLDEGDYFPDFDPNTEELRADRSWTSQAEIPVDLQDRRVEITGPTDRKMVINAMNSGARVFMADFEDANSPTWRNQIEGPIKL

SEQ ID NO: 165516 - protein, 107 aa, Heterodera glycines
  Homolog annotation: Hit_ID=NP_113997.1; Match level="QueryCoverage =95%, HitCoverage=7%, E-value=1e-09, Identity=35%"; Hit description =cyclic nucleotide-gated channel beta subunit 1 [Rattus norvegicus] emb|CAA04133.1| cyclic nucleotide-gated
  Coding regions on vcDNA: vcDNA=SeqID_91939; Strand=-; Position=2-322
MNKEQIKEIFQHIGIPFDEKEFEGTDKQMAFLSDQKIEDQQKKKRKKNRRKKNGQKLGMNEENESEQTQETTESKIEEKGKSEKERTKKEEEKEAMEEKMEEKEKEN

SEQ ID NO: 165517 - protein, 80 aa, Heterodera glycines
  Homolog annotation: Hit_ID=CAE57685.1; Match level="QueryCoverage =70%, HitCoverage=4%, E-value=1e-15, Identity=66%"; Hit description =Hypothetical protein CBG00683 [Caenorhabditis briggsae]
  Coding regions on vcDNA: vcDNA=SeqID_91940; Strand=-; Position=134-376
PTLARERLYSILHHTFVGIPYILKECLAAHKEADEMSTKCRSYVNHFELISLRDYHFSYRFTQACQDDIRAHCVQFGQDK

SEQ ID NO: 165518 - protein, 148 aa, Heterodera glycines
  Homolog annotation: Hit_ID=NP_494736.1; Match level="QueryCoverage =100%, HitCoverage=14%, E-value=5e-17, Identity=39%"; Hit description= putative protein family member, with 2 coiled coil-4 domains, of eukaryotic origin (124.6 kD) (2E497) [C
  Coding regions on vcDNA: vcDNA=SeqID_91941; Strand=+; Position=1-573
RQIGTNEAFDRPADAALLFEDIDDKDVTYAPEIQSLEVPPDQLSQADSLNLVDEEQFSEEHQRVIENLQRIIDRLRRTPSPRPHRMDQAQVPQAPQFLRSYFNDESTSSLSSTFQSIRQSSLLSALGVTSTQEMLLRLTSLGALSDAM

SEQ ID NO: 165519 - protein, 99 aa, Heterodera glycines
  Coding regions on vcDNA: vcDNA=SeqID_91942; Strand=+; Position=129-428
PAGQINLTVQKLVEVGTGIGNQARIGLLDLNPFCRDPDQTFFRINRDKDPGKIPKGSPIPFGLQISVTYDNPHKNLINHPLAELIGVKPRGHLLLLVDE

SEQ ID NO: 165520 - protein, 91 aa, Heterodera glycines
  Coding regions on vcDNA: vcDNA=SeqID_91943; Strand=-; Position=355-630
KICEKLQESLDKFGIDISKIHLVLRDAQSAMKLGTNILGCDSQDCFLHKMQLVSLCFLLVKNEKLSQSVMVLKFTRIFYRFLKKSKKSLGK

SEQ ID NO: 165521 - protein, 155 aa, Heterodera glycines
  Coding regions on vcDNA: vcDNA=SeqID_91944; Strand=-; Position=161-628
MPHKWHSPRSSPGPKFENNLRKCCLIIDYKHTAIGFLKIPKSISLGRFGGARMSFGRYERTGDAATRTPVGVGERARAKRRAGPTKPVAVAGAGTNLAVKKEYLRLFTQEMLLTFLRWLANRQTARRRRREREREGGGVSSKESCLGYGSCRESG

SEQ ID NO: 165522 - protein, 213 aa, Heterodera glycines
  Coding regions on vcDNA: vcDNA=SeqID_91945; Strand=+; Position=1-639
IFSMLKPRPLFRQFVQSRFSSPNSSVEPHKKITTVPISAKNSATILHEFVNSLKTVNLPPSAVPNASILDKIVPKPGQRMRITDRIRTFEQIVTEIDFLYTVSTEVPSALSDEHWVQLLDTVSAAEREHLLRTIHYAQLVEKAAAAERQTLKNGTKTLDAIAGVNDDDDDGCVAHSSSSATTATNSPNYQQMFGDEFCDQSALKSRMDTHFGL

SEQ ID NO: 165523 - protein, 70 aa, Heterodera glycines
  Coding regions on vcDNA: vcDNA=SeqID_91946; Strand=+; Position=140-352
NICITDVFSTDRFSGHEQSWYHMKNVKKSCFFTTFCRLENLFACAKTTWSLFYYIFFWKTLIILENFFYV

SEQ ID NO: 165524 - protein, 106 aa, Heterodera glycines
  Coding regions on vcDNA: vcDNA=SeqID_91947; Strand=-; Position=191-511
THIFQVCHHVHLFRFSQFHFQTSDSANWARKDFFAALLNTLKQDFIKREFRQRTVKKKKKRGKKKVKPSDFFCLQRLLIYTLTQRNARTMGQLPLVLAYYFRVSNT

SEQ ID NO: 165525 - protein, 173 aa, Heterodera glycines
  Coding regions on vcDNA: vcDNA=SeqID_91948; Strand=+; Position=2-523
EEKEQFTSARRTVEGVFRDIIRLDNEAKEFSFSAHNTMVEAQNIKNKNPDKPGVNFWHSKLLDGVLKIHALFDKIKKEEKNMKNIKKGMEKCLDRKDLTMCQELAEEAKQSIEIAKNYRQEIGHIYRTAYSQPDLGIGDLANKLKETMRKNQIRFERQRPQEEFRDEFIAYKI

SEQ ID NO: 165526 - protein, 98 aa, Heterodera glycines
  Coding regions on vcDNA: vcDNA=SeqID_91949; Strand=-; Position=353-649
WVFFPNYILFACFSLINHLFLMAPMCNDFAFSNRYCVALCLANQNDLSLSRLQNELLGGLTAGISGHPFNHNVRSALLCTGIYVLYSHGKVGQWPTSC

SEQ ID NO: 165527 - protein, 79 aa, Heterodera glycines
  Coding regions on vcDNA: vcDNA=SeqID_91950; Strand=-; Position=129-368
IVKNIRKLFSVLIMLYNAFKPRREAGQFQNFVPHFTVESPSTLLNNYVSMSIVAFGQLWNGKMGISDGVRSFLKIPLFV

SEQ ID NO: 165528 - protein, 133 aa, Heterodera glycines
  Coding regions on vcDNA: vcDNA=SeqID_91951; Strand=+; Position=243-641
LSFLCFATKKVLIKNLICLFLRLFNAYFAIFSAFLCAYFAKNIFFIEYLLKKIFYFYIFPQFVTIFQLVSSACILHSLKPSNRRHGHYTYYLEFANGTRIRQMADVIYDERQGGKFVICMSLGQYTFVWRSGL

SEQ ID NO: 165529 - protein, 114 aa, Heterodera glycines
  Coding regions on vcDNA: vcDNA=SeqID_91952; Strand=+; Position=168-512
FNQCFPLLFISMSLFDLPLTDRLIIIMPFFLQSFINGGNAIQCPPPHLKPSLYKWRLSLAIDRRFVLHSLREQNVAAEEHKYPFIRIIEWINNKRKYLGMGEYFLKNRSKFNNQ

SEQ ID NO: 165530 - protein, 196 aa, Heterodera glycines
  Coding regions on vcDNA: vcDNA=SeqID_91953; Strand=+; Position=3-590
IVARMSSDLCSPLISQQQQQQFVAQPLAHNVQQQVTNTELGANLLVNAIAAQQQQQNQMGPFLELLANLNTSNQSTASVHQPLPQFNSPLADSQSSSLIDGSAALNAFQLVQQTAQLNHQKMLVEQQQHQLISAATMSIKSPLSSQSAVFAGSEGGIPALFNRLSAVPSIFRSMGPSHSKPIPLLDEQMDLLQFKR

SEQ ID NO: 165531 - protein, 119 aa, Heterodera glycines
  Homolog annotation: Hit_ID=XP_417163.1; Match level="QueryCoverage =94%, HitCoverage=14%, E-value=6e-15, Identity=40%"; Hit description =PREDICTED: similar to Cullin homolog 5 (CUL-5) (Vasopressin -activated calcium-mobilizing receptor) (VACM-
  Coding regions on vcDNA: vcDNA=SeqID_91954; Strand=+; Position=3-362
LDHVTDAANNIHSHNDDDSLLRAYIQEWENYSQLCRYLPLPFNFIEKNLVKTPSRPKTESQRVRNVMLDYFFRHVFADISQRILNAAMGMVERERNRELVNSQMIVGVRESFGDFQSQT

SEQ ID NO: 165532 - protein, 67 aa, Heterodera glycines
  Coding regions on vcDNA: vcDNA=SeqID_91955; Strand=+; Position=24-224
RQLFWNTCLSLWKTENKCALNSDVSADRSIFIQHHQRVVFFYHHQHYSSSGHRLIKFDAHCCGPVPY

SEQ ID NO: 165533 - protein, 31 aa, Heterodera glycines
  Coding regions on vcDNA: vcDNA=SeqID_91956; Strand=-; Position=3-95
FFFFFSFRGSDGNVRPLYSDQLHISANQPSK

SEQ ID NO: 165534 - protein, 144 aa, Heterodera glycines
  Homolog annotation: Hit_ID=NP_499054.1; Match level="QueryCoverage =82%, HitCoverage=86%, E-value=1e-30, Identity=55%"; Hit description =esophageal gland cell secretory protein 11 like precursor family member (3K419) [Caenorhabditis elegans]
  Coding regions on vcDNA: vcDNA=SeqID_91957; Strand=+; Position=115-549
EIRCQFQCRFGQIRCPIIINNRSNKTQSAGVYGALTCNGSPAGGVRVKLFDVDRWFESDDLLADGWTAQNGTFALYGSAKEATKIVPKVNIYHDCNDTKICQRKFSIFVPLHFVNEGKIPSQFYHLGTIELSEKFPHEQRDCLH

SEQ ID NO: 165535 - protein, 91 aa, Heterodera glycines
  misc_feature (33)..(33): Xaa can be any naturally occurring amino acid
  Coding regions on vcDNA: vcDNA=SeqID_91958; Strand=+; Position=371-643
KDAFQIEVPLILKHIQIHWRCTGDVQRDEEIDXLLEKHADSLRRKLSEMFFHTPIPPFVFVEDRRHLYEQELSKLLEIADYGMQYRAVSHV

SEQ ID NO: 165536 - protein, 67 aa, Heterodera glycines
  Coding regions on vcDNA: vcDNA=SeqID_91959; Strand=-; Position=403-606
KIFKSILRGCIFHFYCIFVNEFSGNPEKFVKNGEIGIKHKKSKIGKVRHYKSHRRHAKSSGKCVFRA

SEQ ID NO: 165537 - protein, 100 aa, Heterodera glycines
  Coding regions on vcDNA: vcDNA=SeqID_91960; Strand=-; Position=2-301
VNCIAICSSLCVGLGNGAGRTNRKRHFPPPMVPLLSVSLTALFPLSLDAFAHFVLVKKHLTSMAPIIPREQAQCLQNVFKHFAHFEINSATKDWTQEGGH

SEQ ID NO: 165538 - protein, 83 aa, Heterodera glycines
  Homolog annotation: Hit_ID=NP_758841.1; Match level="QueryCoverage =91%, HitCoverage=9%, E-value=4e-17, Identity=51%"; Hit description =RIKEN cDNA 4732437J24 [Mus musculus] dbj|BAC34510.1| unnamed protein product [Mus musculus] dbj|BAC26068.1
  Gene Ontology: Mol. function=heat shock protein activity; Cellular component=mitochondrial inner membrane; Biological process=protein folding
  Coding regions on vcDNA: vcDNA=SeqID_91961; Strand=+; Position=2-250
LLLVNIIAYELNPYNTLGIRRTAGPKDIKDAYKKLALQWHPDKNKNPESNQRFSDVKQAYEILSNPHRKKAYDTFGFPDDQFE

SEQ ID NO: 165539 - protein, 79 aa, Heterodera glycines
  Coding regions on vcDNA: vcDNA=SeqID_91962; Strand=+; Position=281-520
EFSISNIYEHCFVLFVLFSSHFFSCFFLCKTITNFIYSVINILQFLYLLYLFFTNNQFLLVFFCSFYIVKRNILPLIHV

SEQ ID NO: 165540 - protein, 82 aa, Heterodera glycines
  Coding regions on vcDNA: vcDNA=SeqID_91963; Strand=+; Position=3-251
LLLSSSISLLFHPHGPPYPQSELLQLHLRLQRTHRRAMRWARLNTFEAGAGFKSLKDWGGGAQLGRGKGNQLISLLINNGKW

SEQ ID NO: 165541 - protein, 89 aa, Heterodera glycines
  Homolog annotation: Hit_ID=AAR11446.1; Match level="QueryCoverage =97%, HitCoverage=14%, E-value=5e-44, Identity=100%"; Hit description= matrix metalloproteinase [Heterodera glycines] gb|AAR11445.1| matrix metalloproteinase [Heterodera glycin
  Coding regions on vcDNA: vcDNA=SeqID_91964; Strand=+; Position=123-554
GLAIAKASSPPVARIVLNADENWSTFQTQEEGKIDIFVVLLHEIGHALGLRHSGDEHSVMFPMFERSVGEHLPVISNDDVEHLRALYGD

SEQ ID NO: 165542 - protein, 103 aa, Heterodera glycines
  Coding regions on vcDNA: vcDNA=SeqID_91965; Strand=-; Position=3-311
IHLADENPVHIRHIRRASQPNGHREWSSPIFLTFHLFRWSNPQFVPHKPRQPVLVQLPSRIRLPFSVHSPPSISHPRVHRCGCCCCCQPSLPREIRVPIVPRM

SEQ ID NO: 165543 - protein, 209 aa, Heterodera glycines
  Homolog annotation: Hit_ID=XP_316894.1; Match level="QueryCoverage =100%, HitCoverage=71%, E-value=9e-44, Identity=45%"; Hit description= ENSANGP00000006544 [Anopheles gambiae]
  Coding regions on vcDNA: vcDNA=SeqID_91966; Strand=+; Position=3-629
YIRTCVHHAQEKGYRCAVLNHIGVLKNVQLTSQRIFSYGGNGEMEAMFRVLAKLYPRTYFIGIGFSMGANVLTNCLASGLDPSISSRILLGISVCQGYCASDASSLLFDWQGGRRLYNYIITESVKRLLRRNYAMVVLPHVKSGLVDERKIWSSTSLLWLDEFYSRRVHNFASVSDYYSHISCLPRIKDIKIPMIFINTLDDPLVPEAL

SEQ ID NO: 165544 - protein, 174 aa, Heterodera glycines
  Homolog annotation: Hit_ID=EAL33017.1; Match level="QueryCoverage =90%, HitCoverage=50%, E-value=5e-09, Identity=29%"; Hit description =GA12721-PA [Drosophila pseudoobscura]
  Coding regions on vcDNA: vcDNA=SeqID_91967; Strand=+; Position=124-645
MDNEFSSLEEIFAQFFPGQQCSAAGSSNWRWDRNLAENLLLEKTVRFKEDGFCVQFHPLFSYGTAAVWGECALDELVRAYWEVAEDEMYGSSMMFGLGTRDALQSVPFGYVDLIGGVGQLGDQAYGLTHNGFVTHACESRPFCEQLRTMNDIHCTCTVGILFDGPSARIGFSLD

SEQ ID NO: 165545 - protein, 24 aa, Heterodera glycines
  Coding regions on vcDNA: vcDNA=SeqID_91968; Strand=-; Position=56-130
FFFFFFLLTSRSATTPIKRPRRVT

SEQ ID NO: 165546 - protein, 210 aa, Heterodera glycines
  Coding regions on vcDNA: vcDNA=SeqID_91969; Strand=+; Position=2-631
KCLPLELLYEIVPFIPAENAAPNALSSCSLLHKLLLPRVIKWKEKAMDERIIELFDQFKEEMEQKLMNKLDEIKEFLSLEFNQKFDALEQKFEQKFDALEVRVGRLERGTATNTNQGKKSLNVHERLDLIFEKLGIIRVNKSRSPEPSCSNTLPTSETANNTNTGGLENDGNRGGESEKEQTKSSNDGALPPPMPPLRSSLQGKPPPVPT

SEQ ID NO: 165547 - protein, 213 aa, Heterodera glycines
  Coding regions on vcDNA: vcDNA=SeqID_91970; Strand=+; Position=1-639
LSVGSVEQLESEDLEDIGVKKLGHIKRICLALKKLRNYRAELVDPPLAVCPLLCPPSSSSSVCPLSSVVGIPLDIHSSAFSSENLFVQSLSSKRRNSQAQQSNSQLTAVEINEKNCQRISFTNGISTDGTRLMSKWTEDGGQRVQMRNVSFERDSLDERTATDKGPPRLNLYRTSQIIAQLPRDPPPELDEADEWEDERGTNGLHGDGHHGQP

SEQ ID NO: 165548 - protein, 160 aa, Heterodera glycines
  misc_feature (1)..(1): Xaa can be any naturally occurring amino acid
  misc_feature (3)..(3): Xaa can be any naturally occurring amino acid
  misc_feature (5)..(6): Xaa can be any naturally occurring amino acid
  misc_feature (10)..(11): Xaa can be any naturally occurring amino acid
  misc_feature (13)..(13): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(27): Xaa can be any naturally occurring amino acid
  misc_feature (31)..(32): Xaa can be any naturally occurring amino acid
  misc_feature (36)..(36): Xaa can be any naturally occurring amino acid
  misc_feature (43)..(43): Xaa can be any naturally occurring amino acid
  misc_feature (45)..(46): Xaa can be any naturally occurring amino acid
  Homolog annotation: Hit_ID=CAE70202.1; Match level="QueryCoverage =99%, HitCoverage=12%, E-value=2e-44, Identity=55%"; Hit description =Hypothetical protein CBG16677 [Caenorhabditis briggsae]
  Gene Ontology: Mol. function=phosphorylase kinase activity; Cellular component=phosphorylase kinase complex; Biological process=energy pathways
  Coding regions on vcDNA: vcDNA=SeqID_91971; Strand=+; Position=2-481
XEXDXXSRRXXAXEKRPPXEXQXXXXXEGRXXKEEXPRFFFEXQXXSELEPKYSVLPASVFAKILQRVGQSTKLNLSGRPADRDVQLLSTSRLYHVGNKLVAFTPQFMDVRRSHLVYDIRVLMDEWSSELHYIYNSWKQVSIRGRPLVLLMISDNMLQTD

SEQ ID NO: 165549 - protein, 207 aa, Heterodera glycines
  misc_feature (155)..(155): Xaa can be any naturally occurring amino acid
  Homolog annotation: Hit_ID=CAE56807.1; Match level="QueryCoverage =100%, HitCoverage=27%, E-value=2e-22, Identity=30%"; Hit description= Hypothetical protein CBG24620 [Caenorhabditis briggsae]
  Coding regions on vcDNA: vcDNA=SeqID_91972; Strand=+; Position=32-651
MEEDNAGDIIKWLYKDSTKLDCSSEKVKVTSEHLHSKLCQVKLRGNLLGFKPLDFASEPFLIVCEKINVQRSEQNKNSLAIRQSNKELHLEFQSEKQCDQWVVKLMTCSHRIVQAEYDQVLYNRFTQPLPASSLSQQMVNNFAYFLTAPSVVNNXFSLSQSHNFPSRQIKCQEVMYESKLSMVVPREILRLSHKWATELRDELLDKL

SEQ ID NO: 165550 - protein, 119 aa, Heterodera glycines
  Coding regions on vcDNA: vcDNA=SeqID_91973; Strand=-; Position=2-358
TSAGGIFNASYLSSEKGDDNFVLNACATEEKKCFKELEKFCPPPLTIHKCQVCPESGCNENRTERICPSELETTAEPVDKNGQTKNGRGSPGKTVRHHHAKPCRNIVGTICREFGMDLS

SEQ ID NO: 165551 - protein, 192 aa, Heterodera glycines
  Coding regions on vcDNA: vcDNA=SeqID_91974; Strand=+; Position=69-644
VKKILFRIILMPPLDKIFSCRLKGIELNIFRGDIVMAETDAIAILCDPDFKLNAGVGRAIRNTGGQDFMNSLNEEKRKQRGSRVISVPISSGIRSASVLLAPVSGMDRHSLDQVYSAIIQKALDLRIESLSMPLLGSLFSSLDTASNYLWACLQQFSSFGRLKKIQIVDTNDFHMRSLHKFIIAKLRAQSQL

SEQ ID NO: 165552 - protein, 151 aa, Heterodera glycines
  Coding regions on vcDNA: vcDNA=SeqID_91975; Strand=+; Position=1-456
MLQSAAHSNGITNGNNSNGTKSGGKSGKANGIGTILTTTTSTTTTITTTTNGISAAAVCLQSPSTSSSGVFLHFGQLTAVLLLHHHSAVVRFKRGGRWNGAHFATTVRRRRPGAGHATARTWPTVGAATVAACGPGSAGSAIRHRWPCRRH

SEQ ID NO: 165553 - protein, 198 aa, Heterodera glycines
  Homolog annotation: Hit_ID=NP_501220.1; Match level="QueryCoverage =96%, HitCoverage=21%, E-value=3e-45, Identity=49%"; Hit description =aminopeptidase (100.0 kD) (4I310) [Caenorhabditis elegans] gb|AAB03152.1| Puromycin-sensitive aminopeptid
  Gene Ontology: Mol. function=aminopeptidase activity; Cellular component=cytosol; Biological process=proteolysis and peptidolysis
  Coding regions on vcDNA: vcDNA=SeqID_91976; Strand=+; Position=69-662
MANGSTDKFSKLPELAKPSLYQIFVSLNLNTFKFKGKQTIHLEITKPTNYLKLHSNALDVEKASLKLEDGTVFPDLKREIDAKWTLLTVQLPQEIKPQKAELEFVYNGELTTNMKGFYKSTYKDSEGNEMAVASTQFESTYARNAFPCWDEPTYKAQFDIKLEVDKALTALSNMNVTEEKHTETGTKTVTFARTPLMS

SEQ ID NO: 165554 - protein, 67 aa, Heterodera glycines
  Coding regions on vcDNA: vcDNA=SeqID_91977; Strand=-; Position=95-298
FFFFFFILYNRCYCVYLTDQSPPLLHPLVFHFDHQMDTFRFLSPSLSIHKRHTLSSALIVLLHINCE

SEQ ID NO: 165555 - protein, 51 aa, Heterodera glycines
  Coding regions on vcDNA: vcDNA=SeqID_91978; Strand=-; Position=4-159
ILSLKYFQKFSWRRRLPPLHKKFFFGKSAPQKSVLLIFKFGIKLKKMIFAL

SEQ ID NO: 165556 - protein, 206 aa, Heterodera glycines
  Homolog annotation: Hit_ID=NP_741157.1; Match level="QueryCoverage =100%, HitCoverage=99%, E-value=1e-108, Identity=97%"; Hit description=ribosomal Protein, Large subunit, ubiquitin (94.0 kD) (ubq-1) [Caenorhabditis elegans] gb|AAC46525.1| U
  Coding regions on vcDNA: vcDNA=SeqID_91979; Strand=+; Position=33-650
MQIFVKTLTGKTITLEVEASDTIENVKAKIQDKEGIPPDQQRLIFAGKQLEDGRTLADYNIQKESTLHLVLCLRGGMHIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGR

SEQ ID NO: 165557 - protein, 168 aa, Heterodera glycines
  misc_feature (24)..(24): Xaa can be any naturally occurring amino acid
  misc_feature (57)..(57): Xaa can be any naturally occurring amino acid
  Homolog annotation: Hit_ID=CAC33829.1; Match level="QueryCoverage =100%, HitCoverage=51%, E-value=2e-46, Identity=57%"; Hit description= annexin 2 [Globodera pallida]
  Gene Ontology: Mol. function=phospholipid binding; Cellular component= cytoplasm
  Coding regions on vcDNA: vcDNA=SeqID_91980; Strand=+; Position=1-505
RDDIVHLLCTIFNLQTARIGTLIXQVLGEDFSFELKKALSGDFEELILALLEPAAVXHAQKMRRAMSGLRTHESVLIEILVTHRNRLIAEMNPGYDQLYGHPLENDICWDTTRAYERLLVSLCYDSRDECWSSDPLRADTTARALVQESEVDSGVNDFLFKQVLANED

SEQ ID NO: 165558 - protein, 84 aa, Heterodera glycines
  Coding regions on vcDNA: vcDNA=SeqID_91981; Strand=+; Position=341-595
YVCTFSNLDKMSEIWFFYKKSQTSETALCNLCHNSFSCKKSSTKGLWDHLKMKHNDEFEQLEKRKGKTNKEVINLESSIIFKII

SEQ ID NO: 165559 - protein, 211 aa, Heterodera glycines
  misc_feature (111)..(111): Xaa can be any naturally occurring amino acid
  Homolog annotation: Hit_ID=NP_500379.1; Match level="QueryCoverage =80%, HitCoverage=27%, E-value=4e-22, Identity=36%"; Hit description =protein from EUROIMAGE 1967720 (62.7 kD) (4E360) [Caenorhabditis elegans] gb|AAD12825.1| Hypothetical pro
  Gene Ontology: Cellular component=mitochondrion
  Coding regions on vcDNA: vcDNA=SeqID_91982; Strand=+; Position=3-634
AGCAHIKSEYVVLRSETQQQEGGNKPPNESNPLEGNSHEGILPRNVRARGMDRQREQKMAKARAENRQKIVRICPSVLFESEGRKCKYGEKCDAEHSLTKYWAKKPPDIGXVLAPNAKHHLSLEGPSCFLFDQMGKCSFSLSCCFARAHTNESDLSQKSKAGHSEWQSVLNTHTLPIQQQLRKRTYDFSRSERALHESPSGCMEREAPKWD

SEQ ID NO: 165560 - protein, 131 aa, Heterodera glycines
  Coding regions on vcDNA: vcDNA=SeqID_91983; Strand=-; Position=148-543
MNGSTPRGQKLDSKLRRCIKVANAATVTTPLLAFPSGAEVVVGPTSIVEIPLGNSADGISQSDGARERPTKFIYAIPAALAAAAEEGKFQQILTANQMSINLMDGEMRSLISKLIEQQKQSNETVVKRQNI

SEQ ID NO: 165561 - protein, 112 aa, Heterodera glycines
  Coding regions on vcDNA: vcDNA=SeqID_91984; Strand=+; Position=30-368
HCFGWKSVRLRYSPEHYYSNRALYCQIFMRKKPQPSRPNTSSAQPCELAYYFLALFTLICPFFNFHLVPNYFRAPFSLIVSFGSLAVRIRCPPCTSPSYSPNRIQLKRQLIN

SEQ ID NO: 165562 - protein, 215 aa, Heterodera glycines
  Homolog annotation: Hit_ID=CAE57503.1; Match level="QueryCoverage =91%, HitCoverage=51%, E-value=6e-12, Identity=25%"; Hit description =Hypothetical protein CBG00477 [Caenorhabditis briggsae]
  Coding regions on vcDNA: vcDNA=SeqID_91985; Strand=+; Position=1-645
IQLATPSHFASKGQIDRVGLNRNKLFVALRNARELELWSVHCLVPCSWKCLFSYKFHELFYAHCALSSQQNAIFSMVAAFFNIDGNSAEDGGIKILRYDLTYEKLSEFDLDFDCVDTFEGVTLERVAMGCGQTENRLFLYDRTMVTGEIPFWQISLDWTKMTFSIKSVPILDGHHFCAHCIRFPVVLDGDRRIILRITEDFQVVVYEGKSERWEE

SEQ ID NO: 165563 - protein, 73 aa, Heterodera glycines
  Coding regions on vcDNA: vcDNA=SeqID_91986; Strand=-; Position=45-266
LFVKTWELFILEIAHYFLHRWASPGANTVLHSHHSADNARGHLRGGVGEPSPFIRMIRDLFISVHAYHSVIRQ

SEQ ID NO: 165564 - protein, 78 aa, Heterodera glycines; identical to SEQ ID NO: 140616
  Coding regions on vcDNA: vcDNA=SeqID_91987; Strand=+; Position=3-239

SEQ ID NO: 165565 - protein, 196 aa, Heterodera glycines
  misc_feature (23)..(23): Xaa can be any naturally occurring amino acid
  misc_feature (101)..(101): Xaa can be any naturally occurring amino acid
  Homolog annotation: Hit_ID=NP_500013.1; Match level="QueryCoverage =79%, HitCoverage=10%, E-value=2e-40, Identity=49%"; Hit description =predicted CDS, polyprotein family member (4B673) [Caenorhabditis elegans] gb|AAC02594.1| Hypothetical pro
  Coding regions on vcDNA: vcDNA=SeqID_91988; Strand=-; Position=2-588
HYEREREALKNLLEEFKDIFSKXQYDLGSFSGGEHHFDTTTEAPISSLPRRMPYKYRDELKKHIDQLLNKGVMVESETPWVTPFVVVQKKDDGIRPCLDFXKLNEVMIPDRYPLHRLESIMEKVGSCKFYSSLDLSSGYMQIRLSDDTSWKCGVITEDNVYQMRYMPFGLKNATAAFSRAMAVVLSGLEDCSLSNV

SEQ ID NO: 165566 - protein, 81 aa, Heterodera glycines
  Coding regions on vcDNA: vcDNA=SeqID_91989; Strand=-; Position=11-256
VKKGKKIYFQFFFLLKFLLGPKFIGFHINTLFQPKKLLKIFSAWFETSGIFYFLNFHSSPCVNIFKISPFIRHFHQKFSSS

SEQ ID NO: 165567 - protein, 55 aa, Heterodera glycines
  Coding regions on vcDNA: vcDNA=SeqID_91990; Strand=+; Position=364-531
IYTKLLFLIYFLSQKKRITTKSAKIKCHLNKNNNKLHYNFTLIIIFIRINFLVKL

SEQ ID NO: 165568 - protein, 59 aa, Heterodera glycines
  Coding regions on vcDNA: vcDNA=SeqID_91991; Strand=+; Position=287-466
AYVPEKQNSRHEAEILKHRQLLGAAPPPPSPKNENLISVFLILKLKNIYRFFIRKKFIL

SEQ ID NO: 165569 - protein, 218 aa, Heterodera glycines
  misc_feature (83)..(83): Xaa can be any naturally occurring amino acid
  Homolog annotation: Hit_ID=CAE57608.1; Match level="QueryCoverage =100%, HitCoverage=17%, E-value=7e-66, Identity=55%"; Hit description= Hypothetical protein CBG00589 [Caenorhabditis briggsae]
  Gene Ontology: Mol. function=calcium ion binding; Cellular component =actin cytoskeleton; Biological process=muscle contraction
  Coding regions on vcDNA: vcDNA=SeqID_91992; Strand=+; Position=3-655
HNNPDLVMPPKPSDKEKAMAFYNIDFSLSNQLRLAGQSPGSSVDSLSPNKSQQKDYMQRKKDFIRRRRCQADQDRASKVISKXMSKMAQDAHEMNQSVEKENDANLRPVIGWKEKMEQHKPRLDYSDVFDAVAGADAGLWVWEIENFYPVLVDSGFHGQFYEADCYLVLKTTRETNGALTHAIYYWIGEKTSLDKAMCAAVHAVNLRNHLGASCRTIR

SEQ ID NO: 165570 - protein, 218 aa, Heterodera glycines
  misc_feature (54)..(54): Xaa can be any naturally occurring amino acid
  Homolog annotation: Hit_ID=NP_957381.1; Match level="QueryCoverage =97%, HitCoverage=20%, E-value=6e-22, Identity=30%"; Hit description =similar to transportin-SR [Danio rerio] gb|AAH45332.1| Similar to transportin-SR [Danio rerio]
  Coding regions on vcDNA: vcDNA=SeqID_91993; Strand=+; Position=3-657
SPTSSSNSTVLVALFKALPEELYSHKLKIGENRRTEIEEELARHTETLLSKLFXCALWILLCLKKMDFERRFLFFSPLAFSIKAVDCLASWLLNPRCPVAVLTRSPFFRSVLSVLSQPNTSQHLHDAATECAVNALQLIDDSKVALTMSGELSEFAQLLQQSIFETADVFRLAMREEDSEKLQNFTRLYAEQSNAFLSAMANNSPQGFGDLRMLDMLL

SEQ ID NO: 165571 - protein, 156 aa, Heterodera glycines
  misc_feature (40)..(40): Xaa can be any naturally occurring amino acid
  Homolog annotation: Hit_ID=CAE71476.1; Match level="QueryCoverage =100%, HitCoverage=17%, E-value=2e-23, Identity=37%"; Hit description= Hypothetical protein CBG18394 [Caenorhabditis briggsae]
  Gene Ontology: Mol. function=DNA helicase activity; Cellular component=nucleolus; Biological process=nucleobase, nucleoside, nucleotide and nucleic acid metabolism
  Coding regions on vcDNA: vcDNA=SeqID_91994; Strand=+; Position=2-469
SRAALGLCQLVLVPHNILLLKSTRDAWRLNLRDNELIVDXAHNLLQTLASIHAVELSTGQLNLCSALIHDYLERFRKRLFFFNLLHIRQLHSLTVAVHNLATSTAKEDDGGAKERVLTLTQFMAKLGSASDIDLVRLLDYLDQSKLCRKLRDFRLQ

SEQ ID NO: 165572 - protein, 111 aa, Heterodera glycines
  Coding regions on vcDNA: vcDNA=SeqID_91995; Strand=-; Position=1-333
EHSAASWPHNGRFAPVFNFIKNIRPFRGLINGRFAPVFNFVKNIRPLRGLKTVASRPFLILLRTFGRFAASGRALRASFLNLVGARRALHAFFSNFVGLGRALRDRFLNLF

SEQ ID NO: 165573 - protein, 149 aa, Heterodera glycines
  Coding regions on vcDNA: vcDNA=SeqID_91996; Strand=+; Position=27-473
MSFQTKSYSATIQLTDEQRERIKQNRERALRIQAEKAEQRIKQGPTAAASQLLPHVDGMAISNNKPPPLIGERLVCPRHIQIQPPITTKNSNSPRPSTSSVQKVLVQMDFSLINANRFKVQFTPFNSDVMDKLKSIPSRSFNADDKTWS

SEQ ID NO: 165574 - protein, 192 aa, Heterodera glycines
  Coding regions on vcDNA: vcDNA=SeqID_91997; Strand=+; Position=50-625
CGTVPTFPCHSRNAHFDPLRLSLCVNPNSSVQHWLSSRVDALSNKIRFFVRQLCARCFSIRSALSPVHFIRFGGRCWPFQQNNAQITRDCQLNLRANGCSSLAQLLKQNANSRILLFIVPVSFRTSDQFSAASDPKIVHVEFPDSTFIISTSIMYNSQPPAKALNNTVFSQRHNSHFYAFDLSSSTSCVEGL

SEQ ID NO: 165575 - protein, 105 aa, Heterodera glycines
  Homolog annotation: Hit_ID=CAE63553.1; Match level="QueryCoverage =98%, HitCoverage=16%, E-value=6e-43, Identity=75%"; Hit description =Hypothetical protein CBG08039 [Caenorhabditis briggsae]
  Gene Ontology: Mol. function=neurotransmitter:sodium symporter activity; Cellular component=integral to plasma membrane; Biological process=protein folding
  Coding regions on vcDNA: vcDNA=SeqID_91998; Strand=+; Position=36-508
TGDPTGRGTGGQSIWGGDFEDEFHPALRHDKAFRVSMANAGPNTNGSQFFITICPAEWLDGKNTIFGQVVEGFNVVQKINQVPVYKKSGRPREEISIISISLKSV

SEQ ID NO: 165576 - protein, 116 aa, Heterodera glycines
  Coding regions on vcDNA: vcDNA=SeqID_91999; Strand=+; Position=1-351
SSINVANSMSPILAFSNISLLVGNSLAKMLNFVSIMRFFKICLILITAPSFPFFTASNSFFAISKYFTSQNVSFFFINSMRLPNVCSISFLFSRTFDQPNTPQLQPPKCQIAFQTH

SEQ ID NO: 165577 - protein, 174 aa, Heterodera glycines
  misc_feature (140)..(140): Xaa can be any naturally occurring amino acid
  Homolog annotation: Hit_ID=NP_509028.1; Match level="QueryCoverage =98%, HitCoverage=16%, E-value=1e-54, Identity=61%"; Hit description =nicotinamide nucleotide transhydrogenase (109.7 kD) (nnt-1) [Caenorhabditis elegans] gb|AAB52670.1| Nicot
  Gene Ontology: Mol. function=electron transporter activity; Cellular component=integral to membrane; Biological process=energy pathways
  Coding regions on vcDNA: vcDNA=SeqID_92000; Strand=+; Position=2-564
LFALPAGALIGSYAFGALNGFEQIHAIGAFTSSLCCVGAISGLSSQHSARIGNSLGMIGVSGALLTTLGTLNPDPQTLSQMCAAIASGSLIGSIVATRIKVTDLPQLVALFHSFVGIAATTTCVSNYLAEFSHFLADPAXTAAVKTCLFLGAYIGGVTFTGSLMAYGKLQGYYF

SEQ ID NO: 165578 - protein, 85 aa, Heterodera glycines
  Coding regions on vcDNA: vcDNA=SeqID_92001; Strand=+; Position=390-644
NALLVRCFVGSCTCTCSYVTCLARLWGFGVLARTCGSNSRFTDRNSGAPMLCMLWRSAWITGIPALIFRPELRREHPLNLSISVS

SEQ ID NO: 165579 - protein, 196 aa, Heterodera glycines
  misc_feature (77)..(77): Xaa can be any naturally occurring amino acid
  Homolog annotation: Hit_ID=NP_504414.3; Match level="QueryCoverage =100%, HitCoverage=21%, E-value=3e-84, Identity=75%"; Hit description= Na/Ca eXchanger (103.1 kD) (ncx-2) [Caenorhabditis elegans] gb|AAM29661.1| Na/ca exchangers protein 2, i
  Gene Ontology: Mol. function=calcium, potassium:sodium antiporter activity; Cellular component=integral to membrane; Biological process=calcium ion transport
  Coding regions on vcDNA: vcDNA=SeqID_92002; Strand=+; Position=3-593
MHFLSVPWKLLFATIPPTDYWGGWACFTVSILMIGLLTAVIGDLASQFGCWVGLKDAVTAISFVALGTSVPDTFAIXLSAVQDKYADNSIGNVTGSNAVNVFLGIGIAWTLAAVYHWFQGSVFRVDPGTLAFSVTIFCIEAVICIIVIVARRHKAIGGELGGPRNFQMATSAFFACLWAFYIGISALESYCVIAGF

SEQ ID NO: 165580 - protein, 165 aa, Heterodera glycines
  Coding regions on vcDNA: vcDNA=SeqID_92003; Strand=-; Position=44-541
AAIVTFYGTLDNWDLILLHLYDILIAASLSKFIKSNCFSIFSNRRLSKGQNHRASTLHRTLRPIPMDRRRRKMPTLVRVPPLLPMPPAFVGTLNGAFGSQKSSVISFCAVYFLFILSICFRSSVSFGMSLTCITSKSSLILVILFFVYNVSTNFLHKNLLCDGSK

SEQ ID NO: 165581 - protein, 196 aa, Heterodera glycines
  Homolog annotation: Hit_ID=NP_492097.1; Match level="QueryCoverage =50%, HitCoverage=8%, E-value=4e-17, Identity=54%"; Hit description =related kinase (1I38) [Caenorhabditis elegans] emb|CAA98148.1| Hypothetical protein ZK524.4 [Caenorhabditi
  Coding regions on vcDNA: vcDNA=SeqID_92004; Strand=+; Position=1-588
PSAPLTFRATSSLHSSCDRISPHAIQELLEFSRLSGRMRRTVIGQPANYFVSTNTFQASPDSRLSSRSPSPSCLSSGRTSPAMSGIVSRLKTTNFLPSTGGMRKLSSSPHLLGICEVGFLLTHSFNVKIASRRLKKAEICKTCWAKATAPSAPTHSSPAEPTAQVGVKTFSAMAKALPRSSFAVRGPPPWDWAPSG

SEQ ID NO: 165582 - protein, 175 aa, Heterodera glycines
  Homolog annotation: Hit_ID=NP_491290.2; Match level="QueryCoverage =100%, HitCoverage=40%, E-value=8e-25, Identity=29%"; Hit description= UNCoordinated locomotion UNC-89, PHarynx Muscle abnormal PHM-1, UNC -89 (unc-89) [Caenorhabditis elegans]
  Coding regions on vcDNA: vcDNA=SeqID_92005; Strand=-; Position=2-526
YLNFAAQAPQFTRILSDQEAQIGGQVVLECSVTGIPQPTIEFHTVQDSFRILTGTRVSIQHDATHTQWRMVIKDVVESDFRQYRAVAKNSVGQAVSECTVRASEPGIERPRIVDGLNRQRVREHETAEMCVRVLGAGKPGQPPPDVQWFRNGESLQPDGRKLEVVEYREAGEYKL

SEQ ID NO: 165583 - protein, 71 aa, Heterodera glycines
  Coding regions on vcDNA: vcDNA=SeqID_92006; Strand=-; Position=293-508
AMVVQWLVRNTHCVKARVRFRCSLTFCFFQTVAFLSDPLSIFINIWSIFENSFPFLMIFLKFTVFKCFVSY

SEQ ID NO: 165584 - protein, 139 aa, Heterodera glycines
  Homolog annotation: Hit_ID=NP_500088.1; Match level="QueryCoverage =95%, HitCoverage=28%, E-value=9e-36, Identity=58%"; Hit description =hexokinase (50.1 kD) (4C273) [Caenorhabditis elegans] gb|AAF36071.1| Hypothetical protein Y77E11A.1 [Caen
  Gene Ontology: Mol. function=glucokinase activity; Cellular component= soluble fraction; Biological process=glycolysis
  Coding regions on vcDNA: vcDNA=SeqID_92007; Strand=+; Position=248-664
MLSPDQLPDEVRGMLKPFIISKERLVKISEDIETELRQGLQEGATTNGRTSIPMLPSYLPALPDGTETGKYVAIDLSGKNLRILMLTLQGKDKEPIIATNNFVVPYPIMKGSGEQLFNFIVNCLQKFLREFHLEEANLP

SEQ ID NO: 165585 - protein, 68 aa, Heterodera glycines
  Coding regions on vcDNA: vcDNA=SeqID_92008; Strand=-; Position=77-283
TKLRLFKLYNMDQQQKIKTKRNKVKLEHDGALYVFDQLSADGLKKFWRCEFHGPSDNLPQKILIIFSV

SEQ ID NO: 165586 - protein, 198 aa, Heterodera glycines
  Homolog annotation: Hit_ID=CAE75378.1; Match level="QueryCoverage =92%, HitCoverage=22%, E-value=1e-40, Identity=50%"; Hit description =Hypothetical protein CBG23365 [Caenorhabditis briggsae]
  Gene Ontology: Mol. function=chloride channel activity; Cellular component=integral to membrane; Biological process=transport
  Coding regions on vcDNA: vcDNA=SeqID_92009; Strand=+; Position=54-647
MRNFGLSSDQRPLIWSRTDRRFSHNSLDPNEDPVSGIERVSSTSTLFSRRRREERLREQEEVRRRQFSGSRKLSDGASEHTLSEKYESLDYELIENELYRAAEKDKGHQRKLFRQTVDRWIVCFLIGVATASVAAFIDVLVYYNSKLKFHLIINNLIHSCEEGSVGSSGCTWTILWVWALYNCALVAVASFLVIVVSP

SEQ ID NO: 165587 - protein, 52 aa, Heterodera glycines
  Coding regions on vcDNA: vcDNA=SeqID_92010; Strand=+; Position=3-161
RLLAPPYPPPPLPHKKALNKYTAKKSGVKNKIKISSIIGSESQKSAFLDKIY

SEQ ID NO: 165588 - protein, 201 aa, Heterodera glycines
  Homolog annotation: Hit_ID=NP_504721.1; Match level="QueryCoverage =99%, HitCoverage=24%, E-value=6e-90, Identity=76%"; Hit description =protein kinase and Citron-like (92.4 kD) (5H270) [Caenorhabditis elegans] gb|AAA97966.1| Hypothetical pro
  Gene Ontology: Mol. function=ATP binding; Cellular component =cytoplasm; Biological process=protein kinase cascade
  Coding regions on vcDNA: vcDNA=SeqID_92011; Strand=+; Position=44-646
MHNAIRRADPSGDYELLQRVGSGSYGEVFKARDVRSGEFAAIKIVKLETGDNFADIQQEILVLKECVHPNIISYYGSYLKRDRLWIVMEYCSGGSLQDIYEMIGPLAELQIAFICRETLHGLKYLHQRGKIHRDVKGANILLTHNGDVKLADFGIAAQITATIGKRKSFIGSPYWMAPEVANVERSGGYGSECDVWAVGIT

SEQ ID NO: 165589 - protein, 209 aa, Heterodera glycines
  Homolog annotation: Hit_ID=NP_495675.1; Match level="QueryCoverage =100%, HitCoverage=35%, E-value=2e-62, Identity=54%"; Hit description= glutaminase family member (68.3 kD) (2I301) [Caenorhabditis elegans] emb|CAA88938.2| Hypothetical protei
  Coding regions on vcDNA: vcDNA=SeqID_92012; Strand=+; Position=22-648
MTSPNSAFRHESPEDVVFDLFKLPNRDEASIGKLISVLRGFGLQPDDPRLRGTMDKMREAEGTHAEEHSDAWRHMIREQFKTCVHPCIALITRAIRNQLIIPNWTEFTGKVRELFEECHAETGGQVATYIPQLARADPEKWGMAICTIDGQQFSLGDSLAPFCFQSVSKAFNYAIVASDLGDYVHSFVGHEPSGRLFNEICLDPNGKPH

SEQ ID NO: 165590 - protein, 210 aa, Heterodera glycines
  Homolog annotation: Hit_ID=CAE69110.1; Match level="QueryCoverage =88%, HitCoverage=45%, E-value=5e-11, Identity=27%"; Hit description =Hypothetical protein CBG15136 [Caenorhabditis briggsae]
  Coding regions on vcDNA: vcDNA=SeqID_92013; Strand=+; Position=2-631
MSEAAISLKTKAMQEEAEKNEQNFEFVCENDGFRYYKDVKTGRQCCLDSAGFWYILNEEKGAFEPMASNFVAEKLAEKPRRKQDKMQSILKNVERFGIRFDQHGKPVFPKNEKGHFILPKDEKGSPFFPVDDRTVPIFPWDHEKGMPTFPVDDTDEPIFPRNDQNKPIVPVDENDQPIFPVDKTGTFIFPVDESNCPIPALTVYGTRVVP

SEQ ID NO: 165591 - protein, 84 aa, Heterodera glycines
  Coding regions on vcDNA: vcDNA=SeqID_92014; Strand=-; Position=137-391
TVADSEEGPTPFLCPLSFIISISSSSTSSHWNCCCCCSSVPPNELTVSVEFAAENVVRSKPRILRLRKADINWYAKYVTKTGLI

SEQ ID NO: 165592 - protein, 188 aa, Heterodera glycines
  Homolog annotation: Hit_ID=CAE69115.1; Match level="QueryCoverage =94%, HitCoverage=40%, E-value=2e-47, Identity=53%"; Hit description =Hypothetical protein CBG15141 [Caenorhabditis briggsae]
  Gene Ontology: Mol. function=GTPase activator activity
  Coding regions on vcDNA: vcDNA=SeqID_92015; Strand=+; Position=38-654
MDESYKNVHYGYWIRNLHLLQENAPIPRPVPCYCRLKVKPNYYGLEYHGPISRVETERLLLEFGEGAFLVRESHRCANAFTLSMNFENSVLNYKLFYDALCGNHYVGEKRFDSIFELVQDGLICMYVEKHASDYIDQMADSAEYELSPYSFYGSFVAGQNFVSQTHPRGHNWQIFTFKIPTYCDFCRN

SEQ ID NO: 165593 - protein, 76 aa, Heterodera glycines; identical to SEQ ID NO: 130912
  Coding regions on vcDNA: vcDNA=SeqID_92016; Strand=+; Position=262-492

SEQ ID NO: 165594 - protein, 126 aa, Heterodera glycines
  Coding regions on vcDNA: vcDNA=SeqID_92017; Strand=+; Position=176-553
RHFVPPTLSHQWRQKPFGFKHLRPKPKSNICGFAHNMNLRVLFIRSDAVFDLHGHLGAVDRWLLGAAVVVTPRPAAHAAMRRSEQRLLPLHLNVPAPSVDRWRELPPLLPVMRKYFVRLVANPALL

SEQ ID NO: 165595 - protein, 211 aa, Heterodera glycines
  Homolog annotation: Hit_ID=NP_510561.1; Match level="QueryCoverage =99%, HitCoverage=36%, E-value=7e-68, Identity=59%"; Hit description =suox gene product (61.0 kD) (XQ117) [Caenorhabditis elegans] emb|CAB17069.1| Hypothetical protein H13N06.
  Gene Ontology: Mol. function=sulfite oxidase activity; Cellular component=mitochondrial intermembrane space; Biological process =protein catabolism
  Coding regions on vcDNA: vcDNA=SeqID_92018; Strand=+; Position=5-637
MEEVRRHGKDADRIWVIFHQGVYDVTEFIANHPGGDRILLAAGASIEPFWTVYPQHKTDEVMEILEEMRIGSLRLEDLQEIETQQKDAPSGDPFAADPPRHPALIVNMQKPFNAETPPSLLIDSFLTPKELFFVRNHMAVPRTNEETHKVRIDGIGVDKQIVLSLDQLRNNFEPVSIVSAIQCAGNRRSDMNEFKKVQGLMWTGTAISNAR

SEQ ID NO: 165596 - protein, 125 aa, Heterodera glycines
  Coding regions on vcDNA: vcDNA=SeqID_92019; Strand=+; Position=7-384
AIHPPPPPPARRHRCLGMMMKWKRNEPAFERPLEEWRERRNQHAQNTIHPPPAPPQEEEEEHWAQAWPEEEEVAKISNEEMDDEEGKLAPESELDYDELNRGDFYLIGGVHDPINLRFEAAICAR

SEQ ID NO: 165597 - protein, 110 aa, Heterodera glycines
  Homolog annotation: Hit_ID=NP_741290.1; Match level="QueryCoverage =98%, HitCoverage=73%, E-value=2e-09, Identity=28%"; Hit description =putative protein, with at least 2 transmembrane domains (17.0 kD) (4B167) [Caenorhabditis elegans] gb|AAK
  Coding regions on vcDNA: vcDNA=SeqID_92020; Strand=+; Position=1-333
LSRHFLFSLTILHLFAPLFVASALNFYFLVIIFVRTIIEDGSPKRAIAGNALHFFRVTMVALFEMILCHKLQDEFERGNQQISIETTYFMIMMPLWALLIALSVHACRLF

SEQ ID NO: 165598 - protein, 219 aa, Heterodera glycines
  Coding regions on vcDNA: vcDNA=SeqID_92021; Strand=+; Position=2-658
KYGISKKFSYDKYYIYPPWAVDKIQIESVGRMELKAFKINHTNANITEEEWANVRHFVRVVDKENGRLLSKDEQINVKIPNKPDGSLKFWVYLLYEGLRWHPFIGKTAMKMIFEGTNVLYFSSYNSIWHEKNFTLGNLKNCNITEQLGKSNITEFNIGIHVMDNAGKYNVTFDTGGKVTECQYENPEMPPWTVQYIAVILKNDPQQLIKPEISCIPQNR

SEQ ID NO: 165599 - protein, 213 aa, Heterodera glycines
  Coding regions on vcDNA: vcDNA=SeqID_92022; Strand=+; Position=3-641
VLSSVVIGEIQQQQSPDSFVPTSFGRRRHCWVCNDVWMDILPLFDHAQLGLKLALISPRFDVLVDAHFNGKSELTIWRQITIQRFKGPKAKLSEWIDDKWVAFPLPDRPLPNKIRFRNLRIENPDHSVLAFLRANQQIFEKATNLCLSVSSCFHDCLFSFVDNNVQPIWDVFACEIWPIFAPNIRRFNFRDGDHLDNLRRRISPTILTDLNNL

SEQ ID NO: 165600 - protein, 99 aa, Heterodera glycines
  Coding regions on vcDNA: vcDNA=SeqID_92023; Strand=-; Position=0-296
HALGIEPGTHPPFGDLLTDHFATHKSFMVQQLSFRTPCSLIRCVSSPFIVCLSLHFVPFRLRPFGVSPISSPLAPLAPAFVLNERPSAAAAEETLCICS

SEQ ID NO: 165601 - protein, 45 aa, Heterodera glycines
  Coding regions on vcDNA: vcDNA=SeqID_92024; Strand=+; Position=134-268
YAGGFMKRHFQLARSFKAIDPLPSPLFNNFIIFFIRTFQNFITPM

SEQ ID NO: 165602 - protein, 99 aa, Heterodera glycines
  Coding regions on vcDNA: vcDNA=SeqID_92025; Strand=-; Position=1-297
RDGRRTRPSDGRRTTTRPKRWEWRRRKTLFGSVPAFSLLPPSGTVLSRLLRLLCAPQAKQIQRNHSQNKWWKWAHGFRCLSAGFALRRQKFGTFSVGLS

SEQ ID NO: 165603 - protein, 129 aa, Heterodera glycines
  Coding regions on vcDNA: vcDNA=SeqID_92026; Strand=+; Position=3-392
LSLRPQPNSIPKKLFELVGFATFVQFVVVLVSNIAKLVKKATEKHSLAQSEGNRQQKSGKNGFSCKICSSQIAFGQMRRSVCLPCGHCLCSDCLLTLSSKDLSNDTSSVECPFCRIKCPSNRIVFPLNL

SEQ ID NO: 165604 - protein, 50 aa, Heterodera glycines
  Homolog annotation: Hit_ID=NP_493544.2; Match level="QueryCoverage =100%, HitCoverage=9%, E-value=3e-14, Identity=70%"; Hit description =putative cytoplasmic protein of ancient origin (60.5 kD) (1P247) [Caenorhabditis elegans] emb|CAC70109.2|
  Coding regions on vcDNA: vcDNA=SeqID_92027; Strand=+; Position=2-151
PELSDVLLRLHRLGRTSFRKLKDKRDYRRRRRFCSWLYLSRLAAAKEIPF

SEQ ID NO: 165605 - protein, 215 aa, Heterodera glycines
  Homolog annotation: Hit_ID=AAH68420.1; Match level="QueryCoverage =99%, HitCoverage=25%, E-value=3e-43, Identity=39%"; Hit description =Unknown (protein for IMAGE:6970634) [Danio rerio]
  Coding regions on vcDNA: vcDNA=SeqID_92028; Strand=+; Position=2-646
ERPQLSCCLLHQKLQMINFCISVKKRKHKEMEANETENLGGSAKDLPANRNTADDEFFDAIESFDQFDVAISSECPRGRSLPLDSNEFLKSNPNQRIFVPFTQEEGPMTEDQIEQRESFLCNLEDANLRTKAQSELLLSDMQAFKAANPGCELVDFLRWHSPRDLTEEGELSDRMKIAGNFWQETWDSARAIPATQQQRLFNETREVEQILQYFA

SEQ ID NO: 165606 - protein, 102 aa, Heterodera glycines
  misc_feature (84)..(84): Xaa can be any naturally occurring amino acid
  Homolog annotation: Hit_ID=AAC47437.1; Match level="QueryCoverage =99%, HitCoverage=57%, E-value=2e-28, Identity=52%"; Hit description =COL-1
  Gene Ontology: Mol. function=structural constituent of cuticle; Cellular component=collagen; Biological process=cuticle biosynthesis (sensu Nematoda)
  Coding regions on vcDNA: vcDNA=SeqID_92029; Strand=+; Position=17-326
EQVHPPPCIFFSGGQRGNNGPPGPPGAPGAPGQPGTGGGQPEPGEPGAPGPNGQPGQAGEPGAPGRPGQRENPRPTETAPAGPXGEAGAPGQPGSGWEPRER

SEQ ID NO: 165607 - protein, 194 aa, Heterodera glycines
  Homolog annotation: Hit_ID=AAM44925.1; Match level="QueryCoverage =86%, HitCoverage=25%, E-value=5e-10, Identity=28%"; Hit description =putative protein kinase [Arabidopsis thaliana] gb|AAK59581.1| putative protein kinase [Arabidopsis thalian
  Coding regions on vcDNA: vcDNA=SeqID_92030; Strand=+; Position=48-629
MCFGRKEKKKRPNSPAYDKKPVHPSAAGVVVSPTPIAPSGPSSAVPPSLVPRTAPTSAAPSAPNKKADLGKAVVRPSRPPGSTKPLKSTATTPVGLPHPKKGVSAGIDVPSSPYSADPIDCAKTGKWKAVSRPPPPSSGKKTDAKTKAVSRPPPPPAKKTHKGKVVTPPHRPPPSDKKPFVKAKTLSPRFPSLF

SEQ ID NO: 165608 - protein, 212 aa, Heterodera glycines
  Homolog annotation: Hit_ID=NP_497969.1; Match level="QueryCoverage =98%, HitCoverage=13%, E-value=2e-21, Identity=32%"; Hit description =EMB-5, abnormal EMBryogenesis EMB-5 (175.8 kD) (emb-5) [Caenorhabditis elegans] emb|CAA84801.1| Hypotheti
  Gene Ontology: Cellular component=nucleus; Biological process =chromatin modeling
  Coding regions on vcDNA: vcDNA=SeqID_92031; Strand=+; Position=3-638
PTGEELAQILLKEDCSNLQNKLVHGQWINVLYRRLNDQDVENSQSKINNKTNKWICPFCKRDNFSTPDLVNEHTRRGDCPVSPIGIRVKLDNGLTGLVPMKFFSSDQNKTFMDPTKFFKPGQSQYFRIINFNPERIQCDLSCRSEDLKGDEQQQKFDPYFDHVQMESVQKAKKIKKAQKDDENKNRRIFQYEYFANYTDEKAAAAIRRMKQG

SEQ ID NO: 165609 - protein, 212 aa, Heterodera glycines
  Homolog annotation: Hit_ID=AAA62547.2; Match level="QueryCoverage =85%, HitCoverage=64%, E-value=5e-52, Identity=57%"; Hit description =Hypothetical protein C45G9.2 [Caenorhabditis elegans] ref|NP _498078.2| protein E.coli yhdg R. capsulatus n
  Gene Ontology: Mol. function=tRNA dihydrouridine synthase activity; Biological process=RNA processing
  Coding regions on vcDNA: vcDNA=SeqID_92032; Strand=+; Position=18-653
MEESERIILCRERECARRGIAVPPLFVAAPMVRYSKLPFRRLVSLYGCDFSYTPMIYADCFIKSEKCRQVEFVPSPFDLPIVQFAAKRAEEFASAAQLVYGHCRGIDLNCGCPKSDVRSDGYGSKLLEDPQLVADIVRQCRASIADPDFTISIKIRIQYPMERTVDLCRKVERAGVSHIAVHARTVSQRSEPPDYAAVALLKQCLQVPIFAN

SEQ ID NO: 165610 - protein, 116 aa, Heterodera glycines
  Coding regions on vcDNA: vcDNA=SeqID_92033; Strand=+; Position=75-425
MHTVVPTTSDCATNVQKSSVIGPIGQPIAAPESVKGIGLTDGGGAATEATSARIKQFPTPPSRDLCCGSGCPNCVWIQFADEVMDYVKSLPLHDGVEKQQKKMVGDALNQNVEDKN

SEQ ID NO: 165611 - protein, 136 aa, Heterodera glycines
  Coding regions on vcDNA: vcDNA=SeqID_92034; Strand=+; Position=3-413
KIKKRARSARPEAAKRPNVPDKIKKRARSARPEAAKRPNVPHKIKKRARSARPEAAKRPNVPQKIKKRARSARPEAAKRPNVPQKIKKRARSARTEAAKRPNIPQKIKNGREAPVLRPRSGRISPKKLKTGAKRPS

SEQ ID NO: 165612 - protein, 132 aa, Heterodera glycines
  misc_feature (59)..(59): Xaa can be any naturally occurring amino acid
  misc_feature (78)..(78): Xaa can be any naturally occurring amino acid
  Homolog annotation: Hit_ID=CAB88203.1; Match level="QueryCoverage =99%, HitCoverage=43%, E-value=5e-20, Identity=42%"; Hit description =putative cuticular collagen [Globodera pallida]
  Coding regions on vcDNA: vcDNA=SeqID_92035; Strand=+; Position=2-397
CLHPPNGPYGHFVHGFAHGGAGQSVHPVHADKPASPCLGQIMPCPLCEAGPSGRPEGQXPPCQQRDPGRPSTPARCGXDRDAIAGGPPRQAGHVGSLGSARPARHPASEGCVSRPTPGPIGPSGTPGRTGNA

SEQ ID NO: 165613 - protein, 214 aa, Heterodera glycines
  Homolog annotation: Hit_ID=CAE59405.1; Match level="QueryCoverage =85%, HitCoverage=38%, E-value=4e-50, Identity=55%"; Hit description =Hypothetical protein CBG02769 [Caenorhabditis briggsae]
  Gene Ontology: Biological process=main pathways of carbohydrate metabolism
  Coding regions on vcDNA: vcDNA=SeqID_92036; Strand=+; Position=6-647
MASIANSTKLTIGSFKTVPRMISPFVTRFGVGGFCAPNLAIANLTVRKSFASCAFPPAECEDVDYAFEMMSSTLRCGNGVTSEIGFDVQNLGSKNALIVTDKNVTKTRAFKEVAASFARLRLSFAVFDEVKCEPSQQSIQKAIDFARAKSYDCFVAVGGGSVIDTAKVAALYASNCESDFLDFVQKPIGKGMIPKHPMLPLIAIPTTAGTGSET

SEQ ID NO: 165614 - protein, 116 aa, Heterodera glycines
  Coding regions on vcDNA: vcDNA=SeqID_92037; Strand=-; Position=240-590
MNRKMSKMRVSRERKTSRTLSAHGFAKRVSPAAAVPSVGIGAVDLPTVISVGKAKAQSLIGLLLLGGPPNGGRKKEDGKCKTPRIDVAELTSQLPKECRCEFHRKARPPAEMLLIR

SEQ ID NO: 165615 - protein, 186 aa, Heterodera glycines
  Homolog annotation: Hit_ID=AAC47437.1; Match level="QueryCoverage =99%, HitCoverage=77%, E-value=9e-87, Identity=61%"; Hit description =COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_92038; Strand=+; Position=1-558
SCQSNAKDIWSEVSQLKGLPLIVSGNRTARQVYGGSGGYGSCQDCCSGGGPGPAGPPGQPGRPGNPGAPGSPGQPGHSVQTPCEQVHPPPCTPCPGGQPGNPGPPGPPGQSGAPGQPGSGGGAPQPGEPGPQGPPGQPGAPGQPGAPGQPGQPATSQEAGPAPPGPPGEAGAPGQPGQPGAPGQPG

SEQ ID NO: 165616 - protein, 162 aa, Heterodera glycines
  misc_feature (59)..(59): Xaa can be any naturally occurring amino acid
  Homolog annotation: Hit_ID=NP_492399.1; Match level="QueryCoverage =100%, HitCoverage=34%, E-value=1e-35, Identity=45%"; Hit description= UNCoordinated locomotion UNC-29, beta-1 subunit of nicotinic acetylcholinereceptor family member (56.5 k
  Gene Ontology: Mol. function=nicotinic acetylcholine-activated cation- selective channel activity; Cellular component=integral to membrane; Biological process=memory
  Coding regions on vcDNA: vcDNA=SeqID_92039; Strand=+; Position=2-487
SVFTSDDEERLTKEVFEGDNSLNLPLHSDSQPITDRMTLQTELQITVDDDDQIMHTSVXHTLFWKDLQMAWSPDNYIGVEQLRVSPDKEQYNVDDRNYQLPYWSDVIINYLDNVVTVPPDVYKSTCINDEEYFSVDEKVCHFVFDSCTYHQNQPTMEFAHAD

SEQ ID NO: 165617 - protein, 134 aa, Heterodera glycines
  Coding regions on vcDNA: vcDNA=SeqID_92040; Strand=+; Position=3-407
TALSEELNDQEILLISTREALHCFYCQKSEVATPTEVLIRKDGTGITRRRFHNLLMLGRDEHLFEIEFALTATIGEKMIFGQNFDGCKSDIEQATSTLKLILEEDGLKNFGSMIDTTVFLFLRWKQTKKQLFGI

SEQ ID NO: 165618 - protein, 217 aa, Heterodera glycines
  Homolog annotation: Hit_ID=NP_491709.1; Match level="QueryCoverage =100%, HitCoverage=29%, E-value=3e-66, Identity=46%"; Hit description= tyrosinase family member (82.2 kD) (1G477) [Caenorhabditis elegans] gb|AAB52481.1| Hypothetical protein
  Coding regions on vcDNA: vcDNA=SeqID_92041; Strand=+; Position=1-651
QNNRCVQTTDTSSTPWPMPPTDVTTPNPIRPVQSCYNEHECCSVWSQKGECQRNPGFMNSWCKASCQQCQPDYDLYQECDDRHPNCQSWTSQGQCQQNKFWMAENCRQSCGKCRVSRQQVCSGGRDSQQNQDRITLAPPKNRCTSPSCHNENICCQLWGLAGECHRNPTWMGCFCKVSCGRCIPQDYDFGGCSDYHQRCRLWAQQGECGRNAWMLEN

SEQ ID NO: 165619 - protein, 207 aa, Heterodera glycines
  Homolog annotation: Hit_ID=CAE62153.1; Match level="QueryCoverage =100%, HitCoverage=38%, E-value=1e-76, Identity=64%"; Hit description= Hypothetical protein CBG06199 [Caenorhabditis briggsae]
  Gene Ontology: Cellular component=mitochondrion; Biological process =glutamate catabolism
  Coding regions on vcDNA: vcDNA=SeqID_92042; Strand=+; Position=2-622
VPAPDMGTGEREMACIADTYAPTVGHTDKEASACVTGKPIVAGGIHGRVSTTGRGLWKGLAVFINDEKFMTKLGLTTGFKGNTFIVQRFSNVRLHSHRYLHIDGAIYIVVHQYDCAIYNPNGIHPKDLDDRKIANGSIRGYPGAKDLKPFTNFIFENCYILVPAACEKAILLWNAHRIQPNVIAETDNRPTTPDADAILMNRGDCLI

SEQ ID NO: 165620 - protein, 206 aa, Heterodera glycines
  Homolog annotation: Hit_ID=NP_497604.1; Match level="QueryCoverage =95%, HitCoverage=48%, E-value=2e-30, Identity=37%"; Hit description =predicted CDS, nuclear protein SET (3D795) [Caenorhabditis elegans] gb|AAK29971.1| Hypothetical protein Y
  Coding regions on vcDNA: vcDNA=SeqID_92043; Strand=+; Position=20-637
MKKIENATSVASKLTELWCEIFSRPPPENTNKLWEEYNKINSELQLLKLVRCDQFQRQSRLEQIPSFMNWCVEMGIRHSGLDILCSPHGLCLSATEPLEEGAIVAEVPLSAIFSTDVAENIVSLKHILQDKLLQSMENVALAICVAHEVLRGSESQWAAYFTTLPSTFPTPLFYSEEQLTALKPSPVFEESLRMHRAIARQFVYFY

SEQ ID NO: 165621 - protein, 41 aa, Heterodera glycines
  Homolog annotation: Hit_ID=NP_996331.1; Match level="QueryCoverage =100%, HitCoverage=2%, E-value=2e-10, Identity=60%"; Hit description =CG16902-PB, isoform B [Drosophila melanogaster] gb|AAS65249.1| CG16902-PB, isoform B [Drosophila melanoga
  Gene Ontology: Mol. function=ligand-dependent nuclear receptor activity
  Coding regions on vcDNA: vcDNA=SeqID_92044; Strand=+; Position=2-124
FCRFQKCLKEGMVLEAVREDRMPGGRNGSAIYHMHKRRHRK

SEQ ID NO: 165622 - protein, 104 aa, Heterodera glycines
  misc_feature (84)..(84): Xaa can be any naturally occurring amino acid
  Homolog annotation: Hit_ID=AAP04352.1; Match level="QueryCoverage =100%, HitCoverage=78%, E-value=4e-21, Identity=49%"; Hit description= 40S ribosomal protein S12 [Dermacentor variabilis]
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_92045; Strand=+; Position=2-313
KSALIVDGVARGLNEAAHTLDKRDAHFCVLAKSCDEASFEKLVRSLCKEHIIPILDAEDKPELFLFFGQGQYDQDGKARKTLGXSVAVVKNYRRDQEANNDLQE

SEQ ID NO: 165623 - protein, 212 aa, Heterodera glycines
  Coding regions on vcDNA: vcDNA=SeqID_92046; Strand=+; Position=3-638
FIPHSPLSYSTSYSPISPLKEQQQVKCADPSVADLGKTNVGFGPTNKSILKNPTTLFFKEQHKKFMKSNENLVDSVKKATETTAARKEALKTVAFGLTTRLEDTVLANKSVPSSSRLGKTVIFSHEAQSLHKIILAQQTEIAELRGKIEELTASDDRRRGEEREQKNTIAELASRLGMVERALTNISNTGQKCHEENRENGKPKAYKCTGAD

SEQ ID NO: 165624 - protein, 111 aa, Heterodera glycines
  Coding regions on vcDNA: vcDNA=SeqID_92047; Strand=+; Position=3-338
ATKSFKINLFYMEERRRRQNALLSKFRKRTKTDFSSSPTSSSMPANDGVLAESNVTKTDNDCGGSDEDIQIVETDEQRKTHDELRQKAAEALIREAKRSAQRAQLYGPQGW

SEQ ID NO: 165625 - protein, 219 aa, Heterodera glycines
  Homolog annotation: Hit_ID=S29742; Match level="QueryCoverage=100%, HitCoverage=35%, E-value=8e-83, Identity=68%"; Hit description =malate dehydrogenase (oxaloacetate-decarboxylating) (NADP)  (EC 1.1.1.40) - pig roundworm
  Gene Ontology: Mol. function=electron transporter activity; Cellular component=cytosol; Biological process=pyruvate metabolism
  Coding regions on vcDNA: vcDNA=SeqID_92048; Strand=+; Position=2-658
AEMCVRQMQSEGLSFEEACGQIYMMDIDGLITTQRKNIEPRHLPFAKNLPDSQSLLEVVLSVRPGALIGASTVRGAFTDDVIRTMAEHNARPIIFALSNPTSKAECTAEDAYRVTNGTALFASGSPFKNVELGGKVYKPGQGNNAYIFPGIALGVILFKVSTIDNKLFLMAARMVAESVTEKSLADGRVFPRLKEIREISIRIAMRVAEECYRDGTAKL

SEQ ID NO: 165626 - protein, 76 aa, Heterodera glycines
  misc_feature (56)..(56): Xaa can be any naturally occurring amino acid
  Coding regions on vcDNA: vcDNA=SeqID_92049; Strand=+; Position=2-232
LLGIIFTLMTLPSWYSEMTPIEPPIAQTDLIPSAAASNLGRTDLIDLLMVLTPTSXPRDHPFDCLFRANPQLPPHC

SEQ ID NO: 165627 - protein, 213 aa, Heterodera glycines
  Homolog annotation: Hit_ID=NP_499068.1; Match level="QueryCoverage =89%, HitCoverage=14%, E-value=3e-25, Identity=33%"; Hit description =yeast transcriptional mediator complex RGR homolog (rgr-1) [Caenorhabditis elegans] pir||A88554 protein C
  Coding regions on vcDNA: vcDNA=SeqID_92050; Strand=+; Position=3-641
ITYCQIYVPIRRFSTAYYAHFRHFCNVRTFAYFKLSLAYGDDREMLFVLAWRWQKYSLCFGQAPVPAGSAWDGRKAARRRWNPHVLVTQSLTERFNRDKDLTWLVNYLINTHRSLCSIYDFARTQMHSTKTAAQVHGTEAAFPAELMCHLSALDESTIRLSYGSRLAMEFLLLDDNRVAVRDCSVGSARSIGGGGPSLADFWHFWRQKCVMAC

SEQ ID NO: 165628 - protein, 103 aa, Heterodera glycines
  Coding regions on vcDNA: vcDNA=SeqID_92051; Strand=+; Position=3-314
RITVCICTNTSKSGSSDQNRLGMGTERRPSSFVLRMFNHLFLLLFVFSFLFVFVDIINLNRLIRLARYFGRIRSHFVLPPFVIPFSHWSLSCAQCKFVQPIHI

SEQ ID NO: 165629 - protein, 115 aa, Heterodera glycines
  Coding regions on vcDNA: vcDNA=SeqID_92052; Strand=-; Position=39-386
STTVVTTTIDTQMAYGGSHSSIMRYGIGIRWSSSASPFPPPSPPPPPPPSLVLSWLLITDNCGVGGGDDADNGGGIVIVSAVVDVTVIDGTVVVLLALLVVSVTTKCGADAAAFR

SEQ ID NO: 165630 - protein, 143 aa, Heterodera glycines
  Homolog annotation: Hit_ID=XP_391856.1; Match level="QueryCoverage =83%, HitCoverage=22%, E-value=3e-35, Identity=59%"; Hit description =similar to ENSANGP00000010393 [Apis mellifera]
  Gene Ontology: Mol. function=uridine kinase activity; Biological process=pyrimidine base metabolism
  Coding regions on vcDNA: vcDNA=SeqID_92053; Strand=+; Position=2-433
KDCKIGKLLIKTNKFTSEPELYYLRLPKNICKYKIFLMDAIVSSGAAAMMAIRILLDHDVLEEDIVLLSLLMAERGVHSLAYAFPRVQLLTISVDKQINEHYRTVLGVDDFDENCVGPDCEVVQLVASDDDPDEDGDDDSSSS

SEQ ID NO: 165631 - protein, 182 aa, Heterodera glycines
  Homolog annotation: Hit_ID=AAH64881.1; Match level="QueryCoverage =93%, HitCoverage=29%, E-value=2e-31, Identity=43%"; Hit description =LOC395047 protein [Xenopus tropicalis]
  Gene Ontology: Biological process=ubiquitin cycle
  Coding regions on vcDNA: vcDNA=SeqID_92054; Strand=+; Position=2-609
GSNPAFFQQLMQSFPGFNSPEIVEQIRNNMPQLTSLMTNPQMLQVMSNPRVVAALQQIQQASQVLRQEAPQLFTNFPGADIQAQPPTSAGATEAGPQPSAPPGQNIPSGFAELLGSLMNLSTTVNSSQPPEERFRAQLEQLTAMGFTDQQANIQALLASFGDLSGAIERLLGGGGQGNADTF

SEQ ID NO: 165632 - protein, 208 aa, Heterodera glycines
  Homolog annotation: Hit_ID=CAE59789.1; Match level="QueryCoverage =100%, HitCoverage=31%, E-value=2e-63, Identity=59%"; Hit description= Hypothetical protein CBG03249 [Caenorhabditis briggsae]
  Gene Ontology: Mol. function=glutamate-cysteine ligase activity; Cellular component=intracellular; Biological process=glutathione biosynthesis
  Coding regions on vcDNA: vcDNA=SeqID_92055; Strand=+; Position=1-624
ENAAYCCFLVLLTRVIVSYRLTFLIPISLVTENMQRAVRRDAISTQKLHFRKTLAHCWHTPEGKPCPEGRPPAEPEPEPYDNNVAEMSIDEIVNGNTDFPGLVPLMLQFLNSADVDVDTRCTVSQYLSFIRKRARGEIWTTAKWMREFVHQHPTYKKDSHVPDECIYDMMKTMDKISRGEHCEKLLGCFKTKTEQRIPSAVKRAEEEM

SEQ ID NO: 165633 - protein, 192 aa, Heterodera glycines
  Homolog annotation: Hit_ID=NP_503730.1; Match level="QueryCoverage =99%, HitCoverage=43%, E-value=5e-59, Identity=56%"; Hit description =putative protein of ancient origin (5D168) [Caenorhabditis elegans] gb|AAF60576.2| Hypothetical protein Y
  Coding regions on vcDNA: vcDNA=SeqID_92056; Strand=+; Position=3-578
RQLKIVKPNLSVVLLEKESRLASHQSGHNSGVLHAGIYYAPGSLKAKLCVSGIDLAYKYLEDNEIAHKKCGKLIVALDEAEIRRLEALFDRAKQNQCKSIEMIGEDGIRQIEPHCRGRKAIWSPYTGIVDWTMVTRKFAEDFQRMGGTVFCDWSLEGIGPSNDSAHPLRLIGAPNGAQIIDSKFLITCAGLF

SEQ ID NO: 165634 - protein, 94 aa, Heterodera glycines
  Coding regions on vcDNA: vcDNA=SeqID_92057; Strand=+; Position=76-360
MTSLGKRRSFRVAKKTNQPLWTKLKRYICNDVWMDTFPFFNNAQLGLKLALISPCLNALVDKHFNGQCLWKKKWGKATHNCAELLNFLRNVLYF

SEQ ID NO: 165635 - protein, 212 aa, Heterodera glycines
  Homolog annotation: Hit_ID=NP_510308.1; Match level="QueryCoverage =68%, HitCoverage=22%, E-value=6e-09, Identity=35%"; Hit description =putative protein family member, with at least 11 transmembrane domains, of ancient origin (63.9 kD) (XO47
  Coding regions on vcDNA: vcDNA=SeqID_92058; Strand=+; Position=27-662
HPTKGCRCRCPKRETPSRRSKCHSSPKGSKSNGRCIRRANERTLRRNAPFSFDKQSFAHKRRNTFSNRPFLSTLELLASRQTIDKPSCTSNSNLALEVSKAGIADLNRPLSRMDIFYSGSTVTLTSRIRRREATITSTNAEAGGELTASAIDGAVAAPARSTLFLSSAGLADVATARTAGGGISSKWTWRIMKSIRPMLDLSLLQSPTFILL

SEQ ID NO: 165636 - protein, 200 aa, Heterodera glycines
  Homolog annotation: Hit_ID=XP_324453.1; Match level="QueryCoverage =86%, HitCoverage=80%, E-value=6e-15, Identity=34%"; Hit description =predicted protein [Neurospora crassa] emb|CAD70422.1| conserved hypothetical protein [Neurospora crassa]
  Coding regions on vcDNA: vcDNA=SeqID_92059; Strand=+; Position=45-644
MVLFALLPVQLMLVVAAVCLVIITQCCGGGQKKNTEEPQVPAEPEGAEASAKPTGQSAAPGGTSAAGGTSAAGQPAEASKKSLAPAGTGSTVPSAYAAPGTGTTLGATSQKAVAASGGGTSAVGTASQKSAVAPAGGASALGTASQKSAAGGTTSQKSAAAPAGGASALGTVSQKSAAGGTASQKSAAGGTVSQKSAAGG

SEQ ID NO: 165637 - protein, 210 aa, Heterodera glycines
  Homolog annotation: Hit_ID=NP_500785.1; Match level="QueryCoverage =94%, HitCoverage=36%, E-value=2e-34, Identity=38%"; Hit description =glucocerebrosidase family member (58.2 kD) (4G110) [Caenorhabditis elegans] gb|AAD14768.2| Hypothetical p
  Gene Ontology: Cellular component=extracellular space
  Coding regions on vcDNA: vcDNA=SeqID_92060; Strand=+; Position=12-641
MLPDAAKELYAGGTVNNVIDGLAFHWYSPPDCPYEVLSEFHEKYTGKFLLATEACTGAAERAEEKGPSMGNWTRALLYSHDIIEDMRDWAVGWVDWNICLDMKGGPNWVDNIVDAPIIISAKDDEFYKQPMFYAMAHFSRFITPNAVRIGSEFGGHLSSSSYNANNKPIEFVAFRSPDNKQLVMVLFSSVTQTTKVKIHDGKRTIPLTIP

SEQ ID NO: 165638 - protein, 192 aa, Heterodera glycines
  misc_feature (67)..(67): Xaa can be any naturally occurring amino acid
  Homolog annotation: Hit_ID=NP_491681.1; Match level="QueryCoverage =97%, HitCoverage=25%, E-value=9e-26, Identity=36%"; Hit description =Germ-Line Helicase GLH-3, germline DEAD box RNA helicase-3; contains 2 CCHC type zinc fingers (79.7 kD) (
  Gene Ontology: Mol. function=RNA helicase activity; Cellular component=cytoplasm; Biological process=translational initiation
  Coding regions on vcDNA: vcDNA=SeqID_92061; Strand=+; Position=51-629
MPPKRDEVELFDESRMIRCGKHFLDAFSDESQITVLTGGGTTQIELIRSFDECELPEPIKRNIELKXYTQPTPIQKAVIPLIANTKRDIMGHAQTGTGKTAAFLLPIVCHVQKLVEARGSGVVNGTHPVALIVVPTKELAEQLYEEARAFAAGTSVSVCHTYGHMPMALSLREKSDGCDIFIGTCGRIQQLV

SEQ ID NO: 165639 - protein, 215 aa, Heterodera glycines
  misc_feature (79)..(79): Xaa can be any naturally occurring amino acid
  Homolog annotation: Hit_ID=NP_490808.1; Match level="QueryCoverage =95%, HitCoverage=48%, E-value=6e-35, Identity=41%"; Hit description =mitochondrial ribosomal protein L38 (48.1 kD) (1B494) [Caenorhabditis elegans] gb|AAK29884.1| Hypothetica
  Coding regions on vcDNA: vcDNA=SeqID_92062; Strand=+; Position=10-654
MHRTSIYAKLQVKYSRRAKFTPRVARPWRQRVIAWAGPDAFSRDRFYELDSWYKARIQRPELLPKLHIIDPDLIVDNYXSKIQRRKERTLDIGFRKNEAAPAKVTEEAMQKLEELSAMNQLVIDLDSVDSSDQLSLAEHFNIFEDLFMPGIFFHNVQSVEVNFGGNNPQQKMLFGNTIRASTAAHPPTVTIGGPRTEAKAFTTMLLLNLEGLGQQ

SEQ ID NO: 165640 - protein, 216 aa, Heterodera glycines
  Homolog annotation: Hit_ID=NP_499796.1; Match level="QueryCoverage =98%, HitCoverage=24%, E-value=6e-20, Identity=29%"; Hit description =MutL Homolog (mlh-1) [Caenorhabditis elegans] pir||T25389 hypothetical protein T28A8.7 - Caenorhabditis e
  Gene Ontology: Mol. function=ATPase activity; Cellular component =mitochondrion; Biological process=meiotic recombination
  Coding regions on vcDNA: vcDNA=SeqID_92063; Strand=+; Position=1-648
HALVQSGSNVFLIRTEPILHEFFYQLVIFSFGNIGSYALKLTSSDCCDSAGRPLPIRELLALYLNDNEQRNENSESDDTEAQIKTSTKVLLEHKDLLWDFFSIQIVEYHSEEDKVPFQGHPKPMLSALPCILEGYLPQMASIPALINHLARNVDYSDEVLCYSSIARALSDFFTPFVVENNFDEEDTKVMEEHRRIQIVLRSIIFPTLKSRFLPPS

SEQ ID NO: 165641 - protein, 218 aa, Heterodera glycines
  misc_feature (83)..(83): Xaa can be any naturally occurring amino acid
  Homolog annotation: Hit_ID=NP_499298.1; Match level="QueryCoverage =100%, HitCoverage=32%, E-value=9e-71, Identity=63%"; Hit description= FtsH protease (3L509) [Caenorhabditis elegans] emb|CAA88955.1| Hypothetical protein M03C11.5 [Caenorhabd
  Gene Ontology: Mol. function=ATP-dependent peptidase activity; Cellular component=mitochondrial inner membrane; Biological process =proteolysis and peptidolysis
  Coding regions on vcDNA: vcDNA=SeqID_92064; Strand=+; Position=3-656
RKDIFRLYLDKIVHGDINVTQLAKGTTGFTGADIENLVNQAALKAAKEGAKEVDMAHLDEARDRVLMGPERIKGRLPDEEENXYTAFHEAGHAIVAHFSDHSNPLHKVTIIPRGTSLGHTSQLPDKDRHQETKAQLLAQLDVTMGGRVAEELVFGQEHISTDATSDLRRATKVAERMVKLFGMSDRAGLRDFTVEPIESEQGFCVERGPSTSETIDRE

SEQ ID NO: 165642 - protein, 190 aa, Heterodera glycines
  Homolog annotation: Hit_ID=NP_505004.1; Match level="QueryCoverage =99%, HitCoverage=49%, E-value=6e-46, Identity=49%"; Hit description =rhodopsin-like GPCR superfamily (5I249) [Caenorhabditis elegans] gb|AAB37078.1| Hypothetical protein C26F
  Coding regions on vcDNA: vcDNA=SeqID_92065; Strand=+; Position=3-572
ALCLLALPVFSMSQLEYFVPSLPPAFTSHLLVFCYPVTLMAQTMSVWILVGITVDRFIAICYPFTVRIHCTVRRAQLTIVAILVFSVCYNLIRFWEYRINNSSDGDGTDAKNEQMPPVVGLLRENYLYMLLYQNVATMLSQFLVPLCVLCALNFQVARTILVAVEQRREMWAELSAAERREHKTAKMMLM

SEQ ID NO: 165643 - protein, 188 aa, Heterodera glycines
  Homolog annotation: Hit_ID=NP_496939.1; Match level="QueryCoverage =95%, HitCoverage=33%, E-value=2e-37, Identity=38%"; Hit description =cytochrome p450 CYP4 family member (2O304) [Caenorhabditis elegans] pir||T20471 hypothetical protein F01D
  Gene Ontology: Mol. function=monooxygenase activity; Cellular component=extracellular space; Biological process=leukotriene metabolism
  Coding regions on vcDNA: vcDNA=SeqID_92066; Strand=+; Position=1-564
HPQYQRLIHAEIDAKCQEMNAKGIVEEISFKPADVNELRYMDRCIRESLRMFPAVPVVERQLQNDLAVNGKVWPRGALAVVAPILIHHNEQVYPNHWQFDPDNFLPEKVAKRNAFDYIPFSGGPRNCIGQKFAMLQLKIVLAHLFCNFRFSTEVPFLQNLPALEPILRPQNGLPLKITKRKCEIIMNE

SEQ ID NO: 165644 - protein, 205 aa, Heterodera glycines
  Homolog annotation: Hit_ID=NP_353964.1; Match level="QueryCoverage =80%, HitCoverage=28%, E-value=1e-12, Identity=32%"; Hit description =hypothetical protein AGR_C_1721 [Agrobacterium tumefaciens str. C58] ref|NP_531642.1| sucrose hydrolase [
  Coding regions on vcDNA: vcDNA=SeqID_92067; Strand=+; Position=1-618
ISGESLLVGWLGNWADYNGVQNFPTALTLPRVLKLAPSRNFLLTPPHPSVVQLREKELNMDDFRTFKITQLPKNGAVEIFFEIYYWRLRIYGSIVLEMQQTDKGEEGKISLVASKDGLEMILGWKNGTQHRYIERKARPTSLQIFIDVGSVEVFSDQGEWSCTARIPDEGRVDNIRLIGRSEVLNSQSAKMWSIKSVTQTDETTQ

SEQ ID NO: 165645 - protein, 93 aa, Heterodera glycines
  Coding regions on vcDNA: vcDNA=SeqID_92068; Strand=-; Position=88-369
SGNHPIITFIITQQLFVLIVDRLLQNGLHHLHIFALERVFVAGGGRRARRTARVSEAPGLTLQEDKEAPVLMLQEGEEARLHKRPGAHVRSQA

SEQ ID NO: 165646 - protein, 75 aa, Heterodera glycines
  Homolog annotation: Hit_ID=CAB88203.1; Match level="QueryCoverage =100%, HitCoverage=25%, E-value=2e-15, Identity=54%"; Hit description= putative cuticular collagen [Globodera pallida]
  Coding regions on vcDNA: vcDNA=SeqID_92069; Strand=+; Position=2-226
MLAIIFAVVTLSFFSSEMSHMNSKVREGLEALTIHINSACTDLMDVLRVVTPRSRPGDIPLNSVFSAPRQLPGHC

SEQ ID NO: 165647 - protein, 70 aa, Heterodera glycines
  Coding regions on vcDNA: vcDNA=SeqID_92070; Strand=-; Position=2-214
ALTFSAELLLRSLAEKDGVVVSWGAAIFAAFGVVVFVCPFVDIGFLGSVSSNFLLDGFTLRPLDVTVSGA

SEQ ID NO: 165648 - protein, 177 aa, Heterodera glycines
  Coding regions on vcDNA: vcDNA=SeqID_92071; Strand=+; Position=14-547
MFSYDKEKWTLEEKIRLLELFIDKDSGLWEDRANALQEEFSGKRPTDFFTQTTVKRELNNIFNKPNPEHHIFGMPTHPRGKEAAELWLKHFRRELEEGRERRRQMFMVAMRKQLDIIRRYQQGKLPKEELDALLEEARQRDAQRPDKEQYEEKIKQHMAKAYFEDVKNVHLLTLFQL

SEQ ID NO: 165649 - protein, 103 aa, Heterodera glycines
  Coding regions on vcDNA: vcDNA=SeqID_92072; Strand=-; Position=37-348
MLFEHWPMPSVRVPKPFEHWPMPSVRVPKPFEHWPVPASVPSVHSPKPFEHWPVPSVQRLMPFEVPPVHAHVPSVHWPIPSVIGQCAVFLPFDTRPSRSSSSS

SEQ ID NO: 165650 - protein, 152 aa, Heterodera glycines
  Homolog annotation: Hit_ID=CAE65039.1; Match level="QueryCoverage =99%, HitCoverage=43%, E-value=2e-22, Identity=39%"; Hit description =Hypothetical protein CBG09880 [Caenorhabditis briggsae]
  Gene Ontology: Cellular component=mitochondrion
  Coding regions on vcDNA: vcDNA=SeqID_92073; Strand=+; Position=2-460
QLFRIIRDKILTSRPITVAEYMQNSAASQLGYYAGQNEIFGERGDFVTSADVTHIFREFTGSWDVHDLEMTSWNDRRLLGELGPGSGELMADVHNVLRQFDVLQHVEVCLDESSERLVERQRQTLEKKLGEDLLRTIRWYDSLDDVPQGFSL

SEQ ID NO: 165651 - protein, 93 aa, Heterodera glycines
  Homolog annotation: Hit_ID=NP_598458.1; Match level="QueryCoverage =94%, HitCoverage=77%, E-value=5e-09, Identity=36%"; Hit description =RIKEN cDNA 1110003E01 [Mus musculus] gb|AAH09097.1| RIKEN cDNA 1110003E01 [Mus musculus] dbj|BAC40601.1|
  Coding regions on vcDNA: vcDNA=SeqID_92074; Strand=+; Position=1-282
RILSILQEAQTDCTDTECSTSTGGDPTGTAGSNVLLIAMAWGLFAMLMFFMRPASMRSGGNDRENGQIAGKPSSAANGHNNDDGNGPPPGDVF

SEQ ID NO: 165652 - protein, 197 aa, Heterodera glycines
  Homolog annotation: Hit_ID=CAE61291.1; Match level="QueryCoverage =99%, HitCoverage=24%, E-value=1e-101, Identity=86%"; Hit description= Hypothetical protein CBG05115 [Caenorhabditis briggsae]
  Gene Ontology: Mol. function=protein binding; Cellular component =ubiquitin ligase complex; Biological process=regulation of cell growth
  Coding regions on vcDNA: vcDNA=SeqID_92075; Strand=+; Position=1-594
VDYDLLGEVKTHELKENGTEIAVTEANKNEYIELLVEWRFNRGIEQQTVAFFNGFTSVFPLQWLQYFDERELELLLCGMQEIDVDDWQRHTAYRHYAVQSKQVIWFWQFVRSLDQEKRSKLLQFVTGTCRVPVGGFSELIGSNGPQLFCIERVGKENWLPRSHTCFNRLDLPPYRSYEQLAEKLTVAIEMTEGFGNE

SEQ ID NO: 165653 - protein, 195 aa, Heterodera glycines
  Homolog annotation: Hit_ID=NP_496450.1; Match level="QueryCoverage =99%, HitCoverage=54%, E-value=8e-35, Identity=37%"; Hit description =kinase serine threonine 22 (2L766) [Caenorhabditis elegans] emb|CAA91402.1| Hypothetical protein W02B12.1
  Gene Ontology: Mol. function=protein serine/threonine kinase activity; Cellular component=membrane; Biological process=protein amino acid phosphorylation
  Coding regions on vcDNA: vcDNA=SeqID_92076; Strand=+; Position=35-619
SHHQRHKRSYSSTRHVLINFGFQFPHDFKLGSGRYSKVNKGFYREPNRYFAIKITDLEAVSDTFKHNFVPHELKVWRELSHPNHLRLYKDFMNNDFLFEIINLAVGGDMINYLRNHGPVKEAVCSGWMLQLVDALSYLHQKRIVHRDLKLENILIFDRDVIKITDYGFCKQCCDDELSSTFCGTKSYKAPDILQS

SEQ ID NO: 165654 - protein, 212 aa, Heterodera glycines
  Homolog annotation: Hit_ID=CAE70758.1; Match level="QueryCoverage =72%, HitCoverage=31%, E-value=9e-23, Identity=45%"; Hit description =Hypothetical protein CBG17507 [Caenorhabditis briggsae]
  Coding regions on vcDNA: vcDNA=SeqID_92077; Strand=+; Position=3-638
HVDGEHSETGKSSASSDNELQRKEPSPPSTSKSSIAGIPNDFPKLPKFPLSALPAEIRRQQPMVMRQAPEIPKFASKPEVPDGGLGLAGESERPNSVSETSLNTVSNSADVSEYGGLSDDSPAPGGLIGTVLDLFGFNKDGKPTPDAGGIGRAVGNLLGGSNSPLPGKQFINNVLYKTLTSGSVLPSSASANASADPLNATSALGLPFPQSV

SEQ ID NO: 165655 - protein, 183 aa, Heterodera glycines
  Coding regions on vcDNA: vcDNA=SeqID_92078; Strand=+; Position=54-602
FSVFCINLMVFLLLLLYIFPLYFLVPFGAAHCHDTLSYYEDFDPRMSDFCWLPPGHDDCVEASCLFETAGKSWTKVSKGCTFNGTRECAELEQKCLTDGGKLLVDCSVCNSTSYCNDKIPNEIVVCLNGTMNDGEKKDEAFTEIRCEDAQCFSVRCIGTDNSTLFHTKGCVNMDKLWDVKLPL

SEQ ID NO: 165656 - protein, 208 aa, Heterodera glycines
  Homolog annotation: Hit_ID=CAE70291.1; Match level="QueryCoverage =63%, HitCoverage=40%, E-value=6e-19, Identity=40%"; Hit description =Hypothetical protein CBG16811 [Caenorhabditis briggsae]
  Coding regions on vcDNA: vcDNA=SeqID_92079; Strand=+; Position=6-629
MYSTVIDPFSKSDPEIGIRNQFKLYKNKSYDWRSNVIDPHNNSRFCFLQPLTTYTPWIFETTDQNFHYQRSKIYEQREKLDGLRPLDEWMVSTLPSRPGLYILFGLFSEEQQLRWLGRSLFEYPEPPNITNLSSNGTYSGSSVFKTCGAEKLRWTTLGLDYDWTSKDYSMEEKALPMEIKQISKLVIDVLGSFPLVPDAAIVNYYPKN

SEQ ID NO: 165657 - protein, 206 aa, Heterodera glycines
  Homolog annotation: Hit_ID=XP_228063.2; Match level="QueryCoverage =84%, HitCoverage=40%, E-value=1e-16, Identity=34%"; Hit description =similar to WD-repeat domain 4 protein [Rattus norvegicus]
  Gene Ontology: Cellular component=extracellular space
  Coding regions on vcDNA: vcDNA=SeqID_92080; Strand=+; Position=9-626
MVVSIHAIEGEQFCAVVCTNSHIFVLKCAKNGSQSVELAFQVDLTFPNAVNNQQKLGKDNECNQSILSSDVSADHKLLAVATTTKHVLLFELQSLGNAIGGTWEETKCQTIPKTPTAIHFSACGDTLLVGTRSGSLLQFRVNDANFCPGGAIELLSHFSMLLDHCLSPGRPNFLLSADRDEKVRVSRYPNTQIIECFCLGHTSFVN

SEQ ID NO: 165658 - protein, 201 aa, Heterodera glycines
  Homolog annotation: Hit_ID=CAE61610.1; Match level="QueryCoverage =100%, HitCoverage=45%, E-value=3e-50, Identity=47%"; Hit description= Hypothetical protein CBG05531 [Caenorhabditis briggsae]
  Gene Ontology: Mol. function=phospholipase D activity
  Coding regions on vcDNA: vcDNA=SeqID_92081; Strand=+; Position=1-603
GALARRMLNIQRIYHTGVMHSKFIVADGRHFYLGSANMDWRSLSQKMELGVMVRDCPCLAQDLLSIFDIYWRASDAKTATEMHAQVKKLAPAKFNPQRPLKLMDGEQRLAVHLAASPQAMNCPGRAWDLTGIIDAIKGARKRIFVHVMDYFPMFLYSQNRRYWPEIDNALREAILRGVNVRIIAAALHFPKTGLRFLKSLE

SEQ ID NO: 165659 - protein, 153 aa, Heterodera glycines
  Coding regions on vcDNA: vcDNA=SeqID_92082; Strand=-; Position=22-483
GKYCKTHTKQKKSEREEERKPAGRNTLEHGQKGGTKVKKRKAAGGGRGARLINRRPIPANAATNPHCWAHSGTRSRLLSLAWHHHPAPLGQQRQHSPLASSHYPPLLLLESRYYRRQQRSHTQSAVPFAEHGKASFGTRFGTCPPPTSAQFCQ

SEQ ID NO: 165660 - protein, 135 aa, Heterodera glycines
  Coding regions on vcDNA: vcDNA=SeqID_92083; Strand=+; Position=1-408
RFHNYSSPPNNEWHNNFKEKFLRAITSVSYKIYFNANADSFEPFELVNERTQEKLRLVLANQTIWGSNEWIMKRCPIGETAAAIHWEDENLDDNLNNVDFCRYAGFRCIGPLSPPQAAEDEEAGQSSEEASSDNE

SEQ ID NO: 165661 - protein, 208 aa, Heterodera glycines
  misc_feature (75)..(75): Xaa can be any naturally occurring amino acid
  Homolog annotation: Hit_ID=NP_502781.1; Match level="QueryCoverage =100%, HitCoverage=92%, E-value=6e-58, Identity=53%"; Hit description= snare protein (4P530) [Caenorhabditis elegans] emb|CAB16506.2| Hypothetical protein Y57G11C.4 [Caenorhab
  Gene Ontology: Mol. function=v-SNARE activity; Cellular component =integral to Golgi membrane; Biological process=protein transport
  Coding regions on vcDNA: vcDNA=SeqID_92084; Strand=+; Position=2-628
QYSVSTADITAKIGQLHHLGPSEFAQPAKEVRHLLADVEELLEQMELSAREIPSSSSERSKYETRVKSYRNDKRXLDAELRKAIERAKSNAERDELFQCGDGSVSGDQMDKLITNTERLERTSRKIEDAYRVTVETEQIGAEVLENLGQQRETLTRARGRMREADADLSRSNRMLSQMIRRVIQNRLILLVVAVVMMFSLLFLLYKAL

SEQ ID NO: 165662 - protein, 134 aa, Heterodera glycines
  Homolog annotation: Hit_ID=1NQ3; Match level="QueryCoverage=91%, HitCoverage=89%, E-value=1e-25, Identity=49%"; Hit description=Chain F, Crystal Structure Of The Mammalian Tumor Associated Antigen Uk114 pdb|1NQ3|E Chain E, Crystal Structure
  Gene Ontology: Cellular component=cytosol; Biological process =regulation of translational termination
  Coding regions on vcDNA: vcDNA=SeqID_92085; Strand=+; Position=72-476
MAAPSIRLITTSKAPPATGHSQAVLLNNQTLYISGQTGIAAGSTNVVPGGARAEAKQAMTNIGEILTYAGSSFKHVINCNIMVADMSDFQAVNETIKNFFTEDTYPARSFFQVVKLPKSAYVMIDVVAIVQGQS

SEQ ID NO: 165663 - protein, 114 aa, Heterodera glycines
  Coding regions on vcDNA: vcDNA=SeqID_92086; Strand=+; Position=3-347
SLQLNATSTPVRAKLVYTFRRDNSSLHHERHERLHGIRPRRACTVVRRRGSLSIVRSRERLHGSLARVRAASAGEVPGSERLHVRRCNNDRRMDGRNLKSERPVRRCKDKEDVS

SEQ ID NO: 165664 - protein, 208 aa, Heterodera glycines
  Homolog annotation: Hit_ID=CAB88203.1; Match level="QueryCoverage =100%, HitCoverage=94%, E-value=1e-101, Identity=74%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_92087; Strand=+; Position=6-629
MQETHIVLGIASVCSLLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGGAGQPGQPGQPGQPAPPCPPQNIPCPRCPAGPPGRPGGQGPPGQQGAPGQPGTPAQGGGPGTPGAPGPQGQPGQPGAPGQPGKDSGYCPC

SEQ ID NO: 165665 - protein, 208 aa, Heterodera glycines
  Homolog annotation: Hit_ID=CAE58429.1; Match level="QueryCoverage =99%, HitCoverage=25%, E-value=4e-22, Identity=33%"; Hit description =Hypothetical protein CBG01563 [Caenorhabditis briggsae]
  Gene Ontology: Mol. function=small GTPase regulatory/interacting protein activity; Cellular component=actin cytoskeleton; Biological process=response to pathogenic bacteria
  Coding regions on vcDNA: vcDNA=SeqID_92088; Strand=+; Position=2-625
FVPSPPQRFLGASLGGGVQPPSKPSIGHQSQVKNSRGKPPPPPTPPTVIQQQKEQSPPVPTAASSVASPQQRQSVLTAASSVASPPPPPPPPPPPPLFQSKPTLSDNSVPSTSTESKASFVDPTNNKRSDLLQQIQQGTKLKKVGPPSTERTPVPTNAPTLRDNMMEQIKQGTTLKHVDASDVEINRRSVGGGVQEIGGLAGALAKAL

SEQ ID NO: 165666 - protein, 94 aa, Heterodera glycines
  Homolog annotation: Hit_ID=NP_494848.3; Match level="QueryCoverage =100%, HitCoverage=19%, E-value=1e-14, Identity=41%"; Hit description= AMP-dependent synthetase and ligase family member (55.7 kD) (2F35) [Caenorhabditis elegans] gb|AAC46810.
  Coding regions on vcDNA: vcDNA=SeqID_92089; Strand=+; Position=44-352
LAVLRLGAIYMHVNPTYTKRETQHFVNDAKPKVMVSLNASEDASFTQAGFDVKHEALKQEPSCEVEPAQKDDVACIMYTSGTTGRPKGAMVTHG

SEQ ID NO: 165667 - protein, 126 aa, Heterodera glycines
  Homolog annotation: Hit_ID=EAK82044.1; Match level="QueryCoverage =45%, HitCoverage=4%, E-value=5e-15, Identity=70%"; Hit description =hypothetical protein UM01085.1 [Ustilago maydis 521] ref|XP _398700.1| hypothetical protein UM01085.1 [Ustil
  Gene Ontology: Mol. function=ATPase activity; Cellular component =nucleus; Biological process=telomerase-independent telomere maintenance
  Coding regions on vcDNA: vcDNA=SeqID_92090; Strand=+; Position=2-382
NGGPTDDGSEQSHSAAEDGEQLQLKPQSGRAEGAVGEETVRPSAGIVPRANRLNAKSQRKRLIVMMSVDQVDIDMRDRCSAGQKVLASILIRVALADVFEGNCRILALDEPTTNLDEDKVGRRNWH

SEQ ID NO: 165668 - protein, 168 aa, Heterodera glycines
  Homolog annotation: Hit_ID=AAP30770.1; Match level="QueryCoverage =73%, HitCoverage=43%, E-value=9e-23, Identity=48%"; Hit description =putative gland protein G17G01 [Heterodera glycines]
  Coding regions on vcDNA: vcDNA=SeqID_92091; Strand=+; Position=93-596
MRKFAYFKLCQAVLTSVFLWQILSTHQFCGEFDEPTAFFNSAVSSSSAGGHCDQQFTLIGMDSTTGEYGAVPDKQKWHMQLMASSGGGQGQPIDEQQQQQKNQMEEFSSKLPTVGRHCIPIAFSLVNPWLHDNKSHLQKVVDLFAIQLLCGVLSLFGIAIHVLDQPRS

SEQ ID NO: 165669 - protein, 158 aa, Heterodera glycines
  Homolog annotation: Hit_ID=CAE65983.1; Match level="QueryCoverage =61%, HitCoverage=19%, E-value=3e-12, Identity=39%"; Hit description =Hypothetical protein CBG11172 [Caenorhabditis briggsae]
  Coding regions on vcDNA: vcDNA=SeqID_92092; Strand=+; Position=35-511
MIIEGENFKKTNDEKDRKKKWWQFPSGCKLFAELFFRASMVAVCFAFAYAVPTLDDLVPLVGSTSGMLLAFVYPALIDLFTFVPHYRAEGHRQKACFRLLLNLFLASVGLFGMVAGLYASVSNLISHGSNECNAMTTTGTPTIMWNLYNGTTLSSSIQ

SEQ ID NO: 165670 - protein, 158 aa, Heterodera glycines
  misc_feature (118)..(118): Xaa can be any naturally occurring amino acid
  Homolog annotation: Hit_ID=CAE75294.1; Match level="QueryCoverage =98%, HitCoverage=12%, E-value=1e-28, Identity=49%"; Hit description =Hypothetical protein CBG23262 [Caenorhabditis briggsae]
  Gene Ontology: Mol. function=pyruvate carboxylase activity; Cellular component=cytosol; Biological process=gluconeogenesis
  Coding regions on vcDNA: vcDNA=SeqID_92093; Strand=+; Position=2-479
KLLITALRDQHPDVPIHVHTHDTSGAGVASMIECARAGADPIDAAIDSMNGMTSQPSMGAIWGFVGTGTGLSPGWENDPVFPNTTLYWGTGPYIFPNPSKCPRNNKKGGNSECEKNTXPRGGKFKKFHFPGFFLGGGEKNFQGGKKIIPAGNFSLKKN

SEQ ID NO: 165671 - protein, 195 aa, Heterodera glycines
  Coding regions on vcDNA: vcDNA=SeqID_92094; Strand=-; Position=3-587
ELAALLLHRRSLLGQQQFMRSSSSSVVVALPRVVLRLQRHEQPRRLGLGLVGTLRVQFVGMKQRQEGVQPVVHRFALFARRLRTVRQSLRFVSGVVVIRRLLHSLLLQRCAVANVSETEQFGLALPFLNEVLGVLLQVLLDDGDQILLLFSIGAADVGRLNQWSSIVFAVRQQTHVNAAREWLLLQVHFGNVFSQ

SEQ ID NO: 165672 - protein, 90 aa, Heterodera glycines
  Homolog annotation: Hit_ID=CAB88203.1; Match level="QueryCoverage =95%, HitCoverage=28%, E-value=1e-30, Identity=73%"; Hit description =putative cuticular collagen [Globodera pallida]
  Coding regions on vcDNA: vcDNA=SeqID_92095; Strand=+; Position=2-271
VRGIASVCSLLVIIATVVPLSSLYSEMNQMNSQLRDRLEAFLVHTDSVWTDLMDVQVVVTPPSKPRDNPFHSIFRARRPLPGHCQCAGLQ

SEQ ID NO: 165673 - protein, 202 aa, Heterodera glycines
  Homolog annotation: Hit_ID=CAE65006.1; Match level="QueryCoverage =100%, HitCoverage=74%, E-value=2e-74, Identity=60%"; Hit description= Hypothetical protein CBG09844 [Caenorhabditis briggsae]
  Gene Ontology: Mol. function=phosphatidylinositol transporter activity; Cellular component=membrane fraction; Biological process =nonselective vesicle transport
  Coding regions on vcDNA: vcDNA=SeqID_92096; Strand=+; Position=49-654
MLIREYRIVMPFAIEEYQIGQLFSVTEASRQETGGGEGVQMVRNEPFEGQSLFNGRFTSGQFTHKIIHLDTKVPALLRAIMPRGSTTLHERSWNAFPYCKTEVTNPDYMKDNFLIRIETMHLSDRGTTKNALGLSKDELNERKVVRIDIANDNEFLKAADILDNTRPSTFRSVNTGRGPLEQQWQNNCEPVMCAYKVVTVNF

SEQ ID NO: 165674 - protein, 199 aa, Heterodera glycines
  Homolog annotation: Hit_ID=NP_495985.1; Match level="QueryCoverage =98%, HitCoverage=80%, E-value=6e-66, Identity=56%"; Hit description =DNA segment Chr 7 ERATO Doi 743 expressed like (2J613) [Caenorhabditis elegans] emb|CAA87776.1| Hypotheti
  Coding regions on vcDNA: vcDNA=SeqID_92097; Strand=+; Position=3-599
LSSVVFIYFAALLTIYLRFPELRPEERAHFRYPQTIDDAKRLGRVLIHYKDQHFYTVLSGVAAIYLILQSFAIPGSIFLTILSGYLFSFPLALALVCLCSAAGATVCYFLSQMFGRSLVMYYFPEKLSKWQIEVQKQADNLFNYIVFLRVTPILPNWFINLASPIVDVPILPFFFGTLAGVAPPSFLFIQAGTTLQMMS

SEQ ID NO: 165675 - protein, 167 aa, Heterodera glycines
  misc_feature (23)..(23): Xaa can be any naturally occurring amino acid
  misc_feature (25)..(25): Xaa can be any naturally occurring amino acid
  misc_feature (117)..(117): Xaa can be any naturally occurring amino acid
  misc_feature (124)..(124): Xaa can be any naturally occurring amino acid
  Homolog annotation: Hit_ID=NP_498052.1; Match level="QueryCoverage =95%, HitCoverage=59%, E-value=5e-45, Identity=54%"; Hit description =EAP30 of ELL complex (30.3 kD) (3G50) [Caenorhabditis elegans] gb|AAK67217.1| Hypothetical protein C27F2.
  Gene Ontology: Cellular component=DNA-directed RNA polymerase II, holoenzyme; Biological process=regulation of transcription, DNA -dependent
  Coding regions on vcDNA: vcDNA=SeqID_92098; Strand=+; Position=2-502
ASHSLAIGFGAVHQKRDLQSKFXAXGDELAGELMHPFTTQLEMFSQKLEDFGMKHRDQILKNSQFRRYFPEMCVTDEVDPLASSTGFWAEKLGVGTFYYELAVPIIEVCMSTTHFDXGLITIYXLRNLLMLSRKRTLIVPIAHDDVIRAVKKLTVLGHGFELIALGA

SEQ ID NO: 165676 - protein, 61 aa, Heterodera glycines
  Coding regions on vcDNA: vcDNA=SeqID_92099; Strand=+; Position=262-447
MHAFCVFQAHLDVHLKREEEEQKLQQEKTSKKETKKAKKKELEEDVIEDEYDDYDEQLHRY

SEQ ID NO: 165677 - protein, 112 aa, Heterodera glycines
  Coding regions on vcDNA: vcDNA=SeqID_92100; Strand=-; Position=218-556
FLASICFSRPISAVFSAIAASVATATISPTESISSEPPLAFLSSETMPICADALSLASALAFINPRSVNDIDVSFLITFSSFVLSSSACSRCSSSRSFNSSNLPVSSMIFLS

SEQ ID NO: 165678 - protein, 82 aa, Heterodera glycines
  Coding regions on vcDNA: vcDNA=SeqID_92101; Strand=-; Position=0-245
DTIIQSVQLGSYMGIGSVECILLLLPLRRLSSASSPIHRSFVVSFHRVLLRPFTGISVVLLAVVAVDNRDVHLQRTVRIRVA

SEQ ID NO: 165679 - protein, 177 aa, Heterodera glycines
  Coding regions on vcDNA: vcDNA=SeqID_92102; Strand=+; Position=1-531
AQAAKCADDGFKQVENGCKLECAHWLDAYAPTPAAGKQRDAHPLTNCFGRNVKMEAMPMNECMRKRVDNYCTSSATARISVPAPDYAGWMEPAIASNDTAFEQRHKSAFLHKARAAFFAFRNFQKCMNNCAKKRSIKCFGDEGCAISLPSDRALAKLFYNQCTQQQNVPKNARDACY

SEQ ID NO: 165680 - protein, 206 aa, Heterodera glycines
  Coding regions on vcDNA: vcDNA=SeqID_92103; Strand=+; Position=25-642
IKMCFSPQIDDTRTNCKFVFQQPCRCSIKQLEAIKFSKVVSGRNKSVGCNPTFCCFCCGIFGLVMFVLLLVLFCVAQFSAPNSPDIGISISFVSMILIVVVIVLCCMCGAEFGHSSLEVLYKCPTCGKETHRNYECFIDVSYNWGRRHGDTEMFRYRTFAGSLWGQYTKNVTKTILQKRMTMNNFEVVEHKYDVMSIVQDNYFKTT

SEQ ID NO: 165681 - protein, 116 aa, Heterodera glycines
  Homolog annotation: Hit_ID=NP_496958.1; Match level="QueryCoverage =99%, HitCoverage=12%, E-value=3e-20, Identity=41%"; Hit description =5'-3' exoribonuclease 2 (101.3 kD) (2O455) [Caenorhabditis elegans] emb|CAB54449.1| Hypothetical protein
  Gene Ontology: Mol. function=5'-3' exoribonuclease activity; Cellular component=nucleus; Biological process=cell growth
  Coding regions on vcDNA: vcDNA=SeqID_92104; Strand=+; Position=2-349
HIDAVKAYGMSGEVSYDVEALALGEAHRSLFRNSLEFGDIKENTCIMVEFRDPQFPMHFIFKANRLDGIKELPRVLKPNDWDQRRHGSFQPQIGFSRDIPRANLSMAGHRTLKHHI

SEQ ID NO: 165682 - protein, 147 aa, Heterodera glycines
  Coding regions on vcDNA: vcDNA=SeqID_92105; Strand=+; Position=41-484
MDQIQQMAPKTPKFNSVRSSGGRLATMSPAARSLLGDKLGIRLGTDRIKVSPSPRGSASRTVFSPAIYQMIKVKNEPKSGATTPKRAAATPTSSSSSVTDDLLRIPSPGPSTLIKNKEQREAQQRKVSETEETQQNMVKRPSAADFF

SEQ ID NO: 165683 - protein, 120 aa, Heterodera glycines
  Homolog annotation: Hit_ID=CAE75350.1; Match level="QueryCoverage =41%, HitCoverage=4%, E-value=9e-12, Identity=62%"; Hit description =Hypothetical protein CBG23330 [Caenorhabditis briggsae]
  Gene Ontology: Cellular component=Golgi stack
  Coding regions on vcDNA: vcDNA=SeqID_92106; Strand=+; Position=69-431
MTHNATTDDQMLSLYDILPFDNPDGGVWKQGWPITYDPEKIRTEKRLEVDSHNDPGRGGQFVDGESLPSSARALRPLLLPSVFFRRGDNRFSFIGRPPFVTSSPLSAHFTRWTNGRPQRV

SEQ ID NO: 165684 - protein, 212 aa, Heterodera glycines
  Coding regions on vcDNA: vcDNA=SeqID_92107; Strand=+; Position=14-649
MAMTFMLGKDNGIGIVGVSSANAGTSLPIANNAIATSASESASCSSVTPSPSPSPIVAFNATNDALNSSSPFVTLRKQPQCQQSTPPTQPISSRESEAERKAKSRLKRSTRRSTQGVTLEQLGEVNMRNHSPKHHGRAEIGKEQKQRMAIGHDGNCELQMPASPCSSTSSSSAYLTAASHRAVDQHNSKVERVKENYNSTKNEATPSPSSTA

SEQ ID NO: 165685 - protein, 201 aa, Heterodera glycines
  misc_feature (30)..(30): Xaa can be any naturally occurring amino acid
  misc_feature (36)..(36): Xaa can be any naturally occurring amino acid
  misc_feature (79)..(79): Xaa can be any naturally occurring amino acid
  misc_feature (100)..(100): Xaa can be any naturally occurring amino acid
  misc_feature (118)..(118): Xaa can be any naturally occurring amino acid
  misc_feature (147)..(147): Xaa can be any naturally occurring amino acid
  Homolog annotation: Hit_ID=CAB88203.1; Match level="QueryCoverage =100%, HitCoverage=67%, E-value=9e-40, Identity=46%"; Hit description= putative cuticular collagen [Globodera pallida]
  Coding regions on vcDNA: vcDNA=SeqID_92108; Strand=+; Position=2-604
IASEWSRFSIRVDIVTLPSLYSEMSLMNSXLRDGIXDFRVNTYSTCTDWMDVQVVLTAPSMPRDNPFNFILRAGTLFFXHWQCAGLQKLSCNPGLNGPLXSPGQSGDSAGTGRARNPXLPGKPVPPCPPQKMTGARCLVGPLSRPVXQGAPGKQGGPVVAGILAQGGGLSKSGSIGNLGQPVLSGFRGAAGQILMSGANGI

SEQ ID NO: 165686 - protein, 185 aa, Heterodera glycines
  Homolog annotation: Hit_ID=CAE67747.1; Match level="QueryCoverage =80%, HitCoverage=57%, E-value=2e-41, Identity=56%"; Hit description =Hypothetical protein CBG13322 [Caenorhabditis briggsae] emb|CAE67742.1| Hypothetical protein CBG13317 [Cae
  Coding regions on vcDNA: vcDNA=SeqID_92109; Strand=+; Position=2-559
FGRLMMSKELYERKMRKIEAQKEEKVPEKFFAKVHYYFKRYWYIALPVHFAVCSVWFGALYFAVKSGMDVVALLERMHMPDHWVDKIRNVPPSAGFAVAALILYKIATPLRYACTLVGIRIAFNTLRRLGKLRTTREIDLTVRQRLDLLIEHRDQKRSAKRAVRHQNNSMKRHSLCSSRTRTKLD

SEQ ID NO: 165687 - protein, 168 aa, Heterodera glycines
  Homolog annotation: Hit_ID=CAG08111.1; Match level="QueryCoverage =97%, HitCoverage=36%, E-value=3e-34, Identity=45%"; Hit description =unnamed protein product [Tetraodon nigroviridis]
  Gene Ontology: Cellular component=mitochondrion
  Coding regions on vcDNA: vcDNA=SeqID_92110; Strand=+; Position=2-505
PLLDVILLLDLLGFTLILPLIPSLIDHFSKRHTIKSDPIFAVFDSVAHGLKTFLNVPSIEPNNGVFFGGILGSLFSFLQCLSSPIFGSLTDLHGRKSLLLVAVIGSLISYCLWTLSSESFSIFFVSRLIGGLSHASVSVAIAIVTDVMPTEERGKGMALIGGSFSLAF

SEQ ID NO: 165688 - protein, 118 aa, Heterodera glycines
  Homolog annotation: Hit_ID=XP_467358.1; Match level="QueryCoverage =81%, HitCoverage=12%, E-value=7e-14, Identity=43%"; Hit description =putative DNA helicase [Oryza sativa (japonica cultivar-group)] dbj|BAD08079.1| putative DNA helicase [Ory
  Gene Ontology: Mol. function=single-stranded DNA binding; Biological process=DNA replication
  Coding regions on vcDNA: vcDNA=SeqID_92111; Strand=+; Position=3-359
AINRSRPFVAIHGPPGTGKTKVIAEIVLQHVKKGKNVLVCAPSHNAVDNAMEACKMNGLDNFVRLGEEADDGALSEYRIGKLAQNHAEYERIEKDIRNSREIKSQRDFLDKSRLCNSI

SEQ ID NO: 165689 - protein, 175 aa, Heterodera glycines
  Homolog annotation: Hit_ID=CAE70368.1; Match level="QueryCoverage =98%, HitCoverage=69%, E-value=2e-77, Identity=77%"; Hit description =Hypothetical protein CBG16927 [Caenorhabditis briggsae]
  Coding regions on vcDNA: vcDNA=SeqID_92112; Strand=+; Position=3-530
KVEVYAPGLDGNKKYYVHVETRIGIHGKPERCVNPDKEGCGGIGSCVHCDICQTIGGFRQFIQIFKGDKPAECSAKGLPPGTYDNLSLKVCLPSKDELLPFLDQNSSRAEQLWDVFVSSRARSGGEIPLVIAARIFDRPINKLSIKELNDALHNTKKGMIGCHWIYATVRSINQD

SEQ ID NO: 165690 - protein, 207 aa, Heterodera glycines
  misc_feature (133)..(133): Xaa can be any naturally occurring amino acid
  Homolog annotation: Hit_ID=AAC47437.1; Match level="QueryCoverage =99%, HitCoverage=93%, E-value=4e-72, Identity=50%"; Hit description =COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_92113; Strand=+; Position=21-640
MADFEGRVKAYRFVAYTTVSFSIISLLSVCLTLPMLKSYVSNVGMKMDSELSSCQHNAKDIWSEVSQLKGMPLLVAGNRTARSAYGSCQECCSGGAQGQPGQPGQPGRPGNPGAPGSPGQPGQTPQTPCEQVXPASPPPTEPAPAGPPGEAGAPGQPGQPGAPGQPGAAGQPGPKGPPGGPGQPGNGGAPGQPGQPGQPGNPGERGI

SEQ ID NO: 165691 - protein, 133 aa, Heterodera glycines
  Homolog annotation: Hit_ID=CAE73451.1; Match level="QueryCoverage =99%, HitCoverage=14%, E-value=2e-45, Identity=63%"; Hit description =Hypothetical protein CBG20900 [Caenorhabditis briggsae]
  Gene Ontology: Mol. function=5'-3' exoribonuclease activity; Cellular component=chromosome; Biological process=cell growth
  Coding regions on vcDNA: vcDNA=SeqID_92114; Strand=+; Position=2-400
KWYYPYHYPPFASYLELIADFQPYFNMPTKPFKPLEQLMGVFPAASRAHIPDRRRWLMTDSSSPIIDFYPETFEIDLNGKKYAWQGVALLPFVEEKRLLDALDSVYTTLTTDESTRNDTGPDRLFVCNKHKLF

SEQ ID NO: 165692 - protein, 150 aa, Heterodera glycines
  Homolog annotation: Hit_ID=NP_498961.2; Match level="QueryCoverage =88%, HitCoverage=92%, E-value=4e-22, Identity=37%"; Hit description =putative nuclear protein of eukaryotic origin (16.2 kD) (3J979) [Caenorhabditis elegans] emb|CAA77449.2|
  Coding regions on vcDNA: vcDNA=SeqID_92115; Strand=+; Position=39-491
MSSNKDEFDKSQERMKDAVNQVAEELDLSYIRKMQCEMHLCSAGCYEGRGALNRKQIDDCEEQCRIKYQAVVAKVDDEFSAWQDQLNRCISTCQDKQHQQFGTDFSKLSEQQRKQFSDNLAKCAGVCMDEHVKHLPKLKDRIVTFLKKSS

SEQ ID NO: 165693 - protein, 106 aa, Heterodera glycines
  Coding regions on vcDNA: vcDNA=SeqID_92116; Strand=+; Position=3-323
VTLEGRTRLPQRVQELVIDIGNAMTSIQQTSGSTDLLITSIRNFTSSDGIMANSEQNLVKIQNQMDRIETQTNGAEQNLKNVSSVNNFLDALEQSAYCTNFDDKKN

SEQ ID NO: 165694 - protein, 191 aa, Heterodera glycines
  Homolog annotation: Hit_ID=CAE74225.1; Match level="QueryCoverage =53%, HitCoverage=13%, E-value=2e-12, Identity=38%"; Hit description =Hypothetical protein CBG21909 [Caenorhabditis briggsae]
  Coding regions on vcDNA: vcDNA=SeqID_92117; Strand=+; Position=2-574
DNLYTYATRPSCTATNGCGSPYLFCDLTKQQTPEPLCCAKIKSGGDCSIFQGNNEEPCFDSVCINGICTASEKGTTTEHGETTPQTETSSTTLGTTQLGETTATPTTGTSSTNIDTTLIGETTSTASDHFSTVFSLSPSLLTTEPTDQITLSTISSSTTLGTFTPNTTVSSSYTQNPSCCCVCKECDEEEQ

SEQ ID NO: 165695 - protein, 94 aa, Heterodera glycines
  Coding regions on vcDNA: vcDNA=SeqID_92118; Strand=-; Position=211-495
HKADLKGVVPTQRFAVVADRKFDSEEFVPEQQFVVADGKPLRKGFVQEERFVSVGDMTQHLKVFAPRQRFGVVDDRKQCSGSRFPGLELKQAIG

SEQ ID NO: 165696 - protein, 214 aa, Heterodera glycines
  Homolog annotation: Hit_ID=AAU91738.1; Match level="QueryCoverage =75%, HitCoverage=21%, E-value=2e-54, Identity=62%"; Hit description =5-methyltetrahydropteroyltriglutamate--homocysteine S -methyltransferase [Methylococcus capsulatus str. Bat
  Gene Ontology: Mol. function=5-methyltetrahydropteroyltriglutamate -homocysteine S-methyltransferase activity; Biological process =cysteine metabolism
  Coding regions on vcDNA: vcDNA=SeqID_92119; Strand=+; Position=2-643
VSLGLVDGRNVWLSPLRQCHANALRVVQKLAPGRVLVSSSCSLLHVPYSTKFAQSLTKKPVKGMLTGPMTILKWSFVRNDQPQKDTLFQVALALRDDVAELEKEGINCIQMDEPAFREGLPLDLAQHNEYLKITVQAFKISTGCVADSTQIYSHMCYSDFGDIFTHIAELDADVLCIECSRSDLSLLSCFDRFGYPLMVGPGIYDIHSPRVPSV

SEQ ID NO: 165697 - protein, 166 aa, Heterodera glycines
  misc_feature (64)..(64): Xaa can be any naturally occurring amino acid
  Homolog annotation: Hit_ID=AAC46462.1; Match level="QueryCoverage =99%, HitCoverage=21%, E-value=4e-47, Identity=49%"; Hit description =E(z)
  Gene Ontology: Mol. function=DNA binding; Cellular component=nucleus; Biological process=establishment and/or maintenance of chromatin architecture
  Coding regions on vcDNA: vcDNA=SeqID_92120; Strand=+; Position=2-499
HCVKVNNLCTKYCGCLDCDNRFPGCRCAPGNCRTKQCHCYYPRWECDPDVCKSCNCDKLDGSGXPICKKVSIQRGLQKRLIVAPSQVAGWGCFVNQDIEKNDFVSEYCDEVISTEESERHDTIYHRVKCPYMFGLNDEQVVDSTRVDNVIQFPNHSQNPNCRAEVI

SEQ ID NO: 165698 - protein, 112 aa, Heterodera glycines
  Coding regions on vcDNA: vcDNA=SeqID_92121; Strand=+; Position=226-564
IPALAFARKWENKLDLSQSNKLMCFRNLHLIRIAMVRIGRLKRELENAQQSGDDQLLFRCCDALMDRMPDQLQLDSDECTVAFDLDKFDEGAVQTLEQLLLIDPLTPLNGNS

SEQ ID NO: 165699 - protein, 178 aa, Heterodera glycines
  Coding regions on vcDNA: vcDNA=SeqID_92122; Strand=+; Position=26-559
MARCPFLFILLIPLLLLVLINFPPILAWILKRDDVLLAYSPNELTTDETKIIGEKQLCPAREWSLEKTFGLPIDPNSEFGKMLPGLSTEFNHALPGIGKSLEYILCTFDKMHCRQRFCQLNILACVRSVTCTRESDGRCMPCCMDHFQYTCVNDWKEVEAMFPTTTTTTTTTTTTLAP

SEQ ID NO: 165700 - protein, 150 aa, Heterodera glycines
  Homolog annotation: Hit_ID=CAE63374.1; Match level="QueryCoverage =95%, HitCoverage=82%, E-value=3e-61, Identity=68%"; Hit description =Hypothetical protein CBG07786 [Caenorhabditis briggsae]
  Coding regions on vcDNA: vcDNA=SeqID_92123; Strand=+; Position=198-647
SVQFHSKDCGTAATEWKPCIERRLADQVFGSCCERFVPPECRGLCTYESHPIEARILLMHTIQPSRCRMYKYLSAIVHCAAQTHDNTHCCREMGMEEIGQNCLDLCRPQQNPRIRWGRQSLRKDLVQCLSKWDQVMFCHQGGLWSRKISK

SEQ ID NO: 165701 - protein, 209 aa, Heterodera glycines
  Coding regions on vcDNA: vcDNA=SeqID_92124; Strand=+; Position=2-628
TNQTSVQTNPPTISLFVPTNNTVEALPASLPTASQSPILTQDINGTTFSRIPKPLETRKSPEQLRKEVQKELPKDTKVPLELTPEFKQQKAEERRKDAEAAQLENDWKGKIAELDRARQALGEEARAAAQGQSNDALFQGLQADYQRKLAEMTEAKQRKEQAQRDAAEQARKMEMLQKEWKKKMDELDAERRRQEEEHKQTHWHSRKRR

SEQ ID NO: 165702 - protein, 110 aa, Heterodera glycines
  Homolog annotation: Hit_ID=NP_490770.1; Match level="QueryCoverage =96%, HitCoverage=48%, E-value=4e-25, Identity=50%"; Hit description =phosphoglycerate/bisphosphoglycerate mutase (24.9 kD) (1B166) [Caenorhabditis elegans] gb|AAK21514.2| Hyp
  Coding regions on vcDNA: vcDNA=SeqID_92125; Strand=+; Position=2-331
VKTLWIVRHAEREDNLHSNWPKDAKPPKLKSDNRPLSARGMQHATELADRFSNVHIDHSFASPFERTVQTATFLISPRKIPIQVEPGLAQALYLCESPAGFEESDELHTR

SEQ ID NO: 165703 - protein, 188 aa, Heterodera glycines
  Coding regions on vcDNA: vcDNA=SeqID_92126; Strand=+; Position=35-598
FLIMESSYLARQILDRCNNLLANRSRYTSKEEFARTVLQTLFGDPSVDLLLLKPHFDSLHADALNRLNALIGFESTVFMTIYVNDALFDEFIELFSRHCIRSPATVKEATESVYMWLLADYLQYLLPVDEQKLNLLKNSTWISAPFSSLPTSAVTSPRRLLRPEVLAQCAPLEHVSLRSGAFKTLYPR

SEQ ID NO: 165704 - protein, 92 aa, Heterodera glycines
  misc_feature (42)..(42): Xaa can be any naturally occurring amino acid
  Homolog annotation: Hit_ID=CAB88203.1; Match level="QueryCoverage =98%, HitCoverage=30%, E-value=3e-19, Identity=50%"; Hit description =putative cuticular collagen [Globodera pallida]
  Coding regions on vcDNA: vcDNA=SeqID_92127; Strand=+; Position=2-277
KHTLIALWIASARSLLAIIHTVVSLPCLYTEIRRMNNRATDXMDAFPINTHSGWTDLMDMRAGLTPPTNPIDNPSNSILRDKHRLDGDCECA

SEQ ID NO: 165705 - protein, 73 aa, Heterodera glycines
  Coding regions on vcDNA: vcDNA=SeqID_92128; Strand=+; Position=3-224
LYPPFLLLFSTIFSLFPILSYIAHKWPNNSIFSINLPFFSSILLQIIYINFCFHFIHSFFHPHHLCRIHLLIS

SEQ ID NO: 165706 - protein, 186 aa, Heterodera glycines
  Homolog annotation: Hit_ID=AAP30754.1; Match level="QueryCoverage =100%, HitCoverage=100%, E-value=1e-102, Identity=99%"; Hit description=putative gland protein G11A06 [Heterodera glycines]
  Coding regions on vcDNA: vcDNA=SeqID_92129; Strand=+; Position=28-588
MSSSPSVSVLAIVAIVCLMCQCCFSAPHPCCPGSQKVVSLMSNYVGTFANSISKSSLCSDAQNVADALKGQLIGCSNGGDRTLLADIEASLASHSADECAHSLGFVRAMFAIAASASSHASNNSEWQALSTQFVQKVTEIDSKCAEFGISIGKVPIDGPKGDHSQRNVPSTDSVISMPGLTGSHQH

SEQ ID NO: 165707 - protein, 119 aa, Heterodera glycines
  Coding regions on vcDNA: vcDNA=SeqID_92130; Strand=+; Position=2-361
FLFKVDLIRQLKTDIELLNAPTTSPGSALLTPNASTRTRESAAQGTAKRTQNNAQQQQLQIPNAKNSPSFFVFPSPAAQTKNFQKTQREGRKSSSVSAAENGQMDERRSLLDGSMEFTV

SEQ ID NO: 165708 - protein, 97 aa, Heterodera glycines
  misc_feature (48)..(48): Xaa can be any naturally occurring amino acid
  Homolog annotation: Hit_ID=CAE72295.1; Match level="QueryCoverage =98%, HitCoverage=28%, E-value=2e-22, Identity=50%"; Hit description =Hypothetical protein CBG19425 [Caenorhabditis briggsae]
  Gene Ontology: Cellular component=extracellular space; Biological process=lipid metabolism
  Coding regions on vcDNA: vcDNA=SeqID_92131; Strand=+; Position=2-296
EHFFQLENELGLENVGICLVVFADNSNNTWRVQAIPVSDVSSFDNRIXILWRGHRDDQLEKESGIEGAIFVHANGFIGGTKSLEGAMRMAEETLKMN

SEQ ID NO: 165709 - protein, 100 aa, Heterodera glycines
  Coding regions on vcDNA: vcDNA=SeqID_92132; Strand=+; Position=62-364
LTQLNSELTFVSEQKEVLENAMKIGFDVPNLCRDVYRRFKDKHNFGQNVAREALRKAAEELILAWKWLAFCETETVWDAIIEANFLLRKFFCEFFLTEII

SEQ ID NO: 165710 - protein, 210 aa, Heterodera glycines
  Coding regions on vcDNA: vcDNA=SeqID_92133; Strand=+; Position=12-641
MRKKRSGVHTPNSICEKEQKKPKIGNESAEVCHFQAEKFVGEYCTVHTRPSLTVKALSFNSSIGRLCVIRQNESTVSQQFPSQLSLVEFYNADNLPLIFLEKSIPVNDRFETLVWVDNWAVFGGLGGRLTALSPFTSKFGRVQLCVSDILVMTRAGENHQFVAGNTSGELLVVNNRDFDEEGKCTNKVPTFSTVQTIKLSTDEHITAIGC

SEQ ID NO: 165711 - protein, 215 aa, Heterodera glycines
  Homolog annotation: Hit_ID=CAE59500.1; Match level="QueryCoverage =97%, HitCoverage=46%, E-value=4e-60, Identity=53%"; Hit description =Hypothetical protein CBG02886 [Caenorhabditis briggsae]
  Gene Ontology: Mol. function=GTP binding; Biological process=Rho protein signal transduction
  Coding regions on vcDNA: vcDNA=SeqID_92134; Strand=+; Position=2-646
DDLLTPTEADGSFSFKNIPSTEMTKSFLERDNFESELGATQQDDPFGEDFCDISSNEIIDVFADGDLAGRPVIVFYAHRLPSNKNFDHYKFLRFIQFTLDKIVDSDYTIIYFHYGLRSNNKPPLKWLIQAYQLLDRRYKKNLKALYLVHPSRFIRFLWAVFQPLISFKFEQKMHYVNSLNELNSIISIVTLNLPEPIIRYDRSLHSATSNTVFDH

SEQ ID NO: 165712 - protein, 148 aa, Heterodera glycines
  misc_feature (59)..(59): Xaa can be any naturally occurring amino acid
  misc_feature (93)..(93): Xaa can be any naturally occurring amino acid
  Homolog annotation: Hit_ID=CAB88203.1; Match level="QueryCoverage =100%, HitCoverage=49%, E-value=1e-38, Identity=53%"; Hit description= putative cuticular collagen [Globodera pallida]
  Coding regions on vcDNA: vcDNA=SeqID_92135; Strand=+; Position=2-445
TLLVLGIASLCSLLAMILTCIFLWSVYSEMSFMNNLVRHRLEAFRVYTDYGWNDLLDLXVVVTTASTLRDNPFNSIFSAICSLSGHCWCAQAXQPTCPPGPPGALGLPAQTGQLVGIRLPGEPAETGQPAPPWAHLNIPCTTCPAETP

SEQ ID NO: 165713 - protein, 81 aa, Heterodera glycines
  Coding regions on vcDNA: vcDNA=SeqID_92136; Strand=-; Position=1-243
MPSVALSWAKVNLPLLVRRSLPSACAMSTLATTILSAFGSCGCCSSSTDCCWGGAACCGCCLACGGGGGGGIFQTFLALSN

SEQ ID NO: 165714 - protein, 126 aa, Heterodera glycines
  Coding regions on vcDNA: vcDNA=SeqID_92137; Strand=-; Position=5-385
PTLLLPPPPPLPGPGAGAAHRQTSCQCSAPGAQLSTRAPRRRGRPRPPSSSSSSSSPPRRPALRARRGRCSSSTPSSSTSSSSSSSSWAGGGAPPNKLAMLSARRAAFHSRPCSASLSCSSSLSAM

SEQ ID NO: 165715 - protein, 186 aa, Heterodera glycines
  Homolog annotation: Hit_ID=AAP30770.1; Match level="QueryCoverage =96%, HitCoverage=70%, E-value=7e-60, Identity=64%"; Hit description =putative gland protein G17G01 [Heterodera glycines]
  Coding regions on vcDNA: vcDNA=SeqID_92138; Strand=+; Position=93-650
MEKKIVYFKLVQIVLTLAFIWQLLSLHQFCGTFADPKAFIHDISVGHCKRFTLIGKESKSGEFGAVFDQDKWQNQLSMSSTNGRPIEEQQHQFMDELAAKLPSAGRHCIPITISLFDWIGKDRNLLNNGTLLFFSLLLWAAFWSLLPLGIATIIVLHSVEGFPVYVCAFGSIYFWCVSAAVSPICC

SEQ ID NO: 165716 - protein, 207 aa, Heterodera glycines
  Homolog annotation: Hit_ID=NP_501998.1; Match level="QueryCoverage =99%, HitCoverage=42%, E-value=9e-81, Identity=70%"; Hit description =6-phosphogluconate dehydrogenase (53.2 kD) (4L541) [Caenorhabditis elegans] emb|CAA94380.1| Hypothetical
  Gene Ontology: Mol. function=electron transporter activity; Cellular component=cytoplasm; Biological process=pentose-phosphate shunt
  Coding regions on vcDNA: vcDNA=SeqID_92139; Strand=+; Position=2-622
TLIAEAGFARCLSALKKQRMDASKLLPKPSKKASDLVKDSKKFLNSIGSALYASKVVSYAQGFMLMAEASREFDWNLNYGAIALMWRGGCIIRSRFLDRIQNAFEKNPSLVNLLLDDFFMKAIGDAHDSWREVISTAVQLGIPMPAFSSALAFFDGYRTEALPANLIQAQRDYFGAHTYELLAQAGVAVHTNWTGRGGKVTSNAYSG

SEQ ID NO: 165717 - protein, 94 aa, Heterodera glycines
  Homolog annotation: Hit_ID=XP_521593.1; Match level="QueryCoverage =98%, HitCoverage=24%, E-value=5e-20, Identity=52%"; Hit description =PREDICTED: similar to Alpha-centractin (Centractin) (Centrosome -associated actin homolog) (Actin-RPV) (AR
  Gene Ontology: Cellular component=microtubule associated complex; Biological process=reproduction
  Coding regions on vcDNA: vcDNA=SeqID_92140; Strand=+; Position=2-283
CVGRLKQVRATAGALKGDVSNGPKAQEHRGRLSLKYPTEHGSATDWNDMEKGRQDIFFFQHQRAKPSEQPVSLTEARLNTRTPREKRGETIYET

SEQ ID NO: 165718 - protein, 121 aa, Heterodera glycines
  Homolog annotation: Hit_ID=XP_314924.1; Match level="QueryCoverage =77%, HitCoverage=70%, E-value=1e-11, Identity=37%"; Hit description =ENSANGP00000012377 [Anopheles gambiae]
  Gene Ontology: Mol. function=zinc ion binding; Biological process =nonselective vesicle transport
  Coding regions on vcDNA: vcDNA=SeqID_92141; Strand=+; Position=275-637
MTSSETSAEKIGTEKGQQQTEFSREEEVTADGRNIRPVLCPHCPSVILRPLSANFLSSADGPRIALPLPRQKKRADEGGDEAVQTTEHSQWWTLTDMMQFENVGFTNAFRGRRFLACADCE

SEQ ID NO: 165719 - protein, 205 aa, Heterodera glycines
  Homolog annotation: Hit_ID=NP_501005.1; Match level="QueryCoverage =99%, HitCoverage=45%, E-value=9e-54, Identity=50%"; Hit description =TraB determinant (4H346Co) [Caenorhabditis elegans]
  Coding regions on vcDNA: vcDNA=SeqID_92142; Strand=+; Position=15-629
ERQALTRQKILTIIRENGLAQGLLQVLLLSLSAHITQQLGMAPGGEFRAAHAASKLVPGCGVILGDRPLNVTLQRALSALNIFQRMKFFFHLTVSLGMEIDEAEVERCKNMDMLEEMLQQMAGEFPQVSRILVDERDQYMTQVLHSLLQRSTMEKLYASKKCNAPFEPANVVAVVGMGHVAGIRANWTKHIDSTSLLTVPRPSMK

SEQ ID NO: 165720 - protein, 117 aa, Heterodera glycines
  Homolog annotation: Hit_ID=NP_495161.1; Match level="QueryCoverage =97%, HitCoverage=14%, E-value=7e-28, Identity=49%"; Hit description =mitofusin 2 (87.5 kD) (2G124) [Caenorhabditis elegans] gb|AAC71095.1| Fzo (fzo mitochondrial fusion prote
  Coding regions on vcDNA: vcDNA=SeqID_92143; Strand=+; Position=1-354
VAGLYAFERLRWNNGAKEERLKTQFRQHLEQRLHQTESIHTSSCEQQVTRELDQVYEGLKTVVGGFHREMKEGIDQCKCQKDSLEGIVKSINTIKNKTNFVGSTLDEFSRRFLNAFF

SEQ ID NO: 165721 - protein, 209 aa, Heterodera glycines
  Homolog annotation: Hit_ID=NP_492295.1; Match level="QueryCoverage =99%, HitCoverage=29%, E-value=2e-18, Identity=26%"; Hit description =bactericidal Permeability Increasing Protein like family member (1J22) [Caenorhabditis elegans] emb|CAB02
  Coding regions on vcDNA: vcDNA=SeqID_92144; Strand=+; Position=3-629
TINSMLYHMHRIGFFVIKIGPDTPAVGRLMRLTCESGDEDVFLDDHGVEDENGTVIFRKRSRMSRRRTKRQEEEEEDLVQTMIDTGICIRSLLPAAADEYPDEKVDLTMSTMRAPSVSIYKNSTIILEHIAKLEFYGHTNKKKLGTFKATSVAQIDVKTEGDLIKANLTLPTLVLTDIGTDIKSGMTQDGLDSLTGLVKDKVPESANKK

SEQ ID NO: 165722 - protein, 48 aa, Heterodera glycines
  misc_feature (43)..(43): Xaa can be any naturally occurring amino acid
  Homolog annotation: Hit_ID=CAA55240.1; Match level="QueryCoverage =100%, HitCoverage=12%, E-value=5e-17, Identity=81%"; Hit description= actin related protein [Drosophila melanogaster] pir||S47988 actin -related protein ARP87C - fruit fly (Dro
  Gene Ontology: Cellular component=microtubule associated complex; Biological process=cell organization and biogenesis
  Coding regions on vcDNA: vcDNA=SeqID_92145; Strand=+; Position=2-144
IDNGSGVVKAGFAGEQSPKCVFGNFVGRPKHVRVMAGALEGDXFIGPK

SEQ ID NO: 165723 - protein, 164 aa, Heterodera glycines
  misc_feature (42)..(42): Xaa can be any naturally occurring amino acid
  misc_feature (79)..(79): Xaa can be any naturally occurring amino acid
  misc_feature (113)..(113): Xaa can be any naturally occurring amino acid
  misc_feature (149)..(149): Xaa can be any naturally occurring amino acid
  Homolog annotation: Hit_ID=CAB88203.1; Match level="QueryCoverage =98%, HitCoverage=82%, E-value=7e-35, Identity=47%"; Hit description =putative cuticular collagen [Globodera pallida]
  Gene Ontology: Biological process=reproduction
  Coding regions on vcDNA: vcDNA=SeqID_92146; Strand=+; Position=2-495
SLYSEMSQMNSTVRDGVEAFRVNTDSAWTDLMDVQVVVTPRXKPRDNPFTHLSCQSHCPDLPVRLASTAKCPPGPPGPXAPGNPEKPVREENPRKPGKLGKPVFFSPPKNSPXPFPGCPPGRPPRKGGPPKKRGAPVKNCYPPLKGGGXGKPLGGPGPPGKTWR

SEQ ID NO: 165724 - protein, 188 aa, Heterodera glycines
  misc_feature (102)..(102): Xaa can be any naturally occurring amino acid
  Coding regions on vcDNA: vcDNA=SeqID_92147; Strand=-; Position=11-577
INKWFCVLGLSVLPFFLFRWPFSLSLGQILLLLLTDCPLNLHLAVLQLRSHLRQMSQNLLLAFCVAFQIQRTILGSPAIERLWRLRSADVAAGADERRRRHXAHPPPNSAATPAAVAWSASGDCAAAAARCCRLGTARHDGRATAVPKNAAGEPRKRRHWHGVMGRPKIAVGRAERRRIRCLRSSNCC

SEQ ID NO: 165725 - protein, 106 aa, Heterodera glycines
  misc_feature (14)..(14): Xaa can be any naturally occurring amino acid
  misc_feature (72)..(72): Xaa can be any naturally occurring amino acid
  misc_feature (88)..(88): Xaa can be any naturally occurring amino acid
  Homolog annotation: Hit_ID=CAB88204.1; Match level="QueryCoverage =100%, HitCoverage=35%, E-value=1e-20, Identity=44%"; Hit description= putative cuticular collagen [Globodera pallida]
  Coding regions on vcDNA: vcDNA=SeqID_92148; Strand=+; Position=2-320
DGVKVVPVNADSAXTDLLDLMMDVTPPPKTHGDSFNSTLHTKRHLNGHWHCTGLPTPRCLPRMPGPTESTGXPRLPGRPGQPGPCGLXAHQHLSCPLRNRPCPACP

SEQ ID NO: 165726 - protein, 157 aa, Heterodera glycines
  Coding regions on vcDNA: vcDNA=SeqID_92149; Strand=+; Position=3-476
AGQTPLASQCHPPQIPRRNSFQLITIRNIVEGLRNASEPISTSQEKLSRYPCEDEAKTLLCCALPPALPSPSLRPLPSHFQLFSQPSPDQLPTTISDLSRTTTPQIVEPKNEEEAKESDQQKQKGTGNSRESEGTEKKQSIGGLMGDNGQTTQKTKH

SEQ ID NO: 165727 - protein, 73 aa, Heterodera glycines
  Coding regions on vcDNA: vcDNA=SeqID_92150; Strand=-; Position=321-542
IERRRGGTFPIKLRFSPFLMKLHHAYKIYHFHFISRDVSRDTPHSKVVGGFSCCKSACMLLFYFLCLIPGCLC

SEQ ID NO: 165728 - protein, 146 aa, Heterodera glycines
  Homolog annotation: Hit_ID=CAA65474.1; Match level="QueryCoverage =96%, HitCoverage=47%, E-value=4e-29, Identity=48%"; Hit description =collagen [Globodera pallida]
  Coding regions on vcDNA: vcDNA=SeqID_92151; Strand=+; Position=2-439
RIGFRIASVCSLVVIIFTDLDQPSLDSEISQMNRQLRDGFDVFRGNTDSGSTNLTYVELVLTPPSKPPDNPDNSFVRGKRTMPETGHCAGRLPPSRPSGSPGPSRPTRQLGRPGCARQPEKTVLAGQTSPPCRSHSLACSRCPSAP

SEQ ID NO: 165729 - protein, 201 aa, Heterodera glycines
  Coding regions on vcDNA: vcDNA=SeqID_92152; Strand=+; Position=2-604
LSLVDPPFYSLLCSLLMFPPLPYYIARRCSSASSSSSSSPIALFSAASPPTLRPPALANARPPHHHQQQRLAEKAGTTVLLLHGGEPRTNFYARAHLGRVLVDRLAVPNWVGMLIADFYFACSAFPARCIADSVHFPQNVDQLNWLRLRLERALALLLPEFGPFRCLPATGQAEDQTNVGRQLHSAIRHGMDNLLLFPLQP

SEQ ID NO: 165730 - protein, 181 aa, Heterodera glycines
  Homolog annotation: Hit_ID=NP_506146.1; Match level="QueryCoverage =71%, HitCoverage=45%, E-value=3e-19, Identity=41%"; Hit description =putative protein, with 2 coiled coil-4 domains (5N52) [Caenorhabditis elegans] emb|CAB02877.1| Hypothetic
  Gene Ontology: Mol. function=actin polymerizing activity; Cellular component=vesicle membrane; Biological process=endosome transport
  Coding regions on vcDNA: vcDNA=SeqID_92153; Strand=+; Position=18-563
MTLISKCSLLLLFVAPFSHAFFSGFEVSPNAARLRRQCGCGGCPPPPSGGGSVQLGISCDSPRPPPPPPCCGCQSSCGCGGGGGGGCGGGCGGGAIKLTIGCDSPRPPPPPPCCGCGCGCGCGGCPPPPSGGGSVQLGISCDSPPPPPSCGCQPSGGCGCNRRKRMAFLRRAVAQRSVGRH

SEQ ID NO: 165731 - protein, 211 aa, Heterodera glycines
  Coding regions on vcDNA: vcDNA=SeqID_92154; Strand=+; Position=1-633
QTEPEEKPKTFAFGLQTDQTGLIDSEMQTVSEEKPKTVTFAMQTVQTDLVNSEMQTLSEEKPKMTNDEVLELNVSKLPMDDSSFLSNQGRSSPLLDESLRRKYNEKCEEMAELRHAYEFQQSIISNQLDEIARLKQQQQLRNGVQKNGSPSSTRHPTITAAASPSSVFPSGALPTISGRPRAARRTYCEHCEMFDAHDSSECPKEEAKRAE

SEQ ID NO: 165732 - protein, 72 aa, Heterodera glycines
  Coding regions on vcDNA: vcDNA=SeqID_92155; Strand=+; Position=227-445
YCGFWNGKKETIWGGSDRISKLCCFILLAVPTRFVPFVMLQNPFSIQYQKAFSVGLIKLILFFISFGRINTD

SEQ ID NO: 165733 - protein, 193 aa, Heterodera glycines
  Homolog annotation: Hit_ID=NP_505734.1; Match level="QueryCoverage =79%, HitCoverage=37%, E-value=1e-42, Identity=52%"; Hit description =protein phosphatase (pph-1) [Caenorhabditis elegans] pir||T18936 phosphoprotein phosphatase (EC 3.1.3.16)
  Gene Ontology: Mol. function=protein serine/threonine phosphatase activity; Cellular component=chromosome; Biological process=sodium ion homeostasis
  Coding regions on vcDNA: vcDNA=SeqID_92156; Strand=+; Position=66-644
MEDYCFDATAAAAAEQSRRQSGAASDLVQGDGLSSGFLDAIITKVNRSPPHRFTDEISDDEIRQLCKAATDVFRMQPTLVRIHPPAVIVGDIHGQFADLKKIFSTHGLPPEQQYVFLGDYVDRGPQSLETIILLFCYKVKYPSNFMLLRGNHECANINRVYGFYEEIDRRYPRTGARRLFDLFNQVFAWMPFV

SEQ ID NO: 165734 - protein, 211 aa, Heterodera glycines
  misc_feature (193)..(193): Xaa can be any naturally occurring amino acid
  Homolog annotation: Hit_ID=CAG32688.1; Match level="QueryCoverage =80%, HitCoverage=39%, E-value=7e-28, Identity=37%"; Hit description =hypothetical protein [Gallus gallus]
  Coding regions on vcDNA: vcDNA=SeqID_92157; Strand=+; Position=2-634
KVIILLISQYFCYSFYVLRVLVSARPNIKFGFHFSLCFPFCHLLANVPCILCSNFSAHWRALRQWVDRKTGRPNFEFLKSKFGTESVPILIGTDICPTQMPFSSFIDEYFGFSPTDNETKNKVAYLKDWHFQNSHPEESDLYELPAFLRFDWANYERWTVTDQQQNPFGGDYRFGYFGTKGSWTPFHSDVLNXFSWSANVCGRKVWYLLRP

SEQ ID NO: 165735 - protein, 170 aa, Heterodera glycines
  Homolog annotation: Hit_ID=CAE59214.1; Match level="QueryCoverage =90%, HitCoverage=15%, E-value=2e-38, Identity=50%"; Hit description =Hypothetical protein CBG02527 [Caenorhabditis briggsae]
  Coding regions on vcDNA: vcDNA=SeqID_92158; Strand=+; Position=120-629
MPTSTTTPLLPRSSCSTYRIAPNRYSDEEIPESPETSPDEEFGSMLKPDDWVGGAGSGATATRRMKTGQKLISWVDRIAHTKYFREASELKLIRKMMEEISSMRLLLNVQVTMLEGRMCCNFPPPPSDRLWYAFRTSPRMSVKAVPQVGDRSVELSLVSEWIENKLQLIL

SEQ ID NO: 165736 - protein, 213 aa, Heterodera glycines
  Coding regions on vcDNA: vcDNA=SeqID_92159; Strand=-; Position=1-639
LLIIIGVVQIIINVFIVIIFPIIVGIVIRIMTVIGLKGEHIRQLIRTVADLLAQHLKHAFVLPPLRVDHPAFPCAVFFGCILQVDMFTPFEEIARVQGEILICENATTQLQQNANLCLCAAFGKRCENVVHKLGDHFSKMVQKTLVFARTKFEENFDVNGFNLGARNEQRMEQIVPIHRFCIGSAKAIVEMTEQTTEPNCEFLHPIGCARTNW

SEQ ID NO: 165737 - protein, 161 aa, Heterodera glycines; identical to SEQ ID NO: 140016
  Homolog annotation: Hit_ID=Q99LR1; Match level="QueryCoverage=91%, HitCoverage=38%, E-value=5e-33, Identity=42%"; Hit description =Protein C20orf22 homolog
  Coding regions on vcDNA: vcDNA=SeqID_92160; Strand=-; Position=2-602

SEQ ID NO: 165738 - protein, 210 aa, Heterodera glycines
  Coding regions on vcDNA: vcDNA=SeqID_92161; Strand=+; Position=1-630
DRRTTAEEGTEKAATNSSSSKSFKSRKPPPSASIRVVCATFVNHWRSRVGGAGLLLLLLQFLWVPPYLCFANYLERCLLPLRVYCYNAPDLLAVRTPLRVGPAACATHFFANNAAHWAQRHSKQRFPSPNSTCSLNGTLPVLLRPWRAIADNESSIQRIIVIRSAPRASEYRKYIRDSWKPAVERLNGPVVFVSGRDGTELAEENGQHGD

SEQ ID NO: 165739 - protein, 153 aa, Heterodera glycines
  misc_feature (131)..(131): Xaa can be any naturally occurring amino acid
  misc_feature (144)..(144): Xaa can be any naturally occurring amino acid
  Homolog annotation: Hit_ID=CAB88203.1; Match level="QueryCoverage =100%, HitCoverage=50%, E-value=2e-44, Identity=60%"; Hit description= putative cuticular collagen [Globodera pallida]
  Coding regions on vcDNA: vcDNA=SeqID_92162; Strand=+; Position=2-459
VLGIASECSLLDIISTCIALPYLYSEMTPMNKKVRDRFEAFRVNTDSLCTDLMDVQLVLTPSSNPPDNPFKSIFHAKHQLTGQCQCTGSHNSEDVPLALPGPNRPSGQSGESGGGRQPGQAAQPEQPAPPXPAQNIPCPRMPCXGPPGRPGGQ

SEQ ID NO: 165740 - protein, 89 aa, Heterodera glycines
  Coding regions on vcDNA: vcDNA=SeqID_92163; Strand=+; Position=1-270
FRSLSISKCSPSVSSLSFCCWPSFAFPSSSAVSSALVPLPLKPLGAASSAKSPPIAREVPFTADFPPSAEHTDLADRKRRIWIRILLDY

SEQ ID NO: 165741 - protein, 139 aa, Heterodera glycines
  misc_feature (36)..(36): Xaa can be any naturally occurring amino acid
  Homolog annotation: Hit_ID=NP_509045.1; Match level="QueryCoverage =86%, HitCoverage=32%, E-value=1e-37, Identity=59%"; Hit description =heat shock protein (43.2 kD) (hsp-43) [Caenorhabditis elegans] gb|AAA80366.1| Heat shock protein protein
  Gene Ontology: Mol. function=chaperone activity; Cellular component =cytoplasm; Biological process=muscle contraction
  Coding regions on vcDNA: vcDNA=SeqID_92164; Strand=+; Position=2-418
SSPSDHFHHNWFDYPFWRDLYWRWAEPIFEDGIHVXTNITNDSNRFAVEMETYQFRPEELQVKTMDDTLLIEGRHKNVRDRYNYTKMYFVRKNEMPANVETHSISSHIHSSGRLSVEAHKRWQAMECKRSIPINSGSRR

SEQ ID NO: 165742 - protein, 165 aa, Heterodera glycines
  Homolog annotation: Hit_ID=CAE64421.1; Match level="QueryCoverage =99%, HitCoverage=38%, E-value=6e-53, Identity=59%"; Hit description =Hypothetical protein CBG09115 [Caenorhabditis briggsae]
  Gene Ontology: Mol. function=ornithine-oxo-acid aminotransferase activity; Cellular component=mitochondrial matrix; Biological process=ornithine metabolism
  Coding regions on vcDNA: vcDNA=SeqID_92165; Strand=+; Position=2-499
KMLCCEHDGVRPDIVTLGKALSGGLYPISAVLADDEVMLTIRPGQHGSTYGGNPLACQIAIEALKVIEDEKLCENAEKMGTILMDELQKLPKQKVKSARGKGLLCAIELDNGIDAWQMCLRLMDNGVLAKQTHEHTIRFAPPLVINEKDTRTVAKIIGRTLNAFD

SEQ ID NO: 165743 - protein, 73 aa, Heterodera glycines
  misc_feature (54)..(54): Xaa can be any naturally occurring amino acid
  Homolog annotation: Hit_ID=CAB88203.1; Match level="QueryCoverage =100%, HitCoverage=24%, E-value=8e-21, Identity=68%"; Hit description= putative cuticular collagen [Globodera pallida]
  Coding regions on vcDNA: vcDNA=SeqID_92166; Strand=+; Position=2-220
QETHVVLGIASVCSLLAIITTDITLPSLNSEMSHMNTTETDRLEAFRVNTHSLXTDLMDVQMVMTPPSNPRDN

SEQ ID NO: 165744 - protein, 207 aa, Heterodera glycines
  Homolog annotation: Hit_ID=AAL78214.1; Match level="QueryCoverage =74%, HitCoverage=80%, E-value=1e-18, Identity=32%"; Hit description =putative esophageal gland cell protein Hgg-20 [Heterodera glycines]
  Coding regions on vcDNA: vcDNA=SeqID_92167; Strand=+; Position=27-647
MSSEILWSTVFLLLVDCATILFWFFFGHVKKRRRPHKNEIFICGDCWLLVFDFLAPSQLGLEIALVNRRFNCIVDEHFKTRKWKLGCMRICHKIGENGTKQLQIVNSDAKPLPIPQNPLPNKVLGFRHIQIHYIDQNVIAFLRRFHRRIFDVCSMVLYIHTDNDRILDYFLLNIWPMFRHSMRLMNLNSISLRRLRQLAGPSLLSDC

SEQ ID NO: 165745 - protein, 18 aa, Heterodera glycines
  Coding regions on vcDNA: vcDNA=SeqID_92168; Strand=-; Position=1-54
QQPPPYSNCPGPQLLISP

SEQ ID NO: 165746 - protein, 201 aa, Heterodera glycines
  Homolog annotation: Hit_ID=S35098; Match level="QueryCoverage=26%, HitCoverage=83%, E-value=2e-10, Identity=50%"; Hit description =trypsin inhibitor - pig roundworm sp|P19398|ITR1_ASCSU Trypsin inhibitor (ATI) pdb|1ATE|  Trypsin Inhibitor (P
  Coding regions on vcDNA: vcDNA=SeqID_92169; Strand=+; Position=34-636
MPRPLPPHLLALRFFLCFCCSANFLQLLLQLVLAPHFVSAFSASQRDCQVNELFIECGTCEGSCREPIITNCRKECKPPRCECRAKLGYVRAHDGACVPFSECATYKGTSLAKEGTRPLTGGVNANKEQKEMHSQLRNEGKEAVALPPSIRPPSASLHHSTKQHKLQDQVIQVGPSPPVIVRPSGQSHPVGTSHMNLFADL

SEQ ID NO: 165747 - protein, 137 aa, Heterodera glycines
  Coding regions on vcDNA: vcDNA=SeqID_92170; Strand=-; Position=74-487
MLPLLSLDEEDNDEAEEEEAVKESTRGPTPTVLSTIRSIWMSRSSAHGKVSLFVSSLPFSLFGSNEASFRESSSFSSDCCCFCCSVCVAVSPFSEGGNGHPKLKHLVNAWRSRSKVSNSNSRQQLGPASKVYASRVP

SEQ ID NO: 165748 - protein, 148 aa, Heterodera glycines
  Homolog annotation: Hit_ID=NP_783594.1; Match level="QueryCoverage =71%, HitCoverage=83%, E-value=1e-22, Identity=47%"; Hit description =histone 1, H2ba [Mus musculus] emb|CAI35973.1| OTTMUSP00000000673 [Mus musculus] gb|AAO06249.1| histone p
  Gene Ontology: Mol. function=DNA binding; Cellular component =nucleosome; Biological process=nucleosome assembly
  Coding regions on vcDNA: vcDNA=SeqID_92171; Strand=+; Position=46-492
FLRKPTVAHVQQQRHFQQHRTKMARRRRKKEPRKVSYKLYVRRVLKEVHPGKEISMRALNIMNSFVIDALDRIATEATRMAHYDRRKTVTLRDMEFSCRLCLPDIMAKHANQKAQKTVTKFYAAKVRDRMRRTELRRGEFAMMQMAAM

SEQ ID NO: 165749 - protein, 187 aa, Heterodera glycines
  Homolog annotation: Hit_ID=AAP30770.1; Match level="QueryCoverage =100%, HitCoverage=72%, E-value=4e-29, Identity=41%"; Hit description= putative gland protein G17G01 [Heterodera glycines]
  Coding regions on vcDNA: vcDNA=SeqID_92172; Strand=+; Position=63-623
MRKFAYFKLCQAVLTSVFLWQILSTHQFCGEFDEPTAFFNSAVSSSHCEQFTLIGMDSTTGEYGAMPDKQKWHMQLMASSGSGQPIDEQQQNHMDEFSSKLPTVGRHCIPIAFSLVKPWVRDNKSHLQKVADLFAIQLLCGLLSLFVIAMHVLDQPRSWGYESIDYERTTFCAVLWCCPALVSSVLL

SEQ ID NO: 165750 - protein, 97 aa, Heterodera glycines
  Coding regions on vcDNA: vcDNA=SeqID_92173; Strand=+; Position=283-576
PFSLHLANFSDSSFCHLAVTQMPCWTGIPLANERKPSAAAAADLFIFCSFSFQIFQLAYDAANEAFDIYLFKLYLNLYIILSQQNVMFCYAQHKFLF

SEQ ID NO: 165751 - protein, 106 aa, Heterodera glycines
  Homolog annotation: Hit_ID=CAB88203.1; Match level="QueryCoverage =100%, HitCoverage=35%, E-value=2e-42, Identity=74%"; Hit description= putative cuticular collagen [Globodera pallida]
  Coding regions on vcDNA: vcDNA=SeqID_92174; Strand=+; Position=2-319
QETHIVLRIASVCSLLAIIDTVITLPSLYSEMSQMNNKLRNGLEAFRVNTDSAWTDLMDVQVVLTPPTKPRDNPFNSIFSTKHKLPGHCQCAGLQHPSCPPGPTSP

SEQ ID NO: 165752 - protein, 128 aa, Heterodera glycines
  Coding regions on vcDNA: vcDNA=SeqID_92175; Strand=+; Position=142-528
RNNNCHPHAILKFPHRFFRIIFAQNGQFVGHAFPRRPLPFQCFIFAVSHCHGFSLPRCFFAEFGHCSVECLFRGEHLHLCADAFAAAAHFAHFPYLPQLPSQCLLSHFVHKWRHRLTSVGPVTHLRRA

SEQ ID NO: 165753 - protein, 202 aa, Heterodera glycines
  Homolog annotation: Hit_ID=BAA23764.1; Match level="QueryCoverage =98%, HitCoverage=93%, E-value=2e-79, Identity=69%"; Hit description =cyclophilin G [Tachypleus tridentatus]
  Gene Ontology: Mol. function=cyclosporin A binding; Cellular component=cytoplasm; Biological process=signal transduction
  Coding regions on vcDNA: vcDNA=SeqID_92176; Strand=+; Position=1-609
IFASIINITQSNDAEKPKGPKVTEKVYFDIKIGDESVGRIEIGLFGKTVPKTVENFVELAKKPKGEGYAGSVFHRVIKDFMIQGGDFTKGDGTGGKSIWGEKFPDENFKLKHYGAGWLSMANSGKDTNGSQFFITCKKTTWLDGRHVVFGKVLSGMSVVRRIEATKTLGGDRPEKEVTIAAAGQIPVETPFSVHKEDSRDEL

SEQ ID NO: 165754 - protein, 209 aa, Heterodera glycines
  Homolog annotation: Hit_ID=XP_313575.1; Match level="QueryCoverage =87%, HitCoverage=56%, E-value=1e-71, Identity=69%"; Hit description =ENSANGP00000013498 [Anopheles gambiae]
  Gene Ontology: Mol. function=GPI-anchor transamidase activity; Cellular component=integral to endoplasmic reticulum membrane; Biological process=proteolysis and peptidolysis
  Coding regions on vcDNA: vcDNA=SeqID_92177; Strand=+; Position=9-635
MVIYFLFSLFLYSSLVPSFSLADSLSDFFSRSTHTNNWALLVCSSRFWFNYRHVANVLSLYRSLKRLGMPDSNIILMLSDNIPCNARNPSPASIFNNAFAHQNLYLEDTEVDYRGYEVTAESVVRILTGRTHTDTPRNKRLLSDSQSNVLIYLTGHGGDGFLKFQDSEELTNVDLADAIETMHQQNRYNELLLIADTCQSESMYQRVYS

SEQ ID NO: 165755 - protein, 78 aa, Heterodera glycines
  Coding regions on vcDNA: vcDNA=SeqID_92178; Strand=+; Position=3-239
WSIKKKILLKMSKQFLLLALLLLLLPIGTLQECSWDVDLCTGSCSTGCEQLSEPNCFCGKEFKPFIRENPRHLKSAVN

SEQ ID NO: 165756 - protein, 151 aa, Heterodera glycines
  Homolog annotation: Hit_ID=NP_503987.1; Match level="QueryCoverage =64%, HitCoverage=24%, E-value=1e-09, Identity=34%"; Hit description =nuclear receptor NHR-116 family member (5E8) [Caenorhabditis elegans] gb|AAC17795.2| Hypothetical protein
  Coding regions on vcDNA: vcDNA=SeqID_92179; Strand=+; Position=37-492
MCSKFRSMMANSEIEVKLPSNIVPLRELQRYPAYNNDLVAQKMARFLFVNMMEPFSRTKLSLDEFLLLRAILICHPGAPNLSRPAQKLLQSESERYACILLHFLQLKHGCFAGASRYAEIMQVVESMLHSQSKQFAYLGHLADVMLEAPKE

SEQ ID NO: 165757 - protein, 207 aa, Heterodera glycines
  Coding regions on vcDNA: vcDNA=SeqID_92180; Strand=+; Position=1-621
KRRRFPSRVQIIYLLCPALALILSITQALTIHVTVTESIYTVRFLLVKLLGVLLEVNRAGRFSIEQYFECEFFNDDDIVKPPCAGQIHDSVLSKSTMTVVMTIHVIPIVIFIYLLVRNLKSDKLEHLFLYIESVGTDLSAMPGEYGDAEKGGYGKMTHGAYSSQEQQTLKETLNDLLLGFNAKFMPKRVFCDSMSKQQKVNGSNSSS

SEQ ID NO: 165758 - protein, 134 aa, Heterodera glycines
  Homolog annotation: Hit_ID=CAE74225.1; Match level="QueryCoverage =82%, HitCoverage=12%, E-value=4e-13, Identity=33%"; Hit description =Hypothetical protein CBG21909 [Caenorhabditis briggsae]
  Coding regions on vcDNA: vcDNA=SeqID_92181; Strand=+; Position=2-406
PKERVCYDNHECCAVWATKGACKSAPRYMNTWCPGACRYDGCLPQAVKRAAGLDYYSQCKRWSIFHEKYSHAEGWRSYRPNLVLRREKLRNECERNPHWMACNCPQACSKVKRLKEDCSQNMPKDYVLEPVDNS

SEQ ID NO: 165759 - protein, 105 aa, Heterodera glycines
  misc_feature (43)..(43): Xaa can be any naturally occurring amino acid
  misc_feature (54)..(54): Xaa can be any naturally occurring amino acid
  misc_feature (86)..(86): Xaa can be any naturally occurring amino acid
  Homolog annotation: Hit_ID=CAB88204.1; Match level="QueryCoverage =94%, HitCoverage=33%, E-value=1e-18, Identity=45%"; Hit description =putative cuticular collagen [Globodera pallida]
  Coding regions on vcDNA: vcDNA=SeqID_92182; Strand=+; Position=2-319
VSAIASSCSLVAIICTDGALPCLYSQIRQMINTWRYVLQVFRXAPTRGWTDLMXLTLVLTAPAKLRHHPFTSLWQDLHQLPRFCRXAGLQQPTCPPGAPASHTDP

SEQ ID NO: 165760 - protein, 190 aa, Heterodera glycines
  Homolog annotation: Hit_ID=CAF96120.1; Match level="QueryCoverage =54%, HitCoverage=29%, E-value=4e-15, Identity=43%"; Hit description =unnamed protein product [Tetraodon nigroviridis]
  Coding regions on vcDNA: vcDNA=SeqID_92183; Strand=+; Position=1-573
LEGDPAKRGIIPNAAQQIFDEIEGRREQARRSGKVIPSLEVSAQFIELYNEELIDLLSPDRGSSSIKIMENPTSHEILLMGASSRIVKSQEDIMSALVIGAQNQTTAQLQRKYAALETRVREYETELENGREQMERAKRYIVDQENRPEKDARRTLLKLAEMFESPIPTTSNVARLRKQFDDDDNDADDN

SEQ ID NO: 165761 - protein, 216 aa, Heterodera glycines
  Coding regions on vcDNA: vcDNA=SeqID_92184; Strand=+; Position=1-651
EIYNHWLNDMRQWDEEYPSLEFIEKKSKELVTVLSEPPRGPPVDVIRLATIEAERENSTKLLKKLKEWQEEQKVGNAMHQPFPPPRQPFYPPSRPIRFPHWPFHHDPSRPRPHLMYGRSVGYHPYANQFHRPMTQARMRSPFCYGTSQPFGLYRYPRNIPANSASNFQPEALKNSALKKSQSAMEWTTNRPAPYFPRNDYAAFSTSQVGNARGTWF

SEQ ID NO: 165762 - protein, 215 aa, Heterodera glycines
  Homolog annotation: Hit_ID=NP_496555.1; Match level="QueryCoverage =96%, HitCoverage=36%, E-value=2e-45, Identity=45%"; Hit description =ash2 -like (64.5 kD) (2M277) [Caenorhabditis elegans] emb|CAA19449.1| Hypothetical protein Y17G7B.2a [Cae
  Gene Ontology: Cellular component=nucleus; Biological process =positive regulation of transcription of homeotic gene (trithorax group)
  Coding regions on vcDNA: vcDNA=SeqID_92185; Strand=+; Position=1-645
QPFYSHVRVGWAQANAILQASLGYGKFGYSWRSKRGTVFHDAYGKHFHGRDFRQGDVIGCLIVLPSPEEIAAQGLAPSDVMPASRKDCDLIKFKQTYFFEEKDEPQQAQQRLKPLQGSKIEFFLNGDSVGVAYEDIFFGHYFPAISLFQSARVRFNFGPKFRHAPPAIRKGTAQPMSARPEQQQVEQALADAVFMTVNVEELVQRNEDYFAALAA

SEQ ID NO: 165763 - protein, 195 aa, Heterodera glycines
  Homolog annotation: Hit_ID=CAE64562.1; Match level="QueryCoverage =92%, HitCoverage=9%, E-value=3e-36, Identity=46%"; Hit description =Hypothetical protein CBG09312 [Caenorhabditis briggsae]
  Gene Ontology: Mol. function=zinc ion binding; Cellular component =nucleus; Biological process=growth
  Coding regions on vcDNA: vcDNA=SeqID_92186; Strand=+; Position=2-586
ADAHQSLSRESAQCNKNAHQILHKVLTQLEELLNDMKSDVSRLPTTLARLRPVTERLGMTERAILGRLTSKDPDALAGQSPLPPPGPFVTPMAQSRFSGIQPKFAALLKPKHQSKKENLPEKDGNDKQNQEETRPSKEEKRTDADVEKTSDRSTKEAEGSCKEEAEPVQDDTVKEDSTVEEKTKDSDLSSVQQPN

SEQ ID NO: 165764 - protein, 158 aa, Heterodera glycines
  Coding regions on vcDNA: vcDNA=SeqID_92187; Strand=-; Position=104-580
QNWPVADPSLLSDQSPRFCSLRPKWASNAVPFRAQFRLVPPTTMPPFSLPLRAPFLLPPSPQFAISLRFPLRHPRNLPFAPQAHFANGPKWRPRVAFRAMIRFHPPIVDHHFPHHCPHNCCLQKCIGSNFAICRVPTKELRSFFATKSSAFHPWHKLC

SEQ ID NO: 165765 - protein, 200 aa, Heterodera glycines
  Homolog annotation: Hit_ID=NP_502813.1; Match level="QueryCoverage =90%, HitCoverage=37%, E-value=2e-25, Identity=34%"; Hit description =putative cytoplasmic protein of bilaterial origin (49.4 kD) (4P789) [Caenorhabditis elegans] emb|CAB09005
  Coding regions on vcDNA: vcDNA=SeqID_92188; Strand=+; Position=37-636
MDVIEYESPREQTEISANLLSDFGVTAQQAYKIAVTFYKNEEKANPVSIDYLYKLRFMALSKQAKYGTYREEVADCGWFDIMGNEAKKTWKRISDLTSEQAMLEFVRLLDVVCPSFRAQLEIERKAKTNEPNQKATIDNPSKDSNGQSKNDCHLNVLVDSASIRAQEVLEQFEQQKRQIQEALNKQTYHQFLAYAQQTHP

SEQ ID NO: 165766 - protein, 85 aa, Heterodera glycines
  Homolog annotation: Hit_ID=NP_741391.1; Match level="QueryCoverage =97%, HitCoverage=14%, E-value=7e-31, Identity=78%"; Hit description =suppressor Of Clr SOC-2, SUppressor of activated let-60 Ras SUR-8, Ras-binding leucine-rich repeat protei
  Coding regions on vcDNA: vcDNA=SeqID_92189; Strand=+; Position=1-258
RIGENLLTFIPEEIGHLENLKSLYLNDNPNLHSLPFELVLCSSLEIMSIERCPLSQIPSDIIEGGPSLVIQYLKMHGPYRGVLNM

SEQ ID NO: 165767 - protein, 219 aa, Heterodera glycines
  Homolog annotation: Hit_ID=NP_666115.2; Match level="QueryCoverage =52%, HitCoverage=9%, E-value=2e-10, Identity=32%"; Hit description =SUMO/sentrin specific protease 6 [Mus musculus]
  Coding regions on vcDNA: vcDNA=SeqID_92190; Strand=+; Position=1-657
IHWYLAIIVNVRHGICSLNTTDNESIFPTSSHYSPVPHLIVLNSLIDPAEDKHLAVRDQLGEYLHLEYADKLGQDTKTYFNKQMMDVVVPTMLPQQKNFIDCGLFLLHFAQLFLSNPPKFISRHSSFRRWYPTFKIKHKRDELRSVIMQLASHVKSSDFVQLPTPKRKNKKIGRRSQVDKMQMILDGMALMGRTRRYSDSELDGIMKDEHFSCLYRPRS

SEQ ID NO: 165768 - protein, 47 aa, Heterodera glycines; identical to SEQ ID NO: 153004
  Coding regions on vcDNA: vcDNA=SeqID_92191; Strand=-; Position=1-141

SEQ ID NO: 165769 - protein, 140 aa, Heterodera glycines
  Homolog annotation: Hit_ID=NP_386245.1; Match level="QueryCoverage =92%, HitCoverage=89%, E-value=2e-26, Identity=46%"; Hit description =HYPOTHETICAL TRANSMEMBRANE PROTEIN [Sinorhizobium meliloti 1021] emb|CAC46718.1| HYPOTHETICAL TRANSMEMBRA
  Coding regions on vcDNA: vcDNA=SeqID_92192; Strand=+; Position=2-424
LVPNSARGAFTGAALYINLVEQPSRLQLETAAALKQFKESYTRAIPMQAGLAILSGIVGIGGTIKTGEKAWAFGAALMLANIPYTFLCIFPVNKRLLATNEANADENTRADIQRWGRLHAVRTVLGLIATGVYLYAVSKE

SEQ ID NO: 165770 - protein, 96 aa, Heterodera glycines
  Homolog annotation: Hit_ID=EAA53912.1; Match level="QueryCoverage =100%, HitCoverage=33%, E-value=2e-23, Identity=60%"; Hit description= hypothetical protein MG09875.4 [Magnaporthe grisea 70-15] ref|XP _365030.1| hypothetical protein MG09875.4
  Coding regions on vcDNA: vcDNA=SeqID_92193; Strand=+; Position=2-289
GVLATTPRDGTRRNPFQQDASIIRDREIQSGQVGPCGRTLAGGNNNMQSGVQEILSEFGELPLVAPGSALTMTVHQVNADGAGPYTCEVSMDGTGA

SEQ ID NO: 165771 - protein, 181 aa, Heterodera glycines
  Coding regions on vcDNA: vcDNA=SeqID_92194; Strand=+; Position=33-578
MKVDKFLDKLSRKLSSSSLCFCPAINYCDANFGYHRKASTNERQKEEAAEGAADEADQCSHISIPVQYRKHSSTSETSSLYDQIVEAEVENEETMTETFWVRRQQQHQLVQATIFPISKPFARGTIRMAKMPKRGSSKKRRNSFPAGIFNERFTDDLVSVQLTISEFNMAKKCEALKNMKQ

SEQ ID NO: 165772 - protein, 215 aa, Heterodera glycines
  Homolog annotation: Hit_ID=AAM80487.1; Match level="QueryCoverage =95%, HitCoverage=25%, E-value=2e-32, Identity=36%"; Hit description =endo-beta-N-acetylglucosaminidase [Homo sapiens]
  Coding regions on vcDNA: vcDNA=SeqID_92195; Strand=+; Position=3-647
TIDRLIASLVDCCVVFKFDGWLINIESEVNSDSVDYLEYFLFSLRNALHDNVHKDAKIVWYDSVTTDGKLSWQNALNANNLRWFKSVDAFYTNYAWKEEHIQQTVRTFLSTSELFPRKSLFDVFVGIDVFGRGCLGDGGWNCVQPMEILRRYALSVAIFAPGWICEKFSGQSHRILFDNSFRFWNSLSTFLYPHALRQRNFRTDFAVAFASERPN

SEQ ID NO: 165773 - protein, 220 aa, Heterodera glycines
  misc_feature (142)..(142): Xaa can be any naturally occurring amino acid
  misc_feature (180)..(180): Xaa can be any naturally occurring amino acid
  Homolog annotation: Hit_ID=AAK68509.3; Match level="QueryCoverage =55%, HitCoverage=14%, E-value=4e-25, Identity=42%"; Hit description =Squashed vulva protein 6 [Caenorhabditis elegans] gb|AAO85277.1| xylosyltransferase [Caenorhabditis elegan
  Gene Ontology: Mol. function=peptide O-xylosyltransferase activity; Biological process=glycosaminoglycan biosynthesis
  Coding regions on vcDNA: vcDNA=SeqID_92196; Strand=+; Position=1-661
VAFILLLLDRKLSTEFRDFLGENWQYEDGTTDRLAKSAQNRIQSTACKVQLRNFLHDIAFKRHWPVKEIAKNCDDLFEVPSAANALKFRPFSPGTSHVKILFLLQLNGRDSRQLRRLFRSLFLPRHFYFVHVDSRREFMLKXEESLRAEGFANFRVAKRRMATIWGGSNLLDLFLWTVAXTLGETNSNWAQWDYIVNLSETDMPILSVEELEQNLAENRG

SEQ ID NO: 165774 - protein, 94 aa, Heterodera glycines
  Homolog annotation: Hit_ID=NP_494893.1; Match level="QueryCoverage =93%, HitCoverage=26%, E-value=3e-26, Identity=61%"; Hit description =small glutamine-rich tetratricopeptide (36.5 kD) (2F192) [Caenorhabditis elegans] gb|AAA83170.1| Hypothet
  Gene Ontology: Mol. function=protein binding
  Coding regions on vcDNA: vcDNA=SeqID_92197; Strand=+; Position=2-283
KNATNSLKSNEFEEAILKYSKTVTLNRDPIFFGHRACAYCRLEQYDLPIQYCPTALALDPNYAKAYWRMGVALSCQNPYHCACDAYNKVLELDP

SEQ ID NO: 165775 - protein, 189 aa, Heterodera glycines
  Coding regions on vcDNA: vcDNA=SeqID_92198; Strand=+; Position=11-577
TMEVDVSSSSDSATNVLFSLRADRSLLDPTFDRYILRTEKLAMFKRRMDDKIRFKLPSDSQWGYQQIRAHTLASHLFFDHFASSVDQQLFFAFLDDLRLISFTFDRTSNRWSVPVQVADIGTSSVALSPSFVFVSEDDASSQSFPESLHFVDSRTAITARGLNTFSVWDTGERRPTDWTTQKWRGMFHY

SEQ ID NO: 165776 - protein, 160 aa, Heterodera glycines
  Coding regions on vcDNA: vcDNA=SeqID_92199; Strand=+; Position=7-489
MMSSSSFEQLSCEIAELEKLRQQSQLPNVQKAIDELIGRWKVKKEEQKMKTDKGTAETLSAPTEAPKLISGSVHVRPTKKLTTYAFDESDKFVKLYYSLPGISDSVPGTISTDFRGKLFSIVCSTSRGLTTKIQCKDFGRVFEPEKLVGNQKTVTNGYFA

SEQ ID NO: 165777 - protein, 86 aa, Heterodera glycines
  Coding regions on vcDNA: vcDNA=SeqID_92200; Strand=-; Position=221-481
SDKHSEGLGKYCNSHLCIFCFSILSVWDDEDTLISAAVPVSSEEKLEESAMHTSGQLNADLALSDSDEEQLMCAKKPKLDDFDASL

SEQ ID NO: 165778 - protein, 144 aa, Heterodera glycines
  Coding regions on vcDNA: vcDNA=SeqID_92201; Strand=-; Position=77-511
CPSESTSNQQLLRRTSFSSACSYFIIFHLSLSKCDCFLMSKMPSLNSSLNRPKVSAKLNRPIAFRRPFPFTCRLHCLPLGYCVRFPRVPKSPPIRRFSISRRSTTVSSLQVATPTFASVPRSCPSVSFPLPILRPSILRRRVLW

SEQ ID NO: 165779 - protein, 212 aa, Heterodera glycines
  Homolog annotation: Hit_ID=EAA09691.2; Match level="QueryCoverage =89%, HitCoverage=67%, E-value=1e-54, Identity=56%"; Hit description =ENSANGP00000013225 [Anopheles gambiae str. PEST]
  Coding regions on vcDNA: vcDNA=SeqID_92202; Strand=+; Position=14-649
MSSIPILSSFSRALQMRQHPLLFGMIHVPALPGSPLSKLSIAQLVDRVSAETEIYAECGIDGVIVENMHDLPYQKGIDHGPEVCATMARLCAACAHTLGANRRPKMLLGVQILAGANRAALAVAQAAEFDFVRAESFVFGHVADEGWMDGCAGELLRYRRAIGADQIAVVTDIKKKHCSHAITADVSVAETARAAELFLADGVILSGAATGE

SEQ ID NO: 165780 - protein, 215 aa, Heterodera glycines
  Homolog annotation: Hit_ID=CAE73908.1; Match level="QueryCoverage =100%, HitCoverage=48%, E-value=1e-97, Identity=78%"; Hit description= Hypothetical protein CBG21516 [Caenorhabditis briggsae]
  Gene Ontology: Mol. function=Rab GTPase activator activity; Cellular component=Golgi apparatus; Biological process=synaptic vesicle fusion
  Coding regions on vcDNA: vcDNA=SeqID_92203; Strand=+; Position=2-646
LYSDSLARYGKSPYLYPLYGLGELPQGFARLSSIYGGTYMLDKPVDEIVIENGKVVGVRSGGEVAKCKQLYCDPSYVDSTRVKKLGKMVRAICILNHPIPNTNDAPSCQIIIPQKQVGRSFDIYVSCVSNSNQVTPKPWFIATVSTTVETENPEAEIQPALQLLGPIFEKFVTISDLYEPVDMGYESQIFISRSFDATTHFETTCLDVLDIFKRG

SEQ ID NO: 165781 - protein, 169 aa, Heterodera glycines
  Homolog annotation: Hit_ID=NP_497689.1; Match level="QueryCoverage =52%, HitCoverage=41%, E-value=1e-39, Identity=85%"; Hit description =v-ral simian leukemia viral oncogene homolog like (3E405) [Caenorhabditis elegans] gb|AAF59545.1| Hypothe
  Gene Ontology: Mol. function=ATP binding; Cellular component=membrane fraction; Biological process=small GTPase mediated signal transduction
  Coding regions on vcDNA: vcDNA=SeqID_92204; Strand=+; Position=130-636
MDQAKQCLSRFWHWLRIRLIALWTFLKWVGHEICCCGICLQEEDDVEKGRTKNPFDQQVTISTTAMSAGTQNATGQGHVHKVIMVGSGGVGKSALTLQFLYDEFVENYEPTKADAHRKQVVLDGEYCAVDILDTAGQEDYSAIRDNYYRSGEGFICVFSITDLDSFDQL

SEQ ID NO: 165782 - protein, 215 aa, Heterodera glycines
  Homolog annotation: Hit_ID=AAD37247.1; Match level="QueryCoverage =80%, HitCoverage=43%, E-value=4e-11, Identity=34%"; Hit description =chimeric AFGP/trypsinogen-like serine protease precursor [Dissostichus mawsoni]
  Coding regions on vcDNA: vcDNA=SeqID_92205; Strand=-; Position=0-644
ATAAARGLTAAGRRGRRGVAADAELDRATAAGGRRAPAATAAAPATAARRGRWRGFWAFAANCQLNGTAAAAAAICTITATTTSAAAAAPATAARRGRRRAWGVAANCQFNGTAAATAATSAATAATAAARRLTTAARRGRRRARRVAADAELDRATAAGRRRAPAATALPTETCRVGRNLKAGEKRMGKGRDEKEEKRTFANEGHLDKGKHKLG

SEQ ID NO: 165783 - protein, 109 aa, Heterodera glycines
  Coding regions on vcDNA: vcDNA=SeqID_92206; Strand=-; Position=83-412
MIPGQCSQTLCTLPGFTTYLGSSHSVATRVSLINAARENSPGSLPEEEKCKRKRSNKKEEESRRRKRERERERERKIRVRGKTDRKETDRAECGERERERDGSNTAYTA

SEQ ID NO: 165784 - protein, 207 aa, Heterodera glycines
  Coding regions on vcDNA: vcDNA=SeqID_92207; Strand=+; Position=1-621
IKTNLARQRFLEALIVSSRGTSTKKSDAGNKKLRTLISVRSLRELVNRMVGNDKVATDKSESDCKQQSSVFPYLLALHSAIDFYSILDEKFTDCISTDDQPIAEIEACVKHLSQIQCDRTNPLLAKALSILEFVYDNSGSSAIASSLLNIAKCRLELNDFVGFFNLNLYQTFDNNAQVGTPITAKYDENNLSTKIPTNLLAKLGATL

SEQ ID NO: 165785 - protein, 119 aa, Heterodera glycines
  Coding regions on vcDNA: vcDNA=SeqID_92208; Strand=+; Position=6-365
MHFSSVLLLLLVNFVLLLLLRPSVDAFPHPPPWAGPPRPWGWGQRPWGGGGWRRRHHGRGRGDSGSSERGGGRWRGRNRGDDSSEEKHRGSKYQQPQQNAQSVAVAIAVAGGATGNAAG

SEQ ID NO: 165786 - protein, 136 aa, Heterodera glycines
  Homolog annotation: Hit_ID=AAC06352.1; Match level="QueryCoverage =83%, HitCoverage=28%, E-value=8e-24, Identity=51%"; Hit description =SH2/SH3 adaptor protein [Mus musculus]
  Gene Ontology: Mol. function=phospholipid binding; Cellular component= vesicle membrane; Biological process=axon guidance
  Coding regions on vcDNA: vcDNA=SeqID_92209; Strand=+; Position=2-412
PPSVPSSSLSPVPPSPRPNSYIDSSDWDQLTGPYARQPWYYGHITREQSDTLLKTRGVEGDFLVRDSESKPGDFSISLKDSAKNKHFWVQFDAASAQFIIGNRRFESMEKLILNYMSSPIFSDGIVNLFLRKPLPK

SEQ ID NO: 165787 - protein, 216 aa, Heterodera glycines
  misc_feature (148)..(148): Xaa can be any naturally occurring amino acid
  Homolog annotation: Hit_ID=NP_495983.1; Match level="QueryCoverage =100%, HitCoverage=50%, E-value=3e-33, Identity=37%"; Hit description= WD40- FYVE-domain containing protein 2 (46.2 kD) (2J611) [Caenorhabditis elegans] emb|CAA87770.1| Hypoth
  Coding regions on vcDNA: vcDNA=SeqID_92210; Strand=+; Position=2-649
SVINQNPSVTKTSNVGENARMELAQKIEGQITGRIDGIRLLEREDGLLVVNEDRTLRVLLKPESEMFWPSIIHDLPHIPTKLTCSEQKNTILVGFANGQIHEYSIENYFNNISFTRQWNSHTQSISGLGSSQPLEQIVSCSKDKTVGXQCTSTTRKIASYCTGTPCTTLQFNGHASIDFVGDSSRDMSVLRLVVGTQHLPLLINTLSAHTAAITDL

SEQ ID NO: 165788 - protein, 167 aa, Heterodera glycines
  Coding regions on vcDNA: vcDNA=SeqID_92211; Strand=+; Position=111-611
MRELLFKTANQEQHTFTLEVEENETIAQIKQKIEDRFGLAFEADEQVLFYNGRELDDALTVDNLNIEAPNFIVVFVMNDLVGADEGEMLVQPMHMNDHPAAAQAGYVNDHAAHHHHHHHHQHHQQQQQNGMLIDHNVWQQILAPVQQLVQLTAQDYPAIRRLMALGF

SEQ ID NO: 165789 - protein, 30 aa, Heterodera glycines
  Coding regions on vcDNA: vcDNA=SeqID_92212; Strand=+; Position=2-91
PMESDPSVPSADGLPNRPINSRDDVTQLIA

SEQ ID NO: 165790 - protein, 212 aa, Heterodera glycines
  Homolog annotation: Hit_ID=CAE71172.1; Match level="QueryCoverage =99%, HitCoverage=7%, E-value=1e-53, Identity=50%"; Hit description =Hypothetical protein CBG18029 [Caenorhabditis briggsae]
  Gene Ontology: Mol. function=protein kinase A anchoring activity; Cellular component=cytoplasmic vesicle; Biological process=eye photoreceptor cell development
  Coding regions on vcDNA: vcDNA=SeqID_92213; Strand=+; Position=1-636
VASGSADCTVVLWHFSQHLGLLVGDYNMPGEEPSPRAILTGHDSEISAICVSAEHGIVLSGSTDGALLMHSTQGDLLRSIICSNGNGTDTLAPINNILFSRDCYIAAFIGNDSLATFSTNGQLLKQRGYKCAEKILCAILSRDGEFVVFGTDNGRISILRLFTLQLLYTFAQCDSPIRSLALSTNQRLIFGGLDSGAIVVFNVDFNRWHHYG

SEQ ID NO: 165791 - protein, 207 aa, Heterodera glycines
  Homolog annotation: Hit_ID=NP_502437.1; Match level="QueryCoverage =100%, HitCoverage=17%, E-value=1e-100, Identity=82%"; Hit description=UNCoordinated locomotion UNC-31, EGg Laying defective EGL-22, Ca2+-dependent activator protein for secr
  Coding regions on vcDNA: vcDNA=SeqID_92214; Strand=+; Position=3-623
LKGTLSLLERVLMKDVVSPVPPEEVRAVIRKCLEDAALVNYTRICNEAKIEQRMGLDVSPQQRIEDMIRVTELCIDLLKENEEHHGEAFAWFSDLLADHSEIFWSLYSVDLDAALELQPPDSWDSFPLFQLLNDYLCIDQNLRMGIFHSKLISQFSPMVVRYIDLMEHSISQSIEKNFCREKWEVRKDGCSTSEDVFWKLDALHAFI

SEQ ID NO: 165792 - protein, 60 aa, Heterodera glycines
  Homolog annotation: Hit_ID=XP_127049.3; Match level="QueryCoverage =100%, HitCoverage=16%, E-value=3e-10, Identity=51%"; Hit description= alkB, alkylation repair homolog [Mus musculus]
  Coding regions on vcDNA: vcDNA=SeqID_92215; Strand=-; Position=2-181
RSEIDLRRPLVSLSFGQSAVFLIGGRTPDLPVDALLLRSGVVLVMADFQRIAFHAVPRIL

SEQ ID NO: 165793 - protein, 106 aa, Heterodera glycines
  Homolog annotation: Hit_ID=AAQ82688.1; Match level="QueryCoverage =98%, HitCoverage=9%, E-value=8e-10, Identity=42%"; Hit description =Epa4p [Candida glabrata]
  Coding regions on vcDNA: vcDNA=SeqID_92216; Strand=+; Position=24-656
MAPSQMVKSSQSHTDGFCQLLHHQSRPPCASSSSSASSSGYASMALSASSSSSASSSSSACCCAENRLFLCSPQQRGLTFPSPIRPSGECSSSSSSSASSSASSSS

SEQ ID NO: 165794 - protein, 104 aa, Heterodera glycines
  Homolog annotation: Hit_ID=CAE73615.1; Match level="QueryCoverage =99%, HitCoverage=16%, E-value=6e-29, Identity=57%"; Hit description =Hypothetical protein CBG21105 [Caenorhabditis briggsae]
  Gene Ontology: Mol. function=structural constituent of cytoskeleton; Cellular component=cytoskeleton; Biological process=cytoskeletal anchoring
  Coding regions on vcDNA: vcDNA=SeqID_92217; Strand=+; Position=2-313
GKPLRVNVTTMDADLNELIIERDSLGQHLFHTVCKIIGLREIWYFGLCFTNRKGFTCWLQMDKRIKDPSVPKQEDGSLHFLFLVKFFPESVNVELIQDLTRHLY

SEQ ID NO: 165795 - protein, 213 aa, Heterodera glycines
  Coding regions on vcDNA: vcDNA=SeqID_92218; Strand=+; Position=1-639
ASPYPKRLLEHLDQSTSEGAASPSADNESPAKRPMKAFGQIWPIASAGRPSTTTPTRWSKSARRLLPIHERGSPCDAPESVQKAQSSDNKSDQSENNSNDKQQHVDEQLEKLPRMDEQQKDDEIVLVGSANVCVVLPEEEANENRHQQKRDFEQPNETISNDSDKTATDLGTVSKESEENAVQSEAMFHKKLTTDNKSETFERIKNKLDEQQE

SEQ ID NO: 165796 - protein, 191 aa, Heterodera glycines
  Homolog annotation: Hit_ID=NP_495793.1; Match level="QueryCoverage =100%, HitCoverage=46%, E-value=7e-31, Identity=36%"; Hit description= gamma Butyrobetaine Hydroxylase (gbh-2) [Caenorhabditis elegans] pir||T23737 hypothetical protein M05D6.
  Gene Ontology: Mol. function=oxidoreductase activity, acting on single donors with incorporation of molecular oxygen, incorporation of two atoms of oxygen; Cellular component=mitochondrion; Biological process=carnitine biosynthesis
  Coding regions on vcDNA: vcDNA=SeqID_92219; Strand=+; Position=1-573
QRRSDCTNLFAGATLADDCYPIHFDADRQRLTLSWADGHESAFGVRELLSWAMFSQKHYGEEWEAGAECPSRSLWDARGLREVPSVSSSEFDFALFARLFIRFGVVSVSGVNSRDERATHELCETVSTIFGTIFGQFWTFGTGLDTQNEMESHDDTAYGSEAIGPHTDGTYLDQPPGIQVFHCLRPAPRGG

SEQ ID NO: 165797 - protein, 121 aa, Heterodera glycines
  Coding regions on vcDNA: vcDNA=SeqID_92220; Strand=+; Position=227-592
RRLWHGWKGFAFCASAKSAAGAAGTNDHHPHESRRNVADITCYKCGEKGHYANRCTKGILAFLSNTATASDQQREQPRDNQQKKYAGGEGGRKRKMTDRKISIDILFCKFICCYFPLSEKN

SEQ ID NO: 165798 - protein, 161 aa, Heterodera glycines
  Coding regions on vcDNA: vcDNA=SeqID_92221; Strand=+; Position=43-525
MSLLFVVSMFVDGCAILWSYWDRFKKPKKKIFISADCWLCVFDLLAPSQLGLGISMISHRFDYYVDEHFKTRKWTLKSIRIRRKIGKNGTKQMAIVNYDWKPLPIPKIRMPRKVIGFKSIRILFIDRNAIAFLRHFCQIFAVCPINLSIHTDNDDYRILEF

SEQ ID NO: 165799 - protein, 213 aa, Heterodera glycines
  Homolog annotation: Hit_ID=CAE59915.1; Match level="QueryCoverage =96%, HitCoverage=42%, E-value=2e-77, Identity=65%"; Hit description =Hypothetical protein CBG03400 [Caenorhabditis briggsae]
  Gene Ontology: Mol. function=4-aminobutyrate aminotransferase activity; Cellular component=intracellular; Biological process =nitrogen metabolism
  Coding regions on vcDNA: vcDNA=SeqID_92222; Strand=+; Position=2-640
SVLGFNGSFHGRTLGVLSITRSKPIHKVDIPAFDWPVANFPRYLYPLDENRQYNTEQDERCLAQVSQLIDTQKSAGRDIAAVIVEPIQCEGGDHNGSAQFFRGLQEICQDNGVFFIVDEVQTGGGICGTFWAHEQWNLPTSPDFVTFSKKTLLGGYFYKDELRVNEPYRIYNTWMGEPTKLVLLEKVVEVIGRENLVQKTGQIGAKLLDGLKA

SEQ ID NO: 165800 - protein, 218 aa, Heterodera glycines
  Homolog annotation: Hit_ID=NP_508085.2; Match level="QueryCoverage =100%, HitCoverage=28%, E-value=8e-65, Identity=53%"; Hit description= glutamate carboxypeptidase ii homolog family member (85.5 kD) (XA925) [Caenorhabditis elegans] gb|AAU055
  Gene Ontology: Mol. function=peptidase activity; Cellular component =integral to plasma membrane; Biological process=proteolysis and peptidolysis
  Coding regions on vcDNA: vcDNA=SeqID_92223; Strand=+; Position=1-654
IWGSERPDEWVMLGYHFDAWVFGAIDPNSGTAVLAEVAKGLAQTVRTTGWRPKRTIVFCAWDAEEPGLIGSTEFVEEFADVLRERAVVYLNVDNISSNVTLNIHAVPSLYQAAVDASKSVQNPNGQGSVFGPWIENYPSRTSWLPDFPHMGIPGGGSDQKSFLDFLGIPVMMITYIDPKRGQYPLYHTRYELPFVHEHLFDNNQLAVHKARGEYWAEL

SEQ ID NO: 165801 - protein, 161 aa, Heterodera glycines; identical to SEQ ID NO: 165798
  Coding regions on vcDNA: vcDNA=SeqID_92224; Strand=+; Position=43-525

SEQ ID NO: 165802 - protein, 95 aa, Heterodera glycines
  Homolog annotation: Hit_ID=NP_509566.1; Match level="QueryCoverage =87%, HitCoverage=18%, E-value=5e-16, Identity=45%"; Hit description =GLYcosylation related, UDP-N-acetylglucosamine:a-3-D-mannoside b-1,2- N-acetylglucosaminyltransferase I (5
  Coding regions on vcDNA: vcDNA=SeqID_92225; Strand=+; Position=348-632
IPKEGSPSGQTVWKQPIAILVFVCNRLEAAKTHLQKLIRFRRDRKELFPIIVSQDCDNDSLQRMIRNEFGNEVQHIKHSSSESEHLKPPREHRQF

SEQ ID NO: 165803 - protein, 181 aa, Heterodera glycines
  Coding regions on vcDNA: vcDNA=SeqID_92226; Strand=+; Position=1-543
LTNGTVSAPGTDKQLSLEEAVLRKDRIHRKGFFLLVWACLLCYLLSYLPGASAEQGTVEALHTRWEPEAIGPITFSDINYDYEDYGQTTEEPPTTTPPPPSTTSPPPTEPEPPSATTPNPTVPTPTWCPVVITGLAALVVLLCLCLCCCPSVPQSVANWCRRFVHRFCTCAGEGLPRTTAQ

SEQ ID NO: 165804 - protein, 167 aa, Heterodera glycines
  Coding regions on vcDNA: vcDNA=SeqID_92227; Strand=+; Position=54-554
RKMAANISEKDEALSDLNCLFVQMKNKKFSFSLMSKVAQKFGDGGVAAKVLLPYEVYKEAVDLLASARFEIDYRVVIHFLPTFKAIFLHLSFDDWQLAMERFFEITELRQTHRGFPREEMHTLSHSYSLALLENANFNKETERTSEFLFTDYGDLANFIDNCFECQC

SEQ ID NO: 165805 - protein, 161 aa, Heterodera glycines
  Homolog annotation: Hit_ID=CAE74663.1; Match level="QueryCoverage =100%, HitCoverage=25%, E-value=2e-24, Identity=36%"; Hit description= Hypothetical protein CBG22464 [Caenorhabditis briggsae]
  Coding regions on vcDNA: vcDNA=SeqID_92228; Strand=+; Position=2-484
LPSRLLRVQLHKFCEPIVRMRYPKLVENVIDTLMELINEGGAPSDPITVFQFVGLFRGKSFVAFVENISHEAWINSNLASGHLSSIQTVMDPLRGVPVVPPLESLRHIALVLSSEETTQSATSSIEKYFRKASSDLRTDLAACFLCLLEHKKTLTRCGACR

SEQ ID NO: 165806 - protein, 176 aa, Heterodera glycines
  Homolog annotation: Hit_ID=AAH77284.1; Match level="QueryCoverage =98%, HitCoverage=64%, E-value=1e-21, Identity=31%"; Hit description =MGC80090 protein [Xenopus laevis]
  Coding regions on vcDNA: vcDNA=SeqID_92229; Strand=+; Position=1-528
VFGKFKYSTNIDYSLGSLGHEEISCNYIDLSYIRVNSPELVSEFDGKISIFVDAVDRTVSDGYFLTGSASISAACAAPSQREGRIYGIDRWETLFPVQIKLEFYQRRKRQWLIPEDTAPWEVWELQLNLVRTLSNEDFFRMREFTAEKLSDIVFHICELINKPQYLPKIPSQPEIS

SEQ ID NO: 165807 - protein, 212 aa, Heterodera glycines
  Coding regions on vcDNA: vcDNA=SeqID_92230; Strand=+; Position=1-636
KQRIDTLIEMERQMHEDDQSIEENNIDTIELSLGELRSDFPNGFAVDWQKLFNAIVPDRNFTASSTVLLVAQKMNGRTERQTPLDVMAEYMRNFGPKNDTLNKWEQYVEWLLILQHAALSDNKIFHRIFRRHPRSANAMMSALLVNKYFFERHDDEQYIRDGTSEERRVAQIRHNCLEQLKHFFPEYVDRMFALGLNDAIEEEAKTVLDNVK

SEQ ID NO: 165808 - protein, 163 aa, Heterodera glycines
  Homolog annotation: Hit_ID=CAE63259.1; Match level="QueryCoverage =88%, HitCoverage=50%, E-value=4e-22, Identity=40%"; Hit description =Hypothetical protein CBG07631 [Caenorhabditis briggsae]
  Coding regions on vcDNA: vcDNA=SeqID_92231; Strand=+; Position=47-535
MEFLYAETFPLSFSLDPFKKGWFERVAPCSLLAFFVNKNALMMFKGGQISQRNVFPPGVNRNFHFCHFCQSNPPPRFFHCPVCNFGVFRRDHHCSFTVSWVGHFNQRYFVAAVLNLRPVVFSCCVRNWHALLLPFSPISLPDFLKWVFPQMVLLFRFFSFHHF

SEQ ID NO: 165809 - protein, 209 aa, Heterodera glycines
  Homolog annotation: Hit_ID=CAE60710.1; Match level="QueryCoverage =90%, HitCoverage=43%, E-value=1e-11, Identity=29%"; Hit description =Hypothetical protein CBG04378 [Caenorhabditis briggsae]
  Coding regions on vcDNA: vcDNA=SeqID_92232; Strand=+; Position=4-630
MSNFIIMSQIPWEKIKYFFVFLLSLIFLFITYKNYGFLYDNSALFRFTYTENNSVTISPEECCGENMVYTLKMNDSRIIRGKKFNCSLTWLLERYKLSDKYAIKEKIEVKYPGHPKFVFVTAANNHYYPYLRTFIANIKEKFGCKQKIIAYDLGTVTKNKEWMNELDSVCNFEWRIFDFGQMVEGRVRHPKSYAWKMFVMAHVLLEYDT

SEQ ID NO: 165810 - protein, 139 aa, Heterodera glycines
  Coding regions on vcDNA: vcDNA=SeqID_92233; Strand=+; Position=5-424
MRSEVPAPHALGRSRSLADVFRSNSRYAESQFSPTVVPIGMPSKPISVHRPYFTYSAYWPYRYHRNFNTYDNQITDSFYWHYPFRLWTSYKHNWYQYDSPYYYRRYHDNYNIFYNTELMSYGNRSKLMENLYQGTPITQ

SEQ ID NO: 165811 - protein, 126 aa, Heterodera glycines
  Coding regions on vcDNA: vcDNA=SeqID_92234; Strand=+; Position=1-378
RWWASMERNGRVLPLCGVPPSKGMARTRWRTWRRRTQRIWTWGSRWTWQLRQRTTHGTHAPLRNRDKELRRQFSEEGRNVESVFRNFKPFLFFALLSHPRPSGRPSSYSSKISFLFQLPIFMTFPP

SEQ ID NO: 165812 - protein, 101 aa, Heterodera glycines
  Homolog annotation: Hit_ID=CAE74212.1; Match level="QueryCoverage =86%, HitCoverage=43%, E-value=2e-22, Identity=58%"; Hit description =Hypothetical protein CBG21894 [Caenorhabditis briggsae]
  Coding regions on vcDNA: vcDNA=SeqID_92235; Strand=+; Position=1-306
GICVGLAINKSLCAGIVFNPITDELYTAIEGKGALKNGFPISVSSAKALDQSVICQTFGQHNIKEKGEKWLDNAFGNLRSAVLSGTHGYVSSFLSHQFHDH

SEQ ID NO: 165813 - protein, 66 aa, Heterodera glycines
  Homolog annotation: Hit_ID=CAB88204.1; Match level="QueryCoverage =96%, HitCoverage=21%, E-value=6e-16, Identity=59%"; Hit description =putative cuticular collagen [Globodera pallida]
  Coding regions on vcDNA: vcDNA=SeqID_92236; Strand=+; Position=38-235
ARNGAKDFRANTDSACTDLMDWRTGVRPPPNPRDNPITSIFRAKLLLPGCCQCAGLLHSSCPPGPP

SEQ ID NO: 165814 - protein, 197 aa, Heterodera glycines
  Homolog annotation: Hit_ID=NP_501552.1; Match level="QueryCoverage =100%, HitCoverage=73%, E-value=8e-47, Identity=51%"; Hit description= agpet8 (29.0 kD) (4J697) [Caenorhabditis elegans] emb|CAA92291.1| Hypothetical protein D1046.3 [Caenorha
  Gene Ontology: Mol. function=transporter activity; Cellular component= mitochondrial inner membrane; Biological process=mitochondrial transport
  Coding regions on vcDNA: vcDNA=SeqID_92237; Strand=+; Position=3-593
GFRASGGFRNIYRGAPAVAVGSAPGSALFFITYCNGKEMLAQQIGTSIPLPLVDALSATFGELIACLVRVPTEIVKQRSQTSRASGLLQIVTELYRTRGGIRGFYKGYVSTVAREIPFSFIEFPLWEWLKRRVAHRMGSCSPLASAACGSLAGLTAAALTTPFDVLKTRVMLDRDRRTRLLPTAIQILRNEGIARLY

SEQ ID NO: 165815 - protein, 124 aa, Heterodera glycines
  Homolog annotation: Hit_ID=CAI21890.1; Match level="QueryCoverage =91%, HitCoverage=24%, E-value=7e-11, Identity=35%"; Hit description =C20orf13 [Homo sapiens] emb|CAI22071.1| GD:C20orf13 [Homo sapiens] dbj|BAB15209.1| unnamed protein product
  Coding regions on vcDNA: vcDNA=SeqID_92238; Strand=+; Position=15-386
MDTVGGVAIHPDGMCEACVSSGGILLKREGRMGHSAQFGAAIWAEQCSASSSSAAANSDFGLSVAVSVSGCGEALTRTHFAEALAQQILSMDVDDLAFVQCITHFLDHHFVRSRRLCSFPSDRL

SEQ ID NO: 165816 - protein, 161 aa, Heterodera glycines
  Homolog annotation: Hit_ID=CAA65474.1; Match level="QueryCoverage =100%, HitCoverage=53%, E-value=8e-28, Identity=44%"; Hit description= collagen [Globodera pallida]
  Coding regions on vcDNA: vcDNA=SeqID_92239; Strand=+; Position=2-484
DLMDETWGTRPTTNPPEDAFRSIFPVKPQLRGRRQRAGLQQPSCRPGPTSPSGPPGQPGQAGCERLHGQAEHPGQRARSCPRQSIHWAHCPAGPACRPVGHGPPRQQGAPGQADTTHQGAGTGNCLAPGAQGTPGKGRHHRKPGAHPGQRRRTANATRARP

SEQ ID NO: 165817 - protein, 73 aa, Heterodera glycines
  Coding regions on vcDNA: vcDNA=SeqID_92240; Strand=-; Position=0-218
WLFLNAIVHLLYVLTGYAKRMRSTRIARSNRHRIRRQFSYWHNHFDLVVEWQFDGAKVAHGLPTGAMLWDNSR

SEQ ID NO: 165818 - protein, 201 aa, Heterodera glycines
  Homolog annotation: Hit_ID=NP_500253.1; Match level="QueryCoverage =81%, HitCoverage=29%, E-value=4e-56, Identity=62%"; Hit description =spastic paraplegia 3A homolog, atlastin, putative guanylate-binding protein, similar to ARL-6 interacting
  Gene Ontology: Mol. function=zinc ion binding
  Coding regions on vcDNA: vcDNA=SeqID_92241; Strand=+; Position=33-635
MLAPIPIIEPATVTVPPNEDVVGSYDENQQREEELLVNQFVINSEAIKRILDDPRYADKKVCVVSVAGAFRTGKSFILNFFLRYLRWRSAPSVDEMVNDWLKMDPKLEGFSWRGGDDRDTNGILIWPEPFLLEDRNREQVVVLLMDTQGIFDSVSTFKNCATVFALSTMVSSVQIFNINKTIQEDHLQHLQLFTEYARLAL

SEQ ID NO: 165819 - protein, 166 aa, Heterodera glycines
  misc_feature (135)..(135): Xaa can be any naturally occurring amino acid
  Homolog annotation: Hit_ID=CAE72923.1; Match level="QueryCoverage =100%, HitCoverage=20%, E-value=4e-68, Identity=77%"; Hit description= Hypothetical protein CBG20243 [Caenorhabditis briggsae]
  Gene Ontology: Mol. function=ATP-binding cassette (ABC) transporter activity; Cellular component=integral to membrane; Biological process=positive regulation of growth rate
  Coding regions on vcDNA: vcDNA=SeqID_92242; Strand=+; Position=2-498
IEHFYEPDSGEVLLDGIPVRDYDHQFLHMKVALVGQEPVLYGRSVEENIGYGYENATPEAVQRSAKHANAHGFIMDTQQGYETDVGEKGGQMSGGQKQRIAIARALVREPAVLLLDEATSALDSESEHLVQEAIXKNLKGRTVLLIAHRLSTVENADKIVVVSAGR

SEQ ID NO: 165820 - protein, 110 aa, Heterodera glycines
  misc_feature (96)..(96): Xaa can be any naturally occurring amino acid
  Coding regions on vcDNA: vcDNA=SeqID_92243; Strand=+; Position=67-396
MVALSLIANSPVNYPPPPNASLFKILFYPPMQSVPLLAQLLATHFPLQIPSLSFSSCHFHLLFIPFLPFLCFFPLFCYFFCPPFLLPAQVEKINCXSKKKKKKKKKKKKK

SEQ ID NO: 165821 - protein, 204 aa, Heterodera glycines
  misc_feature (82)..(82): Xaa can be any naturally occurring amino acid
  Homolog annotation: Hit_ID=CAB88203.1; Match level="QueryCoverage =100%, HitCoverage=84%, E-value=1e-95, Identity=67%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_92244; Strand=+; Position=1-611
MQETHIVLGIASVCSLLAIIATVVTLPSLYSEMSQMNSKVRDGVEAFRVNTDSAWTDLMDVQVVVTPPSKPRDNPFNSIFRXQPAPPCPPQNIPCPRCPAGPPGRPGGQGPPGQQGAPGQPGTPAQGGGPGTPGAPGPQGQPGQPGRPGAAGQPGQPGANGVVSRPIPGPKGPPGAPGQNGNPGSQGQPGQPGGQGPPGPPGAP

SEQ ID NO: 165822 - protein, 118 aa, Heterodera glycines
  Coding regions on vcDNA: vcDNA=SeqID_92245; Strand=+; Position=272-625
VGNAMHQPFPPPRQPFYPPSRPIRFPHWPFHHDPSRPRPHLMYGRSVGYHPYANQFHRPMTQARVSHCFVLNWHFAYRCDLRFAMALLNRLAYIGILVTFQLIPHQISHRKHSSTKLL

SEQ ID NO: 165823 - protein, 107 aa, Heterodera glycines
  Homolog annotation: Hit_ID=ZP_00132649.2; Match level="QueryCoverage =63%, HitCoverage=15%, E-value=9e-09, Identity=52%"; Hit description =COG0513: Superfamily II DNA and RNA helicases [Haemophilus somnus 2336]
  Coding regions on vcDNA: vcDNA=SeqID_92246; Strand=+; Position=311-631
FIRQIKRNKHNANVIELLALLFLFSDFDGFVPQLTKNIAEKGIERPTLIQKCVMPIILTKSEFDLLARAETGTGKTAAFLFPIIHLLESDRLAIGTKPSTGRKSPFA

SEQ ID NO: 165824 - protein, 170 aa, Heterodera glycines
  Homolog annotation: Hit_ID=CAF87943.1; Match level="QueryCoverage =77%, HitCoverage=39%, E-value=1e-21, Identity=45%"; Hit description =unnamed protein product [Tetraodon nigroviridis]
  Gene Ontology: Mol. function=transcription co-activator activity; Biological process=development
  Coding regions on vcDNA: vcDNA=SeqID_92247; Strand=+; Position=142-651
MDERTNDRQMFTDSINNDLDDRRLRRQIANCNERRRMQSINAGFQALRQLLPRKDGDKMSKAAILAATAEFIQSLLREKDKLLEENCVVMAKKRRMDTEDAEKVILREEAVRPNVVDCLRTIGELRNSLQKETQLRMVYEKEMAELRCQLRLSPPSSALVALPPFPSPRP

SEQ ID NO: 165825 - protein, 115 aa, Heterodera glycines
  Coding regions on vcDNA: vcDNA=SeqID_92248; Strand=-; Position=101-448
STDKNHSKSDQLSDGGRLAGRLNGDGIRPKGGQKPKGGGAELLDDEGPKKPWPANCRNLNGLNCCSSLPDSSELLSSDAISDELFGASLCPLTKMAIVKIKATIKNLLAIICAIN

SEQ ID NO: 165826 - protein, 215 aa, Heterodera glycines
  Homolog annotation: Hit_ID=CAA65474.1; Match level="QueryCoverage =94%, HitCoverage=68%, E-value=1e-103, Identity=82%"; Hit description= collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_92249; Strand=+; Position=3-647
HIVLGIASVCSLLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGGAGQPGQPGQPGQPAPPCPPQNIPCPRCPAGPPGRPGGQGPPGQQGAPGQPGTPAQGGGPGTPGAPGPQGPPGQPGQPGNSGQPGQPGAPGQPGKDSGYCP

SEQ ID NO: 165827 - protein, 97 aa, Heterodera glycines
  misc_feature (48)..(48): Xaa can be any naturally occurring amino acid
  Homolog annotation: Hit_ID=CAE63207.1; Match level="QueryCoverage =98%, HitCoverage=3%, E-value=3e-19, Identity=44%"; Hit description =Hypothetical protein CBG07562 [Caenorhabditis briggsae]
  Coding regions on vcDNA: vcDNA=SeqID_92250; Strand=+; Position=2-292
RKRLFSGVRRLDAHSSLPYYASGSSDGSVFLWEWGDEQPVFVALAAGXFAQEAKLPFAHNGTRFAAVHGDALVFIWQAPPAVPPNKPLCHPKGSLQI

SEQ ID NO: 165828 - protein, 101 aa, Heterodera glycines
  misc_feature (47)..(47): Xaa can be any naturally occurring amino acid
  Homolog annotation: Hit_ID=CAE73993.1; Match level="QueryCoverage =100%, HitCoverage=30%, E-value=1e-14, Identity=35%"; Hit description= Hypothetical protein CBG21626 [Caenorhabditis briggsae]
  Coding regions on vcDNA: vcDNA=SeqID_92251; Strand=+; Position=2-304
NETLNVWSNQLGFAWDNYLQWWTLNESLPRVNAPIAEYWTMGTRMLXSQLCMLLSSAYHIIRCHWPQRRKQWMRADLFRASAELKGLDMIGLYTSWYHFPE

SEQ ID NO: 165829 - protein, 107 aa, Heterodera glycines
  Homolog annotation: Hit_ID=CAA65506.1; Match level="QueryCoverage =100%, HitCoverage=65%, E-value=1e-21, Identity=41%"; Hit description= cuticular collagen [Teladorsagia circumcincta]
  Gene Ontology: Mol. function=structural constituent of cuticle; Cellular component=extracellular; Biological process=cuticle biosynthesis (sensu Nematoda)
  Coding regions on vcDNA: vcDNA=SeqID_92252; Strand=-; Position=2-322
SSPVGPGARRGMSPPCARRGSPAVSTASAPQWEGRRGPPGPNGSPDVPAQPGLPGWFDQPGGPGHPGDAGKPGTPGTPGENKGPGVAGEIGNMGTCDHCPTPRPAPG

SEQ ID NO: 165830 - protein, 119 aa, Heterodera glycines
  misc_feature (96)..(96): Xaa can be any naturally occurring amino acid
  Homolog annotation: Hit_ID=CAB88203.1; Match level="QueryCoverage =99%, HitCoverage=39%, E-value=2e-40, Identity=66%"; Hit description =putative cuticular collagen [Globodera pallida]
  Coding regions on vcDNA: vcDNA=SeqID_92253; Strand=+; Position=2-358
HIVLGIASVCSLLATIPSVVTLPSLYSEMSQMNSNLRDGVEVFRDNTDSAWTDLMDVKLIMTPPTKPPDNPFNSIFRVSHQLSGHCLCAGLQKSSXPPGPTGPFGRPGQPGWSECPGQS

SEQ ID NO: 165831 - protein, 194 aa, Heterodera glycines
  Homolog annotation: Hit_ID=NP_495415.2; Match level="QueryCoverage =94%, HitCoverage=32%, E-value=8e-43, Identity=44%"; Hit description =acid SphingoMyelinase, sphingomyelin phosphodiesterase (asm-1) [Caenorhabditis elegans] gb|AAC46756.2| Ac
  Gene Ontology: Mol. function=sphingomyelin phosphodiesterase activity; Cellular component=extracellular; Biological process =ceramide biosynthesis
  Coding regions on vcDNA: vcDNA=SeqID_92254; Strand=+; Position=1-582
AHIPPGDNECLESWSRNYYRIVTRFASTISAQFFGHTHTDSFRLFFEDMNNSSSPALSVLYVAPSVTTFAGLNPAYRVYVASPSDGRILDIENYFLNLTALDGPEKEEKPRWQLLYTAKTEYGMEQLNAEAWNAVAQRIEREPAMARKFNRNYARRADAECDAHCVAERVCDIRAAHSNKTALCGGGSKTRRKL

SEQ ID NO: 165832 - protein, 194 aa, Heterodera glycines
  Coding regions on vcDNA: vcDNA=SeqID_92255; Strand=+; Position=48-629
MEVEVEAVAEAEAEEELDPKGRVQQLLEMGKSLEWEMAVQSDDEQILDLDDDLEMFPRLIFLQLAKFLKNAPDGLNEQQKKELKKVLVNWMEEQKQPFTVDEEMAQVDETVQSLSTFCDQIGKSFKGTPAILDIFLDFHKNETLETEKLEFMWKMVNRKVTHYVKSVGQFYGGIKIAKENLKQVKKIGKWAKKN

SEQ ID NO: 165833 - protein, 111 aa, Heterodera glycines
  Coding regions on vcDNA: vcDNA=SeqID_92256; Strand=+; Position=9-344
MDEQFKICIELHYEQKKKRELMHQIHMKEKASLELSTKDLTDQTKRRVVNERSSLDRKQRQLERLKREAERRGLRTGGDSLQGTTQNGKKNQSQQKQSPAAETASVEPIIA

SEQ ID NO: 165834 - protein, 195 aa, Heterodera glycines
  Homolog annotation: Hit_ID=EAL27882.1; Match level="QueryCoverage =84%, HitCoverage=29%, E-value=5e-74, Identity=77%"; Hit description =GA14079-PA [Drosophila pseudoobscura]
  Gene Ontology: Mol. function=protein serine/threonine kinase activity; Cellular component=cytoplasm; Biological process=eye photoreceptor development (sensu Drosophila)
  Coding regions on vcDNA: vcDNA=SeqID_92257; Strand=+; Position=1-588
ASVRLIDLGSATFDHEHHSTIVSTRHYRAPEVILELGWAQPCDVWSIGCIMFELYSGMTLFQTHDNREHLAMMQRILDGIPYRMGRKSKTKYFFHGRLDWHDHTTAGQYVRDHCKPLSRYMVSTSEEHQQLFSLIRSMLEYEPASRITLSEALRHPYFNRLDPNMRARVDGVGFDTSLNGRGSYASAGSSSSCRD

SEQ ID NO: 165835 - protein, 78 aa, Heterodera glycines
  Homolog annotation: Hit_ID=NP_497035.2; Match level="QueryCoverage =100%, HitCoverage=6%, E-value=1e-10, Identity=40%"; Hit description =ARF(ADP-Ribosylation Factor related)-Like, Complex locus. ARF(ADP -Ribosylation Factor related)-Like and t
  Coding regions on vcDNA: vcDNA=SeqID_92258; Strand=+; Position=2-235
DVFCTVPRELMEPIDQRIRAIVEDIDSTHHLLEAKTTETDIKVFITSSLGHIFDEGNGIQLLIQHLKCDLREGTILVC

SEQ ID NO: 165836 - protein, 53 aa, Heterodera glycines
  misc_feature (38)..(38): Xaa can be any naturally occurring amino acid
  Homolog annotation: Hit_ID=CAE59564.1; Match level="QueryCoverage =94%, HitCoverage=26%, E-value=3e-11, Identity=57%"; Hit description =Hypothetical protein CBG02961 [Caenorhabditis briggsae]
  Gene Ontology: Cellular component=mitochondrion
  Coding regions on vcDNA: vcDNA=SeqID_92259; Strand=+; Position=2-160
IKVILEIGPPGRGKGTLCQRIEKNCGFLHVSAGDLVRXERLREGSTSGELIQP

SEQ ID NO: 165837 - protein, 141 aa, Heterodera glycines
  Homolog annotation: Hit_ID=NP_501102.1; Match level="QueryCoverage =94%, HitCoverage=39%, E-value=6e-24, Identity=39%"; Hit description =putative nuclear protein of ancient origin (4H846) [Caenorhabditis elegans] gb|AAF60570.1| Hypothetical p
  Coding regions on vcDNA: vcDNA=SeqID_92260; Strand=+; Position=15-437
MKYSFNVREIQSLLNGFMCIFKPRDVSISAIEKLLMRRICEQANCLDPCRPLPTIEMPIVEAHPKSGALVVVGRKKQIDYSKHPLMVGQMFRPEDMRIEALNYLEPSCSGVCVFGLNDGCDQLEKVRDRAWVNEYILRGRI

SEQ ID NO: 165838 - protein, 75 aa, Heterodera glycines
  Homolog annotation: Hit_ID=CAA65474.1; Match level="QueryCoverage =86%, HitCoverage=21%, E-value=2e-18, Identity=70%"; Hit description =collagen [Globodera pallida]
  Coding regions on vcDNA: vcDNA=SeqID_92261; Strand=+; Position=2-226
THIALGIASVCSLLGIIPTVVTLPSLYSEMTQMKSKVRDEVEVFRDKIDSDWTDLMNVERIGTPPWNLLDDAIKS

SEQ ID NO: 165839 - protein, 91 aa, Heterodera glycines
  Coding regions on vcDNA: vcDNA=SeqID_92262; Strand=-; Position=1-273
CFLFFGHFHPLWFVPWKTSIFLAFIFPADAQHFVRFANWPIASGLCQCHVRKAAQSEQSESENEEKTERKHFGKILREEIKRFFLMIRAII

SEQ ID NO: 165840 - protein, 198 aa, Heterodera glycines
  Homolog annotation: Hit_ID=CAE62723.1; Match level="QueryCoverage =90%, HitCoverage=72%, E-value=3e-19, Identity=33%"; Hit description =Hypothetical protein CBG06882 [Caenorhabditis briggsae]
  Gene Ontology: Mol. function=thiamin pyrophosphokinase activity; Biological process=thiamin metabolism
  Coding regions on vcDNA: vcDNA=SeqID_92263; Strand=+; Position=1-594
PPTFAPFRLLRQHFDRLAVILLNSPPAAVVPCGDFAFPADWAKIWNSANIRLCTDGAANHLMKLCSDGTDQLKVPELIIGDFYSISAEARHHFGGFGNCEQRKVPDQNSTDLTKALEALGEKHPNLSGILLLGGFHGRFDHVLGALHALLLHVQQWPQVPLFAVDNENVLTVLPEGEMLVELDAERITGTCGLFPIEQ

SEQ ID NO: 165841 - protein, 195 aa, Heterodera glycines
  Homolog annotation: Hit_ID=BAD73620.1; Match level="QueryCoverage =61%, HitCoverage=47%, E-value=4e-09, Identity=28%"; Hit description =putative legumaturain [Oryza sativa (japonica cultivar-group)]
  Coding regions on vcDNA: vcDNA=SeqID_92264; Strand=+; Position=38-622
MFDFKAIPWGLAKRRQSDHQVQCHHGANECTANQLLSCALKHPYSDKSKRHRLLNCFMAKMMSKREPENAMISCLAKSGLSRNEILNCARTDAVTRLQLEDETETEHILNSPRFVPFVSLNGWSHLTLQAPAQLLLTEKLAHWNDTLNGVSIYKRSALKLLPTPYRSCALPPDFWCSSDSSVTGACFDEQKCRTF

SEQ ID NO: 165842 - protein, 200 aa, Heterodera glycines
  Coding regions on vcDNA: vcDNA=SeqID_92265; Strand=+; Position=22-621
MFKLSQLFFIFIFSIKLIGNKCTKNGVASPFEKVIQKDANKSTPKIAEKNAENEEQNPLKKEIENLKARMDQELNKIIELKLGTQLLKMNEIAERIENEKTPLDKEFIQKVIEEIRPLYVEAIRDHINILVKLNFLENDKGFKKDAKNMENLNALENQLIANKACLIKEDEIVQTYHNERAELERKMKRNEGNETLDEYD

SEQ ID NO: 165843 - protein, 183 aa, Heterodera glycines
  Homolog annotation: Hit_ID=NP_741716.1; Match level="QueryCoverage =99%, HitCoverage=28%, E-value=3e-16, Identity=25%"; Hit description =putative protein, with at least 10 transmembrane domains, of ancient origin (68.2 kD) (XB658) [Caenorhabd
  Coding regions on vcDNA: vcDNA=SeqID_92266; Strand=+; Position=1-549
LFLAITSLFLNSICWWFFEPSLTTFMATLRLDWSASVMSGILIAVFNAAYMTSAPIWGFVQPYLTGQMRPMLLLTSVGMVIVMLLMGPSPLLGLPNLMITAVAFALLGIVAGAAYVPLFKWCVDAANNAGLDGTSSAICGCISGFIQSALALSAFLATSVGGLSAHHLGLPWTATLVAAIQLA

SEQ ID NO: 165844 - protein, 192 aa, Heterodera glycines
  misc_feature (87)..(87): Xaa can be any naturally occurring amino acid
  misc_feature (143)..(143): Xaa can be any naturally occurring amino acid
  Homolog annotation: Hit_ID=CAA65474.1; Match level="QueryCoverage =100%, HitCoverage=63%, E-value=6e-35, Identity=41%"; Hit description= collagen [Globodera pallida]
  Coding regions on vcDNA: vcDNA=SeqID_92267; Strand=+; Position=2-577
THIDLGIATACSRSVIVIIVATLTFLYSDMNMMNMNVRERDEVFGFHTDSDWTGFVDMDVVVTPTPTPHDHAFPSIFLFRGQLPLHXHCAGLGLPHCTCGPAGPGGSGAPARPAEGAGPRQHAEPAEPAAPPCPCPNLNCPCXPCGAAARRRRRGPAPHRRARGHAETGTPGGGAGTARPAAPGRQSGPPQP

SEQ ID NO: 165845 - protein, 160 aa, Heterodera glycines
  Homolog annotation: Hit_ID=XP_317671.1; Match level="QueryCoverage =90%, HitCoverage=34%, E-value=2e-15, Identity=36%"; Hit description =ENSANGP00000018488 [Anopheles gambiae]
  Coding regions on vcDNA: vcDNA=SeqID_92268; Strand=+; Position=71-550
MALRRQRPFFRSFVPLLICLLPCLIVELFSFWAASFLWQIPPILNPNSVIILIISDPQLIGHINEPRWTGIVSRWDADRYMRRAYALASRAVRPDLEVFLGDLFDEGVLLGGDEQQFVDTRKRFMNIFPLNRYSTNRIYLPGDNDIGGEMEPVYAELYER

SEQ ID NO: 165846 - protein, 169 aa, Heterodera glycines
  Homolog annotation: Hit_ID=CAE61462.1; Match level="QueryCoverage =98%, HitCoverage=65%, E-value=5e-82, Identity=61%"; Hit description =Hypothetical protein CBG05354 [Caenorhabditis briggsae]
  Gene Ontology: Mol. function=structural constituent of cuticle; Cellular component=extracellular; Biological process=cuticle biosynthesis (sensu Nematoda)
  Coding regions on vcDNA: vcDNA=SeqID_92269; Strand=+; Position=1-507
GTSGGGGGGCQPCCNPGPPGPPGTSGRPGRPGKPGSNGMPGGPGKPPSQPCESVTPPPCKPCPGGPPGPPGPPGPPGDGGGPGQPGQPGSDSGAGSPGPKGPPGPPGQPGQPGSPGEPGQPAQSQPIIPGPPGPPGDSGPPGPPGPPGNPGTDGGAGQPGPKGPPGPPG

SEQ ID NO: 165847 - protein, 120 aa, Heterodera glycines
  Coding regions on vcDNA: vcDNA=SeqID_92270; Strand=-; Position=93-455
LITDNRSEGDKAPTNDIIWGEGNSVILWGSAAVRRGEAFVARSPSFVRSSTGAILESIIVHRWGSRFLLLVLLGAAARRCLGPFGVVNHATVRSTAERIRSHEHVQEEAHCVVGEQQQQK

SEQ ID NO: 165848 - protein, 55 aa, Heterodera glycines
  Homolog annotation: Hit_ID=CAB88203.1; Match level="QueryCoverage =100%, HitCoverage=18%, E-value=1e-15, Identity=74%"; Hit description= putative cuticular collagen [Globodera pallida]
  Coding regions on vcDNA: vcDNA=SeqID_92271; Strand=+; Position=2-166
HIVLGIASVCSLLAIIGTFVALPSLYSEMSPMNSDVRDVVEAFLVNTDSDWTDIV

SEQ ID NO: 165849 - protein, 122 aa, Heterodera glycines
  Coding regions on vcDNA: vcDNA=SeqID_92272; Strand=+; Position=60-428
MNMNSSSSSNRRCSAPNSTTLRAAASALLIIIAASLVLPQCAAVGGMAELKALTGDAPYLGTGNQEQAPEFFGEALSRQYYQNPAYRYNDWYGTRFAQNYYRSPYRAYGGGGGGGDFGCGPC

SEQ ID NO: 165850 - protein, 171 aa, Heterodera glycines
  misc_feature (57)..(57): Xaa can be any naturally occurring amino acid
  misc_feature (90)..(90): Xaa can be any naturally occurring amino acid
  misc_feature (140)..(140): Xaa can be any naturally occurring amino acid
  Homolog annotation: Hit_ID=NP_510450.1; Match level="QueryCoverage =100%, HitCoverage=53%, E-value=8e-56, Identity=63%"; Hit description= succinyl-coa synthetase (33.8 kD) (XP373) [Caenorhabditis elegans] emb|CAA94107.1| Hypothetical protein
  Gene Ontology: Mol. function=succinate-CoA ligase (ADP-forming) activity; Cellular component=mitochondrion; Biological process =succinyl-CoA metabolism
  Coding regions on vcDNA: vcDNA=SeqID_92273; Strand=+; Position=2-514
FYTATRQNLEINQNTKVGGQGFTGKQGTFHGQQMIEYCTNVVAGVSPSKTGTEHLGXPIFATVKDARKKTGADASAIYETAAFAAAAIDXAIDAEIPLVVCMTDGICQLDMVREKNRLLKNNRTQLLGPYCLGIMAPGEXQIGIMPGQIHQKRVIGIGSRSGTLTYGAVRQ

SEQ ID NO: 165851 - protein, 137 aa, Heterodera glycines
  Homolog annotation: Hit_ID=NP_506597.1; Match level="QueryCoverage =98%, HitCoverage=10%, E-value=2e-23, Identity=38%"; Hit description =tRNA modification enzyme (5P0) [Caenorhabditis elegans] emb|CAB03994.1| Hypothetical protein C53A5.2 [Cae
  Coding regions on vcDNA: vcDNA=SeqID_92274; Strand=+; Position=222-632
LLIGDSFHPERIFQMGPDFACLEWLMNAGSTSVLMSDGTLLKSKKEMQNFLSQKGFDLRKLKTEAPTAKLLKDIPLADALRPSASDLLYNEKWRHISPIHMKEIDASDSVITDEGFAYFLECRNIEKLRLNFCDYFG

SEQ ID NO: 165852 - protein, 137 aa, Heterodera glycines
  Homolog annotation: Hit_ID=NP_505960.1; Match level="QueryCoverage =70%, HitCoverage=8%, E-value=3e-19, Identity=44%"; Hit description =guanylyl family member, abnormal DAuer Formation DAF-11 (daf-11) [Caenorhabditis elegans] emb|CAD56284.1|
  Coding regions on vcDNA: vcDNA=SeqID_92275; Strand=+; Position=241-651
SIESRVNDIRASVASIVSAHQQQRGAEGDGAVPRRDILDNNFKSAFVRDIVKGLDFLHSSPIGYHGALTSTRCLIDSHWILKLAGFGTSRLLYKWRHNGILSNGNGTVIQPLIPNEELHYYAPELRLTIRSAVLRNK

SEQ ID NO: 165853 - protein, 208 aa, Heterodera glycines
  Homolog annotation: Hit_ID=Q15032; Match level="QueryCoverage=30%, HitCoverage=6%, E-value=6e-10, Identity=48%"; Hit description=R3H domain protein 1
  Gene Ontology: Mol. function=endopeptidase inhibitor activity
  Coding regions on vcDNA: vcDNA=SeqID_92276; Strand=+; Position=3-626
RMLVHRIAAFFGLLHNVDQSGQKVVVTKLPGTKLPDIEFEQLIKHNDFYDFHSARRNGQSFDESKGYRFPMREFRNRFNTTASEGANGGELSRNRRARSFEIDNDLYAGFPRQHLAFHRYSATFDNAGGADMASGNCSSSTSSTAISAQMHPLHLPMLQPPYANSSTEASLISPASAYSEPAACVRHQTAQFANSQCQIPCKNVTDSP

SEQ ID NO: 165854 - protein, 166 aa, Heterodera glycines
  misc_feature (74)..(74): Xaa can be any naturally occurring amino acid
  misc_feature (105)..(105): Xaa can be any naturally occurring amino acid
  misc_feature (113)..(113): Xaa can be any naturally occurring amino acid
  Homolog annotation: Hit_ID=NP_509110.1; Match level="QueryCoverage =73%, HitCoverage=85%, E-value=2e-25, Identity=47%"; Hit description =esophageal gland cell secretory protein 11 like precursor family member (15.3 kD) (XH214) [Caenorhabditis
  Coding regions on vcDNA: vcDNA=SeqID_92277; Strand=+; Position=1-498
FSSYTKKKKCFHLSIFVTLCLLISCLIPFSFDYDDDLFEIGTAQSVAVTGILTCNGRPSGGTKVKLYDVDTFDXDDLMAEGFTDEKEHFLLEGFETEISDIDSKXNIYHNCNXRTYPCLQKFSIEIPDNYITEEKRSPQKIFYIGKLNLEGKFSGQHRDCINRTFC

SEQ ID NO: 165855 - protein, 107 aa, Heterodera glycines
  misc_feature (49)..(49): Xaa can be any naturally occurring amino acid
  misc_feature (65)..(65): Xaa can be any naturally occurring amino acid
  Homolog annotation: Hit_ID=CAB88203.1; Match level="QueryCoverage =95%, HitCoverage=34%, E-value=3e-24, Identity=57%"; Hit description =putative cuticular collagen [Globodera pallida]
  Coding regions on vcDNA: vcDNA=SeqID_92278; Strand=+; Position=2-325
SPVGTLTSLYSEMRHVNSKVPDQLEALLVNTDSAWIDLMDLQVVLTPPXKPRDNPFNSIFPAIRXLPGHCLGDLFQQARWPPISPGPSGPTGHAVHPVRPRQTGDAV

SEQ ID NO: 165856 - protein, 215 aa, Heterodera glycines
  Homolog annotation: Hit_ID=P23241; Match level="QueryCoverage=100%, HitCoverage=41%, E-value=9e-47, Identity=46%"; Hit description=Elav protein (Embryonic lethal abnormal visual protein) gb|AAA28505.1| ELAV
  Gene Ontology: Mol. function=mRNA 3' UTR binding; Cellular component =Cajal body; Biological process=mRNA processing
  Coding regions on vcDNA: vcDNA=SeqID_92279; Strand=+; Position=3-647
QMVVVSSMVDQNHKRQQPQQQKSNTRQISDAAEIGHLSETDQQQQQQQKQQEELYYAQLLAVQQQAIAMREGQQKERGTEQRQNGAETDGEAGDGGEDEREKREREVSERNTNLIINYLPQNMTQEEVRALFGSMGEVESCKLIRDKSSGQSLGYAFVNYERPEDARKALTSMNGLRLQNKVLKVSLARPSKDDIKGANLYVSGLPKSLTQFELE

SEQ ID NO: 165857 - protein, 207 aa, Heterodera glycines
  Homolog annotation: Hit_ID=NP_499188.2; Match level="QueryCoverage =100%, HitCoverage=55%, E-value=4e-68, Identity=64%"; Hit description= NAD-dependent glycerol-3-phosphate dehydrogenase (3K944) [Caenorhabditis elegans] emb|CAA80176.2| Hypoth
  Gene Ontology: Mol. function=glycerol-3-phosphate dehydrogenase (NAD+) activity; Cellular component=cytoplasm; Biological process =nucleotide-sugar metabolism
  Coding regions on vcDNA: vcDNA=SeqID_92280; Strand=+; Position=36-656
MTKKQVTIVGSGNWGTAIARIVGKTVQMHNSEFDDSAVKMWVFEEVVEGRKLSEIINEKHENVKYLPGKKLPTNVIAVTDVVEASKNADVLIFIIPHQFLHKVCEQLKGNIKKSAIAISLIKGLATFHEKDIGLRLISNEIATSLGIDTSVLMGANLANEVADDHFCEATIGTKNPQHGNELKKLFHTDNFRINVVEDAATVELCGA

SEQ ID NO: 165858 - protein, 211 aa, Heterodera glycines
  Homolog annotation: Hit_ID=AAL78214.1; Match level="QueryCoverage =72%, HitCoverage=75%, E-value=2e-11, Identity=27%"; Hit description =putative esophageal gland cell protein Hgg-20 [Heterodera glycines]
  Coding regions on vcDNA: vcDNA=SeqID_92281; Strand=+; Position=11-643
MAPPVKKKKKFSSDNHRLISSTEIGEHEQQSMGSLTTSFGKRQSLFRHAKKMNNRILRKIWICTDIWMDTFPFFDHAQLGLKLALISPRFDVLVDKHFNCQSELTIWREITIVKDTGSELNLTVLIGGKSVQFPLPDRSLPNKIRFDNLNIDYIDHSVLVFLRANKQIWDKGTNLSLYVCWSHNQNDNNNNFLPIWDVFVCKIWPIFAPNI

SEQ ID NO: 165859 - protein, 133 aa, Heterodera glycines
  misc_feature (53)..(53): Xaa can be any naturally occurring amino acid
  misc_feature (93)..(93): Xaa can be any naturally occurring amino acid
  Homolog annotation: Hit_ID=CAC33829.1; Match level="QueryCoverage =100%, HitCoverage=40%, E-value=5e-30, Identity=53%"; Hit description= annexin 2 [Globodera pallida]
  Gene Ontology: Mol. function=anticoagulant activity
  Coding regions on vcDNA: vcDNA=SeqID_92282; Strand=+; Position=2-403
IHLVGPISNQDRLELARQFEPLFGEDVSSKLKNALSGDSNELILALLEPTSVXYAHPMHRAMCGLRTLKGSGLIEMLLSPRKRPVDEMTRACXTLYRHPLEKDIFGDSCGAFPPLLPSVCNYTRDKRWSSDPI

SEQ ID NO: 165860 - protein, 84 aa, Heterodera glycines
  Homolog annotation: Hit_ID=CAE63288.1; Match level="QueryCoverage =88%, HitCoverage=13%, E-value=8e-13, Identity=43%"; Hit description =Hypothetical protein CBG07668 [Caenorhabditis briggsae]
  Coding regions on vcDNA: vcDNA=SeqID_92283; Strand=+; Position=1-252
ETLHDSLSKDPVFPVIAFKHYAALERRLYKIMEYLLECMDKQNGDLTQMVVNEFHNPTVAEPLPGEELETEEDETNDAPAGPPA

SEQ ID NO: 165861 - protein, 170 aa, Heterodera glycines
  Homolog annotation: Hit_ID=NP_493879.1; Match level="QueryCoverage =95%, HitCoverage=45%, E-value=3e-32, Identity=41%"; Hit description =transposase family member (2B289) [Caenorhabditis elegans]
  Coding regions on vcDNA: vcDNA=SeqID_92284; Strand=-; Position=3-592
FRAESSKRKRLEGGGRKVPNRNFEEAVFQWVSELRQKKVRVTRNMIAAQAIKMSAAYEDMENFAASNGWLEKFMHHHKFSLRRPTTVAQKEPDAYKNIIINIILYIQQLIHKNNYTHVYAADETAVWLDPGGGTCVAEKGSKTVTVLNTGHEKARVTVLLTARSDGTKMR

SEQ ID NO: 165862 - protein, 75 aa, Heterodera glycines
  Coding regions on vcDNA: vcDNA=SeqID_92285; Strand=+; Position=280-507
TACRWRASDGTRRLWSWGWWSGLSPILALPELSQLRVRHSATARRRRWCGRRRLRCWTWRWCCCCCCSHGWRWLR

SEQ ID NO: 165863 - protein, 217 aa, Heterodera glycines
  Homolog annotation: Hit_ID=AAW30666.1; Match level="QueryCoverage =92%, HitCoverage=31%, E-value=6e-48, Identity=47%"; Hit description =Neurofibromatosis homolog protein 1, isoform c [Caenorhabditis elegans]
  Gene Ontology: Mol. function=protein binding; Cellular component =adherens junction; Biological process=negative regulation of cell proliferation
  Coding regions on vcDNA: vcDNA=SeqID_92286; Strand=+; Position=1-651
GVGIFESDNKLSPRPFFPWTEIKCISFKNKMFTICTADKSKIKFRAQDMSINQSLLDLCVGTHNLYLRRRQPDLLEVQQMKQQADEQRRRRMEEQVRLHREREQRAQAEQERDRYRAELNHLSEQLSAMQNVIRSAEETQVLIAERARLSEQEAIEQARRASEAEAEAQRAKLSQLRAEETKMLLERKIRETEMAAQRMAALQHQQQQKQQQQQNGI

SEQ ID NO: 165864 - protein, 214 aa, Heterodera glycines
  Coding regions on vcDNA: vcDNA=SeqID_92287; Strand=+; Position=1-642
IDEADVAAMSSNGVEENCEATTITSLDNELADLLRYWLPLGAATDHCLNVAMQWQQQKRPNAVLMSTISLLLVARGHIQRAFEHIFNEGVERRLDSTISQPPAADDRCVASLLELASAHPSDARRGDWLAKLFRHLLKALPEETEAKSDDNAAEFTASVVHEQMTRPNSQLFRLLCAIIEQQHHHDDEQEQDGLRDIQIGAEKGTSASVLVAEL

SEQ ID NO: 165865 - protein, 203 aa, Heterodera glycines
  Coding regions on vcDNA: vcDNA=SeqID_92288; Strand=+; Position=17-625
MTESDEGTNWVESHPCRCGAKNWTASHMERVMVKLCCGSEEVQNFGNNNNGAQKNGTPERKNSLAPPEPSRVRRRSINNWRPIAGIFAVNPKEEDFNDCVKSHQDSPHEAIHVLFKCNKCSREFDCTYEIIADERGKRQSFGHYESVSEPITIGNCCNEMHSYEHIQRIFAAMWDKDKFQVHYNNCRHWSDGFWWKVHPDEYQ

SEQ ID NO: 165866 - protein, 218 aa, Heterodera glycines
  misc_feature (99)..(99): Xaa can be any naturally occurring amino acid
  Homolog annotation: Hit_ID=CAA82797.1; Match level="QueryCoverage =93%, HitCoverage=30%, E-value=3e-11, Identity=24%"; Hit description =gag protein [Ascaris lumbricoides]
  Coding regions on vcDNA: vcDNA=SeqID_92289; Strand=-; Position=3-655
NHWNSDCRKFSTIQQRVEIVKSKGLCFKCLFAHRTFDCPKPRKMFQMRTTSSQQHFAATLMRRTKSQRQQSCHICQYQARNQSKMLQSKPNQCETPSMXTDTRALLMTTTATIFNPAQPHLSMIASIFIDPGSHRSFVSNHTAQRLDLPIVNTEECLLTSFGERMPKKYISDMVKLGFLCINGERLIFNLNALQFLVNEMPMIQLSELDRDQLKQRKL

SEQ ID NO: 165867 - protein, 216 aa, Heterodera glycines
  Coding regions on vcDNA: vcDNA=SeqID_92290; Strand=+; Position=1-648
DSCAKQMVKTTKLSHLKKSRKRLKPLTGQATSSLASSSSTISTTSAHKQPFDCVDEARASGTLPTHSGRTLLRIDEDGNCVEIPMQRKPTSPVKKNCLDIGKPEMELLQVNGGQWEFVQRITNESQLYFYINRFNLVFGSSSKATGGRRYFNCIERGGSTKCPYRMMYMLERQVLYQTGEHNHSFSLLRRRKPTKINIKGLLPTPEKGGDFELLSL

SEQ ID NO: 165868 - protein, 170 aa, Heterodera glycines
  Homolog annotation: Hit_ID=CAE59760.1; Match level="QueryCoverage =100%, HitCoverage=35%, E-value=3e-63, Identity=72%"; Hit description= Hypothetical protein CBG03212 [Caenorhabditis briggsae]
  Gene Ontology: Mol. function=chaperone activity; Cellular component =actin filament; Biological process=regulation of cell cycle
  Coding regions on vcDNA: vcDNA=SeqID_92291; Strand=+; Position=3-512
FVGACAIGDLVKTTLGPKGMDKILVSGRGEHQNVQVTNDGATILKSIGVDNPAAKVLVDISLTQDKEVGDGTTSVTVFAAELLREAEVMIGQRIHPQVIVSGYRKAVRVAKDALENAAQASGEHLREDLLKIAKTSLGSKILSQHSNHFAKLAVDAVLRLGPNGALDSIQ

SEQ ID NO: 165869 - protein, 202 aa, Heterodera glycines
  misc_feature (196)..(196): Xaa can be any naturally occurring amino acid
  Homolog annotation: Hit_ID=CAE70100.1; Match level="QueryCoverage =80%, HitCoverage=23%, E-value=4e-40, Identity=49%"; Hit description =Hypothetical protein CBG16544 [Caenorhabditis briggsae]
  Gene Ontology: Mol. function=MAP kinase kinase kinase activity; Cellular component=cytoplasm; Biological process=cytoskeleton organization and biogenesis
  Coding regions on vcDNA: vcDNA=SeqID_92292; Strand=+; Position=53-658
MCSPTKNLLKSNDDCNKKESFPPAVLSVPSSQRCCPNSPSTSSGSSSPSSCCRQLSGYPVIPREQLEIGKQLGAGTYGSVFRGWWTKTDGNLLCVAMKKVFMLDKEVEILSQIRHRNIIQFYGVSVANPDFWIVTEYAENGSLFDNLHNKEQPLEFGRIIKWAVQIARGVVYLHYEAPLTVIHRDLKSKNIVIGSXNQCKLC

SEQ ID NO: 165870 - protein, 60 aa, Heterodera glycines
  Coding regions on vcDNA: vcDNA=SeqID_92293; Strand=+; Position=457-636
FNDPHPAGFSRRSPPGALIANNFRHFPRPYSMPHLSDFISNSSTVRKLVFFKCNFLSPPR

SEQ ID NO: 165871 - protein, 115 aa, Heterodera glycines
  Coding regions on vcDNA: vcDNA=SeqID_92294; Strand=+; Position=174-521
QIMHTQQNLFQPNLGVLIRHKLTINDRIFCAMPKRNMIYFWVPTKMPNIHLFHSPWYLSPVLPMQFPNMSNELFLLRGWLCNMCAVQMVRIFVAFLVVAQHRLGNKRAQIGLGRE

SEQ ID NO: 165872 - protein, 59 aa, Heterodera glycines
  Coding regions on vcDNA: vcDNA=SeqID_92295; Strand=+; Position=77-256
FYSFFMDKKMNIFLNEYQSNCALGIAAFPKKFSKIFPYSNAYTNISQIFLSFITEFWGL

SEQ ID NO: 165873 - protein, 158 aa, Heterodera glycines
  Coding regions on vcDNA: vcDNA=SeqID_92296; Strand=+; Position=3-476
LQLFFVIKMLRLRCPSRHFASSAASAMKARPTVEPVQQKISRLPTGFSVSSVELQIAKRTAEMQTLTTANCSSSFAADQACQLLAKGTALLSPHFQIGNITNKRTPQIVNSRWLTKEAALIGVNIEHDLLLDYAGPISQLMFAFRSGARFQQHDEAGL

SEQ ID NO: 165874 - protein, 217 aa, Heterodera glycines
  misc_feature (126)..(126): Xaa can be any naturally occurring amino acid
  Homolog annotation: Hit_ID=CAE58620.1; Match level="QueryCoverage =93%, HitCoverage=38%, E-value=2e-16, Identity=24%"; Hit description =Hypothetical protein CBG01787 [Caenorhabditis briggsae]
  Coding regions on vcDNA: vcDNA=SeqID_92297; Strand=+; Position=3-652
GTAFSAPLPTGEGTVDTGCLFYQKSPPRMADFDYSLPIYSTLSRIAIRDHNSFPLAEIWRLFHPFSVDTWLAIVLFIALHSFVFMVIEKIEFLVNRRTVAQMPIFHNILWRLLRLQLLQPKSVRLXHRFGFVHCVCFTSLYRSWIVTSLVQPKPAIPIRDASSFVKDVQQGKYTFVSQYRGHWFYESLNKSTTFPFKEMREGGAQKKLLQAHSIQES

SEQ ID NO: 165875 - protein, 67 aa, Heterodera glycines
  Coding regions on vcDNA: vcDNA=SeqID_92298; Strand=+; Position=196-399
FHSLLLFLVSIRRMYCRNANAVTPSAAVPLFLVDGEVNSLNKNSTPRPSAGEIQIFAENMGNSLIYD

SEQ ID NO: 165876 - protein, 51 aa, Heterodera glycines
  Coding regions on vcDNA: vcDNA=SeqID_92299; Strand=-; Position=1-153
FAEGSQSELIAFVRLQSVHAKVPRPIRTVRRRHSQFLHSAPTSLSFCPNFQ

SEQ ID NO: 165877 - protein, 213 aa, Heterodera glycines
  Homolog annotation: Hit_ID=NP_492174.1; Match level="QueryCoverage =100%, HitCoverage=32%, E-value=2e-93, Identity=73%"; Hit description= phosphoenolpyruvate carboxykinase cytosolic family member (73.4 kD) (1I447) [Caenorhabditis elegans] emb
  Gene Ontology: Mol. function=phosphoenolpyruvate carboxykinase activity; Cellular component=mitochondrion; Biological process =glucose metabolism
  Coding regions on vcDNA: vcDNA=SeqID_92300; Strand=+; Position=2-640
KTNPMAVQTFQKNSIFTNVAETSEGKVYWEGLEDEIRDRDDVTITDWMGAPWKLGSPTPAAHPNSRFCAPAKQCPIIHPDWESPNGVPIDAIIFGGRRPQGVPLVFESFSWEHGIFTGACLKSETTAAAEHQGKTVMHDPMAMRPFMGYNFGKYLAHWCSLKQPGRKMPRIFHVNWFRKSGADGKFLWPGYCENIRVIDWIVRRLDKQRALAL

SEQ ID NO: 165878 - protein, 212 aa, Heterodera glycines
  misc_feature (101)..(101): Xaa can be any naturally occurring amino acid
  Homolog annotation: Hit_ID=NP_499522.1; Match level="QueryCoverage =80%, HitCoverage=7%, E-value=3e-24, Identity=38%"; Hit description =golgi-specific brefeldin A-resistance guanine nucleotide exchange factor 1 (3M842) [Caenorhabditis elegans
  Gene Ontology: Mol. function=ARF guanyl-nucleotide exchange factor activity; Cellular component=mitochondrion; Biological process =retrograde (Golgi to ER) transport
  Coding regions on vcDNA: vcDNA=SeqID_92301; Strand=+; Position=1-636
DTANPPLNSPPSSQPLHSRLAFNGTTSAKINDTARHWKQWNSSEEMALAFGENKKAQMAARAMFDLVHQYGDNLREVLFLFSRPLRTGAHFTECSPSFSIXGWMNVLDCLLYMLKANLLPSPLVQLEDFVELSGFVSLKHCFKRRPTAPKKEESGLLSWLGLTGSSATGGGESGQSRPQNEQEKELAANTVAECHPEQIVLDSRYLASSSLT

SEQ ID NO: 165879 - protein, 187 aa, Heterodera glycines
  Homolog annotation: Hit_ID=NP_508928.2; Match level="QueryCoverage =97%, HitCoverage=20%, E-value=1e-22, Identity=34%"; Hit description =drosophila Discs Large homolog (107.0 kD) (dlg-1) [Caenorhabditis elegans] gb|AAK39197.2| Drosophila disc
  Gene Ontology: Cellular component=apical cortex; Biological process =regulation of synapse
  Coding regions on vcDNA: vcDNA=SeqID_92302; Strand=+; Position=80-640
MPGRSTEAHRALEQLEAYHALLTQPGDAELRYGIERVIGIFKANLFQALLDIQEFYDNTLLNERVPLDMKTTETRKLAERWEQSPPFGAVSRAFTPSSFDRPVFPATTTATPHTNGFNGEMETAITHSSHSYSYQEQSKQLTKDGWHTQEYRTQTVDGPSGFQTETVTNNGLIDDQGKAWEVEDVVL

SEQ ID NO: 165880 - protein, 112 aa, Heterodera glycines
  Coding regions on vcDNA: vcDNA=SeqID_92303; Strand=+; Position=299-634
AIRMLLLVVCDPTGWEALRTHNNIVHGSFIEAAQARGLLSDNNLWMNTVMEAFQTKKSIRQRIRWLAVFFATTNLSSPTTILDSILKDADNWLVNTSVAKASAEDQKQYVLR

SEQ ID NO: 165881 - protein, 44 aa, Heterodera glycines
  Coding regions on vcDNA: vcDNA=SeqID_92304; Strand=-; Position=21-155
FEISLGLNQNSLYCSQNLQRKECQVPKRQQVQFTISTDNKKYFK

SEQ ID NO: 165882 - protein, 183 aa, Heterodera glycines
  Homolog annotation: Hit_ID=NP_510109.1; Match level="QueryCoverage =51%, HitCoverage=11%, E-value=2e-17, Identity=48%"; Hit description =influenza virus NS1A binding protein like (90.9 kD) (XN244) [Caenorhabditis elegans] emb|CAA92005.1| Hypo
  Coding regions on vcDNA: vcDNA=SeqID_92305; Strand=+; Position=94-642
MADQWQEYLARDQSADETFHASVKTADNGQQQQQANNVANNNGSQRVAQTNGVGLPNGGDDGALRFVPERTRIKSRMNDETDEWAEREEMMAQEDQMMMLKDPKHKDSLLSRLDTFRRNRAFCDVVLFVDGRELLAHKAVLAAISPPLFDLFHSNSASIPIDEENEHTLLPDQALELAKAASQ

SEQ ID NO: 165883 - protein, 145 aa, Heterodera glycines
  misc_feature (97)..(97): Xaa can be any naturally occurring amino acid
  Homolog annotation: Hit_ID=CAE56617.1; Match level="QueryCoverage =100%, HitCoverage=36%, E-value=4e-21, Identity=41%"; Hit description= Hypothetical protein CBG24373 [Caenorhabditis briggsae]
  Gene Ontology: Mol. function=UDP-N-acetylgalactosamine transporter activity; Cellular component=Golgi membrane; Biological process =galactose transport
  Coding regions on vcDNA: vcDNA=SeqID_92306; Strand=+; Position=2-436
LLALVLHNACHELRTRYDMTRERLPRFSKPRPFCSMSSSDFAVPLILFVISTNDLCKCFKILYHRFGPSCLDTLKGGGPAVIYLVQNLMIFLAIEKXRTSAYMDTYRLKILTTAFFAVLILKQKLSIIQWVPLLILVDGAALTQY

SEQ ID NO: 165884 - protein, 206 aa, Heterodera glycines
  Homolog annotation: Hit_ID=CAE68439.1; Match level="QueryCoverage =90%, HitCoverage=39%, E-value=4e-44, Identity=49%"; Hit description =Hypothetical protein CBG14224 [Caenorhabditis briggsae]
  Gene Ontology: Mol. function=glutamate/aspartate porter activity; Cellular component=integral to plasma membrane; Biological process =synaptic transmission
  Coding regions on vcDNA: vcDNA=SeqID_92307; Strand=+; Position=4-621
MASQCVSPLPVKGSRRKHPLLANLLLVLTLISVFIGIGIAFFVRQFQPSQRTIDMIGFPGELFMNLLKSLILPLIAASLVSGLSQLDTRQSGRIGAFAALYYAITMVLAVTTGICLVLLIHPGDPSIKEHFASENDSHPANVSALEKLMDLLRNMFPDNIVQATFQQMETEYVEIRPPTNVSSTTAIVHAVHRHIDGMNTLGMIMF

SEQ ID NO: 165885 - protein, 58 aa, Heterodera glycines
  Coding regions on vcDNA: vcDNA=SeqID_92308; Strand=+; Position=13-189
EHWEKTLWEKERNLFDFRNSKHMTSSAHISRNGDLSSQLKFITIIFASATSKFSLFYA

SEQ ID NO: 165886 - protein, 154 aa, Heterodera glycines
  Coding regions on vcDNA: vcDNA=SeqID_92309; Strand=+; Position=160-624
QTLNEAEVLIMNFERGKTYFGGHCLWLNAELVTKISTINSEHSYAATPIQFGIGSPAPSTFTWPTTVTPQEQLVQYSLSSLSTSKQRLQFTCGRKKSFGRPSSQFQFGTCIRRPRLPSLIQTMDWRKVSATTLHSRTSFVKSVKAPTDDGRCPI

SEQ ID NO: 165887 - protein, 59 aa, Heterodera glycines
  Coding regions on vcDNA: vcDNA=SeqID_92310; Strand=+; Position=1-180
LLHLRLRRQRLRQLSNPRPSNRRQRRQPSPLSSKHLATDHFVNDGMCPADHGADQFLLF

SEQ ID NO: 165888 - protein, 186 aa, Heterodera glycines
  misc_feature (62)..(62): Xaa can be any naturally occurring amino acid
  Homolog annotation: Hit_ID=NP_506486.1; Match level="QueryCoverage =65%, HitCoverage=14%, E-value=2e-09, Identity=29%"; Hit description =citron-like (105.0 kD) (5O516) [Caenorhabditis elegans] emb|CAB04720.1| Hypothetical protein T08G5.5 [Cae
  Coding regions on vcDNA: vcDNA=SeqID_92311; Strand=+; Position=52-611
MYEAYTNEEIVSKLPIEASSIGSYVSKGKLFIGSRQGHLITCNQNSADTSKLHYEYQWLSRXDLIICLTDVHLSIHDAVEPFKLLDVCSKYKSISAFSHFVTESQTIHIAISARKHLHIFKYLLGELCEINDCAPITLPENAQAVVWCGVNNLILAFKCEFQFWDMDHFLHRDDLIDEKVTTNLFL

SEQ ID NO: 165889 - protein, 213 aa, Heterodera glycines
  Homolog annotation: Hit_ID=EAL19820.1; Match level="QueryCoverage =87%, HitCoverage=9%, E-value=2e-09, Identity=27%"; Hit description =hypothetical protein CNBG1130 [Cryptococcus neoformans var. neoformans B-3501A]
  Coding regions on vcDNA: vcDNA=SeqID_92312; Strand=+; Position=3-641
KLLPKTYGKRGAKEAKKRREERCEKAERARQGRWAKKTAPQPNLNAEVPQQDEAGPSTSAAPTEEAMEPPPPTPGPVPTPEMDEEILEFDDPPPSTPATPIGDLVPFPSTPTAPMDTGETTPPPLAIDERSERIEQLEKQLKDRYDTIQFLREQVRNREALISDLRRQLEQCAAPPTATPTTSKTTPNRGRPRKAIDELQRSSRKRLTEQILD

SEQ ID NO: 165890 - protein, 89 aa, Heterodera glycines
  Homolog annotation: Hit_ID=CAB88203.1; Match level="QueryCoverage =100%, HitCoverage=29%, E-value=8e-34, Identity=77%"; Hit description= putative cuticular collagen [Globodera pallida]
  Coding regions on vcDNA: vcDNA=SeqID_92313; Strand=+; Position=2-268
QETHIVLGIASMCSLLDIIATIDTLPSLNSDMSQMNRKVRDGVEAFRVNTDSGWTDLMDEQVVVTPPTKPRDNPFNSIFRVKRQLTEHC

SEQ ID NO: 165891 - protein, 70 aa, Heterodera glycines
  Coding regions on vcDNA: vcDNA=SeqID_92314; Strand=+; Position=103-315
MSDKKEKGGKDKEKKRRSKKSGKSAKKKTNERKTRIIKKEEKLSTGGEREREEAGRKSARSRSPAERRRR

SEQ ID NO: 165892 - protein, 169 aa, Heterodera glycines
  Homolog annotation: Hit_ID=NP_496203.2; Match level="QueryCoverage =97%, HitCoverage=30%, E-value=1e-31, Identity=45%"; Hit description =leucine-rich repeat containing protein (2K499) [Caenorhabditis elegans] emb|CAA88748.2| Hypothetical prot
  Coding regions on vcDNA: vcDNA=SeqID_92315; Strand=+; Position=154-660
MVRSLFDICLASVCQRSLVFDADLSLLPCDCKQRLMEFFASHDQLNSELCFGLMSRPMFGRNLTRLCFYLSDQLNDSILEALASFNQNLRIISIVECPRVTDTGIVSVTLRQNKLVCLELVGIPLLTSNALKAVNSNRLRSVDLSGCRKIASEGIFYLVFNNPSIVSLC

SEQ ID NO: 165893 - protein, 203 aa, Heterodera glycines
  Homolog annotation: Hit_ID=XP_416312.1; Match level="QueryCoverage =75%, HitCoverage=27%, E-value=3e-30, Identity=41%"; Hit description =PREDICTED: similar to KIAA1033 protein [Gallus gallus]
  Coding regions on vcDNA: vcDNA=SeqID_92316; Strand=+; Position=16-624
MERSLFAETSDGNIGNGGGTAPRHHQQEEGQLWHGHSESATSPMVASVSAKLLHLPPFHLGNKLISVKAFVRCHLESTFYNLSVLALHDCDSYRRMALLALHRYHLRLADSGLPNMSVDQGLDLLAVMADVDTFVADYCYDLNEQFFIERNEHGKTQLNILRVHQVINSVKTHGLGILHSLINSAYKFLRVQFQRLSRCLFDE

SEQ ID NO: 165894 - protein, 201 aa, Heterodera glycines
  Coding regions on vcDNA: vcDNA=SeqID_92317; Strand=+; Position=19-621
MSLMKMTTTLEMPNGPDESLWQECANDCAMFNYFSRESFQKCVQRYNGTFAEEKSMRVSYESMHAEAFLTALVNTRQTGRSYVGEFEVANYSNHANDMYFFIGLHQIPMDRLDLRLMDWYYPQMIKNFVKGKAPDIGWKPQNWNGRNYFRITFNVSDNGTLTDWPHGVDGYQDVAGLDFWLHELPLVEQNATRETEEEKEE

SEQ ID NO: 165895 - protein, 200 aa, Heterodera glycines
  Coding regions on vcDNA: vcDNA=SeqID_92318; Strand=+; Position=2-601
ENDPKKRIIKRKLPQLPVTGVVLPFNSGVKPNMARNGMARKALNPQAYEASAVKQMQSYKQTKSMELFKERGMKFTCVDSSQQQQEENRNGRAGGTSGGTLSSIGTVSACPVDMMDPSDREAIQFYEGERNGGRETKGSLAKSTEGGGFGASSLERAKRFGLIPPKFDPRIPPPPICQPPKRKEIEQPKEKRAIKQETEV

SEQ ID NO: 165896 - protein, 175 aa, Heterodera glycines
  Coding regions on vcDNA: vcDNA=SeqID_92319; Strand=+; Position=137-661
WKTKTDCPTSNSSWNMQAWEYVQMIKSILVLRQPAAPFELKEVISSLTNLFADSFQHDSRLRDIPLDKIDIWCFMRLFKDKDEDGQGDRLICISLAQRFTDESHYIMGASDAGQLPMDVPLISINHCLADFIKPEDIEGSRCAQCSNATPCLTVVDNSVDEAVEQEKAENCPTTS

SEQ ID NO: 165897 - protein, 113 aa, Heterodera glycines
  Coding regions on vcDNA: vcDNA=SeqID_92320; Strand=+; Position=57-398
MQMLGIRIPRHPPWLFNCCVSPPQSEFACLRVDRSLISGPSNFRHIGHIGAGDNLSTADDENAMGALLRSKGGPEFGMEVPAELRSSDVPIGVEKERNDGAAGGEGDGGAGDV

SEQ ID NO: 165898 - protein, 155 aa, Heterodera glycines
  Coding regions on vcDNA: vcDNA=SeqID_92321; Strand=+; Position=153-620
RVRLHKRFKVEGTDRKGNARTISFAKRSSAILDPRFGMIIWMICLENTDILLSKSIWKRGDGEEYDCLYSPSCEAPVSSGSWKLCLHQIELVWSLDAHVPFLSALWRRFGPLAQQTTSSFCQPQRKERPSTDGHRLNDFFFFFTPYFRLTNPHCV

SEQ ID NO: 165899 - protein, 153 aa, Heterodera glycines
  Coding regions on vcDNA: vcDNA=SeqID_92322; Strand=-; Position=14-475
GNQSLILIVDFFITNSGGKGQLKTENGQNDKKRKGGKSQKYSPGQRRRSRENGEHFGNRSSPNQRLRRSAEIGHGEEPKGGEGVLKSIRQGKSLEQQREGKPKHRKRERIGDERRAKIHGIGCDIHWHIMYRQARLASLFIALNVFHRREKTE

SEQ ID NO: 165900 - protein, 70 aa, Heterodera glycines
  Homolog annotation: Hit_ID=NP_871914.1; Match level="QueryCoverage =100%, HitCoverage=46%, E-value=1e-24, Identity=72%"; Hit description= serine/aRginine rich pre-mRNA SPlicing factor, Serpin (rsp-1) [Caenorhabditis elegans] emb|CAD59160.1| H
  Gene Ontology: Mol. function=pre-mRNA splicing factor activity; Cellular component=nuclear speck; Biological process=mRNA splice site selection
  Coding regions on vcDNA: vcDNA=SeqID_92323; Strand=+; Position=2-211
ARVYIGHLPSRATERDLEHFFRGYGRIRDVMLKNGFGFVEFDDSRDADDAVYDLNGQKLLGERVIVELSR

SEQ ID NO: 165901 - protein, 108 aa, Heterodera glycines
  Coding regions on vcDNA: vcDNA=SeqID_92324; Strand=-; Position=154-480
RKGCEMIGVLPFHAFSLLPPFSLFPLRMCHLKSKRPKALISRRKVIVSKKRRNEAEEVIGGAKVIRGEAKREDKALPPREETEAPRGGDFSVIVCASFCIVSFNIFFY

SEQ ID NO: 165902 - protein, 163 aa, Heterodera glycines
  Coding regions on vcDNA: vcDNA=SeqID_92325; Strand=+; Position=176-664
MPSLPIRDEENPGQNFVMCFHLWSPTNNGSGDAIVEFAESERLLSTNVQNSKANEQLHSLYSEYKVINIESCAAADSSTSSVLLNSDSFGSSMVQPNAKQLLVCFTVFAMFVLLSTAFACYICVVRRYAERMRTKCDHLLDEQRSASYNSTDNPYSVYAKSNN

SEQ ID NO: 165903 - protein, 93 aa, Heterodera glycines
  Coding regions on vcDNA: vcDNA=SeqID_92326; Strand=+; Position=233-511
FRIEQKDELIERDREALHANIELQEERMEEVEKAKELVNKAIQTLGQTLAKLNEELDEIKPLLLKLYRKRDKCRDEILALPKQQNTTHAHLDR

SEQ ID NO: 165904 - protein, 158 aa, Heterodera glycines
  Homolog annotation: Hit_ID=CAE67927.1; Match level="QueryCoverage =95%, HitCoverage=69%, E-value=2e-38, Identity=55%"; Hit description =Hypothetical protein CBG13527 [Caenorhabditis briggsae]
  Gene Ontology: Mol. function=transporter activity; Cellular component= integral to membrane; Biological process=immune response
  Coding regions on vcDNA: vcDNA=SeqID_92327; Strand=+; Position=2-475
TLQRTEVAFILYAEIATIIVLLLPWVRSTMWKKVFNSRVVHKLKQFSNVYAYAFIFVLILLFIDATREVRKYSHVDTTTEMVGLVAEADAVDHMRLFRAQRNLYMSGFSLLMALIISRIDTLLARCAHLELAAEAAMKQAERAGKAAHTLLGEKGDVN

SEQ ID NO: 165905 - protein, 73 aa, Heterodera glycines
  Coding regions on vcDNA: vcDNA=SeqID_92328; Strand=-; Position=3-221
PSSSSLLLVLSLVRRRRFRQRWGTRRTQQPFWRSWKEKVKDEGKTEKVQRNKHLINCSNYYIYSILCILNKFL

SEQ ID NO: 165906 - protein, 206 aa, Heterodera glycines
  misc_feature (190)..(190): Xaa can be any naturally occurring amino acid
  Homolog annotation: Hit_ID=P11084; Match level="QueryCoverage=71%, HitCoverage=47%, E-value=3e-66, Identity=80%"; Hit description =Serine/threonine protein phosphatase 4 catalytic subunit (PP4C) (Pp4) (Protein phosphatase X) (PP-X) pir||PARB
  Gene Ontology: Mol. function=protein phosphatase type 2A, intrinsic catalyst activity; Cellular component=cytoplasm; Biological process =embryogenesis and morphogenesis
  Coding regions on vcDNA: vcDNA=SeqID_92329; Strand=+; Position=40-656
METENDATASPNRPLSAASVATSTALRDGGEADNSDAQQHQQATRELDEAVTLAAGRGARITDLDRQIETLMRCECLTEQEVKVLCAKAREILLQEGNVQRIDAPVTVCGDVHGQFHDLMELFRVGGQVPDTNYLFLGDFVDRGFYSVETFLLLLALKVRYPDRMMLIRGNHESRQITQVYGFYDECFRXYGSTVVWRCWTEVFDC

SEQ ID NO: 165907 - protein, 126 aa, Heterodera glycines
  Homolog annotation: Hit_ID=CAE68916.1; Match level="QueryCoverage =87%, HitCoverage=37%, E-value=2e-31, Identity=56%"; Hit description =Hypothetical protein CBG14895 [Caenorhabditis briggsae]
  Gene Ontology: Mol. function=C-terminal protein carboxyl methyltransferase activity; Cellular component=membrane; Biological process=protein-membrane targeting
  Coding regions on vcDNA: vcDNA=SeqID_92330; Strand=+; Position=251-628
MVHRLRFGPFFSTTHTLTNVESLRPDSFLLNHSSAYWTAAICSWIEFWTRAWAFPTFCSLYISSIGVCCCIFGEFFRKLAMCHASVGFTHQIAVRRNKDHQLCTQGVYAFVRHPGYLGWMVWSVGT

SEQ ID NO: 165908 - protein, 191 aa, Heterodera glycines
  Homolog annotation: Hit_ID=AAN31467.1; Match level="QueryCoverage =91%, HitCoverage=56%, E-value=8e-70, Identity=71%"; Hit description =ADP/ATP translocase [Phytophthora infestans]
  Gene Ontology: Mol. function=adenine transporter activity; Cellular component=mitochondrial membrane; Biological process=transport
  Coding regions on vcDNA: vcDNA=SeqID_92331; Strand=+; Position=81-653
MGKDAKKQMSTEDQIKSFMLDLVAGGVSGGISKTVVAPIERVKLILQTQDSNTQLAPEKRYKGIMDVFRRIPAEQGIASFWRGNLANIVRYFPTQALNFAFKDKYKQIFVRHNPKTDFWKFFAGNLASGGAAGATSLLFVYPLDFARTRLGADVGKGSARQYTGMVDCISKTYKQNGLKGVYGGFGVSVVG

SEQ ID NO: 165909 - protein, 47 aa, Heterodera glycines
  Homolog annotation: Hit_ID=NP_500197.1; Match level="QueryCoverage =97%, HitCoverage=56%, E-value=1e-09, Identity=63%"; Hit description =protein translocation complex beta (8.6 kD) (4D152) [Caenorhabditis elegans] gb|AAK68450.1| Hypothetical
  Coding regions on vcDNA: vcDNA=SeqID_92332; Strand=+; Position=137-277
MNSGGLWRFYTEDSNGLKKEPVPAMDMSQLIIASVTVLRIWEKYSQT

SEQ ID NO: 165910 - protein, 101 aa, Heterodera glycines
  Coding regions on vcDNA: vcDNA=SeqID_92333; Strand=-; Position=1-303
ILYNISIRRSFTRPNIARNTVLNLLKVFRRFVEIFRTLASHMVDVRRARRIVFHPIADSFTLCRTCRQRVPTHRTVIHRIDLALKLLSLLTRRADERRENE

SEQ ID NO: 165911 - protein, 116 aa, Heterodera glycines
  misc_feature (45)..(45): Xaa can be any naturally occurring amino acid
  Homolog annotation: Hit_ID=NP_505750.1; Match level="QueryCoverage =88%, HitCoverage=45%, E-value=2e-17, Identity=43%"; Hit description =proteasome Alpha Subunit (25.3 kD) (pas-2) [Caenorhabditis elegans] emb|CAA98441.1| Hypothetical protein
  Gene Ontology: Mol. function=endopeptidase activity; Cellular component=26S proteasome; Biological process=ubiquitin-dependent protein catabolism
  Coding regions on vcDNA: vcDNA=SeqID_92334; Strand=+; Position=2-352
TQPASGISQLSYHIACVYSGMGPEARLLARKGRNIAMDYRALYGXGLPVPLLACRVVAALREYTRPGGDHTVGVALLIGGRDSDNGALVFRVHLAGAYHGRGITAIRNNHQLCKIV

SEQ ID NO: 165912 - protein, 150 aa, Heterodera glycines
  Homolog annotation: Hit_ID=CAG04469.1; Match level="QueryCoverage =40%, HitCoverage=20%, E-value=2e-09, Identity=42%"; Hit description =unnamed protein product [Tetraodon nigroviridis]
  Coding regions on vcDNA: vcDNA=SeqID_92335; Strand=+; Position=185-634
MPPHHQHIHHHVPATQLQQQPVQPYLVHHLPQLQHHQQQHHHSVVVPTHAQHVQPHHPTPLAVPQPMRPSPPPLSMPGTGAAKHHYQCTKVRAHNTFGLKCRFRPDGLAVATTSADQTAKLWSCSSNTHKLLNTYSVPGNKWVWDCAFTN

SEQ ID NO: 165913 - protein, 210 aa, Heterodera glycines
  Homolog annotation: Hit_ID=NP_494727.1; Match level="QueryCoverage =98%, HitCoverage=54%, E-value=3e-12, Identity=30%"; Hit description =putative secreted or extracellular protein precursor (49.2 kD) (2E439) [Caenorhabditis elegans] gb|AAA683
  Coding regions on vcDNA: vcDNA=SeqID_92336; Strand=+; Position=3-632
IHYRDGVQKAIFDETPRRVPADFEDTNSVGGAAGELDTYDDVRLVEPQLEQPLFIPEIYRNDTREGTTKAPKGAKGGAAATNANRPLVSPEVQSRPPITVRTTTPRPSSATVRPPHPFGRPPPPLVLPQQPRLPPQHPQPPRPFPPPNAPLPQPFRQNSQPSPLPHSPNAVPRPMPNQQQQRPLTPNIGMGQIRTGVCHQAIFYTPQSVS

SEQ ID NO: 165914 - protein, 207 aa, Heterodera glycines
  Homolog annotation: Hit_ID=AAH72894.1; Match level="QueryCoverage =96%, HitCoverage=67%, E-value=5e-82, Identity=74%"; Hit description =Cdk5 protein [Xenopus laevis] sp|P51166|CDK5_XENLA Cell division protein kinase 5 (Neuronal cyclin-depende
  Gene Ontology: Mol. function=protein binding; Cellular component =transcription factor complex; Biological process=cell-matrix adhesion
  Coding regions on vcDNA: vcDNA=SeqID_92337; Strand=+; Position=37-657
MKMSNNNDMSGYEKLGKIGEGTYGTFKARNKDTEQIVALKIVRLDDEDEGVPSSALREICLLRELRHANVVRLQNVVHTNKTLNLVFEFCDLDLRKFFDTLDGQIDQKVVRSLMHQLLSGLCYCHAHNVLHRDLKPQNLLINNTVKTAPQLKLADFGLARPFGIPVRCYSAEVVTLWYRPPDVLLGAKLYSTSIDMWSAGCIFAEIS

SEQ ID NO: 165915 - protein, 149 aa, Heterodera glycines
  Homolog annotation: Hit_ID=CAE59091.1; Match level="QueryCoverage =69%, HitCoverage=51%, E-value=8e-29, Identity=57%"; Hit description =Hypothetical protein CBG02383 [Caenorhabditis briggsae]
  Gene Ontology: Mol. function=pre-mRNA splicing factor activity; Cellular component=nucleus; Biological process=spliceosome assembly
  Coding regions on vcDNA: vcDNA=SeqID_92338; Strand=+; Position=55-504
MSNRRGNDSINFDELHSLKVDNLPYDASVHELRRMFDRYGDIGDVYIPRDRYNNHNRGFGFVRFYSKRDADYAVSRVDGRMLSGRELRVSIAKYGRPIDEERDRGRFLFAIFSIQILIHYLFYNFVLSTKPERRVCLGLFPRGCFLAAA

SEQ ID NO: 165916 - protein, 185 aa, Heterodera glycines; identical to SEQ ID NO: 142225
  Homolog annotation: Hit_ID=NP_508800.2; Match level="QueryCoverage =83%, HitCoverage=34%, E-value=2e-25, Identity=38%"; Hit description =putative protein, with at least 3 transmembrane domains, of bilaterial origin (50.4 kD) (XF295) [Caenorha
  Coding regions on vcDNA: vcDNA=SeqID_92339; Strand=+; Position=59-613

SEQ ID NO: 165917 - protein, 143 aa, Heterodera glycines
  Homolog annotation: Hit_ID=XP_220829.2; Match level="QueryCoverage =62%, HitCoverage=13%, E-value=2e-09, Identity=35%"; Hit description =similar to hypothetical protein FLJ20315 [Rattus norvegicus]
  Coding regions on vcDNA: vcDNA=SeqID_92340; Strand=+; Position=1-432
LNETPQQLLETKHSFIHSSFIMARPRGSGRDPFKARSARARRRAGNKRKAAAGTAANVQAANRRPICLICLKKMTQVRQVRTICDHVFHYVCFHRWLKYRLFCPVCLLNFRTELYHSGNAVFEGAYNDGHVVLIPDGEQSNSG

SEQ ID NO: 165918 - protein, 177 aa, Heterodera glycines
  Homolog annotation: Hit_ID=CAB88203.1; Match level="QueryCoverage =100%, HitCoverage=97%, E-value=2e-73, Identity=71%"; Hit description= putative cuticular collagen [Globodera pallida]
  Gene Ontology: Mol. function=structural constituent of cuticle; Cellular component=extracellular; Biological process=reproduction
  Coding regions on vcDNA: vcDNA=SeqID_92341; Strand=+; Position=18-548
MQETHIVLGIASVCSLLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGGAGQPGQPGQPGQPAPPGAPGQPGQPGNSGQPGQPGAPGQPGKDSGYCPCPPRSSVLAV

SEQ ID NO: 165919 - protein, 124 aa, Heterodera glycines
  Homolog annotation: Hit_ID=CAB88203.1; Match level="QueryCoverage =97%, HitCoverage=40%, E-value=5e-47, Identity=75%"; Hit description =putative cuticular collagen [Globodera pallida]
  Coding regions on vcDNA: vcDNA=SeqID_92342; Strand=+; Position=2-376
QETHIVLGIASVCSLLAIIATGVTLPSLYSEMSQMNSKVRDGIEAFRVNTDSDWTDLMDVQVVVTPPAKPRDNPFNSIFLAKRRLPGHCQSAGLQQTRWPPGPTRPRGPTGQPGQTGSAGQHPY

SEQ ID NO: 165920 - protein, 69 aa, Heterodera glycines
  Homolog annotation: Hit_ID=NP_501141.1; Match level="QueryCoverage =98%, HitCoverage=6%, E-value=4e-18, Identity=62%"; Hit description =solute carrier family 12 member (4H981) [Caenorhabditis elegans] gb|AAA81476.1| Temporarily assigned gene
  Gene Ontology: Mol. function=potassium:chloride symporter activity; Cellular component=mitochondrion; Biological process=embryogenesis and morphogenesis
  Coding regions on vcDNA: vcDNA=SeqID_92343; Strand=+; Position=2-211
HKMHGAIRLNELILEHSRCSQLVLFSLPKPPFFEDEVDDYIQYLEVISDNLQKVLFVRGTGAEVITTSS

SEQ ID NO: 165921 - protein, 50 aa, Heterodera glycines
  Homolog annotation: Hit_ID=NP_493540.2; Match level="QueryCoverage =100%, HitCoverage=19%, E-value=2e-18, Identity=96%"; Hit description= tropomyosin, LEVamisole resistant LEV-11 (29.6 kD) (lev-11) [Caenorhabditis elegans] emb|CAD45604.1| Hyp
  Gene Ontology: Biological process=pole plasm oskar mRNA localization
  Coding regions on vcDNA: vcDNA=SeqID_92344; Strand=+; Position=113-265
AETRAEFAERSVQKLQKEVDRLEDELLVEKERVRNLTAEIEQTVQEIQGS

SEQ ID NO: 165922 - protein, 30 aa, Heterodera glycines
  Coding regions on vcDNA: vcDNA=SeqID_92345; Strand=+; Position=2-91
TTGTSSFGKPHNKTHTLCPRCGRTSYHIQK

SEQ ID NO: 165923 - protein, 179 aa, Heterodera glycines
  Coding regions on vcDNA: vcDNA=SeqID_92346; Strand=+; Position=2-541
WEKLKFVFVLPSLMFLSVIYKNYSFSYDNSTLFSFAYLQNNSGELSSEECFGEKMVYTLKMNDSRIIRGKKFNCSLTWLLERYKLSDKYAIKEKIEVKYPGHPKFVFVTAANNNYFPYLRTFIANIKEIFGCQQKIIAYDLETVTKNKEWMNELDSVCNFEWRIFDFGQMVEGRVRHPK

SEQ ID NO: 165924 - protein, 182 aa, Heterodera glycines
  Homolog annotation: Hit_ID=AAB40605.1; Match level="QueryCoverage =74%, HitCoverage=32%, E-value=4e-28, Identity=47%"; Hit description =cathepsin B-like cysteine proteinase [Ascaris suum]
  Coding regions on vcDNA: vcDNA=SeqID_92347; Strand=+; Position=8-553
MVRPISFSSFPPFLLLLFVAVFPLLLGAMTTDYHGFFGTRNAPLRHERRHFLPSAFVSSADEMSSSNSRHRYTGRVFIARDELRAARPSPQAEQISGQSLVDYVNRRQRLWRAELSPKFQSYDEAIKWRMMGVNHVRHSTKAKKVLGKTRFLDLDLPESFDARQRWNFCPSISLIRDQSSCG

SEQ ID NO: 165925 - protein, 96 aa, Heterodera glycines
  Coding regions on vcDNA: vcDNA=SeqID_92348; Strand=+; Position=32-322
WNNNKSSQRKCQVPAVPPPPPLRCPNFRFIPAMANCVAVEFAQCANSRRCSDYSRGWSVAWAWRWPFAWPPFCARWPSTDCSTTSPRHNGATHRHN

SEQ ID NO: 165926 - protein, 25 aa, Heterodera glycines
  Coding regions on vcDNA: vcDNA=SeqID_92349; Strand=-; Position=1-75
CSQSVKVVDIRQTLPADTQRPLPLS

SEQ ID NO: 165927 - protein, 98 aa, Heterodera glycines
  misc_feature (52)..(52): Xaa can be any naturally occurring amino acid
  Coding regions on vcDNA: vcDNA=SeqID_92350; Strand=+; Position=247-540
MEQQGTIDFWRPPPFVNSSGDVMVDVLRNGRHFLDFLRKFQVEFKVLVEDLXKLIEEKEIGPSPYAKLSKDGPILRDTFDRFEGVGPPMGDYHSFPQL

SEQ ID NO: 165928 - protein, 85 aa, Heterodera glycines
  Homolog annotation: Hit_ID=AAQ20895.1; Match level="QueryCoverage =95%, HitCoverage=75%, E-value=3e-15, Identity=46%"; Hit description =glutaredoxin [Aphelenchus avenae]
  Coding regions on vcDNA: vcDNA=SeqID_92351; Strand=+; Position=2-256
ELCNGLIKTKPVVIFSKEHCPFWVKANDAINSFKLRWGGLEIGELNHRNDCDQIQDFLKELTGTRSVPREFISGTFVWGGNKQSG

SEQ ID NO: 165929 - protein, 76 aa, Heterodera glycines
  Homolog annotation: Hit_ID=EAL20618.1; Match level="QueryCoverage =97%, HitCoverage=38%, E-value=2e-14, Identity=48%"; Hit description =hypothetical protein CNBE3260 [Cryptococcus neoformans var. neoformans B-3501A]
  Gene Ontology: Mol. function=transcriptional activator activity; Cellular component=CCAAT-binding factor complex; Biological process =regulation of transcription, DNA-dependent
  Coding regions on vcDNA: vcDNA=SeqID_92352; Strand=+; Position=2-232
QDRLLPIANISRIMRRDLPTERKLSKHNTKCVQECITEFVLLITSQVSERCSLQKPKKIMDEHLLLAFRTLWYDKD

SEQ ID NO: 165930 - protein, 199 aa, Heterodera glycines
  Homolog annotation: Hit_ID=NP_510150.1; Match level="QueryCoverage =96%, HitCoverage=67%, E-value=2e-51, Identity=47%"; Hit description =putative secreted or extracellular protein family member precursor (XN558) [Caenorhabditis elegans] emb|C
  Coding regions on vcDNA: vcDNA=SeqID_92353; Strand=+; Position=16-612
MDIPPFIFLLFLVPTLSVQLTIDDEEFGLNLQLIKHQPCPFKSDKSKWDRKLEFEAGNEQEGPKLVQRPNEPNCYSIGGKVTVFSEFKGEFSIYLELRSSANKKQVPEPCHNRKDDGCGGFGSCLYCDACQTLEENRGLKAQLLVDGKSISCGQELSPGTYENMELVFCLPNAEEMLKSQRLTKETFQSLIQTEDGTNL

SEQ ID NO: 165931 - protein, 209 aa, Heterodera glycines
  misc_feature (48)..(48): Xaa can be any naturally occurring amino acid
  Homolog annotation: Hit_ID=CAE69821.1; Match level="QueryCoverage =99%, HitCoverage=67%, E-value=3e-62, Identity=58%"; Hit description =Hypothetical protein CBG16139 [Caenorhabditis briggsae]
  Gene Ontology: Mol. function=enoyl-CoA hydratase activity; Cellular component=mitochondrion; Biological process=growth
  Coding regions on vcDNA: vcDNA=SeqID_92354; Strand=+; Position=1-627
KKLSVIGSGLMGAGIAQVSAQANVKGALVDLIQSIVEKGKRGIEKTIXRVAKKQFEHPGKHNELVTQCLSNISLETDISQVVSCADLVIEAISDNLDVKRKLFAQVESALPQNGKMATNTSSLTLADIAVNLKRKDSFGGLHFFNPVPIMKLLEVVRFDGTSEETFNVLMDFGKTIGKTTVVCKDTPGFIVNRLLVPFMLEAMRMFDRG

SEQ ID NO: 165932 - protein, 91 aa, Heterodera glycines
  Homolog annotation: Hit_ID=NP_004573.2; Match level="QueryCoverage =93%, HitCoverage=25%, E-value=6e-29, Identity=68%"; Hit description =Rab geranylgeranyltransferase, beta subunit [Homo sapiens] emb|CAI22393.1| OTTHUMP00000058696 [Homo sapie
  Gene Ontology: Mol. function=RAB-protein geranylgeranyltransferase activity; Cellular component=Rab-protein geranylgeranyltransferase complex; Biological process=protein modification
  Coding regions on vcDNA: vcDNA=SeqID_92355; Strand=+; Position=3-278
LPDVCYSWWVLASLAIIKRLHWIDGESLTHFIIASQDDEKGGIADRPGDESDPFHTVFGLYGLSLLGHKGLEAVDPVFCMTKKSLVNFAFA

SEQ ID NO: 165933 - protein, 97 aa, Heterodera glycines
  misc_feature (68)..(68): Xaa can be any naturally occurring amino acid
  Homolog annotation: Hit_ID=CAB88203.1; Match level="QueryCoverage =98%, HitCoverage=32%, E-value=2e-34, Identity=73%"; Hit description =putative cuticular collagen [Globodera pallida]
  Coding regions on vcDNA: vcDNA=SeqID_92356; Strand=+; Position=2-292
RETHIVLSIASGCSLLAIIATVVTLPSLYSEMSQMNSKVHDGVDAFRVNTDSGCTDLKDQQVVVTPPXNSRDNPFNSIFRAQRQLPGYCRCDGLQQS

SEQ ID NO: 165934 - protein, 88 aa, Heterodera glycines
  misc_feature (72)..(72): Xaa can be any naturally occurring amino acid
  Homolog annotation: Hit_ID=NP_492117.1; Match level="QueryCoverage =100%, HitCoverage=14%, E-value=3e-12, Identity=39%"; Hit description= atp-dependent clp protease atp-binding clpx like (63.6 kD) (1I153) [Caenorhabditis elegans] emb|CAA98115
  Gene Ontology: Cellular component=mitochondrion
  Coding regions on vcDNA: vcDNA=SeqID_92357; Strand=+; Position=2-265
SKPLRKTPTTNDNSKLLYCIDCNIIFSSSSSNDATTKKFNILNNGPIQSPTNPTEISAYVDKYVVGQQQAKXALPVGIDQHYQRLENN

SEQ ID NO: 165935 - protein, 117 aa, Heterodera glycines
  Homolog annotation: Hit_ID=NP_955890.1; Match level="QueryCoverage =64%, HitCoverage=19%, E-value=3e-20, Identity=63%"; Hit description =sirtuin 2 (silent mating type information regulation 2, homolog) 2 [Danio rerio] gb|AAH45510.1| Sirtuin 2
  Gene Ontology: Mol. function=DNA binding; Cellular component=nucleus; Biological process=gene silencing
  Coding regions on vcDNA: vcDNA=SeqID_92358; Strand=-; Position=110-528
MNAVKVPRCVGCKKGVVKPDIVFFGESLPSRFFSSSLVDFPKCGLLIVMGTSLVVHPFASLVDQVPSDTPRLLINLQPAGTDLLRYTEPDNIRSGFDQHNTGEKCQHFQNARLGAGV

SEQ ID NO: 165936 - protein, 211 aa, Heterodera glycines
  misc_feature (85)..(85): Xaa can be any naturally occurring amino acid
  Homolog annotation: Hit_ID=CAE64749.1; Match level="QueryCoverage =100%, HitCoverage=28%, E-value=4e-70, Identity=61%"; Hit description= Hypothetical protein CBG09538 [Caenorhabditis briggsae]
  Gene Ontology: Mol. function=protein binding; Cellular component=SCF ubiquitin ligase complex; Biological process=induction of apoptosis by intracellular signals
  Coding regions on vcDNA: vcDNA=SeqID_92359; Strand=+; Position=2-633
VLLVLKYVTAKDVFMRYHKTHLSRRLILELVADQEKEEMLVGKFREAGMPVDFVNKLFRMLQDIEVNKDLNLALRKSLEKGNCSXNDCVSVKILNAGAWSRSRDRSHLTLPRELEDLIPEVEDFYKKQHCGRKLNWAHHWSTGTVSFTSKAGRFDLEVTTHQMAILFCWNDRPNDKLSFATIRLATELSEGELARSLLTLVNFPKVRMRLI

SEQ ID NO: 165937 - protein, 168 aa, Heterodera glycines
  misc_feature (33)..(33): Xaa can be any naturally occurring amino acid
  Homolog annotation: Hit_ID=NP_004090.4; Match level="QueryCoverage =94%, HitCoverage=55%, E-value=9e-41, Identity=49%"; Hit description =stomatin isoform a [Homo sapiens] emb|CAH70728.1| stomatin [Homo sapiens] emb|CAH72707.1| OTTHUMP00000064
  Gene Ontology: Mol. function=protein binding; Cellular component =lipid raft; Biological process=signal transduction
  Coding regions on vcDNA: vcDNA=SeqID_92360; Strand=+; Position=2-505
TTSDDTDSRGSCSSLLICFSYCSSIICFPCAIXLSIRVIHQYERAVIFRLGKVMREVAGPGLIFILPCIDDFRCIDMRTTSFDVPPQEFLSKDSVSVTVDELIYFRVDDANKAVFNVENATMATQLLRHTIFPNILATKTLSKLLNNRNQNHFEMQPVLERLTDVWGV

SEQ ID NO: 165938 - protein, 158 aa, Heterodera glycines
  misc_feature (36)..(36): Xaa can be any naturally occurring amino acid
  Homolog annotation: Hit_ID=CAE73993.1; Match level="QueryCoverage =99%, HitCoverage=48%, E-value=2e-35, Identity=41%"; Hit description =Hypothetical protein CBG21626 [Caenorhabditis briggsae]
  Gene Ontology: Cellular component=membrane; Biological process=lipid metabolism
  Coding regions on vcDNA: vcDNA=SeqID_92361; Strand=+; Position=2-474
NKIRLLHRDKLKPCMWLNKHIQSHYRPLELPWTLCXRSIFQWNNETVNVWSHLLGFVWFVYLQWWALNESLPSVNAPIADYWVMGTAMLCSQLCMLLSSAYHIFGCHSPQRRKQWLRADLFGVSAGLSGLYMTGLYTSFYHFPELQKFYGTLIGAMVV

SEQ ID NO: 165939 - protein, 68 aa, Heterodera glycines
  Coding regions on vcDNA: vcDNA=SeqID_92362; Strand=+; Position=6-209
KPKCRSVICPHRQMPPTSWPNAFVSTANERNERRIAPTQSSSTSSIILGRHRRVASSPAVSIISAGAS

SEQ ID NO: 165940 - protein, 91 aa, Heterodera glycines
  Coding regions on vcDNA: vcDNA=SeqID_92363; Strand=+; Position=1-276
ELVPAVFGAEEAAEARTETGRGEATETAERGRAPSPDAAQVQSDERFSAFFVDSAFAIDRTSSHYKGGNLADRQAKERQKRRLLKNNTDAD

SEQ ID NO: 165941 - protein, 127 aa, Heterodera glycines
  Coding regions on vcDNA: vcDNA=SeqID_92364; Strand=+; Position=177-557
FPWLLLIGMLYKKVDAASAEVVNSGLDFFSTPPTNCAVSNSSYREYLTLNPISSRPFHFKAIVWQCVTLISVCSDSSDHQLHRPQQSVCVHGIQAQENRRRRSVVDVPANAAVGLIQMPGATFIRNL

SEQ ID NO: 165942 - protein, 76 aa, Heterodera glycines
  Coding regions on vcDNA: vcDNA=SeqID_92365; Strand=-; Position=0-227
KSTPLYPMVYSLYAFSHSQLGMFPCKHLFLFFQIYNIKLFEFGDKGSGETERKNGFYTIILNLNCKIFLLRFVINR

SEQ ID NO: 165943 - protein, 133 aa, Heterodera glycines
  Coding regions on vcDNA: vcDNA=SeqID_92366; Strand=+; Position=111-509
KMEEGGLPPETAPGSATAEQQQQQQQATQPSGNEAPLDDGLAMLHELYQRRHAELLAQFQQSQSIAQQDYLLNLQLLQSALPAAAAMVVLQQQQIAVMPSAASQHRPLLGSLAHTSSEQSTEEFDVSAQQTAQ

SEQ ID NO: 165944 - protein, 81 aa, Heterodera glycines
  Coding regions on vcDNA: vcDNA=SeqID_92367; Strand=+; Position=347-592
NWWDPNPRPPPPKASTLNTPPLGRLTQAHLIPFSLSFFFGRNPDQKCLSSLFRALPGPGPKQPWYHSKAKSLLMCTNILKF

SEQ ID NO: 165945 - protein, 72 aa, Heterodera glycines
  Homolog annotation: Hit_ID=NP_492268.1; Match level="QueryCoverage =91%, HitCoverage=14%, E-value=4e-28, Identity=83%"; Hit description =TuBulin, Alpha (tba-5) [Caenorhabditis elegans] emb|CAB01495.1| Hypothetical protein F16D3.1 [Caenorhabdi
  Gene Ontology: Mol. function=GTP binding; Cellular component =microtubule; Biological process=microtubule-based process
  Coding regions on vcDNA: vcDNA=SeqID_92368; Strand=+; Position=88-478
MPVGGKMREVISLHMGQAGVQIGNACWELYCLEHGILPDGRMPTDESVGVEDHSYNTFFSETPSGKHVPRSI

SEQ ID NO: 165946 - protein, 205 aa, Heterodera glycines
  Coding regions on vcDNA: vcDNA=SeqID_92369; Strand=+; Position=3-617
KVKKPSLVSAPAGTFSAADNHCSSDEGAPKAKSGRSCSSSTTSSASVPCFPKLDAQRSDKKVNSCSKNIGGDEKMLMGQQHLFAGGHSIKVDQDGVFFVGMTAAESGGSLANTEQQQQQNVCDFAPSGVVGDCAVPSFSAAVYAPMISAISDIYQQTMERGEAAHNNGIGTATRTRDDEQEHSPESGFSDESSSLMMMQGLLTTV

SEQ ID NO: 165947 - protein, 108 aa, Heterodera glycines
  Homolog annotation: Hit_ID=CAC33829.1; Match level="QueryCoverage =100%, HitCoverage=32%, E-value=4e-34, Identity=69%"; Hit description= annexin 2 [Globodera pallida]
  Gene Ontology: Mol. function=phospholipid binding; Cellular component= plasma membrane; Biological process=skeletal development
  Coding regions on vcDNA: vcDNA=SeqID_92370; Strand=+; Position=2-325
IHVLRTSCNQQRKELAREFKQLFGEDLSAKLKKALSGDFEELILALMEPPADDDAQQMHRAMPGLGTHESALIEIVVTHSSRQIDEMNRVYEQLYGHPLENDIVGDTS

SEQ ID NO: 165948 - protein, 188 aa, Heterodera glycines
  Coding regions on vcDNA: vcDNA=SeqID_92371; Strand=+; Position=15-578
LTMFDYDRHLNLAHQVAGNVDASNGQKKAITRTLTDDDDTLPFMGPLDSSPSEDDGKKTDDNAIVHGLEGLLRRCSSPNNGFHIGQFRQKSASVGSDHLYSMQFLSKRPPFHLLDTQRHKFASNGTSLDMQHTFRRLSGGSSGALADGYECDTSSGYGSPGALGTPLASPAMGSAQFHAAQLHKLFMD

SEQ ID NO: 165949 - protein, 179 aa, Heterodera glycines
  Coding regions on vcDNA: vcDNA=SeqID_92372; Strand=+; Position=3-542
QSILFGFCPLFRPPLELYHPGLVLFVIALPCHLFLAMIPVSVFFLTFDRICIIYYGPGYSDRLRKFILYAYQLLLLVCVVYNLLGFHAALPMPEKTCKRFSSASFFGMAFGLIYSHANECFFSVRDQWLHFGRGCPVLFGMACRLCPFQRVRRCNFLHNALPLQQTAVGPNGNYEQPLA

SEQ ID NO: 165950 - protein, 58 aa, Heterodera glycines
  Coding regions on vcDNA: vcDNA=SeqID_92373; Strand=-; Position=3-176
LLLSKFISKIFYFDGFLSNVRARDRILRHMPFFLRTSFDILSIKNAFSTWFEASTLTF

SEQ ID NO: 165951 - protein, 57 aa, Heterodera glycines
  Coding regions on vcDNA: vcDNA=SeqID_92374; Strand=-; Position=319-492
FCKVRQNVQINTLGFSIALKYAFKNICFLIKKLKFNILHLILKRIKKFFLKSINLKE

SEQ ID NO: 165952 - protein, 97 aa, Heterodera glycines
  Coding regions on vcDNA: vcDNA=SeqID_92375; Strand=+; Position=146-436
QMHIGALIIDHLPFRSDHFPPPLLNYASVIPFHCLLRLRKGIISAAVAQVTLKIGAIKHNANIVFSFDTRKKGTKNGTHAFRRSRFGAPVSAPARFS

SEQ ID NO: 165953 - protein, 99 aa, Heterodera glycines
  Coding regions on vcDNA: vcDNA=SeqID_92376; Strand=+; Position=1-300
LEEEHRLVNTVRSLIRIKNPNDRLCLARAVLLGLHDWRSRSPGGGGPTAFKSFANRQHTHGPEARNLLRRAAIPRNKHRYTIDDVQKGQDWIDQRYGPV

SEQ ID NO: 165954 - protein, 75 aa, Heterodera glycines
  Coding regions on vcDNA: vcDNA=SeqID_92377; Strand=+; Position=6-233
ALLISDHQQGEFLYFTYICRYFFLFRLHFKREIIKFTFWRYFQIGRLIFLKNQRGNRLVSKLPKLKKIDLCSSLD

SEQ ID NO: 165955 - protein, 198 aa, Heterodera glycines
  Coding regions on vcDNA: vcDNA=SeqID_92378; Strand=+; Position=3-596
VLPGKMRINGAISNTSAANSLLITDRMEMISHDLSLFLSRNGSTDSDQRAKADDDDQSVLIDAVNSHLRLVHSNHTMASLTAAKHFVEILGGRPLLQILAGNGSEEIELVKETKTVAELNTDIVPKELMRTENAGDSFGSGPFAIRTNVTHPIVLNWTHSPPNPSQLGSSVSASSPLPSSVAPALNLSSLSSASTPSR

SEQ ID NO: 165956 - protein, 115 aa, Heterodera glycines
  Coding regions on vcDNA: vcDNA=SeqID_92379; Strand=+; Position=3-347
KATFIKAALKKVASRIADTADQAHRDNAIVVVLFMCSTILILVQVETNLCSTMFQNVKIEVEVLRQIVFDPIGRVLAQTQKVVDAYEGNFAALLPLIKFLVRHANQFAALSENVG

SEQ ID NO: 165957 - protein, 207 aa, Heterodera glycines
  Coding regions on vcDNA: vcDNA=SeqID_92380; Strand=-; Position=2-622
KEESEEELSWYNLRSSSRQSSRSVGGGEKCAGLTLPTDGILSGNRIKPTISRFFNVVPSSAGVAVSAKPRDASARSNLLATSRANSNDSFAPGPSAILEDEVEADEQQKPTSSTDQSQSQSEDDAMASLPPSTSSTAQSVDFPPPSATSTPFLQRILAPICEFRDQSPDTAVDSVQSAFPFDVPLVANESASGGGIVRRIRPHSAVF

SEQ ID NO: 165958 - protein, 124 aa, Heterodera glycines
  misc_feature (47)..(47): Xaa can be any naturally occurring amino acid
  misc_feature (74)..(74): Xaa can be any naturally occurring amino acid
  Homolog annotation: Hit_ID=NP_506146.1; Match level="QueryCoverage =91%, HitCoverage=47%, E-value=2e-17, Identity=41%"; Hit description =putative protein, with 2 coiled coil-4 domains (5N52) [Caenorhabditis elegans] emb|CAB02877.1| Hypothetic
  Gene Ontology: Mol. function=structural constituent of cytoskeleton; Cellular component=insoluble fraction
  Coding regions on vcDNA: vcDNA=SeqID_92381; Strand=+; Position=2-437
AFFFGSGGGCSCPVCPPPPPQSNCGCCNTNGNGAGFSGGCGGGNGGXNGGANCGCNGCAGGSGGGGGSGACHGXAGGCGFAAPSFRCCGGNCRGPNCTTTGNGTTSGSRHCLGIKTRLPCARPG

SEQ ID NO: 165959 - protein, 96 aa, Heterodera glycines
  Coding regions on vcDNA: vcDNA=SeqID_92382; Strand=-; Position=1-288
MSGSINSNNSPIPLACGQETENMAGNGNELMRTEDNENSDDFLNLFENLELTTSEKLASLREIEKIFADTAPPPAGPTPIESSVLGFVFISHPILW

SEQ ID NO: 165960 - protein, 215 aa, Heterodera glycines
  Homolog annotation: Hit_ID=NP_500306.1; Match level="QueryCoverage =92%, HitCoverage=30%, E-value=4e-71, Identity=67%"; Hit description =acetolactate synthase homolog (69.3 kD) (4E27) [Caenorhabditis elegans] gb|AAC17553.2| Hypothetical prote
  Gene Ontology: Biological process=embryogenesis and morphogenesis
  Coding regions on vcDNA: vcDNA=SeqID_92383; Strand=+; Position=2-646
SPVPKCPVISGRKFFSSDAFNVDRNCTRHGGELVANVLKAHDVREVFTLCGGHISPILVACEQLGINIFDTRHEVNAVFAADAVSRLRQNIGVAAVTSGPGVTNTITALKNAQMAESPVILLSGAAPTLMKGRGALQDIDQLSIVKSMCKFTANVQNVGDIVPTLREAIAAARSDTPGPAFVELPLDVLQPYGKVLAETNFVVHADTAEKKAFND

SEQ ID NO: 165961 - protein, 183 aa, Heterodera glycines
  Homolog annotation: Hit_ID=NP_500870.2; Match level="QueryCoverage =66%, HitCoverage=23%, E-value=8e-13, Identity=34%"; Hit description =putative protein, with a coiled coil-4 domain (56.4 kD) (4G607) [Caenorhabditis elegans] gb|AAA82278.3| H
  Coding regions on vcDNA: vcDNA=SeqID_92384; Strand=+; Position=43-591
MRLLLSLLLLFLSPFISLPLFVPFSLALPSPQKRCPSPLFRQSRSSPPPNGTSPHYSTPIHFFAITQDCQFVLARPDQLGQLPSLSVSLSVSDCAPSRINLLWSLNSPVPSLLLLQQRAHKLCLLPIEVPFSVIAHSTELFRYSLRNALRHFALCHSSNSSSLLTLNPNLAFADSLYSDILYF

SEQ ID NO: 165962 - protein, 137 aa, Heterodera glycines
  misc_feature (34)..(34): Xaa can be any naturally occurring amino acid
  misc_feature (50)..(50): Xaa can be any naturally occurring amino acid
  Homolog annotation: Hit_ID=NP_704188.1; Match level="QueryCoverage =89%, HitCoverage=29%, E-value=1e-09, Identity=32%"; Hit description =hypothetical protein [Plasmodium falciparum 3D7] emb|CAD51004.1| hypothetical protein [Plasmodium falcipa
  Coding regions on vcDNA: vcDNA=SeqID_92385; Strand=+; Position=197-609
FFYEFSTFLQFFLSFIFCFSFFICQNFLIFFFDXIKIIVGIISFFVVLKXFYFFIQIFQKISKLLFSYFQIFFLIFLLFQTVSSIFGGYFDEFVMFLQFPFHSFSDFFFSFANKFLFFPFFLSPLFYCECQNVSSIS

SEQ ID NO: 165963 - protein, 189 aa, Heterodera glycines
  Homolog annotation: Hit_ID=NP_493426.1; Match level="QueryCoverage =56%, HitCoverage=6%, E-value=1e-21, Identity=49%"; Hit description =TBP-Associated transcription Factor family member (taf-1) [Caenorhabditis elegans] emb|CAC14425.1| Hypothe
  Gene Ontology: Mol. function=general RNA polymerase II transcription factor activity; Cellular component=transcription factor TFIID complex; Biological process=negative regulation of FGF receptor signaling pathway
  Coding regions on vcDNA: vcDNA=SeqID_92386; Strand=+; Position=82-648
MALMPTAETTTANLGTPTEQNQPQEQQQKAGTAAGTTTTAAATDAASAAVVMEEQTVPLKLRVPLTLSISISNVASASSIGPLSAISTTSSASGVPPSSAGPTKRRGTIEETDYLMGPLKSVHRRRADPRVSMGSVLMEILNELKNIAGSEHFTFPVNTKKVPDYLEVIKKPMDLQQIRKNVSENKYEL

SEQ ID NO: 165964 - protein, 217 aa, Heterodera glycines
  Homolog annotation: Hit_ID=XP_414883.1; Match level="QueryCoverage =82%, HitCoverage=46%, E-value=7e-18, Identity=30%"; Hit description =PREDICTED: similar to Hypothetical protein FLJ13798 [Gallus gallus]
  Coding regions on vcDNA: vcDNA=SeqID_92387; Strand=+; Position=1-651
KHFNNSPILNGILKNAEIIDHLSKKLQFDESEKALLSIVKRNVDRLHQLCNEWINTGHFSSIPDHYRLLYAFCCAVRAKLSYLLKDYFLSLRHCDDVLLKGNDLEDESLSKFASFLCRKFLPPPSEVPEHQTDSKKAPNLLPNSVQISSSELPSLEYFFNNFYKLQVPVIIRGMVNGRPAFEKWSFSYLNSICGHRLVPDELGSKYTDDDWRQQMMS

SEQ ID NO: 165965 - protein, 174 aa, Heterodera glycines
  Coding regions on vcDNA: vcDNA=SeqID_92388; Strand=+; Position=1-525
TRVGDSLAIQNLCLYDNLNLPLRENSLFASCQYGGPLAIGLPGASPNSWTIGIYMQNGAQIASIEASGVFRLFWTKCQKLIVVNQNGRVLLYNPLGVHLATFAMGNESLALGLAGAMAFSYVNETGLAVINEAKHIFAVNSVNSRVPWRIQNQQSEIVFINISGSSKKGSPSNR

SEQ ID NO: 165966 - protein, 83 aa, Heterodera glycines
  Coding regions on vcDNA: vcDNA=SeqID_92389; Strand=+; Position=172-423
SSRIKVILRPDVPPWHTSATALAMCEQLSTHIGPDAGAFGLHRKRRISSAPRHRGARILLSRLSGISIASHHWSIDQTHEPNT

SEQ ID NO: 165967 - protein, 103 aa, Heterodera glycines; identical to SEQ ID NO: 135492
  Coding regions on vcDNA: vcDNA=SeqID_92390; Strand=+; Position=341-649

SEQ ID NO: 165968 - protein, 198 aa, Heterodera glycines
  Homolog annotation: Hit_ID=AAH41285.1; Match level="QueryCoverage =72%, HitCoverage=45%, E-value=9e-22, Identity=39%"; Hit description =MGC53558 protein [Xenopus laevis]
  Coding regions on vcDNA: vcDNA=SeqID_92391; Strand=+; Position=30-623
MSRPTPSELTVEMLKKRISGGRMDLSSLRLNKVPIELMCRSLAGQRITCVDLSDNLLTSFSAQFLQFFPDIQELDLHSNKIKRLPENFGVLSSLRRLDLSENQIKKLPISFAELDNLRWLNLVNNPLENDLAEVIGSCSNDEECSFAAKSAVQYVQFFSTVSSESTAIADTAFLQNETSSTSNNSDNINVSALRQADN

SEQ ID NO: 165969 - protein, 194 aa, Heterodera glycines
  Homolog annotation: Hit_ID=AAP30770.1; Match level="QueryCoverage =94%, HitCoverage=81%, E-value=2e-10, Identity=28%"; Hit description =putative gland protein G17G01 [Heterodera glycines]
  Coding regions on vcDNA: vcDNA=SeqID_92392; Strand=+; Position=1-582
IEKLCGKFAEPKCFYPTEACDNFTIFKQNAETTELNADNETKWIQLNDLPTGEGCLPINISIVSTLRNGYNCGVSNQLKDTADALARVLYLCLLFLFALVFHTLAQQPSEEYDLFGYLCAAYSVLVLGFSTVTTILESVNWTTLWECTNFRPYQSFLLFLLLPSVILFCSGIYETFSNCSLLKESDAENAQKQT

SEQ ID NO: 165970 - protein, 114 aa, Heterodera glycines
  Coding regions on vcDNA: vcDNA=SeqID_92393; Strand=+; Position=47-391
WLMLQSQHKFSPHLLRTLLLFFVPPPPPKKMVFTPEMTSRLLELVQARKDNLFPGSRHAEAGRIQKEAWSTVTETLNSEFPIDVPAGGLKVQQVQTRWKNLRQAGKEEAQKIKK

SEQ ID NO: 165971 - protein, 75 aa, Heterodera glycines
  Coding regions on vcDNA: vcDNA=SeqID_92394; Strand=+; Position=239-466
LPLQLSSSVAVSPSPLLIHFFFFFCLFFFPLIPLSALFFYLVSPSSNSALSSSLVSPFSLIASPFSLLILSLPSL

SEQ ID NO: 165972 - protein, 210 aa, Heterodera glycines
  Homolog annotation: Hit_ID=CAA82797.1; Match level="QueryCoverage =68%, HitCoverage=22%, E-value=1e-13, Identity=34%"; Hit description =gag protein [Ascaris lumbricoides]
  Coding regions on vcDNA: vcDNA=SeqID_92395; Strand=-; Position=2-631
CLQRNAIQQSRFQQVREKGANNRQSRRSSTEAARLARPHKHTHSSIPTLPQQGGQRRAGRSSSSFKSAIGTHALSKAEKFNLLRNLLGGEARELVAGFRLEDNNYDTALQLLKDTYGAPDEHIRALHFELANLKPCKNLRDTKEFLLQLERLTRELNNSGEDIEGPPTFLMLEKKLTPGFLRTILTKKGEDPARWNTTKFRDVLNEAVRK

SEQ ID NO: 165973 - protein, 71 aa, Heterodera glycines
  misc_feature (62)..(62): Xaa can be any naturally occurring amino acid
  Coding regions on vcDNA: vcDNA=SeqID_92396; Strand=+; Position=371-583
ALFHFWQIERRPGNKVVTLVSNLASFGIDASALDSEIRGTGTSILATAPACEGPQLLVQGNXVYSRIVLCF

SEQ ID NO: 165974 - protein, 152 aa, Heterodera glycines
  Coding regions on vcDNA: vcDNA=SeqID_92397; Strand=-; Position=7-465
SSIWWILPKKNISISVEQYPFILSSLSSQTSMIECPFQVFHFKIDYLHPPGDLSVEKFPNLSPPENLTNNWFLFVLFKRFCFVSPRERLLMLIVSPREQYQKSKSLSSPPEIDKMPKSSKNLNRCRCYLVFCPGAPNSKTSRRSVLFAAYLP

SEQ ID NO: 165975 - protein, 169 aa, Heterodera glycines
  Homolog annotation: Hit_ID=CAE70156.1; Match level="QueryCoverage =100%, HitCoverage=44%, E-value=1e-79, Identity=87%"; Hit description= Hypothetical protein CBG16623 [Caenorhabditis briggsae]
  Gene Ontology: Mol. function=ribose-phosphate pyrophosphokinase activity; Biological process=ribonucleoside monophosphate biosynthesis
  Coding regions on vcDNA: vcDNA=SeqID_92398; Strand=+; Position=63-609
MPNIKVFSGSSHSDLAQRICDRLQLEVAKAALKKFSNKETNVEIIESVRGEDVYIIQSGCGEINDHLMELLIMISACKIASACRVTAVIPCFPYARQDKKDKSRAPITAKLVANMLSISGADHIITMDLHASQIQGFFDIPVDNLYAEPAILKYIRETIPHWQESVIVS

SEQ ID NO: 165976 - protein, 203 aa, Heterodera glycines
  Coding regions on vcDNA: vcDNA=SeqID_92399; Strand=-; Position=3-611
KSTASPRHISQFQPKICPPPFAPCTPIRPVPTPPRQFFAAQLTAHFLRPTILRQFLALLSLLKSSSPFFSQLKCMPFFPDFHNPTQQNPLDELRRTNSGRTKKDSGSVRPRNRRRSPPSSRQKRRQRLAQRWTPFPTDSCAGTSRTRRDRCPFPTDSAFCSFLWRTMSREGGGYECGKRVDEKRKKRQNGGKADEKQLKTEKQ

SEQ ID NO: 165977 - protein, 151 aa, Heterodera glycines
  Homolog annotation: Hit_ID=AAP46398.1; Match level="QueryCoverage =92%, HitCoverage=38%, E-value=2e-17, Identity=39%"; Hit description =chitinase 4 [Coccidioides immitis]
  Coding regions on vcDNA: vcDNA=SeqID_92400; Strand=+; Position=2-454
ITAAATLASAFLASGASARFNLVRQNNTGVYWGQNAGYDTFGTGHQKDLYTTCRDRAIDVVDVSFVTNFRGKDGWPILNLSDQCWTFMTNKTTGLQMDVLECPTIGDHIKKCQALGKKVLLSLGGATYRSPGWATVAEARSAGNDIFAMFA

SEQ ID NO: 165978 - protein, 178 aa, Heterodera glycines
  Homolog annotation: Hit_ID=CAE59330.1; Match level="QueryCoverage =96%, HitCoverage=84%, E-value=3e-29, Identity=50%"; Hit description =Hypothetical protein CBG02672 [Caenorhabditis briggsae]
  Gene Ontology: Mol. function=pre-mRNA splicing factor activity; Cellular component=nuclear speck; Biological process=mRNA splice site selection
  Coding regions on vcDNA: vcDNA=SeqID_92401; Strand=+; Position=3-536
DILIKRGYAFVELDDPRDADDAVYDLNGRSMMGMRVVVEIAKSRPWRSGDSWSSRRRSRSRSRSRGKRSRSRSRSRDRKRRSRSRSLRRRSRSPKRSRSRSVASRSASPPEPKKARHTPSRSRSPDNKRLRSASPRRSRSITPNDRGSRRRSVAKERGSRSPKDRRGGSRSPARRTSR

SEQ ID NO: 165979 - protein, 172 aa, Heterodera glycines
  Homolog annotation: Hit_ID=NP_498563.1; Match level="QueryCoverage =90%, HitCoverage=13%, E-value=5e-30, Identity=42%"; Hit description =o-linked N-acetylglucosamine transferase, nucleocytoplasmic, adds O -linked GlcNAc on transcription factor
  Gene Ontology: Mol. function=UDP-N-acetylglucosamine-peptide N -acetylglucosaminyltransferase activity; Cellular component =perinuclear space; Biological process=O-linked glycosylation
  Coding regions on vcDNA: vcDNA=SeqID_92402; Strand=+; Position=143-658
MDSSKQYYMPSGSNFDKNKALGQVNVPHHSQMSQQQQQPNPATLLTQGQILNPQNIVVVSANTPALINTDLSALIDIAHKEYQAQNYAKAEQHCLALLQQNPHNISVLLLLSSIAFQQKSYERSMQFSNMAIRINPECAEAYSNLGNAHKERGELTEALKNYHMAVRLKPDF

SEQ ID NO: 165980 - protein, 157 aa, Heterodera glycines; identical to SEQ ID NO: 158264
  Coding regions on vcDNA: vcDNA=SeqID_92403; Strand=-; Position=78-551

SEQ ID NO: 165981 - protein, 214 aa, Heterodera glycines
  Homolog annotation: Hit_ID=XP_517745.1; Match level="QueryCoverage =40%, HitCoverage=47%, E-value=1e-12, Identity=44%"; Hit description =PREDICTED: similar to Kinesin-like protein KIF2 (Kinesin-2) (HK2) [Pan troglodytes]
  Coding regions on vcDNA: vcDNA=SeqID_92404; Strand=+; Position=1-642
IGTEVQILRSDGRVHAALVTAINERGVSVEWMEEGETKGKQLDIEVIVRNNPSLFPSRVHKPEKSCADPKTASNGVVSNKNRHSIAASSSMQTVVGRQIDCGPSVGYISKSPPPPPPLQPIAPVKDIKRICAGMSVKIERSNGRVQTALVTTIFPEKNGAAVEWQEQGETKGKEVDIEMLVRNNPEVFRTSPSSMHNKNFPFLAQVMNNVPLSM

SEQ ID NO: 165982 - protein, 36 aa, Heterodera glycines
  Coding regions on vcDNA: vcDNA=SeqID_92405; Strand=-; Position=0-107
FFFFFFLLEKFCRRLVDSNFRSATKPNTLPLWQLVS

SEQ ID NO: 165983 - protein, 205 aa, Heterodera glycines
  Coding regions on vcDNA: vcDNA=SeqID_92406; Strand=+; Position=3-617
SAIFERRPLKCQDLTDCQYVNVSVGAHRCLAIGFVDGSAPVLELLAPSVEERAQWVDILRMTLRRLNFLNTESFDNEQQRERTDNGPSQWPRAANEYVTLAGTANSDANSSTSSPPPQQTLPRANGRREVTQSPRVPMIQIPSTHLRTLSTETAQSSERSQTQLRKGLDDSLPPMRQHSEQQTNGERKGTRKTDGMTSGGESEEH

SEQ ID NO: 165984 - protein, 71 aa, Heterodera glycines
  Coding regions on vcDNA: vcDNA=SeqID_92407; Strand=-; Position=175-390
LWRNMILKIAMAVVFLVIVQFVPPPFSKFFYVFKSHKNTFYGVFGVADHESDAHLDQFLIPDPNSNKKSKI

SEQ ID NO: 165985 - protein, 42 aa, Heterodera glycines
  Coding regions on vcDNA: vcDNA=SeqID_92408; Strand=-; Position=1-126
RGISRGGDGPAAEGVATAEACLTEAEGRTEVRRRREKKQGTP

SEQ ID NO: 165986 - protein, 166 aa, Heterodera glycines
  Coding regions on vcDNA: vcDNA=SeqID_92409; Strand=+; Position=147-644
QICGISIAGPSVAQQNPFKRLQIDYIDHSVIAFLRSNHQIFDKSGTNLELWISCVRITDEQPIWDIFVREIWPIFPTNIRHLGFNGCDALDIFCRRTSPTILTDLNQLISIKSFGRLPEAIGDDFDVPNATISAGQALSKWLHSPRKDGQPKRLRCWQGNFGWINN

SEQ ID NO: 165987 - protein, 196 aa, Heterodera glycines
  Coding regions on vcDNA: vcDNA=SeqID_92410; Strand=+; Position=50-637
RLSPPPPTNSLSVPLFTSAGRQMILHLWSYTFVPLVFRPSQLNFLFPPFFFDIDFPSHFVFCLSSLVMDNLSDPSAVLPSSPSPGDSSVPSSPFDVAASSSFSTLIPGFNHSSHLQIVDVKVQKAADAAFTDFPAYITVLMSILIAVSFFLNLGCVGTILCRLAGQGKAFRCLLPFPSRKLRCSMLYLMFALLALL

SEQ ID NO: 165988 - protein, 200 aa, Heterodera glycines
  Coding regions on vcDNA: vcDNA=SeqID_92411; Strand=+; Position=35-634
MEHAVQLFALAKDIQSARLSLLSAGSSSSSNYIPAAFATSNSLSSTDESMNSTDDEALTTDESEEVSRMSTSDPIELQQNATSMDCSAEDANANESSAFSLPQTEANEITLERCQSFVKSASRIAIQYGTSLSYEFNANLKSIFDQIEPSDVRAVPPRVHPLCWYAIWRATDRFRALNGRFPGSIASSQKGDAKELKEIV

SEQ ID NO: 165989 - protein, 168 aa, Heterodera glycines
  Coding regions on vcDNA: vcDNA=SeqID_92412; Strand=+; Position=131-634
CHLLIIADRILDTIERDVMRKTTEARQALVRKQQVEPKKEELGEHEQVLFTSVDDGGGGSASTLPAQLIQTTTSAVGLNVPHSGQNVVQYVQIPAHGVQNGLILAESKFVPAESSDAQSHYALEHTSPQKFERGTSGSANSSNYYPVSIIQHEWPQRTSVVGSHHQLQ

SEQ ID NO: 165990 - protein, 135 aa, Heterodera glycines
  Coding regions on vcDNA: vcDNA=SeqID_92413; Strand=+; Position=118-525
MLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQTCALPYGYLLVTLHANNIIRLRTNIFPDDEERIIFAPKNG

SEQ ID NO: 165991 - protein, 212 aa, Heterodera glycines
  Coding regions on vcDNA: vcDNA=SeqID_92414; Strand=+; Position=3-638
MNSNSKASSPLGTAIALATAGGEVTIQSAIIAILYRKCAKLTQIIHNLQTENSNTSHSVRNELVLLRRTVLLLERRIAQSEANRTEMPKTEKDDGLGRHEMCEERKAIGRVASANSASEGEYADAVDDDPDFFKMSSKTNGTKVCSAVADSKFLEQIDRLHETGKHSEAYAELMKANREEPEVLWRLARVCHQMASSLELKDPRKRELLDEA

SEQ ID NO: 165992 - protein, 47 aa, Heterodera glycines
  Coding regions on vcDNA: vcDNA=SeqID_92415; Strand=-; Position=4-147
LLLIDQMFSLSATHSKIKNLKSIFNFIFIFGNLFLTPKIKLNFVGTV

SEQ ID NO: 165993 - protein, 107 aa, Heterodera glycines
  Homolog annotation: Hit_ID=NP_741818.1; Match level="QueryCoverage =85%, HitCoverage=24%, E-value=9e-38, Identity=74%"; Hit description =cysteine PRotease related (42.4 kD) (cpr-6) [Caenorhabditis elegans] gb|AAK39189.1| Cysteine protease rel
  Gene Ontology: Mol. function=peroxidase activity; Cellular component =extracellular space; Biological process=protein targeting
  Coding regions on vcDNA: vcDNA=SeqID_92416; Strand=-; Position=2-322
MAKGAFAIAIWGKPFQNELFVNGPIEVPFEVYEDFLNSKGGVYYHVAGKLGGAHAVKLLGWGADNGIPYWLVANSWNTDWGEDGFFRILRGSDECAIEREAVGGVPD

SEQ ID NO: 165994 - protein, 134 aa, Heterodera glycines
  Coding regions on vcDNA: vcDNA=SeqID_92417; Strand=-; Position=244-648
GKCNVKKCIKAAIFGRPSPVELRENIHKNKFENEKKIKILETGMFPKKIRRTKLSLSFSSCLSFNKERRTYLNEEFNVGKCFVREGRNLCKVKPRIKNKMVKVGFSFRVFTPFQFSWEAKSPCSNCRSAIRTIR

SEQ ID NO: 165995 - protein, 58 aa, Heterodera glycines
  Coding regions on vcDNA: vcDNA=SeqID_92418; Strand=+; Position=161-337
FWTRSRKKSILSDQKMFRRFRYFDEFSYINASVDYHNAPISSDQMYSVISNISFLKMP

SEQ ID NO: 165996 - protein, 216 aa, Heterodera glycines
  Homolog annotation: Hit_ID=NP_510342.1; Match level="QueryCoverage =97%, HitCoverage=24%, E-value=8e-65, Identity=52%"; Hit description =beta-mannosidase precursor (103.9 kD) (XO693) [Caenorhabditis elegans] emb|CAB01737.1| Hypothetical prote
  Gene Ontology: Mol. function=beta-mannosidase activity; Biological process=glycoprotein catabolism
  Coding regions on vcDNA: vcDNA=SeqID_92419; Strand=+; Position=1-648
VKLDPTRPFLLSSPSNGIETEREGGVSKNPGDPAYGDVHFYSESVNLWKPSNFPVPRCSSEFGVQSMPLRGTMARWIGPSDWNYKSGTLVSRQHHPGGVLNLPAIVSQHFNLLSSNFSSLSLSAPFFIDKFAFLSQIHQAIALQAQIEHYRRFRSHLDEAGLGHTMCAMYWQLNDVWAAPTWSTVDFDLRWKVGHHFVRRSFSPLIVSMFLDSNGI

SEQ ID NO: 165997 - protein, 102 aa, Heterodera glycines
  Homolog annotation: Hit_ID=NP_507613.1; Match level="QueryCoverage =87%, HitCoverage=3%, E-value=2e-17, Identity=47%"; Hit description =predicted CDS, RNA-directed DNA polymerase  and Integrase, catalytic domain containing protein family memb
  Coding regions on vcDNA: vcDNA=SeqID_92420; Strand=+; Position=339-644
MVTWVPLLCKGKKLRVVYDASAHTRGTNSLNDCLYRGPVLLPDLIGMLLRFRCPTFPLLADIQAAFLQISLEPEDREVTKFLWLKDTEKPLSSENLIIYRFC

SEQ ID NO: 165998 - protein, 162 aa, Heterodera glycines
  Coding regions on vcDNA: vcDNA=SeqID_92421; Strand=+; Position=139-624
ILVNSRRNFQKTNLTPQNFTISSVFHFTNSPPPCTFNLPSPWLPFMCMLFIVAVSVSCCNTTTSTLCCSPYCGCHCSPATASFSRHFQLPMLSLLLLLCCYDNDYDGDCCKNGHHQTVAAFPAGTASAAVHDDFGAPPLFLFLLQLLRMFAIVYCGPFQCPT

SEQ ID NO: 165999 - protein, 122 aa, Heterodera glycines
  Coding regions on vcDNA: vcDNA=SeqID_92422; Strand=+; Position=266-631
IYGPRRWRHGIGRNWRQSEEGENIGREQSQHTAQPPTIKPICSKMPKKSPKFEIAREWHRRAKAPGRYASYVRPHLFLLRRAVFRASAPRCRFRAASAHVGTAGGEQTLLLLSAGRRERRRG

SEQ ID NO: 166000 - protein, 103 aa, Heterodera glycines
  Coding regions on vcDNA: vcDNA=SeqID_92423; Strand=+; Position=3-314
TTESIEWTEQREQLLGNLLAELLTFSDCEFRLRECAFGEFGRPKEKSERNLILTTLATSLLCEQRASEEFVRFTLFLSNCAFLFSLFRFVGPSLFWIAKFILC

SEQ ID NO: 166001 - protein, 155 aa, Heterodera glycines
  Homolog annotation: Hit_ID=AAQ06433.1; Match level="QueryCoverage =82%, HitCoverage=17%, E-value=5e-28, Identity=55%"; Hit description =ABC7 protein [Caenorhabditis elegans]
  Gene Ontology: Mol. function=ATP-binding cassette (ABC) transporter activity; Cellular component=mitochondrial inner membrane; Biological process=iron ion homeostasis
  Coding regions on vcDNA: vcDNA=SeqID_92424; Strand=+; Position=70-534
RHLSFLDDNLYDSQTLRRSTRLFRHFHALPPSGVPVNGLGGATPSGLEMAKRLARHVWPKGQWRVKGRVLFAFSLLIAAKLLNATVPFVLRDIVDFFNGKLPAELSLGFALPGEAILSAGIALIIAYGAARGGTSLFNELRNAVFARVAQRSIPR

SEQ ID NO: 166002 - protein, 81 aa, Heterodera glycines
  Coding regions on vcDNA: vcDNA=SeqID_92425; Strand=-; Position=2-244
SSLIHKEVGELSRKLSSQKNELPKSGERLSKKWCQCGRSEIEKMKPMALINFEDKKPIELLYQKKRLGKGSWSEVGKMLKE

SEQ ID NO: 166003 - protein, 111 aa, Heterodera glycines
  Coding regions on vcDNA: vcDNA=SeqID_92426; Strand=-; Position=3-335
PPLWIDRPGAWLSLSANTGQGLRRDWEAYVDSHTRTDRPSGCRHWRGIEKIEKVWWRHETTPTKDRLSSGVRLKLSKSNEGQYHSVCEAVARTRTNSNYQFLFSKRFRKFL

SEQ ID NO: 166004 - protein, 147 aa, Heterodera glycines
  misc_feature (46)..(46): Xaa can be any naturally occurring amino acid
  Homolog annotation: Hit_ID=CAG06679.1; Match level="QueryCoverage =100%, HitCoverage=51%, E-value=9e-28, Identity=43%"; Hit description= unnamed protein product [Tetraodon nigroviridis]
  Gene Ontology: Mol. function=pre-mRNA splicing factor activity; Cellular component=nucleus; Biological process=regulation of transcription, DNA-dependent
  Coding regions on vcDNA: vcDNA=SeqID_92427; Strand=-; Position=2-441
DRRGKREREEGEIGTEREERERERGEKEREGRRRERARESEERERXREKEREGRRREREREREEGEIGGNEREERERERREKEREGRRREREREREEGEIGGNEREEREREGRRRERGERGEGEKEREREGRRRERGEGEKERERGD

SEQ ID NO: 166005 - protein, 212 aa, Heterodera glycines
  Homolog annotation: Hit_ID=NP_505734.1; Match level="QueryCoverage =99%, HitCoverage=51%, E-value=2e-77, Identity=63%"; Hit description =protein phosphatase (pph-1) [Caenorhabditis elegans] pir||T18936 phosphoprotein phosphatase (EC 3.1.3.16)
  Gene Ontology: Mol. function=protein phosphatase type 1 activity; Cellular component=cytoplasm; Biological process=adult locomotory behavior
  Coding regions on vcDNA: vcDNA=SeqID_92428; Strand=+; Position=9-644
MVTVTRRKSFACSSIDIDNVIGRLTNPTVQANVQWRHGVDVSESEVRALCMLSRDLLLSQPTMLELSAPLKIVGDIHGQFSDLLRLFHACGFPPKSNYLFLGDYVDRGPRSLETIILLLCYKIKYPVNFFLLRGNHEVASLNRIYGFYNECKTRMNIRVWKAFQDVFNCLPVAALINGKIFCCHGGLSPHLRTLEQLKRIQRPAEVQESGLL

SEQ ID NO: 166006 - protein, 144 aa, Heterodera glycines; identical to SEQ ID NO: 152974
  Homolog annotation: Hit_ID=NP_497989.1; Match level="QueryCoverage =100%, HitCoverage=17%, E-value=2e-47, Identity=62%"; Hit description= rho GTPase activating protein 12 (3F891) [Caenorhabditis elegans] emb|CAA86318.1| Hypothetical protein C
  Gene Ontology: Mol. function=Rho GTPase activator activity; Biological process=signal transduction
  Coding regions on vcDNA: vcDNA=SeqID_92429; Strand=-; Position=1-576

SEQ ID NO: 166007 - protein, 51 aa, Heterodera glycines; identical to SEQ ID NO: 138349
  Coding regions on vcDNA: vcDNA=SeqID_92430; Strand=-; Position=478-633

SEQ ID NO: 166008 - protein, 191 aa, Heterodera glycines
  misc_feature (112)..(112): Xaa can be any naturally occurring amino acid
  misc_feature (145)..(145): Xaa can be any naturally occurring amino acid
  Homolog annotation: Hit_ID=NP_504291.1; Match level="QueryCoverage =100%, HitCoverage=29%, E-value=2e-68, Identity=67%"; Hit description= heat shock protein (70.8 kD) (hsp-6) [Caenorhabditis elegans] gb|AAB42371.1| Heat shock protein protein
  Gene Ontology: Mol. function=enzyme regulator activity; Cellular component=mitochondrial inner membrane; Biological process =mitochondrial translocation
  Coding regions on vcDNA: vcDNA=SeqID_92431; Strand=+; Position=2-574
GHVTDLLLLDVTPLPLGIETLGGVLTKLITRNTTIPTKKSQGFSTAADGQTQVEIKGFQGERDMGLDNKMLGHVSLAGIPPAPQGGPQIEVAFDIDAKGIVNVSARDRGTGXQQHIIIQSTGGLIIDQIENMVREAVRPAAADAXKNDTIEVINHAESVLHDTESKITEYTEHLNADKFIVVKEKLEELKK

SEQ ID NO: 166009 - protein, 73 aa, Heterodera glycines
  Coding regions on vcDNA: vcDNA=SeqID_92432; Strand=-; Position=98-319
FAWKNTVLHTYHTSIIFFRLFFSFITQRSRRIRSSPNFAGKLLRTLQMLINFLRIFCLEEHSSSHLPHQYYFF

SEQ ID NO: 166010 - protein, 103 aa, Heterodera glycines
  Homolog annotation: Hit_ID=CAC33829.1; Match level="QueryCoverage =99%, HitCoverage=31%, E-value=1e-26, Identity=62%"; Hit description =annexin 2 [Globodera pallida]
  Gene Ontology: Mol. function=anticoagulant activity; Cellular component=cytoplasm
  Coding regions on vcDNA: vcDNA=SeqID_92433; Strand=+; Position=2-310
LGTPTIVDNVRFDPRLSVNFLHKSIEEKRKDEIIHLLCTISNQQREELAREFKQLFGEHVSAKLKKALSGDFEELILGLLEPPAVIDELQRHRAMSGLGTLEG

SEQ ID NO: 166011 - protein, 211 aa, Heterodera glycines
  Coding regions on vcDNA: vcDNA=SeqID_92434; Strand=+; Position=1-633
LSTDSTFHTNASFSSALRNPLTGFYRPSRFDANVSNFSNKNHPFDEGLNFFGKLTSSQFDNNNSYEPSLNSNRFRFREFFAREHEQQEQDRFLKNLDNSRRNDSIRYDPYSSASKNHRLRKILYKSVANIDDLSPLPNKYVGFTMHDKLAHLKKTIRGFDTTNFSNKENSNFTTPAVSSLGFRNLDSTGYGTALAKRFSPPNTSTPLATNQ

SEQ ID NO: 166012 - protein, 39 aa, Heterodera glycines
  Coding regions on vcDNA: vcDNA=SeqID_92435; Strand=-; Position=0-116
TTAFSSSPGARFFLLRTATTGKLLLRPSPLPGHRKPRSS

SEQ ID NO: 166013 - protein, 66 aa, Heterodera glycines
  Coding regions on vcDNA: vcDNA=SeqID_92436; Strand=-; Position=296-496
LVIFTKPLSNINFDYIFKKKNSTAPSGTMQKQLMDFANIVPMLRFGGEKFGQKITCNYDILCLVNL

SEQ ID NO: 166014 - protein, 213 aa, Heterodera glycines
  Homolog annotation: Hit_ID=NP_506124.1; Match level="QueryCoverage =98%, HitCoverage=29%, E-value=7e-34, Identity=37%"; Hit description =suppressor of white apricot homolog 2 (79.5 kD) (5M933) [Caenorhabditis elegans] emb|CAA99843.1| Hypothet
  Coding regions on vcDNA: vcDNA=SeqID_92437; Strand=+; Position=1-639
QYLRRKWQGDPNILIDRFDVRGYLDTISETAPNALAKKNIPKDDVIELQCDYERYRILVFNEFRKVSEKQFLNEIAAKEFWPAQQQANQSANAAYRREIEKKRKLASKRAAIAFNYADSTETAATGQSNATRENNCTSSSSSDEEDFDEMEEIDSVLDTNALSAEQAATLNKIGAHFNITSGAFLQLLSLDRKEQTSTAQIREIDKAKLALSG

SEQ ID NO: 166015 - protein, 212 aa, Heterodera glycines
  Homolog annotation: Hit_ID=NP_741074.1; Match level="QueryCoverage =85%, HitCoverage=34%, E-value=4e-50, Identity=54%"; Hit description =putative protein, with a transmembrane domain, 2 coiled coil-4 domains, of bilaterial origin (60.0 kD) (3
  Coding regions on vcDNA: vcDNA=SeqID_92438; Strand=+; Position=14-649
MVHKPFSLCLSVFFISAFFFVYSADESIKPPTRNVLITAEEEKQRDVEGFLAIKAIHAVLDDDNSGSIDRFESADFLKEDLKFGGSDKIRRENAFHSNDEAITVDDLWENWFQSEERGWTNKQVVEWLTNQVKLPQYANGFLSAEVTGLDLPKMAVQNSSFLSTKIGIKNYVHRQKLQLKALDLVLFGFQDTSSIAKDIALAGLLGLLVAVL

SEQ ID NO: 166016 - protein, 85 aa, Heterodera glycines
  Coding regions on vcDNA: vcDNA=SeqID_92439; Strand=-; Position=2-256
YSFFVFPFRIDDNSSLFENIIHSLLHFGDFDCLFGASDFSIVSNTRVPVSSASLPNTVPADFNFGRIVLHNNLRISPTPPPRCLP

SEQ ID NO: 166017 - protein, 148 aa, Heterodera glycines
  misc_feature (51)..(51): Xaa can be any naturally occurring amino acid
  Homolog annotation: Hit_ID=CAG06679.1; Match level="QueryCoverage =58%, HitCoverage=12%, E-value=5e-12, Identity=47%"; Hit description =unnamed protein product [Tetraodon nigroviridis]
  Gene Ontology: Mol. function=DNA binding; Cellular component=nucleus; Biological process=regulation of transcription, DNA-dependent
  Coding regions on vcDNA: vcDNA=SeqID_92440; Strand=-; Position=208-653
RGGNREREEEEAKGKRAMEENDSERGTERGRKSRRIYRLMKEEERERERKXRVRERQRGRERERERERGKRERESKRNMIEREESEFSNLLASSSSYLKNIILISFSTGQRLNWLKRNCRNRNASFQFKMALVFGFLKKIFVFLCYCR

SEQ ID NO: 166018 - protein, 136 aa, Heterodera glycines
  Homolog annotation: Hit_ID=AAH82869.1; Match level="QueryCoverage =74%, HitCoverage=24%, E-value=4e-26, Identity=48%"; Hit description =Unknown (protein for MGC:82376) [Xenopus laevis]
  Gene Ontology: Mol. function=transcription factor activity; Cellular component=nucleus; Biological process=induction of apoptosis
  Coding regions on vcDNA: vcDNA=SeqID_92441; Strand=+; Position=39-449
MAPQKANGTDMAKPRGYVQQQQPKQAERDEQKPSICSMCQSADPSPAHRASLLVQCSACQHQMHSSCIDMPLNMVEVIRKYDWLCIECKRCSVCEQPDQEAAMMCCDACDRGYHTFCIGLEMPPNGTWHCPKCKGC

SEQ ID NO: 166019 - protein, 119 aa, Heterodera glycines
  Coding regions on vcDNA: vcDNA=SeqID_92442; Strand=+; Position=270-626
AENVPNSQPRTPITESFYDQCNSFESIFARKFNLVDCSYKDSVSEFTKKKKKFEFKTDPPNAPRAANFEINHLGPLISKSPPYVAMDLIFVFEIVKTFPSFEQLIINDKVPFYSEHMQN

SEQ ID NO: 166020 - protein, 118 aa, Heterodera glycines; identical to SEQ ID NO: 132975
  Homolog annotation: Hit_ID=NP_502882.1; Match level="QueryCoverage =83%, HitCoverage=19%, E-value=8e-18, Identity=41%"; Hit description =DNA polymerase like family member (4Q408) [Caenorhabditis elegans] emb|CAB60306.1| Hypothetical protein Y
  Coding regions on vcDNA: vcDNA=SeqID_92443; Strand=-; Position=63-520

SEQ ID NO: 166021 - protein, 74 aa, Heterodera glycines
  Coding regions on vcDNA: vcDNA=SeqID_92444; Strand=+; Position=274-498
TLITIASYQKFNLVYNEKSHYQLRRTGRFPSIHRSFYSSVFLLSSPTSSFFPHFPLIFPSKIDPPPHKLFSDAH

SEQ ID NO: 166022 - protein, 200 aa, Heterodera glycines
  Coding regions on vcDNA: vcDNA=SeqID_92445; Strand=+; Position=53-652
MPASHSNKEGAHNQSSEGARRHLQLPSPPPDDFQVSRRAVLLSSDEEDEDSDESPSKPSSSAAAPRENRGRAILLSEEEEEPQGEETEWLGKKSAASAGPSNTERKREKKKPEAHGMLKSLKLKAKKLREKQKKRRRKDRMRSDEEEGEAMDSDGSNDGDVDMRADSYDSEDSDANEQISARQLKLMRELEQKCVEFLNE

SEQ ID NO: 166023 - protein, 211 aa, Heterodera glycines
  misc_feature (171)..(171): Xaa can be any naturally occurring amino acid
  Coding regions on vcDNA: vcDNA=SeqID_92446; Strand=+; Position=1-633
VYLKTLAVMSQQQFAERKVMPKREYQKELTMVPSWMISTSTTTTAAASSSTSAASGQSSPGPDSHLPPFHQHGDVGFCELPLEVEGTSKLGSALLKHTATRSYSSNPREFFKFGRKPTIAKSRGGIEQQQTDAVTGGAVGASVGDSAAGPSGSSGGVSQLRYRKSGGSGMXSGAVWRRFKGRGEQAQIAGRGRRSQCCRCGHNSAQGQPRG

SEQ ID NO: 166024 - protein, 208 aa, Heterodera glycines
  misc_feature (187)..(187): Xaa can be any naturally occurring amino acid
  Coding regions on vcDNA: vcDNA=SeqID_92447; Strand=+; Position=1-624
TGTQPTNIPINGTQTTSISIANTSTGLNPPAFQSPTLQRDSIHQHFNHWDSTHQHSNYWDSILLHSNHWDSILLHFYHWDSTHQHSNQRDSIHQHFNRQHFNGTQSTSISITGTQSTSIPITGTQFSCISITGTQPTSIPINGTQSTSISITGTQHTSISITGNQFSRTSITGTLLYSPAFQSLGLXFYAFKSLGLILLHFNHWDSTL

SEQ ID NO: 166025 - protein, 66 aa, Heterodera glycines
  Coding regions on vcDNA: vcDNA=SeqID_92448; Strand=-; Position=145-345
ICRTEVERKAKKAKSGGAEENGGREKEKKRKKEKKKKKKDREKRTEDEGTKRSGGETKRETVMPFF

SEQ ID NO: 166026 - protein, 99 aa, Heterodera glycines
  Homolog annotation: Hit_ID=NP_741614.1; Match level="QueryCoverage =78%, HitCoverage=14%, E-value=9e-22, Identity=60%"; Hit description =AKT kinase (62.7 kD) (akt-1) [Caenorhabditis elegans] emb|CAA98238.1| Hypothetical protein C12D8.10b [Cae
  Gene Ontology: Mol. function=protein serine/threonine kinase activity; Cellular component=intracellular; Biological process =insulin receptor signaling pathway
  Coding regions on vcDNA: vcDNA=SeqID_92449; Strand=+; Position=3-302
EIQATEFFRPIDWDRLYRKENEPPFKPQLNSDSDTSYFDAEFTREAVQLTPPAARTGPLDTLDEMDEIQNNFVQFSFHQEQELGGVPDSLRENSELMEE

SEQ ID NO: 166027 - protein, 111 aa, Heterodera glycines
  Coding regions on vcDNA: vcDNA=SeqID_92450; Strand=-; Position=49-384
WGPPQAQTKTKTAPAKSLRFLFTDFCSAQYLVLMRAPNSALAIRNIGVQLFPGKLDYFLSAYRIATNKPYGYLVVDMHAASNPLLRLRSGIFKDDEEEGKKIIFIPKNGLL

SEQ ID NO: 166028 - protein, 121 aa, Heterodera glycines
  Homolog annotation: Hit_ID=NP_508654.1; Match level="QueryCoverage =87%, HitCoverage=17%, E-value=9e-30, Identity=54%"; Hit description =quiescin Q6 (XE395) [Caenorhabditis elegans] gb|AAA80371.1| Hypothetical protein F47B7.2a [Caenorhabditis
  Coding regions on vcDNA: vcDNA=SeqID_92451; Strand=+; Position=3-623
EVLEPIHQFVVQFLSCEICSKNFDKMAREDGILSVHRPEDVILWLWRGHNKVNKRLKGEASEDPHFPKQQFPPSKLCSECRTQNGDFDEQKVLRFLLKYYSEVRTDHYKVSYSQLGFFSFR

SEQ ID NO: 166029 - protein, 108 aa, Heterodera glycines
  Coding regions on vcDNA: vcDNA=SeqID_92452; Strand=+; Position=257-583
RKQQEKKRRKMPKKGQILKNELIGEITALICSTVADHWSTAKFSMLSLRKIFGMSRKQPFGYRLAIRRIGTVVGRKFKQNSVIEIDNARMNNQSLSIDENRWISTLSE

SEQ ID NO: 166030 - protein, 150 aa, Heterodera glycines
  Homolog annotation: Hit_ID=NP_726651.1; Match level="QueryCoverage =75%, HitCoverage=21%, E-value=1e-38, Identity=63%"; Hit description =CG17743-PB, isoform B [Drosophila melanogaster] ref|NP_524630.1| CG17743-PA, isoform A [Drosophila melano
  Gene Ontology: Mol. function=zinc ion binding; Cellular component =transcription factor complex; Biological process=regulation of transcription from Pol II promoter
  Coding regions on vcDNA: vcDNA=SeqID_92453; Strand=-; Position=168-620
MDQPMLSSQLFTQKIPCSYKGCQKTFVKQSAMRKHLQIHGPRQHICQQCSRSFIERSKLKRHLLVHSGEKRFVCDFEDCGKRFSLDFNFRTHIRTVHTGERPFQCPFCHKQFAQSANLRIHRRFHNCRPTVDGGKEKQKNGANRQKVTSC

SEQ ID NO: 166031 - protein, 122 aa, Heterodera glycines
  Coding regions on vcDNA: vcDNA=SeqID_92454; Strand=-; Position=185-553
IKLNLRNLSPPPPNSLFSILSIFVLFPTHFCYIKRPAAICGCPNNNTMENEETKVIPSHPLMCAKRVRADEGQIWRKNFLKGVANRLPVRQNAKFRGGGGKKLKIYPPRGTLKIGKLKNWIC

SEQ ID NO: 166032 - protein, 171 aa, Heterodera glycines
  Homolog annotation: Hit_ID=NP_055780.2; Match level="QueryCoverage =89%, HitCoverage=22%, E-value=7e-15, Identity=32%"; Hit description =OGT(O-Glc-NAc transferase)-interacting protein 106 KDa [Homo sapiens]
  Gene Ontology: Mol. function=protein binding; Cellular component =plasma membrane; Biological process=protein targeting
  Coding regions on vcDNA: vcDNA=SeqID_92455; Strand=+; Position=111-623
MAPHKTSSFEAPTQSELKQMLDEAEYGFVMADKIGTSLLEQNRELQEKNEFLEASLATSRDNVAQLKRQLEQRCDLFKKLQLQLEGMEEEEPNGTDQYHQTGMCSSTAAQLESKIKRLEGENKELRTKTKDSDELRVIAEKREEQRINEYCSRLRGANLKIGQLEVQLAEK

SEQ ID NO: 166033 - protein, 85 aa, Heterodera glycines
  Coding regions on vcDNA: vcDNA=SeqID_92456; Strand=-; Position=160-417
HHLPTILLSFSKEWEENKQPVSVDKTIKYFDGQLENADEIAQIEGNGPKKRPNMNLNDFTFKLGNWCFDTPGTVNSEQVDNHNLL

SEQ ID NO: 166034 - protein, 205 aa, Heterodera glycines
  misc_feature (170)..(170): Xaa can be any naturally occurring amino acid
  Coding regions on vcDNA: vcDNA=SeqID_92457; Strand=+; Position=1-615
GVLAMAAKFISNQRGGHKLIYEGHSYIKHRHRSTPVGEVTYWRCDQLHRLKCPGFAQTNSRSDEVVVTRSHSHAPSSTRIEVLIAKSDIRRAAVNAISATPGAIVANALEGISDAAKHQLPKIANLKKTATRQRKGIGDGAAENPLPSRETLRKRLVQNYRNGSHRRTTXTVPMPQTSHYVASADPALSIKQSQRAEEGQCQMAT

SEQ ID NO: 166035 - protein, 203 aa, Heterodera glycines
  Homolog annotation: Hit_ID=AAL78214.1; Match level="QueryCoverage =55%, HitCoverage=59%, E-value=8e-10, Identity=31%"; Hit description =putative esophageal gland cell protein Hgg-20 [Heterodera glycines]
  Coding regions on vcDNA: vcDNA=SeqID_92458; Strand=+; Position=11-619
MAPPVKKKKKFSSDNHRLISSTEIGEHEQQSMGSLTTSFGKRQSLFRHAKKMNNRILRKIWICTDIWMDTFPFFDHAQLGLKLALISPRFDVLVDKHFNCQSELTIWREITIVKDTGSELNLTVLIGGKSVQFPLPDRSLPNKIRFDNLNIDYIDHSVLVFLRANKQIWDKGTNLSLYVCWSHNQNDNNNNFLPIWDVFVCKI

SEQ ID NO: 166036 - protein, 108 aa, Heterodera glycines
  Coding regions on vcDNA: vcDNA=SeqID_92459; Strand=-; Position=201-527
LGQLSNVKLASHRKCDEIGESPTVRFAIKNSVLKFLSEFPNSAHLRNNSEFCRTFGSPIFVLNLNIISNDYLNFTFFWSGTTKKKAQTFDGTSHNRKYLNGYFPWKSP

SEQ ID NO: 166037 - protein, 211 aa, Heterodera glycines
  Homolog annotation: Hit_ID=NP_500551.2; Match level="QueryCoverage =97%, HitCoverage=4%, E-value=1e-23, Identity=34%"; Hit description =protein conserved (4F151) [Caenorhabditis elegans] gb|AAC17540.2| Hypothetical protein F55F10.1 [Caenorhab
  Gene Ontology: Mol. function=ATPase activity; Cellular component =nucleus; Biological process=protein complex assembly
  Coding regions on vcDNA: vcDNA=SeqID_92460; Strand=-; Position=3-635
AQLASFHAHWSAVGCHLLTNGFVNPIPIADRQKGGDEADAKRAEAGDGFGDGDLAPNATDVSSQVENMEQIEGLKNDGNDQQQQQQMNDEQNNADADQQQQQQQQKMDETDQPIDVEDDFAGCLEALDAGEDDEQGIDGEDNDDDQQQREDIDDRADWNFGEVEEPEETQLDPKLWEDEQKVEEEQKVEEKVEEKVEEEQKVEEEQKAEEK

SEQ ID NO: 166038 - protein, 73 aa, Heterodera glycines
  Coding regions on vcDNA: vcDNA=SeqID_92461; Strand=-; Position=0-218
PFQSGRCMEKLFSDKLGGLFRFSPAILFVSKVIKKNIFLLLLFHHFILFIVLANARKNGAHWDGRSSVHGERR

SEQ ID NO: 166039 - protein, 196 aa, Heterodera glycines
  Homolog annotation: Hit_ID=NP_492174.1; Match level="QueryCoverage =95%, HitCoverage=28%, E-value=4e-82, Identity=76%"; Hit description =phosphoenolpyruvate carboxykinase cytosolic family member (73.4 kD) (1I447) [Caenorhabditis elegans] emb|
  Gene Ontology: Mol. function=phosphoenolpyruvate carboxykinase activity; Cellular component=mitochondrion; Biological process =glucose metabolism
  Coding regions on vcDNA: vcDNA=SeqID_92462; Strand=+; Position=12-599
MATAATQSATMDPAKLTPFKQTPGVSASLRQISADAFYVVNEVVIKRLGPIPILKGDFHLLPFKVQRFVAEKAELCRPRGIFICDGSEHEAEEMTDLLVERGVLTPLVAYENNYLCRTDPRDCARVESKTWMVTREKYETVTHTPAGVEPIMGHWMPPAQFADELDTRFPGCMAGRIMYVIPFSMGPLGSPLSKIG

SEQ ID NO: 166040 - protein, 210 aa, Heterodera glycines
  misc_feature (29)..(29): Xaa can be any naturally occurring amino acid
  Homolog annotation: Hit_ID=AAA19072.1; Match level="QueryCoverage =99%, HitCoverage=29%, E-value=2e-87, Identity=71%"; Hit description =Hypothetical protein F42A10.1 [Caenorhabditis elegans] ref|NP _498339.1| ABC transporter protein (80.3 kD)
  Gene Ontology: Mol. function=ATP-binding cassette (ABC) transporter activity; Cellular component=cytosolic ribosome (sensu Eukarya); Biological process=regulation of translational elongation
  Coding regions on vcDNA: vcDNA=SeqID_92463; Strand=+; Position=2-631
QQSLQLDNAPARAATILFGLGFKPDDQRXPTPEFSGGWRMRVALARALFIKPDLLLLDQPTNMMDMRAVYWIENHLHEWHGTILTDAHDRKFLNTVCTDIVHLHSRRLDAHNENYDDFDNAMREKLTLQQREYEAQQQLRQHIQEFIDEFRYNAKRASMVQARIKMLEKLPVLQPVEFDSDVVVHFKDCDKLCNPVLHLDQVAFRYSKET

SEQ ID NO: 166041 - protein, 202 aa, Heterodera glycines
  Homolog annotation: Hit_ID=CAE70292.1; Match level="QueryCoverage =93%, HitCoverage=15%, E-value=4e-55, Identity=59%"; Hit description =Hypothetical protein CBG16813 [Caenorhabditis briggsae]
  Gene Ontology: Biological process=glutamate metabolism
  Coding regions on vcDNA: vcDNA=SeqID_92464; Strand=+; Position=44-649
MVSVQNAAQPPKGRLGFGIDRGGTFTDVFVAYPDGRTGTFKLLSVDRQNYSDAPTEAIRRVLSDFIGIELTRGEPIPTDHIAWIRMGTTVATNALLERKGEPMALLVTKGFKDLLHIGNQSRPNIFEFDIRIPETLYEEVEEVDERVLLEDDTCEMEIQGRKVRAQNGQMVIVEKELDQEQIRAVLGQILARGIHSLAVLLL

SEQ ID NO: 166042 - protein, 104 aa, Heterodera glycines
  Coding regions on vcDNA: vcDNA=SeqID_92465; Strand=+; Position=11-325
MSTRRSSRRSSAAKGSREGSVAGKSKPSETAISDSKKPSNSSPEKAQETGKMEEEKKLEPVTETEPELSTEDEEKSIVDEKKTTPEKKQEEVGARGGATAGNLR

SEQ ID NO: 166043 - protein, 201 aa, Heterodera glycines
  Homolog annotation: Hit_ID=NP_502353.1; Match level="QueryCoverage =63%, HitCoverage=25%, E-value=4e-27, Identity=46%"; Hit description =putative membrane protein, family 8 (57.2 kD) (4N121) [Caenorhabditis elegans] emb|CAA92989.1| Hypothetic
  Coding regions on vcDNA: vcDNA=SeqID_92466; Strand=+; Position=2-604
RTPEQSRDVFWDNDHIAPLYSMEAAQRTVHPLIGSASKINMAKGKKTITMAPHKSKLSKMDERTRLAHIRLVDTMEHNVKHAEELKADNANNENKALGELRKRQKSGKIRDGRHMEGMPSTRRAPDLERDGFHRLRESRDGEHSPSHHRPNGTSLTSPHRTRRGSPFGAGALRQPDPLSQGHYIGEEMPQRDLNPYMGHIQ

SEQ ID NO: 166044 - protein, 37 aa, Heterodera glycines
  Coding regions on vcDNA: vcDNA=SeqID_92467; Strand=+; Position=146-259
LYHLCFLRLRIRKLNLKILKYVLTFSNFPYYFLKNSL

SEQ ID NO: 166045 - protein, 169 aa, Heterodera glycines
  Homolog annotation: Hit_ID=CAE62660.1; Match level="QueryCoverage =68%, HitCoverage=19%, E-value=1e-12, Identity=39%"; Hit description =Hypothetical protein CBG06798 [Caenorhabditis briggsae]
  Coding regions on vcDNA: vcDNA=SeqID_92468; Strand=-; Position=2-508
WQFLLINTISFFFFRLDLNIVGVANAFGLLRMPQIRELRNRADISSAFKPRMDVRTSEIKFKDEKLEAKRMVMLEQRVKQRNEEREKQRAGRENWGDKQRPAREYGRDKQRTAGENWGDKQKRPAREYGRDKQRPARENWGDKKRPSGEYGRDRQRNGGIRSNNYNSRG

SEQ ID NO: 166046 - protein, 51 aa, Heterodera glycines
  Homolog annotation: Hit_ID=NP_491069.1; Match level="QueryCoverage =98%, HitCoverage=4%, E-value=2e-17, Identity=80%"; Hit description =coatomer (137.7 kD) (1D464) [Caenorhabditis elegans] gb|AAF36010.2| Hypothetical protein Y71F9AL.17 [Caeno
  Gene Ontology: Mol. function=transporter activity; Cellular component= secretory vesicle; Biological process=locomotory behavior
  Coding regions on vcDNA: vcDNA=SeqID_92469; Strand=-; Position=3-408
AISFLPTRRWVLPSLHSGVIQLWDYRLCVLMTKFDEHDGPVRGCDFHSQQP

SEQ ID NO: 166047 - protein, 113 aa, Heterodera glycines
  Homolog annotation: Hit_ID=NP_001004509.1; Match level="QueryCoverage= 100%, HitCoverage=8%, E-value=6e-11, Identity=32%"; Hit description =si:busm1-180o5.3 [Danio rerio] emb|CAD60788.1| novel protein similar to DNA polymerases [Danio rerio]
  Coding regions on vcDNA: vcDNA=SeqID_92470; Strand=-; Position=3-341
GCAWHGCKKCYPSDNMLLPNGKSAGEVRERDAKRLEFIRSQVAHVDVYWECEIQCMLSRSKEMRQKFAEYVDDGPLLIRDAFMGGRTGPLTLYHEARDGEKISYFDFTSLYPY

SEQ ID NO: 166048 - protein, 185 aa, Heterodera glycines
  Homolog annotation: Hit_ID=AAB96970.1; Match level="QueryCoverage =96%, HitCoverage=28%, E-value=6e-63, Identity=65%"; Hit description =gamma-glutamylcysteine synthetase [Onchocerca volvulus] sp|Q9NFN6|GSH1_ONCVO Glutamate--cysteine ligase (G
  Gene Ontology: Mol. function=glutamate-cysteine ligase activity; Cellular component=intracellular; Biological process=glutathione biosynthesis
  Coding regions on vcDNA: vcDNA=SeqID_92471; Strand=+; Position=82-636
STELLAKVRVSLRAKDLLDALMASEDVNRSLGEENRSLWRPEFAAYMVEGTPGTPYGGLMSCFNIVEYNMRLRYDDVSALLRPNESLLSISFPALGAPDFTDPPAVPRPTHPDSVGRSVFYPDEAIYSGHPRFRNLVRNIRGRRGEKVAINVPIFRDQNTPSPFTETFENAEASRAALPDHIYMD

SEQ ID NO: 166049 - protein, 193 aa, Heterodera glycines
  Homolog annotation: Hit_ID=NP_502120.1; Match level="QueryCoverage =88%, HitCoverage=44%, E-value=2e-47, Identity=53%"; Hit description =tRNA -methyltransferase (4M60) [Caenorhabditis elegans] emb|CAA97418.2| Hypothetical protein B0035.16 [Ca
  Gene Ontology: Mol. function=tRNA (5-methylaminomethyl-2 -thiouridylate) methyltransferase activity; Cellular component =cytoplasm; Biological process=tRNA processing
  Coding regions on vcDNA: vcDNA=SeqID_92472; Strand=+; Position=58-636
QVIFCGICQFGICSNDFPFCFGAVSALLLKRRGFDVVGVHMTNWDPQDEASDSSSCPQSEDLTDSEKLCAFLGIKLHIVNFVKQYWNDVFINFVDNCSFGRTIVPDVGCNKKIKFNLLRKVAFEELGADALATGHFARTSQGDFLENHLAVPNKIKLLRAKDALKDQTYFLSSLCHSQLDRVMFPVGSLYKSE

SEQ ID NO: 166050 - protein, 214 aa, Heterodera glycines
  Coding regions on vcDNA: vcDNA=SeqID_92473; Strand=+; Position=2-643
FRRSLFSNDTLYDFLRCVDTATLGLSVALCCRRFANFADFILRRRAHSNCALMLFDGQNQMLCAKSKAQSSDSVFAVRLWDSAKANIRGRGFERRIYANGMTLYKVIDQWFCNPIEQKALELSEFEVPEWITGIRFLYLLDVVSLPVLSFLRQISPMLEKCCIKFELTSFWSKLHSSGQLLPFLSLFNPLTFSLHLTFDDLYFHSVNRPNPYFF

SEQ ID NO: 166051 - protein, 192 aa, Heterodera glycines
  Coding regions on vcDNA: vcDNA=SeqID_92474; Strand=+; Position=62-637
QNCPLLLLKMAPKCLPPELLYEFVLFIPVEDAIPNVLSSCCLLYNILRPRVIKWEKKMQKLIDEFGKFRRDFDGFRGEFDGFRGEVRTELSTMKNRFEVLDKPFGQLPVSPQTLEHNWAQFIDYLVQANNGVTGRMATLTNAVERLNAGDSDEADKLYGDVTALDSDCTDLAEMVHRIAQLPNVAQATQLAT

SEQ ID NO: 166052 - protein, 85 aa, Heterodera glycines
  Coding regions on vcDNA: vcDNA=SeqID_92475; Strand=-; Position=63-320
SMTFHFSLVFNVRLFKRTELSRPENKATYCVTSECGKATHTPWTHLSGICGTFPFPSPFRNPIPNASTTTAPGRATLPSSDLLSQ

SEQ ID NO: 166053 - protein, 90 aa, Heterodera glycines
  Homolog annotation: Hit_ID=AAO73002.1; Match level="QueryCoverage =63%, HitCoverage=17%, E-value=5e-09, Identity=50%"; Hit description =cathepsin B [Fasciola gigantica]
  Coding regions on vcDNA: vcDNA=SeqID_92476; Strand=-; Position=210-482
MTGLRGTKPPRAVPVSAFLGNTRRHRLGARCSNHVEFDVRTKWPSCADIVNKVQDQTTCASCWAVATASAFTDRYCIEYAKHGKVGNYFI

SEQ ID NO: 166054 - protein, 201 aa, Heterodera glycines
  Homolog annotation: Hit_ID=CAA68071.1; Match level="QueryCoverage =94%, HitCoverage=40%, E-value=2e-62, Identity=57%"; Hit description =dystrophin-like protein [Pectinidae]
  Gene Ontology: Cellular component=plasma membrane; Biological process= muscle contraction
  Coding regions on vcDNA: vcDNA=SeqID_92477; Strand=+; Position=2-604
AFGGSNIEPSVRSCFEHTKFPPTINVEQFLDWLRKEPQSLVWLPVMHRLGSSEFAKHQAKCNACKMFPIVGLRYRCLRCFNFDICQNCFFSQRTAKSHKLSHPMQEYCTPTSAGDDMRDFTVIIKNKVRQGKSRIGYLPVEQINEGPPLECNDQTPQNAETEAMHQRMQLIAARLDKRQTEAAEAFPNAIVPSEEGKVKNG

SEQ ID NO: 166055 - protein, 60 aa, Heterodera glycines
  Coding regions on vcDNA: vcDNA=SeqID_92478; Strand=-; Position=40-222
PMIMIVNFVIFSPYFAILSILIHILTFLVHIFGVFLVYIISFTKRRSGMPKIKIISLAFC

SEQ ID NO: 166056 - protein, 199 aa, Heterodera glycines
  misc_feature (171)..(171): Xaa can be any naturally occurring amino acid
  Homolog annotation: Hit_ID=CAB61036.1; Match level="QueryCoverage =99%, HitCoverage=15%, E-value=4e-28, Identity=36%"; Hit description =Hypothetical protein W02B9.1a [Caenorhabditis elegans] gb|AAB94553.1| HMR-1 [Caenorhabditis elegans]
  Gene Ontology: Mol. function=cytoskeletal anchoring activity; Cellular component=cell-cell adherens junction; Biological process =locomotory behavior
  Coding regions on vcDNA: vcDNA=SeqID_92479; Strand=+; Position=2-599
LEVKVEDKVRNERAMSFIKVNVRAVPEIAFERHATIRLLVDSALSPVSDLLDEEAKGLASALVREEHGEPSRLELFRREMESLTQAFVEVISLKPDEQLLQRLSTKVVDLRFTARNGDEFLDPTHLHGLAMRNRERLATVLRARILAVGVDMCKWTTCDNGCRTENRADNXGVVVQANRTVIVGLNASAADVCECPAYS

SEQ ID NO: 166057 - protein, 80 aa, Heterodera glycines
  Coding regions on vcDNA: vcDNA=SeqID_92480; Strand=-; Position=3-242
SCYENFAFALLFDEKKYILFYPAIRSMFSDEDEEEDEDVSEVGMITAEDDDDEAQHIRVRTQQQQVQPEDEDFMRDFDRL

SEQ ID NO: 166058 - protein, 86 aa, Heterodera glycines
  Coding regions on vcDNA: vcDNA=SeqID_92481; Strand=+; Position=364-624
MGGKKRPTMSAMLTTPFFRTLIMHKLIVHFWHSHSLWPMCGANPKRKSLKTEEEQKTNGLNAKWLLRACPSHKVGKCCASCCCNTI

SEQ ID NO: 166059 - protein, 112 aa, Heterodera glycines
  Coding regions on vcDNA: vcDNA=SeqID_92482; Strand=-; Position=268-606
KGNWNWTNGEKTKNWKFQMTIQSENYCNECMKDMPVSIFKCAFSFIAFSVRLQSTRGGDDDEAFHSVQNEANTMMEDLQGKFKNIDGVFEKLGQIERMLAQLVGSRQTEGGN

SEQ ID NO: 166060 - protein, 91 aa, Heterodera glycines
  Coding regions on vcDNA: vcDNA=SeqID_92483; Strand=-; Position=364-639
SQQLYWAHHHQQAHRETGPSELLEFRFRSERIVGEMSRAICPNDQHYENPSGKCLTRKDAKFLGPKHQFVDQLKFKSATDDRDGLSWYWAK

SEQ ID NO: 166061 - protein, 203 aa, Heterodera glycines
  Homolog annotation: Hit_ID=CAE71951.1; Match level="QueryCoverage =77%, HitCoverage=18%, E-value=3e-34, Identity=45%"; Hit description =Hypothetical protein CBG19019 [Caenorhabditis briggsae]
  Gene Ontology: Mol. function=ATP binding; Cellular component =cytoplasm; Biological process=protein kinase cascade
  Coding regions on vcDNA: vcDNA=SeqID_92484; Strand=+; Position=5-613
MDLTHLTTEEEALFQLHERRCTWLYVVNDTLTALQGKTPYLYRHEMLQLFQQELITQKLAKSLDKLPQKLKPKALMSTLRMPETRDCYQCNVERSINDENLYLCCAVPHAVLLFQWYEPLSRFVHLKRVQLDKLSSPYTDLQHPHKPFNLVFRSGAANSDLPMVCIGISRALTSPVGTAQELLRELRTNLQKDKFELQLVDFN

SEQ ID NO: 166062 - protein, 113 aa, Heterodera glycines
  Coding regions on vcDNA: vcDNA=SeqID_92485; Strand=+; Position=240-581
QMSDFALFSPATVLIAFYFSVVPNSPRFVLDISSAQKKGEELGNLSNFAHLHFFCFGWEWGAEDAHLSRVIIAAPLIGQFKQMMHVPLGGRTNKAIKREINGKRRGRGDHTAE

SEQ ID NO: 166063 - protein, 102 aa, Heterodera glycines
  Coding regions on vcDNA: vcDNA=SeqID_92486; Strand=+; Position=6-314
GGYSWARPVFILIGERLSSLATVSHAGLPAPWLRCKILAYRNLEWVLGTDIFGLEMAVDFTGTSASICTMDALEGKPVPKNHLDFLLGNQQFRRCKLAIFGH

SEQ ID NO: 166064 - protein, 196 aa, Heterodera glycines
  Coding regions on vcDNA: vcDNA=SeqID_92487; Strand=+; Position=48-635
MVFSIFRLYSLSFLLFLPLCPTSAFYKYDSSFAFLNVRSKSLPTGGSDFCVNFQQWHSRQLPSSADTKNFVQIGWWNSNLNTNICLENGHNFAKNELVPVDYRTLSSELLPCKFKEGEAVVNATLNRLKPKGVRNVLFLMEKGKRNRYGIRDFLFSQFYNAEINDSDTSMSVFFVYNDTFRQEIEPLLLNSSSTEL

SEQ ID NO: 166065 - protein, 85 aa, Heterodera glycines
  Coding regions on vcDNA: vcDNA=SeqID_92488; Strand=+; Position=364-618
LGESSKLGERGCCRTPIPILNHFLIRFLHRANMEAGRYIIRQSNVDEWRANVRILSPEGDGRAPTMLSDNWSLRAVQNGQGNVAA

SEQ ID NO: 166066 - protein, 97 aa, Heterodera glycines
  Coding regions on vcDNA: vcDNA=SeqID_92489; Strand=+; Position=182-475
ILNSKKFPNFFSAERDGLMLNMQRILARCNTVNISIETPRDQHQFKALEQVNKVGGAIVGATLFQAVQPAGIYASFESPGRVGICANAIKNISEIGI

SEQ ID NO: 166067 - protein, 131 aa, Heterodera glycines
  Coding regions on vcDNA: vcDNA=SeqID_92490; Strand=+; Position=170-562
ILSKNSFVEENVGRIGSVSLTVTNRLFRAIYFKIKSTSNSFYSICPENGIIQPKENVEVIIKPNDDSLANLQEITTKKHKFLIMSAIVSNLAVQAENFWKGKKHFSEGVYSKKLKTKVQKTHHNQQNSEQR

SEQ ID NO: 166068 - protein, 55 aa, Heterodera glycines
  Coding regions on vcDNA: vcDNA=SeqID_92491; Strand=-; Position=0-164
ISCLDFSPDPQQQRLCAGHSSGALTVFDCGRGRVLFSGRDIIQPGRSVLHVKYIA

SEQ ID NO: 166069 - protein, 148 aa, Heterodera glycines
  misc_feature (7)..(7): Xaa can be any naturally occurring amino acid
  misc_feature (97)..(97): Xaa can be any naturally occurring amino acid
  misc_feature (99)..(99): Xaa can be any naturally occurring amino acid
  Coding regions on vcDNA: vcDNA=SeqID_92492; Strand=-; Position=1-444
LALVCLXDSASPVAIQLLLPSLPLPIPPPFCAPPPVPASPPHPLLRPRLPSTPPPPTWSRGRAADPRVAFFCCFFFFVLLVVAFCVISLGACASGPXAXIKKFIIHRFRGYSFGSFRSFARLRREIRCCRGLSCAVFSSPPMCQFGGF

SEQ ID NO: 166070 - protein, 203 aa, Heterodera glycines
  Homolog annotation: Hit_ID=CAE67537.1; Match level="QueryCoverage =44%, HitCoverage=8%, E-value=9e-25, Identity=64%"; Hit description =Hypothetical protein CBG13060 [Caenorhabditis briggsae]
  Gene Ontology: Mol. function=potassium:chloride symporter activity; Cellular component=integral to plasma membrane; Biological process =embryogenesis and morphogenesis
  Coding regions on vcDNA: vcDNA=SeqID_92493; Strand=+; Position=22-630
MFTTRKVCSHTHTAFEVIPSPLLPLSPPNPLNRQQRVRIQLGADESPQKAKLDSQPLLLDSPSSSSAGAVLSNCPRRNHSYLSLFNLAHPQHFVGEHGFLSWSSLRKKANTETTENGDFALYDNEPAHNFIAPYISGYTTPGPMEREASKHKKAKLGVMLGVYLPTIQHILGVTMFIRLAWIVGVAGVSHTFLMLFICWLCTF

SEQ ID NO: 166071 - protein, 83 aa, Heterodera glycines
  Coding regions on vcDNA: vcDNA=SeqID_92494; Strand=+; Position=68-319
KFTLPMGGEGRTDYFGNKKIFWAKSVVKSAICKGMDSFRAIENEWCFMKRAVKEWMDGNSLYILGVKIARLGNFEIPNFFAAS

SEQ ID NO: 166072 - protein, 166 aa, Heterodera glycines
  Coding regions on vcDNA: vcDNA=SeqID_92495; Strand=+; Position=3-503
MAKSPKKSPTKRHVSVPSHNQSLTKRPKVEFAAILNKTNGTADKQPMSFEHRLAKLDGDDGGLHRASTSSGHISARQPGAEAKWPRPAPAKWVREGRTDANLAFQLIDIDFYMGPTFHSNDWWVNPRQKKADGTYTLAVPLIQTSKSIAFLSSLAELVGLHLAEQS

SEQ ID NO: 166073 - protein, 56 aa, Heterodera glycines; identical to SEQ ID NO: 141389
  Coding regions on vcDNA: vcDNA=SeqID_92496; Strand=+; Position=82-252

SEQ ID NO: 166074 - protein, 81 aa, Heterodera glycines
  Homolog annotation: Hit_ID=CAC33829.1; Match level="QueryCoverage =97%, HitCoverage=23%, E-value=7e-22, Identity=67%"; Hit description =annexin 2 [Globodera pallida]
  Gene Ontology: Mol. function=anticoagulant activity; Cellular component=cytoplasm
  Coding regions on vcDNA: vcDNA=SeqID_92497; Strand=+; Position=2-244
EVSANFLHKAIEDFRPDESVHLLCTISNQQRQELVREFKQLFGEDLSAKLKKALSGDFEELILALVEPAAVYDEQKMRRAM

SEQ ID NO: 166075 - protein, 157 aa, Heterodera glycines
  Homolog annotation: Hit_ID=AAH51607.1; Match level="QueryCoverage =77%, HitCoverage=58%, E-value=3e-09, Identity=33%"; Hit description =Dkfzp434b168 protein [Danio rerio]
  Coding regions on vcDNA: vcDNA=SeqID_92498; Strand=+; Position=3-473
QAFQGELFGRKFELSPNAIRLRIVTAIRECSGVNLGVTIPSEDIVRCIMKVSHSNDYKARSMTLLFFASLGRLIFDDKKVHIFVIESLDCADQTEFSAAIRAGNELAKHSVPFSVLDMNKIAELVGSNSLTHWVRAELMAVVGNLRDLSLTRQCLEL

SEQ ID NO: 166076 - protein, 94 aa, Heterodera glycines
  Coding regions on vcDNA: vcDNA=SeqID_92499; Strand=-; Position=32-316
YENHFTNNKCPFIHKIKSYWKKKKKIIQHFENILKKMKLFPLLFCLILIFIALINQIKSAKKKLEQKSFDEIFGEKWEEKEEEQRIDEKERTKI

SEQ ID NO: 166077 - protein, 124 aa, Heterodera glycines
  Coding regions on vcDNA: vcDNA=SeqID_92500; Strand=+; Position=2-373
IHPIMNAKIIRVPKIACDLRLEKNGVSKNRNYAQKASQPILAHPIPSTIAFIHPIMNAKIIRVPKIACDLSLEKNGVSKNRNFAQKASQTILAHPIPSTIAFMHPIMNAKIIRVPKIACDLRLK

SEQ ID NO: 166078 - protein, 203 aa, Heterodera glycines
  misc_feature (76)..(76): Xaa can be any naturally occurring amino acid
  misc_feature (78)..(78): Xaa can be any naturally occurring amino acid
  Homolog annotation: Hit_ID=CAE64606.1; Match level="QueryCoverage =99%, HitCoverage=69%, E-value=3e-69, Identity=64%"; Hit description =Hypothetical protein CBG09362 [Caenorhabditis briggsae]
  Gene Ontology: Cellular component=mitochondrion
  Coding regions on vcDNA: vcDNA=SeqID_92501; Strand=+; Position=2-610
SLYKLVDIGANLGHPSFQPDFADVLNRAKKAGIVKLLITGASESITDEAAKLASKEPDFLYYTAGVHPHDAKDFFXDXTLDFLRSHLTTNSQCVAVGECGLDFNRNFSPRDQQLRVFEAQVQLACELGKPLFVHEREAHQEMVAILSRHSKSLPPTVIHCFTGTEMEAKQYMDMGLYIGLTGFLWKDRAVDGVKHALRQRTIR

SEQ ID NO: 166079 - protein, 210 aa, Heterodera glycines
  Coding regions on vcDNA: vcDNA=SeqID_92502; Strand=+; Position=3-632
TTMTQTEANNRQNGKSGADKRRQNSAEKGRPETGYASVLTTNGSAIFHRHRKSLQDDEVKGNGSNNNGIHQHMKHRNDFGSSTSVEKREGLVGRKFGLINGAIGALLNRSVSESKALNQQHQNGGGHYGKLKAHQQFPFSQSFPVKENSKKQQQAPIAQSEPSDTDFDDSLSATSAVETGSTPMGSGATRTPIGQGSAEGDTSQHEKRPF

SEQ ID NO: 166080 - protein, 140 aa, Heterodera glycines
  Coding regions on vcDNA: vcDNA=SeqID_92503; Strand=+; Position=3-425
RLETHRVLTSFVGNLCAPNHFFRPDHNSGRFCVVSINTHEANREMVRTFFHDNEAGFTKKYYFCELQFFPMNELPWDVAVLKLYAETMGHIWDPLFTYLDEVITSLENGDMPPYISESSPNNSANSLENLPSVEAPQSDD

SEQ ID NO: 166081 - protein, 18 aa, Heterodera glycines
  Coding regions on vcDNA: vcDNA=SeqID_92504; Strand=-; Position=40-96
FFFFFFFFNNNKFMTQYD

SEQ ID NO: 166082 - protein, 71 aa, Heterodera glycines
  Homolog annotation: Hit_ID=NP_491688.1; Match level="QueryCoverage =97%, HitCoverage=10%, E-value=5e-10, Identity=39%"; Hit description =high Mobility Group protein (hmg-3) [Caenorhabditis elegans] gb|AAC24268.1| Hmg protein 3 [Caenorhabditis
  Coding regions on vcDNA: vcDNA=SeqID_92505; Strand=+; Position=2-217
SFFLWMNENRHRFYQPGMTQADVAKAAGEEWRRMSSSEKAKWGEKSVEDKERYVHEMNEQREKEEGEEEGE

SEQ ID NO: 166083 - protein, 192 aa, Heterodera glycines
  Coding regions on vcDNA: vcDNA=SeqID_92506; Strand=+; Position=3-578
GKENVIKMEEKLTNAEKEIVKLKENAPHKKLGVVQDLVDRLAILDEMEQCLNTLWLMPTDSKTEFYPLATTRTILRLTELCAALESESSNYLESINERILPLLFAEIETRKGELCQQLSDFYASFFRFTEDDRVSPPLYSMSINCPSIKTASDCFSAMRQLDLLEDRLEEMVDIIWEHFCLKLIYAVTEDGQ

SEQ ID NO: 166084 - protein, 179 aa, Heterodera glycines
  Homolog annotation: Hit_ID=NP_499713.1; Match level="QueryCoverage =93%, HitCoverage=43%, E-value=8e-63, Identity=62%"; Hit description =DHHC type zinc finger containing protein (3O207) [Caenorhabditis elegans]
  Gene Ontology: Mol. function=palmitoyltransferase activity; Cellular component=integral to endoplasmic reticulum membrane; Biological process=lipid metabolism
  Coding regions on vcDNA: vcDNA=SeqID_92507; Strand=+; Position=109-645
MKKLCRSLSHALPAVLTWSLIVGCSAAFFYVLVPALVVQLGLVGYVLCCLDVVLFVLCLSNLCLSTAMDPGIHPIAISSEETSVDDFRSPLYRNVEINGITVRMKWCVTCKFYRPPRSSHCSVCNRCIDCFDHHCPWVHNCIGRRNYRFFFLFLLFLSLHMVCVFGLSLAYTMLSRRDI

SEQ ID NO: 166085 - protein, 157 aa, Heterodera glycines
  Coding regions on vcDNA: vcDNA=SeqID_92508; Strand=+; Position=1-471
PNYNRNQYFISIIDSLSQKGLLEANRQPPISHSTLSFLMERKKDPMSMVNIYCSASGEPNFEFFVFQLAVRPSKFVFISELRSRPVYGFCAASKKEAKKACALRLLDILMTEERLECVNLSGRKVRKMPPKPIPTKAANVEQSQQQENMHLSFSDDI

SEQ ID NO: 166086 - protein, 96 aa, Heterodera glycines
  Coding regions on vcDNA: vcDNA=SeqID_92509; Strand=+; Position=257-544
YERMWWTCPGIEQKECFFPLDIPKEVFWTRRSMDQSLRGILPLPNLHLLPLSLRALYHKLFKSKVNIEKIVRISAFVPSDGQKSAVQQANFGAEEQ

SEQ ID NO: 166087 - protein, 193 aa, Heterodera glycines
  Coding regions on vcDNA: vcDNA=SeqID_92510; Strand=+; Position=1-579
CLSARYLFVMAGTNAAVELESWDEMEIDESAATFAPRAVPVTEDRTIMKNVIAWAIDGKLKSLRGGANDEKEGDLFNELAQSGDFMAWTVLAYFDTLKKIAVADTVNFTVKTTLTQYLAALDGELPTAQANTVSETPTSRLLALFISFICLAKGNEARNNPTIQSPVSLENASIFRRYSAMVAGKNLPTANAV

SEQ ID NO: 166088 - protein, 209 aa, Heterodera glycines
  Homolog annotation: Hit_ID=CAE57422.1; Match level="QueryCoverage =93%, HitCoverage=34%, E-value=6e-32, Identity=41%"; Hit description =Hypothetical protein CBG00380 [Caenorhabditis briggsae]
  Gene Ontology: Mol. function=calcium-dependent phospholipid binding; Biological process=vesicle-mediated transport
  Coding regions on vcDNA: vcDNA=SeqID_92511; Strand=+; Position=3-629
HFCSVPLPGQPDIPHTRVELMLSARDLKDKDLLSKSDPMCVIYSLVPGKGGTGPEYVEIGRTEVIWNNLNPRWNTKVTLNYFFETKQQLRFDVFDIDTENTRDLSSQDFLGRCECHLADIVAAAHGVLTLKLKDEPGQEGKLIIRADEVDEGQKEMVRMVCHGQQVASKGICWCLSARDPFLEFHRLYADGSKQLVYRTEVQTRTVDPE

SEQ ID NO: 166089 - protein, 83 aa, Heterodera glycines
  Coding regions on vcDNA: vcDNA=SeqID_92512; Strand=+; Position=2-253
IKSFIMEKDFSINCYIAFSNPIFCHQKMLMRKGEFSFNSQERSFTAKIHNKTRLRLFPCELCAVGKKRCPNGRCLIIRYKTGF

SEQ ID NO: 166090 - protein, 90 aa, Heterodera glycines
  Coding regions on vcDNA: vcDNA=SeqID_92513; Strand=-; Position=3-272
LKNLKFRPPVITLISIISLFLFRQLSGLNVGCAWHVLLLAHYREWFARLSRRRTILRHRRSADPAGRAGRPGYGPTPSDGPSGGAQSWRA

SEQ ID NO: 166091 - protein, 205 aa, Heterodera glycines
  Coding regions on vcDNA: vcDNA=SeqID_92514; Strand=+; Position=1-615
IKLAYSLFCIILLCYITNSSAALGKSKSIAKLQNDTKNNEVMVTERGKMVVDEQSLVIENPEQNTAGMETVNDELKAVPSGGIIGSGQQNAEAAQQKPVPSSALTETEGPRDSSAVTNGGTSGSGSGQHERAAPTGAQQKQGPSSAPTAAEGPRSLGQQEQQPHVDKVEAGGTSTWIIVGSIFGGIGAGAIIVWIVISCVKRCQR

SEQ ID NO: 166092 - protein, 108 aa, Heterodera glycines
  Homolog annotation: Hit_ID=CAE62548.1; Match level="QueryCoverage =84%, HitCoverage=59%, E-value=8e-10, Identity=39%"; Hit description =Hypothetical protein CBG06657 [Caenorhabditis briggsae]
  Coding regions on vcDNA: vcDNA=SeqID_92515; Strand=+; Position=2-328
QQRTVAEPKKQPQKVAEAEELPQQTKQPQQQQEESPTTQCVQQKVRKPKSLKALTEYELCKQECRRKRDQESANEYIDYLREELRLAEERVEAEALQQQQQLQYANGL

SEQ ID NO: 166093 - protein, 65 aa, Heterodera glycines
  Homolog annotation: Hit_ID=EAA76959.1; Match level="QueryCoverage =73%, HitCoverage=6%, E-value=2e-10, Identity=64%"; Hit description =hypothetical protein FG07147.1 [Gibberella zeae PH-1] ref|XP _387323.1| hypothetical protein FG07147.1 [Gibb
  Coding regions on vcDNA: vcDNA=SeqID_92516; Strand=+; Position=2-199
RATPGRASALIRLISETNERALFTGDTLFIGGSARFSEGTAQQMHHALNERLDTLHDQTLVYCQH

SEQ ID NO: 166094 - protein, 22 aa, Heterodera glycines
  Coding regions on vcDNA: vcDNA=SeqID_92517; Strand=-; Position=8-76
FFFFFFSWFRKNHLPTSKQPLK

SEQ ID NO: 166095 - protein, 210 aa, Heterodera glycines
  Coding regions on vcDNA: vcDNA=SeqID_92518; Strand=+; Position=3-632
RFMPATKKKAQLDPLVRRSIALLWAYNGSDLVLLTFLPGECRFDEYCQANRKNFRVLSLGTWFSIKYQRYVKCETRINVLDVSVLVEKPPLETRVIDAVVQLCVPFVCSSANPYTDQYTYKSSLGNIVLRKSQGGGPTQLLIWCSLQTVAWWKDPMLAEVVIRNTDERKVAEERDGFGGRDETTAKGIATPTNDKSASVWRGFKPNIKAK

SEQ ID NO: 166096 - protein, 189 aa, Heterodera glycines
  misc_feature (162)..(162): Xaa can be any naturally occurring amino acid
  Coding regions on vcDNA: vcDNA=SeqID_92519; Strand=+; Position=42-608
NSFDSYHSLPMRVQSIKSCLVASAFLCLVSAFLIGFASLTPGWRSIKGQIRLLQNPPIRSFSVSTGLFGFLCSEAERTAQSADLCSNWANNVSLFERIVSILCVFGVFVGLFAFLWSLVILFDLFSGWENKPRWALPALAFSTFSLASVAAVIYLFRGCSEXDNFVSHLTSSPSSPSSSPVAKCSLHYS

SEQ ID NO: 166097 - protein, 61 aa, Heterodera glycines
  misc_feature (17)..(17): Xaa can be any naturally occurring amino acid
  misc_feature (22)..(22): Xaa can be any naturally occurring amino acid
  misc_feature (26)..(26): Xaa can be any naturally occurring amino acid
  Coding regions on vcDNA: vcDNA=SeqID_92520; Strand=-; Position=62-247
KMKRKIVLESDSPGSNXAAKTXRQNXSRRKRDDAPKNGKTDLKHCEMPCFIDPLRDSCAKY

SEQ ID NO: 166098 - protein, 63 aa, Heterodera glycines
  Homolog annotation: Hit_ID=EAL28983.1; Match level="QueryCoverage =98%, HitCoverage=11%, E-value=8e-16, Identity=61%"; Hit description =GA11316-PA [Drosophila pseudoobscura]
  Coding regions on vcDNA: vcDNA=SeqID_92521; Strand=+; Position=341-529
KWNDNPVEIFANIAAFHLQFDELPTDPNVKKWSVHVLKLSCTKRHLDRAELHKFWEMLDRHIS

SEQ ID NO: 166099 - protein, 162 aa, Heterodera glycines
  Homolog annotation: Hit_ID=NP_496397.1; Match level="QueryCoverage =48%, HitCoverage=28%, E-value=6e-10, Identity=36%"; Hit description =interferon gamma inducible protein 30 like precursor (2L479) [Caenorhabditis elegans] emb|CAB04345.1| Hyp
  Coding regions on vcDNA: vcDNA=SeqID_92522; Strand=+; Position=6-491
MMPKNFCGKTSNFSPKKLPALLLIIVLSILNSVSSSRRHHSPASGHNRRLSSISSPAVANGGSLFEHRTKHQSVAAADESAGGCAVVPPSLWCGCDKLQTQCGTGRLCGRYTGAMRNEPLHITLIYERLCPNCQKIITENLIDGDQKFKKNLRNEFDPIGNA

SEQ ID NO: 166100 - protein, 89 aa, Heterodera glycines
  Homolog annotation: Hit_ID=NP_960651.1; Match level="QueryCoverage =85%, HitCoverage=35%, E-value=2e-18, Identity=60%"; Hit description =hypothetical protein MAP1717 [Mycobacterium avium subsp. paratuberculosis str. k10] gb|AAS04034.1| hypoth
  Coding regions on vcDNA: vcDNA=SeqID_92523; Strand=+; Position=1-267
KPMRTSAYRHTALAGLAAVALITAGCTDDKDVDASMSPQVGLISTSTVQTPPHPAEVKLIGERDVEVTLTGPIAAKYKIKYRIKKKKKK

SEQ ID NO: 166101 - protein, 52 aa, Heterodera glycines
  misc_feature (7)..(7): Xaa can be any naturally occurring amino acid
  misc_feature (23)..(23): Xaa can be any naturally occurring amino acid
  Homolog annotation: Hit_ID=AAL78230.1; Match level="QueryCoverage =100%, HitCoverage=58%, E-value=1e-22, Identity=96%"; Hit description= putative transitional endoplasmic reticulum ATPase [Heterodera glycines]
  Coding regions on vcDNA: vcDNA=SeqID_92524; Strand=+; Position=3-161
DDDLYSXSVNIDYSEVISSDDEXNMSLFNCIGCIFAPCRLLCVLFFIYGKVE

SEQ ID NO: 166102 - protein, 142 aa, Heterodera glycines
  Homolog annotation: Hit_ID=XP_448117.1; Match level="QueryCoverage =97%, HitCoverage=93%, E-value=4e-39, Identity=59%"; Hit description =unnamed protein product [Candida glabrata] emb|CAG61068.1| unnamed protein product [Candida glabrata CBS1
  Gene Ontology: Mol. function=hydrolase activity; Cellular component =cytoplasm; Biological process=nucleotide metabolism
  Coding regions on vcDNA: vcDNA=SeqID_92525; Strand=+; Position=76-504
MTTSATCIFCRIIRKEIPSFKLVETEHVYSFLDIGPLSHGHALVIPKHHGEKLHEIPEPQLAAILPAAKQIIDALRKETGLSDYNILQNNGRAAHQEVPHVHFHIIPKRENGEGLGVKWVPSEINKDMAKLKELHDKLTAQL

SEQ ID NO: 166103 - protein, 80 aa, Heterodera glycines
  Coding regions on vcDNA: vcDNA=SeqID_92526; Strand=-; Position=106-348
MSLRIMANVAVANTFFDCCRMPFCPLPNPALQSEGELTAICCCCLCKVTSFSWRKPFFILPLGSIVCGPCDPLNWLSSEC

SEQ ID NO: 166104 - protein, 201 aa, Heterodera glycines
  Homolog annotation: Hit_ID=CAE72305.1; Match level="QueryCoverage =62%, HitCoverage=37%, E-value=7e-49, Identity=66%"; Hit description =Hypothetical protein CBG19435 [Caenorhabditis briggsae]
  Coding regions on vcDNA: vcDNA=SeqID_92527; Strand=+; Position=1-603
IFCKNSEYAYGGHPFPFSGIFENTPRDAEELGENFKFRESIPLGETDFSAEDVNKMIQNLGQEYRGDSYHLITKNCNHFSAILSKVLTGQELPPWINRLANISGSLPFVERWIPQEWLTPIALQQSLDSRSRSIPLQNGISTAALSVPEETKADVSTDSTARPSSYTVGWRLFQRRNPSCDQSSSPANASSSSAPATSRQP

SEQ ID NO: 166105 - protein, 201 aa, Heterodera glycines
  Coding regions on vcDNA: vcDNA=SeqID_92528; Strand=+; Position=1-603
HWSNYIPNTHFLMDSKCVSLNFFALVKHEQPDEEEADDYADEQQDSANTDYKNLNGASLSAPEMPQNQQFWHAFPPNGSNGYCYDGAMTNCDGETKAIPYDETPPPKFVYTFQGPGRGRWTFSCQFTSADALDLFRKGHGMYQTKKDGCRYFFCSVKRCPYKMIGIENERQWWNIYDRNAHNHTVIPIGAKIGEKRNRNGR

SEQ ID NO: 166106 - protein, 141 aa, Heterodera glycines
  Homolog annotation: Hit_ID=EAA65839.1; Match level="QueryCoverage =98%, HitCoverage=33%, E-value=6e-43, Identity=66%"; Hit description =PGK_EMENI Phosphoglycerate kinase [Aspergillus nidulans FGSC A4] ref|XP_405383.1| PGK_EMENI Phosphoglycera
  Gene Ontology: Mol. function=phosphoglycerate kinase activity; Cellular component=cytosol; Biological process=glycolysis
  Coding regions on vcDNA: vcDNA=SeqID_92529; Strand=+; Position=39-461
MPVQLSNKLNITSVDLKGKRVLMRVDFNVPFAKGTTTISNPQRIVAALPTIQHALAAGAQAVILMSHLGRPDGKRVPKDSLKPVAAKLEELLGQPVQFLDDCVGTAVEAACAPRTAKGVILLENLRFHLEEEGSSKDEQGN

SEQ ID NO: 166107 - protein, 133 aa, Heterodera glycines
  Coding regions on vcDNA: vcDNA=SeqID_92530; Strand=-; Position=90-491
NKILGGGSPGGVLSEKIPCKSLGISLRKFSVIFVHLVEEFFNLARFGPSASAFSKIRPFPSCKYQPFPEITPLTTLTDPSTTIKLPLSTAATRRERCWPMAFPKQKWPLAAMLNSKVNREKSNELEFISQIRK

SEQ ID NO: 166108 - protein, 106 aa, Heterodera glycines
  Coding regions on vcDNA: vcDNA=SeqID_92531; Strand=+; Position=2-322
DVAGGALLGVAVGAFFLRNVLHNFRPNRYSVLDTQMLSSADGWQDIEGMPNGSEALISEKLTVPKTIVTKEQQKRPIGGQRANDYGSVREMSGGRSDGRTETAQIG

SEQ ID NO: 166109 - protein, 87 aa, Heterodera glycines
  Homolog annotation: Hit_ID=NP_496969.1; Match level="QueryCoverage =78%, HitCoverage=7%, E-value=1e-12, Identity=45%"; Hit description =gene amplified in squamous cell carcinoma 1 like (2O526) [Caenorhabditis elegans] emb|CAB54451.1| Hypothet
  Coding regions on vcDNA: vcDNA=SeqID_92532; Strand=+; Position=41-304
MAAYRPIYTKEKEWVNTGTADGEIMVFRPTMEEFSNFSKYIETIERSRAHLSSGVCKVIPPPGWHPRPSKNPSDYSDLNDFVIHCPV

SEQ ID NO: 166110 - protein, 77 aa, Heterodera glycines; identical to SEQ ID NO: 133335
  Coding regions on vcDNA: vcDNA=SeqID_92533; Strand=-; Position=3-233

SEQ ID NO: 166111 - protein, 66 aa, Heterodera glycines
  Homolog annotation: Hit_ID=CAG03239.1; Match level="QueryCoverage =100%, HitCoverage=25%, E-value=5e-12, Identity=48%"; Hit description= unnamed protein product [Tetraodon nigroviridis]
  Gene Ontology: Cellular component=integral to membrane; Biological process=nonselective vesicle transport
  Coding regions on vcDNA: vcDNA=SeqID_92534; Strand=+; Position=2-199
LLDPNNQLRFKGPLTEYVNGHLPLANPSREDVYFIVKTTVPKFYCVRPNSGVILAIDKTPINLILQ

SEQ ID NO: 166112 - protein, 81 aa, Heterodera glycines
  Coding regions on vcDNA: vcDNA=SeqID_92535; Strand=-; Position=1-243
FSAQQQRKMLQRSAFLNQFHVEATYALKAYAQNMMNRGIELLKSVYFWNTKSQLLGGPNAPKNGKIAATISIDPLQPSNAN

SEQ ID NO: 166113 - protein, 83 aa, Heterodera glycines
  Coding regions on vcDNA: vcDNA=SeqID_92536; Strand=+; Position=3-254
MTFLAHFIVSLLLIVPSFIPNVFGEDCCTKCYNSMTGCLQKCIIEHKGDPACRKTCKPNVYKCAAKCGPHCPLNWTTTTPKSG

SEQ ID NO: 166114 - protein, 136 aa, Heterodera glycines
  Homolog annotation: Hit_ID=NP_704883.1; Match level="QueryCoverage =77%, HitCoverage=9%, E-value=5e-14, Identity=39%"; Hit description =vesicle transport protein, putative [Plasmodium falciparum 3D7] emb|CAD52026.1| vesicle transport protein,
  Gene Ontology: Mol. function=poly(A) binding; Cellular component =nucleoplasm; Biological process=G1/S transition of mitotic cell cycle
  Coding regions on vcDNA: vcDNA=SeqID_92537; Strand=+; Position=101-508
MNATEQQQPQSQKRARPAEENGNDDGAVLTKTQKVDNGDIPAATANNEASANNNVLKAKLTNNEKPGGAASADEETEEQGHEEEEESEGESGAGGEEDDQDDEEDDEQGAEGDDDDEEGDDDDEDAEGDEGGEQEE

SEQ ID NO: 166115 - protein, 49 aa, Heterodera glycines
  Coding regions on vcDNA: vcDNA=SeqID_92538; Strand=+; Position=77-226
DERERTSILSIRDKADGKERRNGHSFCCCYCYWRGNQVQSAGATEAVFV

SEQ ID NO: 166116 - protein, 200 aa, Heterodera glycines
  Coding regions on vcDNA: vcDNA=SeqID_92539; Strand=+; Position=12-611
MGRSNRHAARRSPTAGLRTIPDPRLDPATARVHSATMTDTGTATGIPMRRLDNGHDTTRNSRRLQGSPSSPLSRALARFQAMPRSKKRRAVLVGAGITLFIIAIVSLLATSGGSSGPPSGILDPKSPPFNPTESTVANLLSSANVPDPSRVWDTYLPPLLVERLPGTPSHAKAKDHIVSSLKELGWTIELDAFEDSTPMG

SEQ ID NO: 166117 - protein, 201 aa, Heterodera glycines
  Homolog annotation: Hit_ID=NP_594780.1; Match level="QueryCoverage =100%, HitCoverage=51%, E-value=2e-96, Identity=82%"; Hit description= 60s ribosomal protein L3 [Schizosaccharomyces pombe] emb|CAA40901.1| ribosomal protein L3 [Schizosacchar
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_92540; Strand=+; Position=28-630
MSHRKFEHPRHGSLGFLPRKRCRRHQGKVKSFPKDDVKKPVHLTAFLGYKAGMTHVVRDLDRPASKMHKKEIVEAVTIIETPPMVIVGVVGYVETPRGLRTLTTVWAEHLSEEVKRRFYKNWYKSKKKAFTKYSAKYADGAKDITRDLERIKKYCQVVRVLAHTQVRKVKIGQKKAHLMEIQLNGGSIAQKVDWAKEHFEK

SEQ ID NO: 166118 - protein, 53 aa, Heterodera glycines
  misc_feature (25)..(25): Xaa can be any naturally occurring amino acid
  Homolog annotation: Hit_ID=AAQ95745.1; Match level="QueryCoverage =94%, HitCoverage=32%, E-value=6e-11, Identity=60%"; Hit description =SOD [Clonorchis sinensis]
  Coding regions on vcDNA: vcDNA=SeqID_92541; Strand=+; Position=2-160
ERSPVTVEVTIHGLKPGQHGFRFHXFRNNTNGCVSAGPHFHLVGHKRRAPTDP

SEQ ID NO: 166119 - protein, 83 aa, Heterodera glycines
  Homolog annotation: Hit_ID=CAE65930.1; Match level="QueryCoverage =98%, HitCoverage=97%, E-value=2e-35, Identity=80%"; Hit description =Hypothetical protein CBG11103 [Caenorhabditis briggsae]
  Gene Ontology: Biological process=cell growth
  Coding regions on vcDNA: vcDNA=SeqID_92542; Strand=+; Position=16-267
MAKRKSKRKAPTKVKSIVALETQFNCPFCNHENVCEVKMDRERNVGFIQCRVCMEDFQSNITALSEPIDVYSDWIDACEAANQ

SEQ ID NO: 166120 - protein, 53 aa, Heterodera glycines
  Homolog annotation: Hit_ID=CAE73307.1; Match level="QueryCoverage =100%, HitCoverage=3%, E-value=3e-11, Identity=50%"; Hit description =Hypothetical protein CBG20734 [Caenorhabditis briggsae]
  Coding regions on vcDNA: vcDNA=SeqID_92543; Strand=+; Position=2-160
QRNGRMARVLQTHGINLGAFYAHADFLDINTIYSNDIDFMLRNFGIEGAARTI

SEQ ID NO: 166121 - protein, 53 aa, Heterodera glycines
  Coding regions on vcDNA: vcDNA=SeqID_92544; Strand=+; Position=1-162
EEQKPAGKKEKRAAEKEEKKSESKEAEKKENEEQKPAGKKEKRAAEQNSKKGD

SEQ ID NO: 166122 - protein, 142 aa, Heterodera glycines
  misc_feature (86)..(86): Xaa can be any naturally occurring amino acid
  misc_feature (94)..(94): Xaa can be any naturally occurring amino acid
  Homolog annotation: Hit_ID=CAB88203.1; Match level="QueryCoverage =99%, HitCoverage=46%, E-value=3e-25, Identity=46%"; Hit description =putative cuticular collagen [Globodera pallida]
  Coding regions on vcDNA: vcDNA=SeqID_92545; Strand=+; Position=2-424
HETHLVLWIASRSSLWASIATPVTLPSLYPEHSQVKRQMRDGAYDFGRLSISAWTDSMDDRLHTTQPSTPRYNPYNSVFRAQHRLXPEHCQCAXPPTPSTVPQGRPARSEGLAQPTTPGGTRQPRQSEQTGHAGASLPVPEI

SEQ ID NO: 166123 - protein, 194 aa, Heterodera glycines
  Homolog annotation: Hit_ID=CAE67139.1; Match level="QueryCoverage =72%, HitCoverage=18%, E-value=8e-33, Identity=52%"; Hit description =Hypothetical protein CBG12562 [Caenorhabditis briggsae]
  Gene Ontology: Mol. function=enoyl-CoA hydratase activity; Cellular component=mitochondrion; Biological process=growth
  Coding regions on vcDNA: vcDNA=SeqID_92546; Strand=+; Position=42-623
MLPRICCSSRSLLLRNLRISPALSIHFAMHQSTVAPSSAAAAQSLGCKIEPPKPRVDATRATDSDKLSTAKNTVTWALKGEGIAVVKIDIPDVKENTLNEAVSDDLRKTFDAIEQNSSVRGVVLMSGKPNSFIAGADIGMLSRCATAEAAARISRDAKIHFERMEASKKPIVAAISGSCMGGGLEMALACHYRI

SEQ ID NO: 166124 - protein, 176 aa, Heterodera glycines
  Coding regions on vcDNA: vcDNA=SeqID_92547; Strand=-; Position=35-565
LGLGRLTLDKVVMFLLIIMRLALGQLCISIGLVVVLLLLRLGLALGQRGRIVITVVLTRLKEHGRRLADTRDLGLGRTLELLERRGLGTGHLVDNRGSESTDGRAPAGFRVVVESLAGLLRVRKGGREARRGERNEDQGGAQGELEGRAAGRGAGHGGSSEERKGRLARGNGSSAC

SEQ ID NO: 166125 - protein, 160 aa, Heterodera glycines
  Coding regions on vcDNA: vcDNA=SeqID_92548; Strand=+; Position=3-482
PIKLTFCLLITMDAVGTDKFGVAWRSPNSPPHNQYPPTQRWRGPPQQNDPSIADHQPLPRQCAVVPPSLSSPAPFAAVAPKCQFGPTRPPIASEQTPAPYVHYAEPNSEHFANGISSNSHYPLNSEHQFHCKSSPMVPKQSHFDQSHFDQSQLGRQRCVV

SEQ ID NO: 166126 - protein, 193 aa, Heterodera glycines
  Coding regions on vcDNA: vcDNA=SeqID_92549; Strand=+; Position=3-581
SSDQQHQHYQQLPSCSNSGRPSDAAEFFGVAAEQCSLHHELALVAEQHADDEQQHNDMLMMMDGGSGGAQSYDVPSKALFEAVCRTFEERRQFKRLSPSRRSLRQQQQMMALDELARDEAETMTTTLLEEKDVDEQATPMAHDDRTLLVGGGEGRGTTTKEQQQNRNRANTGGSNQSTPTRRRAGTTAHCRDA

SEQ ID NO: 166127 - protein, 165 aa, Heterodera glycines
  Homolog annotation: Hit_ID=NP_497035.2; Match level="QueryCoverage =100%, HitCoverage=10%, E-value=4e-39, Identity=52%"; Hit description= ARF(ADP-Ribosylation Factor related)-Like, Complex locus. ARF(ADP -Ribosylation Factor related)-Like and
  Coding regions on vcDNA: vcDNA=SeqID_92550; Strand=+; Position=3-497
FSISLQNAKESLEISCLPGTSQIRLRATAATCGGCGTVGSSSDDGGTTAFASGGPTGAGEVVLLDIKNEIEEFKKDLKFLQFIQSDDIYNIEQFISTLKVYHPVSETTFREEVAAVVDMFIDADHFNYFFTDRDGTLKSYSCSYVASIQPAYSGVIQAQFARRCA

SEQ ID NO: 166128 - protein, 54 aa, Heterodera glycines
  Homolog annotation: Hit_ID=CAH04312.1; Match level="QueryCoverage =96%, HitCoverage=20%, E-value=3e-11, Identity=65%"; Hit description =S2e ribosomal protein [Meladema coriacea]
  Coding regions on vcDNA: vcDNA=SeqID_92551; Strand=+; Position=2-163
AAFQSGFGGAAPPSARGRGGPLGRGRGATAGRGRGKDADKEWVPVTNLGRLVMD

SEQ ID NO: 166129 - protein, 154 aa, Heterodera glycines
  Homolog annotation: Hit_ID=CAE61905.1; Match level="QueryCoverage =88%, HitCoverage=44%, E-value=8e-37, Identity=56%"; Hit description =Hypothetical protein CBG05897 [Caenorhabditis briggsae]
  Coding regions on vcDNA: vcDNA=SeqID_92552; Strand=+; Position=16-477
MTRHAKNATAASVYTYHERRKDASASGYGTLHERLGKDSMKPFDCCSLSLQPCREPLISPQGFIFEREAILNYILDQKQAYKRKLKIWEQQQRTEKEKQEAVLQREEDQMKAKFASLEAAPVPWKTEVPPATPAGNSRPPKRAAAREDDKSGPN

SEQ ID NO: 166130 - protein, 154 aa, Heterodera glycines
  misc_feature (72)..(72): Xaa can be any naturally occurring amino acid
  Homolog annotation: Hit_ID=CAE71124.1; Match level="QueryCoverage =92%, HitCoverage=74%, E-value=4e-28, Identity=40%"; Hit description =Hypothetical protein CBG17978 [Caenorhabditis briggsae]
  Gene Ontology: Mol. function=ARF small monomeric GTPase activity; Cellular component=cytosol; Biological process=ER to Golgi transport
  Coding regions on vcDNA: vcDNA=SeqID_92553; Strand=+; Position=2-463
SFLHRFRTTVNPPETQSTNIVPTVGYATVELSAAGMLCPAYDMSGEARYTNLWDTLYDNVHGIFFVVYSTYXLRLAVARDELWMLLDHKDLTFKGTPLLILAHKSDLKDAVPATEIHLNLGLNLIMNRSWHIVSTCALTGSGLVEGIDWLANNI

SEQ ID NO: 166131 - protein, 86 aa, Heterodera glycines
  Homolog annotation: Hit_ID=XP_308965.1; Match level="QueryCoverage =95%, HitCoverage=19%, E-value=9e-20, Identity=56%"; Hit description =ENSANGP00000020214 [Anopheles gambiae]
  Gene Ontology: Mol. function=isovaleryl-CoA dehydrogenase activity; Cellular component=mitochondrial matrix
  Coding regions on vcDNA: vcDNA=SeqID_92554; Strand=+; Position=128-385
PLTQKELGPSADEIDRQNEFTKLRDFWGLLGQQWLLRVTVTKDHGSSDAHYLEQCIEMEELTRATASIALIYGVHSNLCVNQIRQG

SEQ ID NO: 166132 - protein, 134 aa, Heterodera glycines
  misc_feature (72)..(72): Xaa can be any naturally occurring amino acid
  misc_feature (81)..(81): Xaa can be any naturally occurring amino acid
  Homolog annotation: Hit_ID=CAE61460.1; Match level="QueryCoverage =97%, HitCoverage=39%, E-value=3e-12, Identity=38%"; Hit description =Hypothetical protein CBG05352 [Caenorhabditis briggsae]
  Coding regions on vcDNA: vcDNA=SeqID_92555; Strand=+; Position=2-407
GRGGGGGGYGGGGGYAGYGDGGGYGAAPNAWGGAPMGQPAAQQWGGYVGTYGTPSGTYGGQQQQAAPMGGQXGGGAAAPVXAQPEQMGWQQQPAGGMASAGGAQWGQQQPVDTNQYAWPSGGAQQPQQWANDPF

SEQ ID NO: 166133 - protein, 174 aa, Heterodera glycines
  Homolog annotation: Hit_ID=NP_949714.1; Match level="QueryCoverage =85%, HitCoverage=81%, E-value=2e-47, Identity=55%"; Hit description =maltose O-acetyltransferase [Rhodopseudomonas palustris CGA009] emb|CAE29819.1| maltose O-acetyltransfera
  Gene Ontology: Mol. function=acetyltransferase activity; Cellular component=membrane
  Coding regions on vcDNA: vcDNA=SeqID_92556; Strand=+; Position=92-613
MSSSSSHLCNASRFGQHSVDDKKPMLQRMLDGELYRCNDPLVQTELEQNEFWLARFNAALSLPVTERNKILRERLGHLGEGSSIRPPFFCDHGEDVFLNYNCCVLDVCRVEIGDKSMVGPAVQIYAADHPRDRAVRDQGWEYGRPVSIGRGVWVGGGAVILPGVTVGDGAIIGA

SEQ ID NO: 166134 - protein, 136 aa, Heterodera glycines
  Homolog annotation: Hit_ID=AAM98324.1; Match level="QueryCoverage =38%, HitCoverage=7%, E-value=4e-11, Identity=61%"; Hit description =At3g14790/T21E2_4 [Arabidopsis thaliana] dbj|BAB02645.1| unnamed protein product [Arabidopsis thaliana] gb|
  Coding regions on vcDNA: vcDNA=SeqID_92557; Strand=+; Position=73-480
MHPDAAHEPAPARPSLAPHSLATPPVPADHTSNGINDADSAIVARALSSSPNAPPGHPASGGDWIDIDAQIGTRLDPPLPSIANVLITGGAGFIASFLVRKLVLLYPEWHIVVVDKLDYCSSLKSLADLESRPNFA

SEQ ID NO: 166135 - protein, 134 aa, Heterodera glycines
  misc_feature (82)..(82): Xaa can be any naturally occurring amino acid
  misc_feature (100)..(100): Xaa can be any naturally occurring amino acid
  Homolog annotation: Hit_ID=NP_501854.1; Match level="QueryCoverage =97%, HitCoverage=14%, E-value=2e-37, Identity=58%"; Hit description =coatomer protein (96.3 kD) (4K919) [Caenorhabditis elegans] emb|CAA93095.1| Hypothetical protein T14G10.5
  Gene Ontology: Cellular component=membrane; Biological process =intracellular protein transport
  Coding regions on vcDNA: vcDNA=SeqID_92558; Strand=+; Position=8-412
NAVPFNETPVNARKCQTILCRLLYLLHTGRPLARPRTHDSFFAITKLWQAKDMTLRMLVYLSIKELCQMSSDVIIVTRNLTXDMSGRDDVYRAPAIRALXRILNDTGMLQGIERYMNHEIVDRTDAVSSAALDS

SEQ ID NO: 166136 - protein, 35 aa, Heterodera glycines
  Coding regions on vcDNA: vcDNA=SeqID_92559; Strand=+; Position=2-106
FVLSAPHHELLAIGENIFCLHFKIVYFCYGMNILN

SEQ ID NO: 166137 - protein, 74 aa, Heterodera glycines
  Coding regions on vcDNA: vcDNA=SeqID_92560; Strand=+; Position=3-224
QAQLHNTSGRSSSNGDSAFARRIQQHFQPGDGAQRLYKMVQQPFRVKFGNGEVEQQRAGSSAIPPLTPFFKDAH

SEQ ID NO: 166138 - protein, 202 aa, Heterodera glycines
  Homolog annotation: Hit_ID=CAE63642.1; Match level="QueryCoverage =47%, HitCoverage=20%, E-value=8e-10, Identity=41%"; Hit description =Hypothetical protein CBG08140 [Caenorhabditis briggsae]
  Coding regions on vcDNA: vcDNA=SeqID_92561; Strand=+; Position=23-628
MATEQQPSDKVLTTTIDAEADDGRDNNPIRDIRRRVHFSDRSQRVLDDSDHLLKSIRTRRAAPLATSMSMSTLPTSLERNGDQSLQDHARKTLIRAQRSVSPEEPLLSASTSRYLQHTPKFPRIDFDDWIEEETQAKKPAWKVLQENVKSSYNKPRATAERHRNLNDFQSAQMDNLEFNRARRRRESADLPFTELTHLDGES

SEQ ID NO: 166139 - protein, 82 aa, Heterodera glycines
  Coding regions on vcDNA: vcDNA=SeqID_92562; Strand=+; Position=3-251
IRQAPFSLQLFLALKYASAMVVSSECCSYSSSGDRPINERTDGKQNSAERGNGGTGCCCCFFCYCCQPPLYSDKICCNNDGK

SEQ ID NO: 166140 - protein, 145 aa, Heterodera glycines
  Coding regions on vcDNA: vcDNA=SeqID_92563; Strand=-; Position=32-469
RTCAIANLADCSARSCCAVGMADDEGDMPPLSWRTKAANLALSEGRPEERAQPNGTPSWADKLGLSRNDWMCSLCSKVVRSKSCNTPGCLARSRQFPIPTLRWRAQWTRRWLKRVGETKFWGPTAPAHRKERGKRPPNTYCLCSR

SEQ ID NO: 166141 - protein, 84 aa, Heterodera glycines
  Coding regions on vcDNA: vcDNA=SeqID_92564; Strand=+; Position=340-591
PLKGFKREAKRDSKWHKIGSCADNPHWFFKTKNGQITKGPLLFYFDSLFLLQVLVCLFQIALIFSWVSKLILFSGPPRGGLVHV

SEQ ID NO: 166142 - protein, 205 aa, Heterodera glycines
  Coding regions on vcDNA: vcDNA=SeqID_92565; Strand=+; Position=1-615
LESNDPLTKFFALYLLQRMCSANTSTRKPFFALSQPGGHPRNWHSLRDVAIAHVRNVRNIFQIATHCKILVHSPGVGSASISKSLADASVFDKSEEVDEDNANKSLVNRNGSLLLNSSTGSTGVLNELYEAKHSFFVPPSLNPRSADAFLSERVHCRRRLIVVPLFCDFIVNRCKELLFAPAPIVSSYDTLCTLYAIKALSKVIS

SEQ ID NO: 166143 - protein, 174 aa, Heterodera glycines
  Homolog annotation: Hit_ID=NP_497829.1; Match level="QueryCoverage =95%, HitCoverage=65%, E-value=5e-43, Identity=51%"; Hit description =protein likely ortholog of mouse Ly1 antibody reactive clone (28.5 kD) (3F252) [Caenorhabditis elegans] e
  Coding regions on vcDNA: vcDNA=SeqID_92566; Strand=+; Position=73-594
MVFFICDQCGETMKKKQVLQHIHRCRNAHYSCMDCQVVFDKNSYQGHTKCITEDQKYGGARHVPKVNKGEQKQDAWVSQVRAAIRQVDEPRLKNLLRSVQCHTNIPRKEAKFVNFLQNSLRIRDRALCVDAWNAIKRAADAEAAKAKRTTAEDAVVTTATEEKETAEHNGDDAD

SEQ ID NO: 166144 - protein, 175 aa, Heterodera glycines
  Coding regions on vcDNA: vcDNA=SeqID_92567; Strand=+; Position=95-619
MTSSRSRTRRTTSTAASTAAAGRSRSRSTHTGRRSASRRATGNRATGRSPSVRNASRRVSSAKKPSRRRRRIVARRATPKKRFKSTKQRGRPRKPQRGRSAQRRVTITQGVLDVPGRGQMTEAELREIFMAGTEAADKRNKMMFWSIIGLLFFKCIHLFPYKFILRQIHPYLYNF

SEQ ID NO: 166145 - protein, 95 aa, Heterodera glycines
  Homolog annotation: Hit_ID=XP_319184.1; Match level="QueryCoverage =77%, HitCoverage=17%, E-value=7e-17, Identity=55%"; Hit description =ENSANGP00000012416 [Anopheles gambiae]
  Gene Ontology: Mol. function=NADH dehydrogenase (ubiquinone) activity; Cellular component=mitochondrial inner membrane; Biological process=energy pathways
  Coding regions on vcDNA: vcDNA=SeqID_92568; Strand=+; Position=187-471
MSSSLSLRAATASSARRATATVVTVTATSRRALATVASTTTAAPAAPAPPRKYGSLKDQDRIFTNLYGFHDFRLQGALKRGDWYKTKEIILKGSD

SEQ ID NO: 166146 - protein, 121 aa, Heterodera glycines
  Coding regions on vcDNA: vcDNA=SeqID_92569; Strand=+; Position=3-368
ALNRPSGHGPRNIRDYKWTGDDPTIIPAEAVLLLIPSLARGPHRDRAKAFAIVRQRLAELGINRDNCADNPAYPGWRKSCGQNGWWLATLSAFVRDILPVLPAMRKALKCRGCEACRAAHV

SEQ ID NO: 166147 - protein, 46 aa, Heterodera glycines
  Coding regions on vcDNA: vcDNA=SeqID_92570; Strand=+; Position=1-141
MAFGFVPLNAFVAITRRNGIVLVRNTTSKYYHPARIHILLVDQNAI

SEQ ID NO: 166148 - protein, 185 aa, Heterodera glycines
  Coding regions on vcDNA: vcDNA=SeqID_92571; Strand=+; Position=1-558
LVFKPNAQMGRPFLPLAFSLVLLLLAVVISTNCANASPIVGEEQPMAPEQKATKGTNDGQMGDDNRTNRRNNMAAAQHQQQNRNATSLVALGWLGLRSGASSVNAVNVASCYDSRLSSFINDGLRYYSIKRVRYSGYWFVHAAMIGGQTQGLQWQSQSNGDIFAQTSRHGCYYHDTQTYIIIIRY

SEQ ID NO: 166149 - protein, 207 aa, Heterodera glycines
  Coding regions on vcDNA: vcDNA=SeqID_92572; Strand=+; Position=7-627
MKSAGATTSSPKNSISAINNDSGAVAAFAAATPPTKIVAAAKPSPPPPSQQQQQQSIRVSSFISSNSSPFNNTNQYTNSNRGTTSSTNTGGGGANAMSTVSNNNTTSTTTVGRDLAATTAATIAAVPANVKDDNRDDSNNNNKSSNIAKPYTNPNSAKSITSCGRDVAATVAAVATVKDDNRRDDSNIAMLTNTCTTGKSTSGSGGD

SEQ ID NO: 166150 - protein, 139 aa, Heterodera glycines
  Homolog annotation: Hit_ID=CAE70919.1; Match level="QueryCoverage =99%, HitCoverage=12%, E-value=4e-29, Identity=46%"; Hit description =Hypothetical protein CBG17718 [Caenorhabditis briggsae]
  Gene Ontology: Mol. function=DNA binding; Cellular component=nucleus; Biological process=protein-nucleus import
  Coding regions on vcDNA: vcDNA=SeqID_92573; Strand=+; Position=2-591
RYMRDAKKTVHFYECNAQGQMVHEKMVKDYSRSAADQDTPLAHELRPLKTLQLTMDYLIFNIAGEIPSTSSNDLARWYDFLWSRTRAIRKDITQQMLNNEMAVDLVEKCARLHIFASFGLVELEADLFDHKMNTGITGT

SEQ ID NO: 166151 - protein, 122 aa, Heterodera glycines
  Coding regions on vcDNA: vcDNA=SeqID_92574; Strand=+; Position=172-537
TTPPKTPKIGGNGRAGQTRSPSRPHYQMKALKAALSHYFSPKKRSPGRPAQRKVQFDDTSSHSEGSDGEEVEEERKSEKWAKCDSNRSDFAAVKCCFEKLDNHLPWKFKRNLNGETFGRHFS

SEQ ID NO: 166152 - protein, 180 aa, Heterodera glycines
  Coding regions on vcDNA: vcDNA=SeqID_92575; Strand=+; Position=71-610
SRKSCKMAKKRLPLSENQQPTPPKRKEMLPLQTWFGTDKQFVTFSVNEDLRWAASSNNPSTSGDAKPNEKQMMPKRDGGSANASQQKAVVESVFCAPSQLQKNLHASVLYLMSLRDNEQQHLLRLLCNHPILLYQKVLEMSGDLQHKGTKKAKKEFVNFSGVICHFPTRYELCQCRIEDS

SEQ ID NO: 166153 - protein, 51 aa, Heterodera glycines
  Coding regions on vcDNA: vcDNA=SeqID_92576; Strand=-; Position=52-207
FSANSWRIMVPTRLLSSKFASDASVVQLSQSSTKSHSLTFYLVCSGRTQVR

SEQ ID NO: 166154 - protein, 204 aa, Heterodera glycines
  Coding regions on vcDNA: vcDNA=SeqID_92577; Strand=+; Position=13-624
HSMSDYDKLKLSPSKLGNLQIRRTQRTKNARVYKKMANGKENWYPLPEDQLPAEVTSFRFIEIKYVDLDVIAFLNRIQRLLQDGEMTLRVRIFHHQRRSLQIFCAQIWPLINKNIVTAVVYPSIWLPPLQQDNAQQHTTLNDLPNLKLLEYCDVSPSQEVIDWLHNSSADGRPKAVRCGLPRQMVDELRARFVAASSPTIFIVL

SEQ ID NO: 166155 - protein, 73 aa, Heterodera glycines
  Coding regions on vcDNA: vcDNA=SeqID_92578; Strand=+; Position=156-374
SSKTLTKELQICFGPSIYTSSYLKQKKQSERRSKALSNNSNTKMETSRNSTNSSLFQWLGLLEDSDQPPDSTP

SEQ ID NO: 166156 - protein, 62 aa, Heterodera glycines
  Homolog annotation: Hit_ID=EAK88176.1; Match level="QueryCoverage =62%, HitCoverage=1%, E-value=5e-09, Identity=66%"; Hit description =signal peptide containing large protein with proline stretches [Cryptosporidium parvum]
  Coding regions on vcDNA: vcDNA=SeqID_92579; Strand=+; Position=7-195
MNLFSLTPLVLCSLLFVGAPVVQSAGKVAPPPPPPPPPPPPPAYEPPEPPSYGAQPPPQPAY

SEQ ID NO: 166157 - protein, 133 aa, Heterodera glycines
  misc_feature (21)..(21): Xaa can be any naturally occurring amino acid
  misc_feature (121)..(121): Xaa can be any naturally occurring amino acid
  Homolog annotation: Hit_ID=AAD27589.1; Match level="QueryCoverage =98%, HitCoverage=21%, E-value=3e-40, Identity=64%"; Hit description =chaperonine protein HSP60 [Onchocerca volvulus]
  Gene Ontology: Mol. function=heat shock protein activity; Cellular component=mitochondrion; Biological process=mitochondrial translocation
  Coding regions on vcDNA: vcDNA=SeqID_92580; Strand=+; Position=32-433
EGLALKDKLKTMVCTLVQDVXNKTDEETGDGTACATVLVRAITKEGFKNISQGANPEEGRKGLMNAMDKLAKELKAMSKTATTPEEIAQVAPIATNGYKTIGKLISDAMKKVGNKGGISVXDGKTLLDALEMD

SEQ ID NO: 166158 - protein, 122 aa, Heterodera glycines
  Homolog annotation: Hit_ID=NP_495986.2; Match level="QueryCoverage =100%, HitCoverage=13%, E-value=2e-41, Identity=70%"; Hit description= MGM mammalian dynamin-like protein, EATing: abnormal pharyngeal pumping EAT-3 (eat-3) [Caenorhabditis el
  Gene Ontology: Mol. function=GTP binding; Cellular component =mitochondrion
  Coding regions on vcDNA: vcDNA=SeqID_92581; Strand=+; Position=1-366
VDLAEKNLSNPHRIKKILDGKLFPMKALGYFGVVTGMDKRDASIAEIRKYEEDFFESSKLFRDGVLKATQMTTRNMSLAVSDCFWRMVRESIEAQAEAFRAHRFHLENGRKTTFAHHPDLTR

SEQ ID NO: 166159 - protein, 163 aa, Heterodera glycines
  Homolog annotation: Hit_ID=CAE73644.1; Match level="QueryCoverage =86%, HitCoverage=30%, E-value=8e-52, Identity=68%"; Hit description =Hypothetical protein CBG21144 [Caenorhabditis briggsae]
  Gene Ontology: Mol. function=MAP kinase activity; Biological process =MAPKKK cascade
  Coding regions on vcDNA: vcDNA=SeqID_92582; Strand=+; Position=2-490
LFPGSSTINQIERIMNSINRPSKQDIESIGSTYAASVLDKMPQRPKRPLDALLAQSFPEAIDLINRLLVFAPHKRLNVEQCLTHPYVVQFHNASEEPSLDYEVKLSLPDHIQLSVHEYREKLYEIISTRKINIRRIQYDKLTSNECEGHQRKQMMTNGSREEN

SEQ ID NO: 166160 - protein, 162 aa, Heterodera glycines
  Homolog annotation: Hit_ID=CAE57385.1; Match level="QueryCoverage =87%, HitCoverage=99%, E-value=3e-14, Identity=34%"; Hit description =Hypothetical protein CBG00333 [Caenorhabditis briggsae]
  Coding regions on vcDNA: vcDNA=SeqID_92583; Strand=+; Position=3-491
MRDFYSLLNCDKSASAEQLKQAYFQQLRKCHPDKNNSLQQLDPFLDLVRAWKVLSDTVARANYDCWLCEQQFRVDKELIFDEIWLNSSAPFPSSPVPVGGDFEEECRCGGIYQVSAEAVEQLALDYLLVDCSNCSLTLRVWRCAASPSPPREEASAISKANA

SEQ ID NO: 166161 - protein, 36 aa, Heterodera glycines
  Coding regions on vcDNA: vcDNA=SeqID_92584; Strand=-; Position=224-334
FFFFFFFFFFFFFFFIKEEFFFSEKVKQSICIRRRE

SEQ ID NO: 166162 - protein, 167 aa, Heterodera glycines
  Coding regions on vcDNA: vcDNA=SeqID_92585; Strand=+; Position=1-501
IKCSMPTAPSIIAHRHHQHNDRIQNGHNANVVVATNGNGNNSSSNGNGCAPISHHRSAAANRALAMPNVDQQAKMAPTSRKKGIIGTRDIVDAKLSEPRCCCGLVQIRHVAIVLGVMEFIFFATQLIVSLVDLFGTADDLWPKSASTLSILLTIISLILAIAAAMLL

SEQ ID NO: 166163 - protein, 203 aa, Heterodera glycines
  Homolog annotation: Hit_ID=CAE61637.1; Match level="QueryCoverage =98%, HitCoverage=91%, E-value=2e-48, Identity=48%"; Hit description =Hypothetical protein CBG05570 [Caenorhabditis briggsae]
  Coding regions on vcDNA: vcDNA=SeqID_92586; Strand=+; Position=21-629
MKMLLGAAAILAFASADFVFGGGNQMEFDPTAPMFPDSQFIDLISRDIESFSGPMAFGHKFMSGGAGEGDQQLGPDGPFEHRQQVKSDSVLPAYCEPPNPCPVGYSEKDGCMEQFDNTAEFSRSYQGQQQCLCDQEHMFNCPSKENAEEYAQGLEQLLSNNGLHKSMIAKKFHLTRAEEPRRRKRSVAFVGPAHATHSRYNPY

SEQ ID NO: 166164 - protein, 121 aa, Heterodera glycines
  misc_feature (24)..(24): Xaa can be any naturally occurring amino acid
  misc_feature (36)..(36): Xaa can be any naturally occurring amino acid
  misc_feature (46)..(46): Xaa can be any naturally occurring amino acid
  misc_feature (50)..(50): Xaa can be any naturally occurring amino acid
  misc_feature (54)..(54): Xaa can be any naturally occurring amino acid
  misc_feature (64)..(64): Xaa can be any naturally occurring amino acid
  misc_feature (78)..(78): Xaa can be any naturally occurring amino acid
  misc_feature (81)..(82): Xaa can be any naturally occurring amino acid
  misc_feature (99)..(99): Xaa can be any naturally occurring amino acid
  misc_feature (109)..(109): Xaa can be any naturally occurring amino acid
  Homolog annotation: Hit_ID=AAN15806.1; Match level="QueryCoverage =81%, HitCoverage=38%, E-value=6e-18, Identity=49%"; Hit description =putative esophageal gland cell secretory protein 26 [Meloidogyne incognita]
  Coding regions on vcDNA: vcDNA=SeqID_92587; Strand=+; Position=22-385
MLFLPLSLLLLLHRPFANALGCMXAVCAAGGPSPSXHAVNRTIRCXSESXCGHXRALRRNDQFXEAVDLSCPEFSVVXAPXXGEISAYRPMGESRAQEXTKGECVPDQXVQIDGRSQWQGL

SEQ ID NO: 166165 - protein, 136 aa, Heterodera glycines
  misc_feature (18)..(18): Xaa can be any naturally occurring amino acid
  misc_feature (27)..(27): Xaa can be any naturally occurring amino acid
  misc_feature (49)..(49): Xaa can be any naturally occurring amino acid
  misc_feature (66)..(66): Xaa can be any naturally occurring amino acid
  misc_feature (121)..(121): Xaa can be any naturally occurring amino acid
  Homolog annotation: Hit_ID=EAA72245.1; Match level="QueryCoverage =100%, HitCoverage=86%, E-value=3e-45, Identity=67%"; Hit description= hypothetical protein FG08655.1 [Gibberella zeae PH-1] ref|XP _388831.1| hypothetical protein FG08655.1 [Gi
  Gene Ontology: Mol. function=translation factor activity, nucleic acid binding; Cellular component=eukaryotic translation initiation factor 4 complex; Biological process=translational initiation
  Coding regions on vcDNA: vcDNA=SeqID_92588; Strand=+; Position=2-409
GRKNRIRGTYENHDQFRXLTFMEDGPXYAQDVNMLDNGRLQALCFDRAXHLANVLRKMHKMVWINXGDLILLSLHDFQNNKGDIIIQYTAYEARTLKYYRELPENAWIDETDSCFRCYDGXAYFEFGDSDSEEESD

SEQ ID NO: 166166 - protein, 107 aa, Heterodera glycines
  Homolog annotation: Hit_ID=XP_395346.1; Match level="QueryCoverage =98%, HitCoverage=33%, E-value=6e-32, Identity=60%"; Hit description =similar to ENSANGP00000013183 [Apis mellifera]
  Gene Ontology: Cellular component=chromatin; Biological process =establishment and/or maintenance of chromatin architecture
  Coding regions on vcDNA: vcDNA=SeqID_92589; Strand=+; Position=2-322
FSDDNVTSMVCAKNFTENSDQINHINYTPDGSLLVTSTADHSITVYDCDSGNKHRSVNRKKYGVDLIHFAHTKTDAIHASTKIDNTIRYLSLYDNKYLRYFGGHSKK

SEQ ID NO: 166167 - protein, 193 aa, Heterodera glycines
  Coding regions on vcDNA: vcDNA=SeqID_92590; Strand=+; Position=3-581
KSLAHRRRSQKVSVSTVLQKPLKVSFSLALTKPDSSSSENCSSDEPSIRKKKRRSRRVKLPVKQVVIPSSVKKETKIQSLPKETTKSQKPKKESQTQPKSQKKSQKEHQQPQKKSQSPQKESQTPHPPPVEGPSVSALVPNTADCKRRVNFGNVEVFRFEFAQGHDTVPAKGGVSLGMQNTHHARHLFQLSEY

SEQ ID NO: 166168 - protein, 194 aa, Heterodera glycines
  Coding regions on vcDNA: vcDNA=SeqID_92591; Strand=-; Position=23-607
DAKNTRKNSFPFIHPTIFLVFCSPKSQPFFSLSHIARLSICCPSILLLKRSAPRAAVAATRSDGASAVSARHHRGHRLRRTARCCSDRRTPVKSRAEAAAVAASSHDHHHHRRRRMTCRRKHQNSRNHRRRCDAYRSHHHRRQCHVPSRAAGGNLLRHTSAAAPPCPSVGADCHATTPCPAADVAAAAVVDVAA

SEQ ID NO: 166169 - protein, 171 aa, Heterodera glycines
  Homolog annotation: Hit_ID=CAE68663.1; Match level="QueryCoverage =39%, HitCoverage=22%, E-value=1e-08, Identity=43%"; Hit description =Hypothetical protein CBG14564 [Caenorhabditis briggsae]
  Coding regions on vcDNA: vcDNA=SeqID_92592; Strand=+; Position=117-629
MIFSINRRIPSLLPPLRRIPPSLFPAPISMLLIPSFPLALLPFAVGLPSAGIRSLPNVSPLSHCFGLSPPRLKRQKSVVLKSVGTEEAEPIVHSGKSIWIGAGKYQFWDSAASLVGRGSYGIVFRGHQCFSSDRPVAIKRMRRMNVRPDELEAMKRVQNQNLVTLLDVCDD

SEQ ID NO: 166170 - protein, 71 aa, Heterodera glycines; identical to SEQ ID NO: 143799
  Homolog annotation: Hit_ID=NP_510124.2; Match level="QueryCoverage =69%, HitCoverage=28%, E-value=4e-15, Identity=83%"; Hit description =regulator of G protein Signaling RGS-2, regulator of G protein (19.6 kD) (rgs-2) [Caenorhabditis elegans]
  Gene Ontology: Mol. function=protein binding; Cellular component =heterotrimeric G-protein complex; Biological process=G-protein coupled receptor protein signaling pathway
  Coding regions on vcDNA: vcDNA=SeqID_92593; Strand=-; Position=100-387

SEQ ID NO: 166171 - protein, 203 aa, Heterodera glycines
  Homolog annotation: Hit_ID=NP_724201.1; Match level="QueryCoverage =98%, HitCoverage=17%, E-value=1e-15, Identity=30%"; Hit description =CG10084-PB, isoform B [Drosophila melanogaster] ref|NP_609976.1| CG10084-PA, isoform A [Drosophila melano
  Coding regions on vcDNA: vcDNA=SeqID_92594; Strand=+; Position=2-610
FSRFGQVTNIQVQYEGRTDSALVTFKTRREAMSAYKSTEPLFNNRFVKVFWQNDANGKEIENEDIGGGNVGEIASTGPTIPLVDSNATNRKTVLKEPIQFPRYFTKVFAQQKKEGGDGSGSAEESMTVTAEPSDDKKSLPTDLATAEHPPPVSVPGITAPQHPVRPIYNSKLATQKKRAAIERDRLNKLAEVQRMKTELYTKL

SEQ ID NO: 166172 - protein, 127 aa, Heterodera glycines
  Coding regions on vcDNA: vcDNA=SeqID_92595; Strand=-; Position=50-433
SGKVTSRGCVGDSRWHPARTPRSPVLRRRSESYPLHPWDSDFAAPLPTSSERRGRPTPSEALVNFDLLLRSGPLSAPANHQGRMRGLKVRIPGSWGVAEAIKESLMKSIMTGKTHIMRCLDEIRNGK

SEQ ID NO: 166173 - protein, 124 aa, Heterodera glycines
  misc_feature (7)..(7): Xaa can be any naturally occurring amino acid
  Coding regions on vcDNA: vcDNA=SeqID_92596; Strand=-; Position=3-374
FFFFFFXIFKNFQLIEKYKSASIFLHHAIPIVRLFVPSFAWHCRQFVEGTLCQVEETVYVSWALTVGRQHVFPPFRCSIPRKICRHWPINLHILMDSLLKKNSHVWCDSRKMRRIKLSIMNFKP

SEQ ID NO: 166174 - protein, 97 aa, Heterodera glycines
  Coding regions on vcDNA: vcDNA=SeqID_92597; Strand=-; Position=84-377
SERHKAVIKKRELSSKAVIRIEKQKRRKRGGGINSYKSTLIRDTVFPGAKNVLEHSLRDVFSTELHNFAFDIGIFRREKRKSLFLLLQSELNAKFPI

SEQ ID NO: 166175 - protein, 124 aa, Heterodera glycines
  Coding regions on vcDNA: vcDNA=SeqID_92598; Strand=+; Position=2-376
SVFFMPTDRPLLLPFFAMYCFNLPAPIRPPISNRSSTKPRPTTLSPSASSVSSLRMAKSIGKCSPRSSLAMHCLFLENAFFRSVINTCLSSDQFLRTYSGWKRPRDSTHTQKIHFILFVHYLCI

SEQ ID NO: 166176 - protein, 90 aa, Heterodera glycines
  misc_feature (7)..(7): Xaa can be any naturally occurring amino acid
  Coding regions on vcDNA: vcDNA=SeqID_92599; Strand=-; Position=2-271
FFFFFFXGNKFIFIKLQRMKNFEGNVIKENDEIEFSRLIIICFWFGMMECCALYVTELQMRKTKKRTQMSRVASAKSIQVPMLTSPLAIV

SEQ ID NO: 166177 - protein, 141 aa, Heterodera glycines
  Homolog annotation: Hit_ID=NP_510271.1; Match level="QueryCoverage =56%, HitCoverage=77%, E-value=4e-15, Identity=43%"; Hit description =putative secreted or extracellular protein precursor (XO197) [Caenorhabditis elegans] emb|CAA94135.1| Hyp
  Coding regions on vcDNA: vcDNA=SeqID_92600; Strand=+; Position=33-458
MPSLRLLPLLLAQLPFCVFGFGFENAGASCSSDEYCPGGWSVLRRPKDYSAHTCNPADPRRAKCPKPYMCVAAKCGISFCCASDKMLDKLKEQQSVEREAKEADDEEREEARRREKASLAEDAEKERETDAIERSAGGDDL

SEQ ID NO: 166178 - protein, 209 aa, Heterodera glycines
  Homolog annotation: Hit_ID=AAL78214.1; Match level="QueryCoverage =90%, HitCoverage=95%, E-value=2e-12, Identity=29%"; Hit description =putative esophageal gland cell protein Hgg-20 [Heterodera glycines]
  Coding regions on vcDNA: vcDNA=SeqID_92601; Strand=+; Position=25-651
MNRRWVCTDVWMDILPFFNRLQLGLKLALLSPRFDVLVDKHFDGKCELTIWRHINILKGAGPEPELSVRIDRKTMKFPLPDRPLPTKIRIKDLHIEYTDHSVITFLRANQQIFDKGIDLDLYWDDALHDNNSDDVQQIWDVFAREIWPIFAPNIRHLNFIFGYDLENLRRHISPTILSDLNINSIHSADLLPEMIADDGPNATAGQALS

SEQ ID NO: 166179 - protein, 111 aa, Heterodera glycines
  Coding regions on vcDNA: vcDNA=SeqID_92602; Strand=+; Position=3-338
HVEMCSAIDFVRARESHFLSSVQSGRNGHLHGELGRAPPNLGLTLRIGHSLLISDHILYLVRYCFNIRSISFPFFSFLPQKFGPFRQIIFNSRQMLAFSAFWSFFPSPTLS

SEQ ID NO: 166180 - protein, 122 aa, Heterodera glycines
  Homolog annotation: Hit_ID=NP_498012.1; Match level="QueryCoverage =100%, HitCoverage=46%, E-value=4e-34, Identity=51%"; Hit description= i-31 protein (30.9 kD) (3F950) [Caenorhabditis elegans] gb|AAA62566.1| Hypothetical protein C35D10.10 [C
  Coding regions on vcDNA: vcDNA=SeqID_92603; Strand=+; Position=1-369
DKSVIWVIEFFTTWSPDCRYVAPVFSALSERYSLPNLRFGKLDVGKHPKEGDHFRVNGHASSKQLPTVALFRNGVQTERRPLVQQRRAVPFIFNEKNLILALGLNDIYAECKKTERTRRKNE

SEQ ID NO: 166181 - protein, 73 aa, Heterodera glycines
  misc_feature (9)..(9): Xaa can be any naturally occurring amino acid
  Coding regions on vcDNA: vcDNA=SeqID_92604; Strand=-; Position=64-285
FFFFFFFFXNCYFNDKSTFFNGLINTRKCFCHKLLLSSTLTRTISTRPKLAPPHLLRARPNFQSEHWHLNGRR

SEQ ID NO: 166182 - protein, 175 aa, Heterodera glycines
  Coding regions on vcDNA: vcDNA=SeqID_92605; Strand=+; Position=148-672
MKAYNDNMERYIELAIQDAELRETSNEGQSNYEEQKKRTDGTRKLLEFYRKERDMFTEGLEKASVNVEEFKFPTENVEQIFDGLFALEITGKQMKANYETTKEAQREHQKQSNAEAMRAQNLVKAKPTKCQSAYNQKAIQCYLDEMTEKGQQQLGQGWKADGSAEASSNVDMTDG

SEQ ID NO: 166183 - protein, 160 aa, Heterodera glycines
  Coding regions on vcDNA: vcDNA=SeqID_92606; Strand=+; Position=3-485
LDNGPLLSEALLNFLFSSFDSSNVAKLNLMKMCAEVLLRMIVAPDRRNLSVILSSIKSSGSEFRPFELLHSFTTGSNLDSDLYLAMLKIIKELCKREPALKSQWSNLENVQFLSSNSMMSSNSEIVNLCSEVLEMLQMGGEDQFHDASLFDIFMNEYTGK

SEQ ID NO: 166184 - protein, 110 aa, Heterodera glycines
  Homolog annotation: Hit_ID=NP_999712.1; Match level="QueryCoverage =90%, HitCoverage=73%, E-value=2e-35, Identity=75%"; Hit description =histone H3 [Strongylocentrotus purpuratus] emb|CAA27582.1| unnamed protein product [Strongylocentrotus pu
  Gene Ontology: Mol. function=DNA binding; Cellular component =nucleosome; Biological process=embryogenesis and morphogenesis
  Coding regions on vcDNA: vcDNA=SeqID_92607; Strand=+; Position=66-398
MARRSNATGTRKPHRYRPGTVARREIRRYQSTTELLLRKLPFNRLVREIAQDNNLEMRFQAVAFAALQEASEAYLVRLLENTNLAAANANRVTIMPSDIQMSRHIRGETL

SEQ ID NO: 166185 - protein, 194 aa, Heterodera glycines
  Coding regions on vcDNA: vcDNA=SeqID_92608; Strand=+; Position=1-585
CFTNKLFIMKRPSSVVAFGSHLFVGFILLSLFIGTLGTEKKETKPAAAHSPADAKHPPPVAAHAAAGAGHASDPKHASPSPAGAAAAASHAHPPNGGAAHAAEQLISLLIFVLFQPKHAAAPAIKITDEANNVYSVCVERDVLPAPENASKDKLKAIAAKCDECGAAKCKAKCGGKEVNDACRTCIMQNCPPAK

SEQ ID NO: 166186 - protein, 197 aa, Heterodera glycines
  Homolog annotation: Hit_ID=AAB37623.1; Match level="QueryCoverage =80%, HitCoverage=25%, E-value=3e-26, Identity=36%"; Hit description =Hypothetical protein C43E11.8 [Caenorhabditis elegans] ref|NP _491337.1| exocyst component (1E812) [Caenorh
  Coding regions on vcDNA: vcDNA=SeqID_92609; Strand=+; Position=53-643
MTSSAAKIGGGGGASVEELNQLLSKDEEWLSSFQGILEKSATLTGSVCSLMDNFQERIDSLSTNVQTLVAKSSVIQKEQQNIRKLLSTVDATIQFHGKTTVLENTIRDGGNVLLNIDDYLEKMRNLKEAIAFFATHPVYRNHEHIKQIYEIGCANIESEFGNLVRTSCVPVDPTKVFEYLGDDYEMPSFRLSSFVTL

SEQ ID NO: 166187 - protein, 209 aa, Heterodera glycines
  misc_feature (53)..(54): Xaa can be any naturally occurring amino acid
  misc_feature (57)..(57): Xaa can be any naturally occurring amino acid
  misc_feature (60)..(60): Xaa can be any naturally occurring amino acid
  misc_feature (96)..(99): Xaa can be any naturally occurring amino acid
  misc_feature (114)..(116): Xaa can be any naturally occurring amino acid
  misc_feature (118)..(119): Xaa can be any naturally occurring amino acid
  misc_feature (121)..(122): Xaa can be any naturally occurring amino acid
  misc_feature (124)..(125): Xaa can be any naturally occurring amino acid
  misc_feature (127)..(128): Xaa can be any naturally occurring amino acid
  misc_feature (130)..(140): Xaa can be any naturally occurring amino acid
  misc_feature (142)..(157): Xaa can be any naturally occurring amino acid
  misc_feature (159)..(159): Xaa can be any naturally occurring amino acid
  misc_feature (161)..(165): Xaa can be any naturally occurring amino acid
  misc_feature (168)..(168): Xaa can be any naturally occurring amino acid
  misc_feature (170)..(188): Xaa can be any naturally occurring amino acid
  misc_feature (190)..(209): Xaa can be any naturally occurring amino acid
  Coding regions on vcDNA: vcDNA=SeqID_92610; Strand=+; Position=2-628
SLICRQIMRLNVLLAILAPLLLLIATATLCGATGKEAAANKIGVAAVALSEAXXNSXGRXRRHRRSALRRGGQRMTKKKDDYRLERSRDEIRQKRXXXXNGKAENRGGKKNGDXXXEXXVXXRXXAXXGXXXXXXXXXXXEXXXXXXXXXXXXXXXXKXKXXXXXEKXKXXXXXXXXXXXXXXXXXXXQXXXXXXXXXXXXXXXXXXXX

SEQ ID NO: 166188 - protein, 161 aa, Heterodera glycines
  Homolog annotation: Hit_ID=AAK70645.1; Match level="QueryCoverage =89%, HitCoverage=31%, E-value=3e-23, Identity=42%"; Hit description =Protein with tau-like repeats protein 1, isoform a [Caenorhabditis elegans] ref|NP_497253.2| protein with
  Coding regions on vcDNA: vcDNA=SeqID_92611; Strand=+; Position=2-484
WDAQKPKGRSPRTPSVPPANNQYAHVKSKVRSITEYTPAPTLVKIFHESVRVTASPKVGSLQNVSHVHTGENVAIQNRKLNFREAVNPRVDEKSEVPIPKSEKNSATQKLEWKGQPRVRSMDNVKHSPARSYHKIFHQSVRMKCESKVGSLDTSDTCPGGA

SEQ ID NO: 166189 - protein, 79 aa, Heterodera glycines
  Coding regions on vcDNA: vcDNA=SeqID_92612; Strand=+; Position=1-240
AAGGGLRQRQAGGAANTGRTSNCWRRRGRRNEQQLTVALLYCRTLPGCKIGPVPVLVMSLEFIGSVFFFYIWGKCIPTH

SEQ ID NO: 166190 - protein, 83 aa, Heterodera glycines
  Homolog annotation: Hit_ID=NP_490812.1; Match level="QueryCoverage =100%, HitCoverage=79%, E-value=1e-18, Identity=51%"; Hit description= glutaredoxin (11.3 kD) (1B523) [Caenorhabditis elegans] gb|AAK29881.1| Hypothetical protein Y34D9A.6 [Ca
  Coding regions on vcDNA: vcDNA=SeqID_92613; Strand=+; Position=2-250
AFVNGLLKTKPVVIVSKEHCPFCVKAKDAINSLKLKPGALEIVQLNHRNDCAQTAFCLMELTGARSVPLMLIGGTFFGGGDDT

SEQ ID NO: 166191 - protein, 73 aa, Heterodera glycines
  Homolog annotation: Hit_ID=CAB88203.1; Match level="QueryCoverage =100%, HitCoverage=24%, E-value=3e-24, Identity=75%"; Hit description= putative cuticular collagen [Globodera pallida]
  Coding regions on vcDNA: vcDNA=SeqID_92614; Strand=+; Position=2-220
IASVCSLLAIIAAVVALPSLYSEMSQMNSKVRDGVEAFLVNTYSAWTDLMDVKVVVTPPANPRDNPFYYFFRA

SEQ ID NO: 166192 - protein, 191 aa, Heterodera glycines
  Homolog annotation: Hit_ID=EAK85900.1; Match level="QueryCoverage =97%, HitCoverage=96%, E-value=6e-64, Identity=65%"; Hit description =hypothetical protein UM05040.1 [Ustilago maydis 521] ref|XP _402655.1| hypothetical protein UM05040.1 [Usti
  Gene Ontology: Mol. function=structural constituent of ribosome; Cellular component=eukaryotic 48S initiation complex; Biological process=protein biosynthesis
  Coding regions on vcDNA: vcDNA=SeqID_92615; Strand=+; Position=42-614
MSAANKIIKAAGVKADELEMQVAQAIFDLENNVAELKADLRAVQISAAKEVDVGKGRKAIVIFVPVPQLKQFHKIQQRLVRELEKKFSDRHVLVVAQRRVMPRPTRHSRQKQQRPRSRTLTAVHEAILDDLVYPTEIVGKRTKLRVDGSKTTKVFLDKKDATYLEYKLDTFSAVYKKLTGKDVHFEFPQYQ

SEQ ID NO: 166193 - protein, 200 aa, Heterodera glycines
  Homolog annotation: Hit_ID=NP_494861.1; Match level="QueryCoverage =99%, HitCoverage=13%, E-value=7e-19, Identity=29%"; Hit description =contactin (2F90) [Caenorhabditis elegans] gb|AAK31482.1| Hypothetical protein C33F10.5b [Caenorhabditis e
  Coding regions on vcDNA: vcDNA=SeqID_92616; Strand=+; Position=2-601
HQCPRGWPAAGDQCVQLQFVPTRREHAEDKCESMGAQLVDVTDGEGELNEAMVEDLSELLQESLEAGVNELIWVVGAGKWRSEWDESGERVRFSRREAQQQRQEGEEEEGMENVLALQNVLLHPPSVHPFICQLWPLWRRLLLYEQSLLPKGAPLLEEQPRPSYFFDPNSSASNSSFLSLPCSASGVPSPTVRWFRNGGE

SEQ ID NO: 166194 - protein, 192 aa, Heterodera glycines
  Homolog annotation: Hit_ID=NP_739264.1; Match level="QueryCoverage =73%, HitCoverage=19%, E-value=2e-09, Identity=32%"; Hit description =hypothetical protein CE2654 [Corynebacterium efficiens YS-314] dbj|BAC19464.1| hypothetical protein [Cory
  Coding regions on vcDNA: vcDNA=SeqID_92617; Strand=+; Position=41-616
MYPGHHPASVRSATLGRPPGTGPRLMDENGLDDTDHSSSSSYSNATAMAPPMSAVKRMAAGTPVPGTPSLHRGLFKKPGHLTAATPSKPHVASATPRQASQTPGSVKPQPSAAKLTGGAPARRLLFPSGTTAVPGTPAAGSSHASFATTPSARHLQMQTPRGPGPASAKPTPARSMYAAATPAAALSTSMSS

SEQ ID NO: 166195 - protein, 163 aa, Heterodera glycines
  Homolog annotation: Hit_ID=NP_498134.1; Match level="QueryCoverage =100%, HitCoverage=35%, E-value=3e-15, Identity=30%"; Hit description= putative nuclear protein, with a coiled coil domain, of bilaterial origin (52.8 kD) (3G399) [Caenorhabdi
  Coding regions on vcDNA: vcDNA=SeqID_92618; Strand=+; Position=3-494
EREGRAKRSSRSSSRTERHRRRRSSAGSSRRRRSRDRSRETTTTTDRARKNGSASSMMAPPTATQSKVVPSKKLTAEELEERRRAMLTNASWRDDMRERNLRDAADKLRKEQDEMANNRGGAGFMRPMMNTATEDASIEKRLQSNRMNIQRQHDHMDKSFVRK

SEQ ID NO: 166196 - protein, 101 aa, Heterodera glycines
  Coding regions on vcDNA: vcDNA=SeqID_92619; Strand=+; Position=81-383
MSSPSDSKFACSTNKSSVGIPPAAIRSFLFASVLRPFASILIYCYHLPSPLLLPCFSHIHRYPVFVPFSHFFHPFSQKLFRITIIFIDLYPVNFNKISFLF

SEQ ID NO: 166197 - protein, 126 aa, Heterodera glycines
  Homolog annotation: Hit_ID=NP_733106.2; Match level="QueryCoverage =92%, HitCoverage=73%, E-value=2e-13, Identity=37%"; Hit description =CG31439-PA [Drosophila melanogaster] gb|AAN14054.2| CG31439-PA [Drosophila melanogaster]
  Gene Ontology: Mol. function=extracellular matrix structural constituent; Cellular component=cell wall (sensu Fungi)
  Coding regions on vcDNA: vcDNA=SeqID_92620; Strand=+; Position=213-590
MSWRHIHLWRPRPMAPTPAVLPMRSRTFSSTSCALSTSTTGRATPHPTSSKTASLLTASFTTTTTTTITTTKPTTQTTTAQSHSTKCRPPCLPCSPRPSPTRPTAAAPPPKNCHPTTTTTMTTTTT

SEQ ID NO: 166198 - protein, 60 aa, Heterodera glycines
  Homolog annotation: Hit_ID=NP_498113.1; Match level="QueryCoverage =98%, HitCoverage=23%, E-value=1e-12, Identity=52%"; Hit description =ring finger protein (3G325) [Caenorhabditis elegans] gb|AAK95873.1| Hypothetical protein C34E10.11 [Caeno
  Coding regions on vcDNA: vcDNA=SeqID_92621; Strand=+; Position=2-181
RCISRKLPNPGKPPILPPAKTKLYTVTQFKWGNPDDIADLLWRRHIYNSAFLSMRRLFRG

SEQ ID NO: 166199 - protein, 177 aa, Heterodera glycines
  Homolog annotation: Hit_ID=CAE69489.1; Match level="QueryCoverage =45%, HitCoverage=19%, E-value=3e-16, Identity=48%"; Hit description =Hypothetical protein CBG15694 [Caenorhabditis briggsae]
  Gene Ontology: Mol. function=RNA binding; Cellular component =cytoplasm; Biological process=mRNA metabolism
  Coding regions on vcDNA: vcDNA=SeqID_92622; Strand=+; Position=16-546
DCANGVYCLSLCINYCFFALHLLANCLSSILHLQMPNSTVKNVALMNGTSPAPSAALPRFNHPTPSASFSFPKGSFFSSASASVESPMTATKNHRPTEPLATAFLGASSSSSNGTIEHAENGGNGHQPMTVILTVRMLMQGKEVGSIICKRGDYVRQIREQSGAKVNISDGSCPERL

SEQ ID NO: 166200 - protein, 90 aa, Heterodera glycines
  misc_feature (13)..(13): Xaa can be any naturally occurring amino acid
  misc_feature (22)..(22): Xaa can be any naturally occurring amino acid
  misc_feature (30)..(30): Xaa can be any naturally occurring amino acid
  misc_feature (46)..(46): Xaa can be any naturally occurring amino acid
  misc_feature (53)..(53): Xaa can be any naturally occurring amino acid
  Coding regions on vcDNA: vcDNA=SeqID_92623; Strand=-; Position=23-295
PIGTAVPARCIRXVGIRKHCQXSPRRHRPXQAHQRHRGHRHRHRRXFSALNAXRHINFVFLQMNGRKNNGHQNEQKKDHWVRWIHIAKRE

SEQ ID NO: 166201 - protein, 148 aa, Heterodera glycines
  Coding regions on vcDNA: vcDNA=SeqID_92624; Strand=+; Position=24-470
MNSLKSASFAILATLLTFFTLIHASPVPTPQDPTTRNRPGPSGLPPPSPTAFVRYLGDGTALIENLGYYYTQVLQQCRGLQGTLPIENVDINTRYLDGRPAYALQFFGDWGCRGPVIAQTTGFTGNGEPLRGNNGQVIVPKSARFVPA

SEQ ID NO: 166202 - protein, 161 aa, Heterodera glycines
  Coding regions on vcDNA: vcDNA=SeqID_92625; Strand=+; Position=7-492
GINITFVAMLPSNLFFLLMTMLSSSLLHQTLANKFSAETDAVNPTRLIQRRHLIRSRAIHKEKMHSNVNEGYLQWEKDKFHEALGEKCGKKSNWEQRDFGILRILPKSSRSLMDPKFLGSVEPRLLKTSADGTRTKSDSEEENWRNWLRRHFPAARTISDQ

SEQ ID NO: 166203 - protein, 185 aa, Heterodera glycines
  Homolog annotation: Hit_ID=AAC46513.1; Match level="QueryCoverage =82%, HitCoverage=40%, E-value=3e-47, Identity=62%"; Hit description =cAMP-dependent protein kinase catalytic subunit
  Gene Ontology: Mol. function=cAMP-dependent protein kinase, intrinsic catalyst activity; Cellular component=cytoplasm; Biological process =protein amino acid phosphorylation
  Coding regions on vcDNA: vcDNA=SeqID_92626; Strand=+; Position=2-556
KIMGTKIEENSSKSVSEDDTSAEEEDEENIENFRPNGTTNRKRAHRNPTSDSAQFRNLLDKAKEDFKQKWEKARNISSSSTANASLIDFERIRMIGTGSFGQVLLVKHRRTGKYYAMKMLEKQKVLKLKQVEHTISEKRILQATEFPFLVKMHYSFKDTANLYMVLEFVSGGEMFSHLRRIGRFS

SEQ ID NO: 166204 - protein, 204 aa, Heterodera glycines
  Homolog annotation: Hit_ID=NP_492680.1; Match level="QueryCoverage =45%, HitCoverage=7%, E-value=1e-15, Identity=46%"; Hit description =isoleucyl tRNA Synthetase (irs-2) [Caenorhabditis elegans] pir||T19442 hypothetical protein C25A1.7a - Cae
  Gene Ontology: Cellular component=mitochondrion; Biological process =tRNA modification
  Coding regions on vcDNA: vcDNA=SeqID_92627; Strand=+; Position=1-612
SAILLPITKFPVLLKGIGRTKLDQQLASLGEFESFYKWQSQQMQSLDNGYTKSFTLLDGPPYANGEPHVGHAINKILKDFILRSRVQLGHLVRMKSSTSDPSKSPQKIVAEAVKEMELYFNALNNALIKHLSLNINLKAYEDLSVTLDNGETHRLVKFARISLKTPKGPIVLNFADNPAAIKPARIAIQNMAENVTPQVDGIVI

SEQ ID NO: 166205 - protein, 198 aa, Heterodera glycines
  Homolog annotation: Hit_ID=AAB20405.1; Match level="QueryCoverage =98%, HitCoverage=51%, E-value=2e-31, Identity=38%"; Hit description =squamous cell carcinoma antigen; SCC antigen [Homo sapiens]
  Gene Ontology: Mol. function=serine protease inhibitor activity; Cellular component=cytoplasm; Biological process=regulation of proteolysis and peptidolysis
  Coding regions on vcDNA: vcDNA=SeqID_92628; Strand=+; Position=3-596
QFETVDFLDGKGTAEKINKFVKEATHKKIRDLVTPDNFDGNTRLVLINALYFKGTWADKFDSKFTKKAKFHVDAKNFKELEMMHLTANFIYFEDTQLQLLGMPYKGKKEFMFVLLPKKRFGLTELLAQLDGKKLMKLIKKRDIETVKVVLPKFKLEATHGLNKPLTNMGMPTAFTDNANFEGISGKKTLLLSEVVQKA

SEQ ID NO: 166206 - protein, 164 aa, Heterodera glycines
  Coding regions on vcDNA: vcDNA=SeqID_92629; Strand=+; Position=3-494
LISPLGVTRGFLDAAKTKVGAAQGITNAAIQAGSDGINLGLDAVQGVEAVKSNALRGVVNITRNLGTEVITQTRNIANHLPSALGIRGVANLGLSGAQGALDLGANAATGVFTGAQALVNGTLEGGRTVSTGVSNAAQTGVNFAGNVVGGVIGAKSNAIGAAQN

SEQ ID NO: 166207 - protein, 62 aa, Heterodera glycines
  Coding regions on vcDNA: vcDNA=SeqID_92630; Strand=+; Position=13-198
MIGSKFIGNKAGMSSIDKEQVARIIAENTSANFEGYEKKRASRIDEQIKRNRQRLDSLTEQQ

SEQ ID NO: 166208 - protein, 214 aa, Heterodera glycines
  Homolog annotation: Hit_ID=CAE68638.1; Match level="QueryCoverage =97%, HitCoverage=28%, E-value=5e-60, Identity=53%"; Hit description =Hypothetical protein CBG14528 [Caenorhabditis briggsae]
  Gene Ontology: Mol. function=carboxylesterase activity; Cellular component=endoplasmic reticulum; Biological process=acyl-CoA metabolism
  Coding regions on vcDNA: vcDNA=SeqID_92631; Strand=+; Position=3-644
LFSFLFFIAQLIFTDCQFPEPTRSVDLWDSFGTSTANSFGSDESRGNVLVRLSVGEVVGLRVTIPNLPWTPWQDPNEQIPADRTHSELNPLPGNNNVSVFAFLGMPYAEPPIGERRFRAPQQLIHLPGPSPFLANTLPSACAQDIEAHPSLFVNDPFPYSVSEDCLHLNIFTPSVKSFSSSVSNSLPVLVFFHGGNFQTGTANDWPGHVLASRG

SEQ ID NO: 166209 - protein, 156 aa, Heterodera glycines
  Homolog annotation: Hit_ID=AAH85708.1; Match level="QueryCoverage =98%, HitCoverage=68%, E-value=1e-56, Identity=68%"; Hit description =Preimplantation protein 3 [Rattus norvegicus] gb|AAH37499.1| Preimplantation protein 3 [Mus musculus] ref|
  Coding regions on vcDNA: vcDNA=SeqID_92632; Strand=+; Position=2-469
NFRNCPGTTRAEWNKWGELAFDEMDGTFAVQQWIQQCIGRDAHGLDLILDCPAGVDEGVWKYEQLRQFCLELIFLFVLLQEQCHPESCTQMTATEQWIFLCAAHKNPKECSAIDYTRHTLDWAASLLNSNRYFPSRATIKESFIAQIGSVCRRLCR

SEQ ID NO: 166210 - protein, 178 aa, Heterodera glycines
  Coding regions on vcDNA: vcDNA=SeqID_92633; Strand=+; Position=1-534
PNYFFSLSFVLIISVFLLFTPKAMVATRPFRFDRPAPQPQRVHPVSLIQMVTAAKIVDEQQRAKERTQTPLVYRMDPQLLIRFVTFNKIAQKQAAAKYLATKKRREKDEQRMREFVRRAVTPPDFGQMDADAMVKLSDFMPVLNLEFFLSAISECFFHLFRPCRPNLTALFATKRSLF

SEQ ID NO: 166211 - protein, 205 aa, Heterodera glycines
  Homolog annotation: Hit_ID=CAF90121.1; Match level="QueryCoverage =58%, HitCoverage=35%, E-value=9e-14, Identity=37%"; Hit description =unnamed protein product [Tetraodon nigroviridis]
  Gene Ontology: Mol. function=UDP-galactose beta-N-acetylglucosamine beta-13-galactosyltransferase activity; Cellular component=Golgi membrane; Biological process=oligosaccharide biosynthesis
  Coding regions on vcDNA: vcDNA=SeqID_92634; Strand=+; Position=20-634
MVISYIWQMFALLIPMAHIVNSGQISYNFQIHFRHFGLDAWAQFEKPCANGTKLLILTMSRREGFDSRKGIRTWMKDAVAAEELRFLIADPGKNEADDVQQQLVNEQKEHGDLVLMHGFVDVYAHLHIKMYSGFVWQQRHCAGTEWVLKVDDDIAVHVRRMVEWTEIKFGKMATEHPLIYFGVPADRGLSRDKNSKWYVPYEMFP

SEQ ID NO: 166212 - protein, 181 aa, Heterodera glycines
  Coding regions on vcDNA: vcDNA=SeqID_92635; Strand=+; Position=101-643
FAKMAKITQIKNGEERRIESITRRKNELDERRRLINKSLTGELKINKQTRFADSDEEEPTQNSKPFSFLASIGRIYPEQNEKSKNTNVVDDSAEQFLEKTRLTNETEKSAPKLKNISLYKPPNGDGDIRQCFFVNEHTPEIRSSFSSFRRHQKEETLRKEWDKKRAPIVKFYKKERKSALR

SEQ ID NO: 166213 - protein, 175 aa, Heterodera glycines
  Homolog annotation: Hit_ID=XP_464070.1; Match level="QueryCoverage =61%, HitCoverage=24%, E-value=5e-12, Identity=41%"; Hit description =putative extensin precursor [Oryza sativa (japonica cultivar-group)] dbj|BAD10529.1| putative extensin pr
  Gene Ontology: Biological process=cholesterol catabolism
  Coding regions on vcDNA: vcDNA=SeqID_92636; Strand=+; Position=1-525
PSPPTPPNGTTPSAPTPSNGTTPSAPAPPNGSTPSPPTPPNGTTPSPLIPPNGTTPSLPQQPPPVAAAPSPSPPVGNVLPLLANGQYAVGCADIMLSEPSAASSSSAGGVGLFARLFYPAASSVVLADPSTSSATTASAFMRWRPDSEYMVGVANYQGVSMFKKNLFLDWGVGDK

SEQ ID NO: 166214 - protein, 181 aa, Heterodera glycines
  Homolog annotation: Hit_ID=NP_001003013.1; Match level="QueryCoverage= 98%, HitCoverage=79%, E-value=1e-38, Identity=44%"; Hit description =acidic (leucine-rich) nuclear phosphoprotein 32 family, member A [Canis familiaris] gb|AAN85118.1| inh
  Gene Ontology: Cellular component=nucleus
  Coding regions on vcDNA: vcDNA=SeqID_92637; Strand=+; Position=2-544
EERIKTELRGIQPSEDQDLLLDSCKANTISGLTEQFTSLTTLSLINVGLTTLDGLPKLQTLGTIDLPDHKLSGGLDKLDECCPRLYHVNLCADKITSMAAHAPVSKLEELAALDLFDCAITEGEEYRSIVFAMMPQLKYLDGFDRNDVEADISDEEEEEGADDALEDEHHSHEQDEGVDTD

SEQ ID NO: 166215 - protein, 71 aa, Heterodera glycines
  Coding regions on vcDNA: vcDNA=SeqID_92638; Strand=-; Position=2-214
FIFLAIFNGRLGLLSIFCTASSVASTPISVSPCLFISSPAIIFISSFMLASLSSLFFLAILAILSSCAFFF

SEQ ID NO: 166216 - protein, 186 aa, Heterodera glycines
  Coding regions on vcDNA: vcDNA=SeqID_92639; Strand=+; Position=82-639
MQSVQSSATAAVTAASTVPLSIQNEILWIKQDALQVRNAVILLEQEKDSLRKAIRILKLENGRLKTKVKTLNEKVAKISNEEMDDEEGKLAPESELDYDELNRGDFYLIGGVHDPISLRFEAAIRDQNAVEHKSAERYYWYKMAEFFGDEEAMKSILHAQNVQQAEEAMKNIKGFDVAEWDKVKLK

SEQ ID NO: 166217 - protein, 131 aa, Heterodera glycines
  misc_feature (104)..(104): Xaa can be any naturally occurring amino acid
  misc_feature (117)..(117): Xaa can be any naturally occurring amino acid
  Homolog annotation: Hit_ID=XP_317352.1; Match level="QueryCoverage =94%, HitCoverage=15%, E-value=6e-24, Identity=50%"; Hit description =ENSANGP00000010476 [Anopheles gambiae]
  Gene Ontology: Biological process=induction of apoptosis by intracellular signals
  Coding regions on vcDNA: vcDNA=SeqID_92640; Strand=+; Position=234-626
MQTRDRPDHTTSMVMIRVHLRRMLDHAYVAQAAVEPVHPLGWRIFREEIVDYPDINEHLKATLLGMISLELKNEIIQWIDLKNVCQMLIALGLDNRAYYEHQFXRPYPPMKLPNFYXLQVKKFLAENSACV

SEQ ID NO: 166218 - protein, 155 aa, Heterodera glycines
  Homolog annotation: Hit_ID=AAH67990.1; Match level="QueryCoverage =100%, HitCoverage=28%, E-value=1e-68, Identity=80%"; Hit description= Hypothetical protein MGC69446 [Xenopus tropicalis] ref|NP _001001215.1| hypothetical protein MGC69446 [Xen
  Gene Ontology: Mol. function=Pol II transcription elongation factor activity; Cellular component=DNA-directed RNA polymerase II, holoenzyme; Biological process=establishment and/or maintenance of chromatin architecture
  Coding regions on vcDNA: vcDNA=SeqID_92641; Strand=+; Position=1-465
KQLGVKCRDVRTREVGIQEIHEKVRPYQVELVRRDYSANGGWETFLSYEDPDQDILIGMLRLRKCTEKVHRTELKGGVSVVRELHVYGTAVPVASRDPTKFQHQGFGQLMEEAERIALTEHLSMKISVISGVGTRHYYRKLGYELDGPYMSKMLD

SEQ ID NO: 166219 - protein, 158 aa, Heterodera glycines
  Homolog annotation: Hit_ID=NP_852135.1; Match level="QueryCoverage =75%, HitCoverage=29%, E-value=2e-15, Identity=35%"; Hit description =RIKEN cDNA 2610020N02 gene [Mus musculus] gb|AAH67062.1| RIKEN cDNA 2610020N02 gene [Mus musculus] dbj|BA
  Coding regions on vcDNA: vcDNA=SeqID_92642; Strand=+; Position=3-571
GVYYRDDYDYLRHLKEPIVEREVIGADEQTTSKQFNSCIFETHGVELRMGMLNRAAPSNELLPDFDPDIVAALDGEIENLGADDDDELDDDFVAKANAPGGKDDGKLFDYRNENRGKDEILQRFGLRNVREKFSGESSADEEDEEMASSVTQSEVDER

SEQ ID NO: 166220 - protein, 58 aa, Heterodera glycines
  Coding regions on vcDNA: vcDNA=SeqID_92643; Strand=+; Position=3-179
TLSSKKKKKRGRKKKASSIDSTLNYNFTDTIFFIYHPQDFHFIPIVFPHATPNSKYVH

SEQ ID NO: 166221 - protein, 30 aa, Heterodera glycines
  Coding regions on vcDNA: vcDNA=SeqID_92644; Strand=+; Position=1-93
ILLAVTIIYQYFEIFVKEQQEMGGVAGLFF

SEQ ID NO: 166222 - protein, 115 aa, Heterodera glycines
  Homolog annotation: Hit_ID=XP_472518.1; Match level="QueryCoverage =98%, HitCoverage=18%, E-value=9e-12, Identity=37%"; Hit description =OSJNBa0011E07.13 [Oryza sativa (japonica cultivar-group)] emb|CAE04204.2| OSJNBa0011E07.13 [Oryza sativa
  Gene Ontology: Cellular component=secretory vesicle; Biological process=cell proliferation
  Coding regions on vcDNA: vcDNA=SeqID_92645; Strand=+; Position=288-632
SSRTSSSSLPSSPSRPPPPWPTTPPTAPSLPLPPAPTTATAPAATLPKKPSKPRPHPRRLALLPTAVTAHPRPATTRLLPAALRPSQARSRPPTTPTRRPVPPTSTSVSRKPRAT

SEQ ID NO: 166223 - protein, 182 aa, Heterodera glycines
  Coding regions on vcDNA: vcDNA=SeqID_92646; Strand=+; Position=59-604
PFLMVELSAVCFVYKSFIRHLLITRLCATLTMENPDANSSTIHQLNGVGLGGQNGRHRSSDWRYKIRNQTAEREGRDGVNSSVGFSAARRHIRPEDILWWLCLLLTFRCFDLPAVLVSHCRIDRQFLRLAFVCAFCLPFLSVAYAFVNLTYRSTVPFSLLRIFQFLSIFCLICASIFFCLAT

SEQ ID NO: 166224 - protein, 123 aa, Heterodera glycines
  Coding regions on vcDNA: vcDNA=SeqID_92647; Strand=-; Position=128-499
SFNDLKSQFIPPHFCLFPDRFWGSMSRGGGEGDGLSKNWGDRKWVGFNEGGDRITTKVLKRKRNSENQKLLFKPQPIVNSFFGANANSSNGTFSQSVPSAGTCQLLYCFQMAFSPNHCLKMTF

SEQ ID NO: 166225 - protein, 58 aa, Heterodera glycines
  Coding regions on vcDNA: vcDNA=SeqID_92648; Strand=-; Position=55-231
LLAFSDSLRKNFLQTFASTVNFPPFLLALLAVVALRPCRRPPPPPLPQIVHFPNSPIL

SEQ ID NO: 166226 - protein, 141 aa, Heterodera glycines
  Coding regions on vcDNA: vcDNA=SeqID_92649; Strand=-; Position=45-470
RSLSSSSGVRRFRCNGSSVNSFGIGMTVLVAASFVVRFELDDASPPPLALFWRSATFLLIGLFERAFRGILGLRLVFMSILVAKCWFSLSSEILGFRFVVRFLFGWLISAALSPCSSSPLFGVLLSEKIYLILKFLYNNLD

SEQ ID NO: 166227 - protein, 185 aa, Heterodera glycines
  Homolog annotation: Hit_ID=AAH77315.1; Match level="QueryCoverage =77%, HitCoverage=35%, E-value=3e-56, Identity=72%"; Hit description =Snx6-prov protein [Xenopus laevis]
  Gene Ontology: Biological process=nonselective vesicle transport
  Coding regions on vcDNA: vcDNA=SeqID_92650; Strand=+; Position=88-642
MPELPMNLTPLRDREKANVNDTEARQNLGKLSTQLLGTYPMPLSEHEKVKYTVQTKTNAPEFARVEMSVVREHDEFIWLHNCLEDNEEYAGFIIPPAPPPPDFDASREKLQKLGEGEATMTKEEFVKMKQELEQEYLATFKKTVALHEKFLTRLAAHPVFQKDQNFRVFLEYENDLSVRSRNKKE

SEQ ID NO: 166228 - protein, 197 aa, Heterodera glycines
  Coding regions on vcDNA: vcDNA=SeqID_92651; Strand=+; Position=1-591
IPSSIPSTSTHSLQSSNITMGVTGLTGFIDHHALVRNLTFSKAAKAAQDANEHPHPHRLVIDGSSLVHHLYFCNLDWAMGGQYHAMILLLDRFFGHLAAAGIEVAMVVFDGGRATATKELVRINRDTKRADHSYHAMKAISVQPLVHLRHGLPVLATGETSSRNRRSFGTDPTLPVLAISLAIRHMRDVLNIPVRVA

SEQ ID NO: 166229 - protein, 208 aa, Heterodera glycines
  Homolog annotation: Hit_ID=CAE66880.1; Match level="QueryCoverage =96%, HitCoverage=39%, E-value=3e-61, Identity=58%"; Hit description =Hypothetical protein CBG12259 [Caenorhabditis briggsae]
  Gene Ontology: Mol. function=serine-type peptidase activity; Cellular component=lysosome; Biological process=protein catabolism
  Coding regions on vcDNA: vcDNA=SeqID_92652; Strand=+; Position=4-627
MLNLLLFLLIVSPILAIEKPWIRRDPITLTKFSCHFALKEAPKYKWQELWYDNMPIDHFSFSDPRSFRLRYLLNTDSFRDKNAPIFFYTGNEGSIEGFAENTGFMWDIAPEFGAAIVFAEHRFYGKTQPFGNESYTKLENLGYLSSEQALADFAQLIDYLKNEKLPNAKHSPVIGFGGSYGGMLTAWMRIKYPHLMDGGIAASAPVFW

SEQ ID NO: 166230 - protein, 134 aa, Heterodera glycines
  Coding regions on vcDNA: vcDNA=SeqID_92653; Strand=+; Position=3-407
VCERGNKCRQSVNNGPEIVLRFGRSPMAELDRTILKRDESVFVEHGRAEFCPSLYQGTVLRSGGGRSDETQRRIVRRAQKRLCPRVGQRLRRLSLGVQPKCSMLTSCYQEWESVRSVSEGMPTTDLKHSQLPNN

SEQ ID NO: 166231 - protein, 195 aa, Heterodera glycines
  Homolog annotation: Hit_ID=XP_234345.2; Match level="QueryCoverage =82%, HitCoverage=17%, E-value=3e-23, Identity=36%"; Hit description =similar to RIKEN cDNA 9430020B07 gene [Rattus norvegicus]
  Coding regions on vcDNA: vcDNA=SeqID_92654; Strand=+; Position=2-586
TKLRQEGTAFCAVWNPQNHNIVAVCNKKTGLLVYDLRMSNNTYAEAGKITKSAICADWSPSGELLFCAISRSNPICFNLQNSEHLRLSDPKYSNICTIKSCSFAGDQYLVTGSDDWNIYVWKVPSNWDDFANGTVNVHSVLEGHRSIVNHVKYGPRSNLLLSCGVEKIIKCWSGLPLRDSYQNPKKRERISTILP

SEQ ID NO: 166232 - protein, 199 aa, Heterodera glycines
  Coding regions on vcDNA: vcDNA=SeqID_92655; Strand=+; Position=1-597
LRMNVQPPPTATHSQPTILPMPIQNWSHELGIEFGDVLIADLLRRMCSPDFSSSLAPSARWHDIPFFEQFRSDLQFQWTLLRSVLVGGNRGKLNAKLLSILFWTVSDREEWQKRTVARLIYAAKDDKELANLVSLVIAVLPQLCQHRQQSSGELGLMSAAILLALADARRFGTEWDQFVMATDASGSTDPKNGSKVVEN

SEQ ID NO: 166233 - protein, 140 aa, Heterodera glycines
  Coding regions on vcDNA: vcDNA=SeqID_92656; Strand=+; Position=1-420
ILRVHLTHSTCVTLQNASCQPPQPPPAQAPSSQPTRAASPSRSTSRPGSPIRSPTSRNGSCGHLLAASCTAWAKLRPRNCSRARQSGAWPPRHRLPWPRHMSRRIGSLRRSKWVVGRLWRLDQPRCGGKSSSESVMRGGA

SEQ ID NO: 166234 - protein, 93 aa, Heterodera glycines
  Coding regions on vcDNA: vcDNA=SeqID_92657; Strand=+; Position=3-284
EFPFIMALAHYGFLAPKRRIEPAGISYEFSLIKDRLILGLSTLPVLQIVFQNSRTTDGDDIDGAAVSGTKNGIYWPLYFLDQIFCLDFNALKS

SEQ ID NO: 166235 - protein, 128 aa, Heterodera glycines
  Homolog annotation: Hit_ID=CAG09769.1; Match level="QueryCoverage =98%, HitCoverage=99%, E-value=3e-27, Identity=47%"; Hit description =unnamed protein product [Tetraodon nigroviridis]
  Coding regions on vcDNA: vcDNA=SeqID_92658; Strand=+; Position=16-402
MKLLLHNFFSSNFLKGVTNGYPLLLRATKIERIDGTEFNGDFVKKMMPRLDYPALLQAAKAVDERAADELPKELGTDWEKDDDFLKKVHSLLVSYEIVEGELECPESHRIFNIKEGIPNFLVGADEVE

SEQ ID NO: 166236 - protein, 119 aa, Heterodera glycines
  Coding regions on vcDNA: vcDNA=SeqID_92659; Strand=+; Position=3-362
GATGKEAAANKIGVAAVALSEADNSTTPAPPPPPSPGGSDDKKKDDDYFLPDEDPAKKGQRNGHGRRRQKNGRSGRSIWRGVHFCCHSFRHGFDVRTDQKCMSIGRSGASRDPPYYQMY

SEQ ID NO: 166237 - protein, 71 aa, Heterodera glycines
  Homolog annotation: Hit_ID=NP_509397.1; Match level="QueryCoverage =100%, HitCoverage=51%, E-value=2e-10, Identity=47%"; Hit description= related to yeast Fis1p, a gene involved in mitochondrial division (fis-2) [Caenorhabditis elegans] gb|AA
  Coding regions on vcDNA: vcDNA=SeqID_92660; Strand=+; Position=2-214
ESLLQRSEQDIPKRDYLYYLVLDHSPISQYNRSLDYINLLLSAESDNPQALYLKELIPHKMKRDGLLDLAL

SEQ ID NO: 166238 - protein, 123 aa, Heterodera glycines
  Coding regions on vcDNA: vcDNA=SeqID_92661; Strand=+; Position=24-395
MASPMFAALLMALLATTLVEGGRLPLKLPPKLPKPKTSSLPRASEVAIINSCITVAQKGFKPTDSAVKTFNACHQDYWGRSASKPATGDLLKSLNQCTRPGGFKSQSTVYKKYEKCVLRRAGR

SEQ ID NO: 166239 - protein, 185 aa, Heterodera glycines
  Homolog annotation: Hit_ID=CAE57920.1; Match level="QueryCoverage =67%, HitCoverage=18%, E-value=2e-12, Identity=31%"; Hit description =Hypothetical protein CBG00972 [Caenorhabditis briggsae]
  Coding regions on vcDNA: vcDNA=SeqID_92662; Strand=+; Position=33-587
MKDQEVQMAREPTAAGAFGNGTADQQSAGDETVWRRIGPRSQTSSAQVLSPGYQDPFTGTNRYMPGCNNGVTTAQQNTKRSPIVPLPDNFCTFGLDGVSKKVIERLREMNLLQPKALQLNDDEFASAEVILSQADFAINECQIVALEKGILWSPETIVPALDLFRIALLHPKLNEIFCSLESVLG

SEQ ID NO: 166240 - protein, 53 aa, Heterodera glycines
  Coding regions on vcDNA: vcDNA=SeqID_92663; Strand=-; Position=183-344
FFFFFFFILNCMYCNWQGGWRGEDDPVSQEASGGQKRQGKALRAQGNCWLCRR

SEQ ID NO: 166241 - protein, 143 aa, Heterodera glycines
  Homolog annotation: Hit_ID=CAG07403.1; Match level="QueryCoverage =79%, HitCoverage=42%, E-value=4e-14, Identity=35%"; Hit description =unnamed protein product [Tetraodon nigroviridis]
  Coding regions on vcDNA: vcDNA=SeqID_92664; Strand=+; Position=40-471
MLATGNAAHTYGKPTMAITHIDSVEITVIEARNLIAGDRFTKNDPYVKIRSGLHDKSTKVQSGTNPVWILVLKIEASHLSDKLVFEVYDKDPGRDDFLGKFELPLDELRRSGNMDRWFTLADKHGKMGGNGELHLILRPRGHN

SEQ ID NO: 166242 - protein, 45 aa, Heterodera glycines
  Coding regions on vcDNA: vcDNA=SeqID_92665; Strand=-; Position=0-134
FFFFSNAITNRSSNLSLLLSNWVISHYSQMGGFVGVPLIVYVLSV

SEQ ID NO: 166243 - protein, 147 aa, Heterodera glycines
  Homolog annotation: Hit_ID=NP_492468.1; Match level="QueryCoverage =90%, HitCoverage=13%, E-value=1e-33, Identity=51%"; Hit description =gamma-tubulin Interacting Protein GIP-2, lipoate-protein ligase (gip- 2) [Caenorhabditis elegans] emb|CAB0
  Gene Ontology: Biological process=coenzymes and prosthetic group metabolism
  Coding regions on vcDNA: vcDNA=SeqID_92666; Strand=+; Position=42-482
MALPTKIHQIPNLLTVFISSSRCIYENLALEEWLFRNNGVKEDGDSLLIWRNSPAVVIGRYQNPWLESDVRFCAANGIRISRRYSGGGAVYHDEGNLNISLMTTHERHSRKKNLQIVADFLNAKLLGGCASATAPRLIANERDDLLI

SEQ ID NO: 166244 - protein, 205 aa, Heterodera glycines
  misc_feature (16)..(16): Xaa can be any naturally occurring amino acid
  Homolog annotation: Hit_ID=NP_497830.1; Match level="QueryCoverage =60%, HitCoverage=54%, E-value=9e-43, Identity=63%"; Hit description =RiNg Finger protein (24.9 kD) (rnf-5) [Caenorhabditis elegans] emb|CAA86745.1| Hypothetical protein C16C1
  Gene Ontology: Mol. function=zinc ion binding; Biological process =embryogenesis and morphogenesis
  Coding regions on vcDNA: vcDNA=SeqID_92667; Strand=+; Position=24-639
MDSEKEDSRFECNICXDMAKDAVVSMCGHLFCWPCLFQWMDTRPYRQLCPVCKSAISKDKVIPLYGRGGGDSDPREKIPPRPQGQRTEETNQGFPGMFHWGGDNGGHGGGGVQFSTPISLWPTNFVRHGSAMSILCLGKVADVYLIDEPSAYLDFEQRLHAAKGIKRKKSGFIVEHDFIMSTYLADRVIVFDGPQPLVNGMNRFL

SEQ ID NO: 166245 - protein, 197 aa, Heterodera glycines
  Coding regions on vcDNA: vcDNA=SeqID_92668; Strand=+; Position=1-591
IAKSREISENQTEREFTTPQVTNGSTGEEKKRNERRKEADKAPDQRSKKGHDEEANANEVHSTTGAQTLPFTVSARLFIFTARTFTYEVDVAPAVAERFESAQVVDIYNSLPPPMDPRMKRENANGISGSVPTPDRLVLRQGKCHQRIAQAFFCGGPLSALAICPRATKKGRELIAIGTFADEKMLKMESESQDAFV

SEQ ID NO: 166246 - protein, 130 aa, Heterodera glycines
  Homolog annotation: Hit_ID=CAG61938.1; Match level="QueryCoverage =97%, HitCoverage=41%, E-value=2e-13, Identity=32%"; Hit description =unnamed protein product [Candida glabrata CBS138] ref|XP_448968.1| unnamed protein product [Candida glabra
  Coding regions on vcDNA: vcDNA=SeqID_92669; Strand=+; Position=8-397
MYLTVCNRYVKGKKIDAAVDLLTNGAKLLCEHKQFGSALYMASVVLKTWTDEEVDVHDKTLGRLFELMDLFAGYSREFNELMKNGIKWTSKCGEFSTGEPALHHHVGVTFANVAKVDEAHRHFMLGTTDS

SEQ ID NO: 166247 - protein, 211 aa, Heterodera glycines
  Coding regions on vcDNA: vcDNA=SeqID_92670; Strand=+; Position=3-635
ISDQEGANCCDATVGFGSADLENNRFSNDSPDIEYTLEKLARLEGYSVKLTSAGQVYANFGHQLIQQLGDERDKRRGRNSLSRDFRKLYEYIIEVVDSWYWEIPLQYPMPEKTQLLAFLDDLQNKMDFEWAEKRETDFVNFVEQCVAEVGRKFDQICRWYMDSYLPAFDYIADTLKKSFQANEFGFLFFDFNFSKVTLDDLLIRAGNNLRL

SEQ ID NO: 166248 - protein, 159 aa, Heterodera glycines
  misc_feature (159)..(159): Xaa can be any naturally occurring amino acid
  Coding regions on vcDNA: vcDNA=SeqID_92671; Strand=+; Position=17-496
CFTANSSHSLCHSFSALLCQLPMVRFLSLFPFPSLFLSFFSSPRPFFLSLLPFSAFCYDLAAICKSSFDCDFVGGMTCSMALCVPSKCHLSSECPTGWVCTSQLQCRRGCFSDDDCALIGWFCTAQNVCEQGDCGDCRMGEKCVEGKCIPKWFRGMKRX

SEQ ID NO: 166249 - protein, 143 aa, Heterodera glycines; identical to SEQ ID NO: 147799
  misc_feature (63)..(63): Xaa can be any naturally occurring amino acid
  misc_feature (74)..(74): Xaa can be any naturally occurring amino acid
  misc_feature (102)..(102): Xaa can be any naturally occurring amino acid
  Homolog annotation: Hit_ID=ZP_00357698.1; Match level="QueryCoverage =79%, HitCoverage=52%, E-value=2e-10, Identity=37%"; Hit description =hypothetical protein Chlo02002738 [Chloroflexus aurantiacus]
  Coding regions on vcDNA: vcDNA=SeqID_92672; Strand=+; Position=1-433

SEQ ID NO: 166250 - protein, 39 aa, Heterodera glycines
  Coding regions on vcDNA: vcDNA=SeqID_92673; Strand=-; Position=28-147
RNGNNLFGRTLEVPMRMCRLRNIFHSISPPAEAGLHALF

SEQ ID NO: 166251 - protein, 78 aa, Heterodera glycines
  Homolog annotation: Hit_ID=CAA74206.1; Match level="QueryCoverage =97%, HitCoverage=21%, E-value=5e-20, Identity=56%"; Hit description =serine proteinase [Heterodera glycines]
  Coding regions on vcDNA: vcDNA=SeqID_92674; Strand=+; Position=2-238
KDKLCVIAEPSLAEKGDSGGPLMFKTGKNNNWAQVGVASTSTCNPEKPKSTDGLTTDYTQIDCNWIEEATNGEVKCIE

SEQ ID NO: 166252 - protein, 181 aa, Heterodera glycines
  misc_feature (61)..(61): Xaa can be any naturally occurring amino acid
  Homolog annotation: Hit_ID=NP_741716.1; Match level="QueryCoverage =99%, HitCoverage=28%, E-value=2e-27, Identity=36%"; Hit description =putative protein, with at least 10 transmembrane domains, of ancient origin (68.2 kD) (XB658) [Caenorhabd
  Coding regions on vcDNA: vcDNA=SeqID_92675; Strand=+; Position=2-545
KTLPKPVSALCSAQAENPRRKWQFAIAWLLIASNLFVGITFACIVPFFPIEAEAKGLSTSXVGFVIGIFQLCSFFVSPVFGKYLVVLRVHRAFIGGLLFTSLCTIALGLSPCLPFGTPFFAGVLLLRVGQAIGNASYSTSSWALIGHLFPQRIVLFTGLLEVAYGLGYVLGPPLGSALFEF

SEQ ID NO: 166253 - protein, 167 aa, Heterodera glycines
  misc_feature (47)..(47): Xaa can be any naturally occurring amino acid
  misc_feature (56)..(56): Xaa can be any naturally occurring amino acid
  Homolog annotation: Hit_ID=AAP44511.1; Match level="QueryCoverage =99%, HitCoverage=95%, E-value=3e-37, Identity=38%"; Hit description =progranulin-b [Danio rerio] ref|NP_997903.1| progranulin-b [Danio rerio]
  Gene Ontology: Mol. function=calcium ion binding; Cellular component =extracellular space; Biological process=cell-cell signaling
  Coding regions on vcDNA: vcDNA=SeqID_92676; Strand=+; Position=58-556
RVNCPDGRSFCPEKTTCCQLSDEGHYGCCPLPKAICCMDHLHCCPRXTQCDLPQLXCVNSDGNSQPFHRKMPAKTQNGETVEQKGTDKEATEEVICPDGSSKCPPRATCCPLGDGFGRRRKDFWRLETNAQQSISYGCCPAERAVCCADHVHCCPHGTQCNARGGEC

SEQ ID NO: 166254 - protein, 129 aa, Heterodera glycines
  Coding regions on vcDNA: vcDNA=SeqID_92677; Strand=+; Position=3-389
GATGKETAANKIGVASVSLAEADDSTTPTPPPAPSAGDSDDEKKDDDDKNPDEDPAKKGNGTDTGDDGEKTDEAGGAFGAGSIFVAILFGMALMFKLDQNVCPLQKAAPVGPTKLSHVLKKHAKHWAKT

SEQ ID NO: 166255 - protein, 166 aa, Heterodera glycines
  Homolog annotation: Hit_ID=XP_225512.2; Match level="QueryCoverage =98%, HitCoverage=35%, E-value=5e-46, Identity=55%"; Hit description =similar to RIKEN cDNA 3110035P10 [Rattus norvegicus]
  Gene Ontology: Mol. function=pre-mRNA splicing factor activity; Cellular component=small nucleolar ribonucleoprotein complex; Biological process=mRNA splicing
  Coding regions on vcDNA: vcDNA=SeqID_92678; Strand=+; Position=2-499
EEPTQQISHPITLLDGHSDVIMAGEWLIGGDQIITASWDRTANLFDAESGKIIKCLSGHDRELTSCSAHPSQKLVATASKDFTFRLWDFRDPIHSVAALQGHNDFVTSVGFSALHHIVSGGDDRTVKVWDLRNMRSLISGIRVNIAANRNFNMEQQKFDLQFPQDN

SEQ ID NO: 166256 - protein, 127 aa, Heterodera glycines
  Coding regions on vcDNA: vcDNA=SeqID_92679; Strand=-; Position=128-511
IRILTTFHRLDDVLLHSVSHLFIGRWVKSCRLLVTVFGRRTRRNGKGCGSGRLFLKDGQRRRQLFLRNVNHSRALLFSLSSSPSSATVSSRSSGGILFGDLFRANTLRFLLFELQCFAGVLNPHGTR

SEQ ID NO: 166257 - protein, 205 aa, Heterodera glycines
  misc_feature (184)..(184): Xaa can be any naturally occurring amino acid
  Homolog annotation: Hit_ID=CAE66651.1; Match level="QueryCoverage =98%, HitCoverage=26%, E-value=2e-26, Identity=38%"; Hit description =Hypothetical protein CBG11988 [Caenorhabditis briggsae]
  Coding regions on vcDNA: vcDNA=SeqID_92680; Strand=+; Position=2-619
REPTFEGWLEQGDTLYIPKGWIFKASAGDLHSLCDFVSICRGHSFADFLEKAYAEFLKTMVSGSKHLRKNLPPLLFDMAGNSVNDYPGEETLEEKIIPDTEIFSRESGENFAAFGPSYSDLTAREFFRLSLHPVLTPDEETNICFGGAIDSSLDIGNETEVRLVRKHTQPLLCENADKAFIAHXMANSRSCEKYPEGTIDFTIDV

SEQ ID NO: 166258 - protein, 183 aa, Heterodera glycines
  misc_feature (83)..(83): Xaa can be any naturally occurring amino acid
  Homolog annotation: Hit_ID=NP_493251.1; Match level="QueryCoverage =97%, HitCoverage=35%, E-value=1e-30, Identity=39%"; Hit description =amino acid/polyamine transporter, family II (1N460) [Caenorhabditis elegans] emb|CAA22315.1| Hypothetical
  Coding regions on vcDNA: vcDNA=SeqID_92681; Strand=+; Position=1-549
ILPKQGLSWPLAAFFMVTDMAIGGMVTLPGAICRIGLSRGLALLLLSGLFCCCSAILLGQCWLFVLDKSPQLRQKHCRRPYVXIGFCALGRWMSILVSVGVNVTQFGIATVFLLLCAVNLSRICSTLFHVDLSQCLLLLILALLLLPLTLLKSPNEFWPILFGGMICTVATFGFILFGISIDL

SEQ ID NO: 166259 - protein, 65 aa, Heterodera glycines
  Coding regions on vcDNA: vcDNA=SeqID_92682; Strand=-; Position=3-200
FNLMQIVKHISTNIFSKNSFNCCFFPFPFTTSSSFICFDNVPGDRLGVHGQWTMPHYAHHPLSSH

SEQ ID NO: 166260 - protein, 168 aa, Heterodera glycines
  Homolog annotation: Hit_ID=NP_353964.1; Match level="QueryCoverage =86%, HitCoverage=25%, E-value=6e-18, Identity=39%"; Hit description =hypothetical protein AGR_C_1721 [Agrobacterium tumefaciens str. C58] ref|NP_531642.1| sucrose hydrolase [
  Coding regions on vcDNA: vcDNA=SeqID_92683; Strand=+; Position=16-519
MEYQRSIVTKDFYRPMGPPRDAIARRPSELAAVITEDFRDPNVFVGPDGALFMTTSSRFTNGTGGVVLLFRQNETAANGGPEGWEFKGILHKDNRWHNAVCECSGLIPLGDPLSLQTLWAFVYSMSNSVDEDGRQFLNPVIVGNFNGRKFTPLFEQMLDFATGSYAYQ

SEQ ID NO: 166261 - protein, 79 aa, Heterodera glycines
  Coding regions on vcDNA: vcDNA=SeqID_92684; Strand=-; Position=270-509
QTKSLLELIRFNNCIKRRLDCLLFFLKQFAGQSRRSHRRPRVFPIVNCAVTINSSEKLTPKEKNAHIQEKEDNKSQANL

SEQ ID NO: 166262 - protein, 162 aa, Heterodera glycines
  Homolog annotation: Hit_ID=XP_393511.1; Match level="QueryCoverage =90%, HitCoverage=94%, E-value=7e-37, Identity=51%"; Hit description =similar to ribosomal protein S19 [Apis mellifera]
  Gene Ontology: Mol. function=structural constituent of ribosome; Cellular component=eukaryotic 48S initiation complex; Biological process=protein biosynthesis
  Coding regions on vcDNA: vcDNA=SeqID_92685; Strand=+; Position=14-502
MATVKDVAAADFIAALSAHLKKGGKIQVPEWMQFAKTATFKELGPSDADFYYVHIAAVARHIYLRKGVGVGDLRKRFGGKERRGVRPNHSAVASGSLQRKALQTLEKLKYVEKSAAGGRQITATGRRELDRIANQVVAIKNAEAARLAEAAAAAAAVNVDQE

SEQ ID NO: 166263 - protein, 188 aa, Heterodera glycines
  Homolog annotation: Hit_ID=NP_508439.1; Match level="QueryCoverage =46%, HitCoverage=31%, E-value=2e-16, Identity=45%"; Hit description =i-87 protein (XD31) [Caenorhabditis elegans] pir||T29994 hypothetical protein C43H6.1 - Caenorhabditis el
  Coding regions on vcDNA: vcDNA=SeqID_92686; Strand=+; Position=75-638
MALSAWPILSSERDEKNQQQMLPYAKYECAISFDDGIEVPISKEGLLTLIQSGFLRDALFMTTKLLNNIGQGMTMAGRQTQNSQFSLEVWACRFQLMMALRMHNQLLDELTAFGELDSSELFLPSGANELKGSMVPFSLRLLHAEASSFSPLPYSSMVRVHKLIENTVKAIEIARRNFAATDSELGIW

SEQ ID NO: 166264 - protein, 63 aa, Heterodera glycines
  Coding regions on vcDNA: vcDNA=SeqID_92687; Strand=+; Position=164-355
ILLAFPLSISNCYLFTHNIIILNCLSICLFHFSILCYLLVFLSFFLFWCHCHLFLNFLFFIFL

SEQ ID NO: 166265 - protein, 78 aa, Heterodera glycines
  Homolog annotation: Hit_ID=NP_872192.1; Match level="QueryCoverage =88%, HitCoverage=48%, E-value=2e-18, Identity=59%"; Hit description =transthyretin-like family member (15.7 kD) (5I318) [Caenorhabditis elegans] gb|AAN84848.1| Hypothetical p
  Coding regions on vcDNA: vcDNA=SeqID_92688; Strand=+; Position=228-464
PCHEFQRSAGKTTELTTINFQLLIYHNCDDVMMPCQRKVTFNIPDSYVTSGAVPAKFFDIGTVNMQIIFDHEERSCIH

SEQ ID NO: 166266 - protein, 72 aa, Heterodera glycines; identical to SEQ ID NO: 142684
  Coding regions on vcDNA: vcDNA=SeqID_92689; Strand=-; Position=1-216

SEQ ID NO: 166267 - protein, 189 aa, Heterodera glycines
  Homolog annotation: Hit_ID=CAH68925.1; Match level="QueryCoverage =100%, HitCoverage=23%, E-value=4e-10, Identity=30%"; Hit description= novel protein similar to vertebrate enabled homolog (Drosophila) (ENAH) [Danio rerio] emb|CAI20810.1| nov
  Coding regions on vcDNA: vcDNA=SeqID_92690; Strand=+; Position=10-576
MAPPPPPPVVSRPPKPVPPPPGGHDPPLSITRTLTLEPASTQVIRDLITRTGPYAYLPVVPTVTVHLNPNDPPTRQLLDLVPDLGQAVLVAADFVYSTLYGSVGIARHEPAEDRDDEENGAFNYSQANLAPNTDDAFTSRPPHPSVTTTAAEITPLPPPPPPPPTASALPTAPLPPCGPPPSLHPPLPP

SEQ ID NO: 166268 - protein, 212 aa, Heterodera glycines
  Coding regions on vcDNA: vcDNA=SeqID_92691; Strand=+; Position=3-638
KAIFFVKLLQGKSSRKFAVMSSGSRGFGRGRGGRGIAPSQTENGTIHLSNDRIVGAYSEANPNEGIIINFSDSQPSQQPPIVNVQTRGILRNCNGIDAASDVQKANGTATNEGEHQLPIADQPVPFGGASVPRVASVTGRGTRGVRGGLGRGAPAQNNNISRPPVNAEISPPKSVTFDSTTVFNGSRARGGGGTTSRGFGRGANAVELGPGD

SEQ ID NO: 166269 - protein, 101 aa, Heterodera glycines
  Coding regions on vcDNA: vcDNA=SeqID_92692; Strand=-; Position=1-303
KTKFCNYILDGCFISPFIKEIISRFMLYEAKKYSCKLYVLVALLSSLAFSLMHIGYDPFVLIKPILLPKLSEHFLFGCVLCSIFWFFPRLSLLISIHAISN

SEQ ID NO: 166270 - protein, 169 aa, Heterodera glycines
  Homolog annotation: Hit_ID=NP_956811.1; Match level="QueryCoverage =77%, HitCoverage=46%, E-value=4e-39, Identity=49%"; Hit description =hypothetical protein MGC66295 [Danio rerio] gb|AAH65896.1| Hypothetical protein MGC66295 [Danio rerio] gb
  Coding regions on vcDNA: vcDNA=SeqID_92693; Strand=+; Position=3-512
FPDSGKHCSVPDCRQLDYLPITCDACSRILCKQHRTYDSHGCTESYKKNVQFPICPLCQQTVPIKRGEKPDLRVNEHIERDCRSELAKKGRWAPKCGVKNCFRREQLVPMVCKECAVHFCLSHRHRSDHQCPKMPMVSHRTTKPKNISSKSAAEQMDALFAAQLQREEY

SEQ ID NO: 166271 - protein, 57 aa, Heterodera glycines
  Homolog annotation: Hit_ID=NP_500253.1; Match level="QueryCoverage =100%, HitCoverage=9%, E-value=2e-12, Identity=63%"; Hit description =spastic paraplegia 3A homolog, atlastin, putative guanylate-binding protein, similar to ARL-6 interacting
  Gene Ontology: Mol. function=protein binding
  Coding regions on vcDNA: vcDNA=SeqID_92694; Strand=+; Position=2-172
STMVASVHIFHIHKNIQDDALQDLLLFTEYARLALDEDKKNKPFHSLLFLAHDWSVP

SEQ ID NO: 166272 - protein, 182 aa, Heterodera glycines
  misc_feature (17)..(17): Xaa can be any naturally occurring amino acid
  misc_feature (63)..(63): Xaa can be any naturally occurring amino acid
  Homolog annotation: Hit_ID=CAE70749.1; Match level="QueryCoverage =100%, HitCoverage=25%, E-value=1e-54, Identity=51%"; Hit description= Hypothetical protein CBG17495 [Caenorhabditis briggsae]
  Coding regions on vcDNA: vcDNA=SeqID_92695; Strand=+; Position=2-547
TWPSFLLPVFLSSVLMXACWDVGHFQLSFLWIVLFTVLYVLKTHSWIRREQHRMSMRSMIMRXRKMVMAHYSRFDYLPAWVQFPDNERIKWVNKIIQQIWPHIGEYTKVFLKEFIEPQIRAQLPAPFKSFKFVAVDMGDIPFRVGGLKVYTQNVGRDRVIMDMDVVYTGDAEFAVQACGFRG

SEQ ID NO: 166273 - protein, 134 aa, Heterodera glycines
  Coding regions on vcDNA: vcDNA=SeqID_92696; Strand=-; Position=80-484
IGGNLFIRGTGRRLNPGVPLNSGDHSRGLLILLLYPESSVELVTFACLAVRQWVLHIQPSVELEVMYAWLKKRRVMLQKQPSHAAFDVIYSWSGRNQLLLHLHSSQADVVTHSPLGRTGPHVATSPSITIRIGQ

SEQ ID NO: 166274 - protein, 88 aa, Heterodera glycines
  Homolog annotation: Hit_ID=NP_494753.2; Match level="QueryCoverage =96%, HitCoverage=18%, E-value=1e-09, Identity=39%"; Hit description =ankyrin (2E574) [Caenorhabditis elegans] gb|AAB00714.3| Hypothetical protein C01F1.6 [Caenorhabditis eleg
  Coding regions on vcDNA: vcDNA=SeqID_92697; Strand=+; Position=356-622
VLGKPFKASTTAKKFEGIVAMSASFPLRFGVLLDMLHVFEPLLPRFSKLRGLCKSRLPEGFPVKMELPLFIGVKTSIFNKTRLRGDKT

SEQ ID NO: 166275 - protein, 152 aa, Heterodera glycines
  Homolog annotation: Hit_ID=CAE67627.1; Match level="QueryCoverage =90%, HitCoverage=51%, E-value=2e-17, Identity=41%"; Hit description =Hypothetical protein CBG13181 [Caenorhabditis briggsae]
  Coding regions on vcDNA: vcDNA=SeqID_92698; Strand=+; Position=7-465
ALFTFLPLPPSLLPSPMFPPFHPPSSSSPFFGPSHSSSSSSSSSSVFLHSFPPVQPLQKKRSSANDGTSPQLKNIVGPVAAEKGTDGQKEPCICERDQALVVCRRCGHDLIARVQLCCPQHPKRISLMDLRECPNSACRSVQLSEVKLPTDK

SEQ ID NO: 166276 - protein, 186 aa, Heterodera glycines
  Homolog annotation: Hit_ID=EAL25200.1; Match level="QueryCoverage =98%, HitCoverage=62%, E-value=6e-38, Identity=45%"; Hit description =GA18502-PA [Drosophila pseudoobscura]
  Gene Ontology: Mol. function=peptidyl-prolyl cis-trans isomerase activity; Cellular component=histone deacetylase complex; Biological process=protein metabolism
  Coding regions on vcDNA: vcDNA=SeqID_92699; Strand=+; Position=78-635
MASSAKNTIYVGGLAPEVNRHMLENLFIAFGDIVNVDVPFDPIAQCNRGFAFITFEDPEDALAAIDNLHLSEISGRTIKVNLANAAAMSASGQRIHTKAVWDQAAIPTDDLVPASGQPQSAGASVAKLPKPVSASNPRVWFQVSIGDVPAGRIVFELRADVVPQTAENFRQLCTHEKGFGYRGSQF

SEQ ID NO: 166277 - protein, 182 aa, Heterodera glycines
  misc_feature (22)..(22): Xaa can be any naturally occurring amino acid
  misc_feature (83)..(83): Xaa can be any naturally occurring amino acid
  Homolog annotation: Hit_ID=CAG02487.1; Match level="QueryCoverage =100%, HitCoverage=88%, E-value=6e-47, Identity=53%"; Hit description= unnamed protein product [Tetraodon nigroviridis]
  Gene Ontology: Mol. function=RAB small monomeric GTPase activity; Cellular component=Golgi apparatus; Biological process=signal transduction
  Coding regions on vcDNA: vcDNA=SeqID_92700; Strand=+; Position=2-547
LFMVVIIGHRGVGKTNLLLPFXDNTISTTYFTTTGEYSATVTISVWGNKITFEISDSTCQERFPSIPSTYYRGTRGDILVFDXTSIESFNTVKRWLHEIDTDCENVQKILVGNKVDEPSRPAIPETDARRFAESMRINYFETSAKENLNVEHMFQCITQIVLESCVDREKNDPRQATDVLKM

SEQ ID NO: 166278 - protein, 199 aa, Heterodera glycines
  Coding regions on vcDNA: vcDNA=SeqID_92701; Strand=+; Position=1-597
DLSNFPLSFSNRTNRSLTLSLSNQPSTRSWSFTTHPPSPPNRHLCCALSRDSLTQSTATRSIHGSRLVSLSTPTSTLHPQPPSTTMGQLIWSLWGYYMALTSAAAIMDGGLWSILYNYPTVDQLRGLPIYNGVSWPGMLSMIFALVTVAVEKSLRPPVGLRAVFYLIVSLIGFLQFSTVVGAQCYFCTSIVFMTAAFKG

SEQ ID NO: 166279 - protein, 199 aa, Heterodera glycines
  Homolog annotation: Hit_ID=CAE69143.1; Match level="QueryCoverage =92%, HitCoverage=20%, E-value=2e-09, Identity=24%"; Hit description =Hypothetical protein CBG15173 [Caenorhabditis briggsae]
  Coding regions on vcDNA: vcDNA=SeqID_92702; Strand=+; Position=1-642
PFSSYCEPFDGYLKFDGESICFSGWVQLPQGMFKHRKRGWAVVRNNTFSISQDDESRTPFFGPVELSKCVFLGKESDSESVKHLLNSSGELNTVRFTPEENHEFWLSLMAKCCSPRNDLFGEKLPMVECCGRLWVKQGISGHWNEGWAFVHGHSLTYWVQAPNAIAEVDIRKIFLVKQNDIPSSDWCNYIDHSSSGPLL

SEQ ID NO: 166280 - protein, 167 aa, Heterodera glycines
  Homolog annotation: Hit_ID=NP_510450.1; Match level="QueryCoverage =98%, HitCoverage=50%, E-value=6e-63, Identity=70%"; Hit description =succinyl-coa synthetase (33.8 kD) (XP373) [Caenorhabditis elegans] emb|CAA94107.1| Hypothetical protein C
  Gene Ontology: Mol. function=succinate-CoA ligase (ADP-forming) activity; Cellular component=mitochondrion; Biological process =succinyl-CoA metabolism
  Coding regions on vcDNA: vcDNA=SeqID_92703; Strand=+; Position=2-505
FASYTSTRQSLKINKNTNVVVQGFTGKQGTFHGQQMIEYSTNVVAGVSTSKAGTEHLGKPIFATVKDARNFTGADASVIYVPVPFAAAAIDKAIDTEILLVVCITEGIPQLDMIHVKNHLLKHNPTQLLGPNCPGIIAPDKCNIALMPGHIHKKGVIGIVSRSGTLT

SEQ ID NO: 166281 - protein, 188 aa, Heterodera glycines
  Coding regions on vcDNA: vcDNA=SeqID_92704; Strand=+; Position=48-611
MESETNEDEIDQEEQGNEHTQAEEDTSHHQQKCYVAKCLDSIAKLQRTFQLSNASADVLDRAADYMQLYLDRYANGKFGADWVRRMLFIARIHGAPLSRLRFIDVNKHNRKMAALYQSLGPGFQTRWLSGAIDMEQFFARMDFLESKYGERLWELHFVYGYENINRSEGSFFRWQIISTVRSLYKGIL

SEQ ID NO: 166282 - protein, 72 aa, Heterodera glycines
  Homolog annotation: Hit_ID=NP_496279.1; Match level="QueryCoverage =100%, HitCoverage=24%, E-value=4e-19, Identity=63%"; Hit description= gene producing two messages overlaping 3' 5', encoding DNA-directed RNA polymerase subunit K/omega and a
  Gene Ontology: Biological process=positive regulation of body size
  Coding regions on vcDNA: vcDNA=SeqID_92705; Strand=-; Position=195-413
IQSPVAIPALSARLQMHGENGMVRHECAEALGSIATDECQRLLRQFVGDEERVVRESCEVALDIAELNRTDE

SEQ ID NO: 166283 - protein, 110 aa, Heterodera glycines
  Coding regions on vcDNA: vcDNA=SeqID_92706; Strand=+; Position=23-355
MPTPICDTPSISGVKKDQFEATKKWRKALKNFHESMPLSTHRRQLRTFTETFTGKDALDFAEQIFPSVFPLCNTRDKSRQLLERFLCFGYITNVRDENCKSFSDNATLYK

SEQ ID NO: 166284 - protein, 207 aa, Heterodera glycines
  misc_feature (12)..(12): Xaa can be any naturally occurring amino acid
  Homolog annotation: Hit_ID=CAE61904.1; Match level="QueryCoverage =100%, HitCoverage=22%, E-value=7e-46, Identity=51%"; Hit description= Hypothetical protein CBG05896 [Caenorhabditis briggsae]
  Gene Ontology: Mol. function=phospholipase C activity; Cellular component=intracellular; Biological process=phosphatidylinositol-45 -bisphosphate hydrolysis
  Coding regions on vcDNA: vcDNA=SeqID_92707; Strand=+; Position=3-623
TGLQVHGNATVXGYISALRRGSRLLELDVFDGEHGEPQITHKRTFIGAISLRNVLKCVKNYAFVQNPYPVILTIENHVGFVQQRIMADIFQEILGDHLLIPSDDLHTKPLPSPQQLKHKVLLRGKTAGGATTADINGGGTHAETTAATMAPASVAANNGTPCTAAPPMGTDYDTREEREDSPKQSQRNLPVDPKFGRLIALPSVKLS

SEQ ID NO: 166285 - protein, 171 aa, Heterodera glycines
  Homolog annotation: Hit_ID=EAL01937.1; Match level="QueryCoverage =98%, HitCoverage=100%, E-value=3e-26, Identity=38%"; Hit description= hypothetical protein CaO19.11807 [Candida albicans SC5314]
  Coding regions on vcDNA: vcDNA=SeqID_92708; Strand=-; Position=92-607
FFFFLLLSFYFPAVLLLLVLPVPLLLVGPVFLLLFFLLLSFFFFFLLLLLFLLLFFLLLLLLLLLFFLLLLLLLLLFFLLLLLLLLLFFLLLLLFLLLFFLLLLLLLLLFFFLLLLLFLFLLFFFLLLLFFFPLLLLLLLLFFLVLLYLFFVFLFYFSAYILAVFLIGSVL

SEQ ID NO: 166286 - protein, 185 aa, Heterodera glycines
  Homolog annotation: Hit_ID=CAE74082.1; Match level="QueryCoverage =100%, HitCoverage=48%, E-value=3e-80, Identity=77%"; Hit description= Hypothetical protein CBG21737 [Caenorhabditis briggsae]
  Gene Ontology: Mol. function=GDP-mannose 46-dehydratase activity; Biological process=carbohydrate metabolism
  Coding regions on vcDNA: vcDNA=SeqID_92709; Strand=+; Position=3-560
WIVVNYREAYQMYACNGILFNHESPRRGETFVTRKISRGVAKISLGQQELVELGNLNALRDWGHAREYVEAMWMILQQDSPDDFVIATGRNYTVRHFVELAFKEIGETIIWEGEGVDEVGREKEKGTLRVRVNPKFYRPTEVELLIGDPSKAKKQLGWEPKVEIEELVKEMVASDIELMKKNPMA

SEQ ID NO: 166287 - protein, 155 aa, Heterodera glycines
  Coding regions on vcDNA: vcDNA=SeqID_92710; Strand=-; Position=113-580
VCRASVGCGRFEVEGDFPEPQAIPVVVVSVVVIPDHPAAAQILFLSWKQPPQRVGRSKNVANIHIDQGPLAGNEIKHGRVDIVVRTFPGFNDDIDGCRQGLGSGTAWPIDIVNHEIDLERLLVERAGAKVDVAVAKDAAELFCFLVELAERLQDF

SEQ ID NO: 166288 - protein, 53 aa, Heterodera glycines
  Homolog annotation: Hit_ID=AAG22849.1; Match level="QueryCoverage =94%, HitCoverage=59%, E-value=3e-10, Identity=66%"; Hit description =histone H3 [Ancylostoma caninum]
  Coding regions on vcDNA: vcDNA=SeqID_92711; Strand=+; Position=2-163
MTVSDDIKWWGLPLLALHEAAELYLSGMLEDTNLCAIHARPVTIMPYDMRLVP

SEQ ID NO: 166289 - protein, 199 aa, Heterodera glycines
  misc_feature (67)..(67): Xaa can be any naturally occurring amino acid
  misc_feature (140)..(140): Xaa can be any naturally occurring amino acid
  misc_feature (154)..(154): Xaa can be any naturally occurring amino acid
  Homolog annotation: Hit_ID=NP_872153.1; Match level="QueryCoverage =99%, HitCoverage=71%, E-value=3e-62, Identity=62%"; Hit description =lactate/malate dehydrogenase and Lactate/malate dehydrogenase precursor (29.1 kD) (5G996) [Caenorhabditis
  Gene Ontology: Mol. function=malic enzyme activity; Cellular component=cytosol
  Coding regions on vcDNA: vcDNA=SeqID_92712; Strand=+; Position=2-598
QPILVLVTGAAGPLGYSLVLHLSKRDVFGQYLPIVLVLLDIPPLTEMLTGVHYKLIDCALPNLFCVXAMTTEEAAFTDIYYPFLVRAMPRSQGMDPTDLLAAYVRIFGSQGEALATFSKPTVIVLWVGNPANTHTLICAXYPANKFPAKNFSAXTRLDHNRAMAQVAHKCAHGTTVGMVKNVIIWGNHSSTQFPDTRHA

SEQ ID NO: 166290 - protein, 200 aa, Heterodera glycines
  Homolog annotation: Hit_ID=CAE70325.1; Match level="QueryCoverage =97%, HitCoverage=81%, E-value=3e-34, Identity=46%"; Hit description =Hypothetical protein CBG16854 [Caenorhabditis briggsae]
  Coding regions on vcDNA: vcDNA=SeqID_92713; Strand=+; Position=1-600
LAFGPPTSAPTLPSATDDTDSVQENQVESWVELAPSRASLCSSIEAVMLDSASGGENSVTRDSRLSPVSLQSPHVEFETSLEQVKYRLVKDMLPFADGAKPSDWLWDWSSRSETGNVPQKSGAKSKNCGAQIGSTLTTPPNSPEPESSEFEFKSKSSNRSILKKTASRKSVFLRFDVIFGFVFSNLVTFFLGAAIGYCIC

SEQ ID NO: 166291 - protein, 125 aa, Heterodera glycines
  Coding regions on vcDNA: vcDNA=SeqID_92714; Strand=+; Position=1-378
SLVPKTKQPHSCSESTPHWRRVCENTRRNSKTGGSRWNVPSATLLTRRTDRRRTHVAHCSNWLKCSSRPFPQHRMWPVYANSLTTTTTMLMTIRDRTLLQSINRGKIVDFSVFFLRLIYIKCIFK

SEQ ID NO: 166292 - protein, 115 aa, Heterodera glycines
  Coding regions on vcDNA: vcDNA=SeqID_92715; Strand=+; Position=33-377
MDEGTTENNNNRKSGAKKRKQKQKQQSVVAEVTEPHNKQSETEEAEKEKSKNGDSEKDGKKVNEASKPIPCQSISVIGDTVKSTILFITFILYSKILFYFSLIIKFCLAKKKKKK

SEQ ID NO: 166293 - protein, 149 aa, Heterodera glycines
  Homolog annotation: Hit_ID=CAE61968.1; Match level="QueryCoverage =57%, HitCoverage=32%, E-value=1e-38, Identity=81%"; Hit description =Hypothetical protein CBG05969 [Caenorhabditis briggsae]
  Coding regions on vcDNA: vcDNA=SeqID_92716; Strand=+; Position=3-452
CYQPGHYISDCPARFNSPYEELTPYQGRKKCYGEFQCEQCKRKWTSQNSVANEAQSCIKCHVPVFPHKQLPVDKAVALGLVKLQRLPVTNIGSTSTENLIDQCTAAGIFIDDTPSGNAFNGLNSDSASSSPSSLDQPMPMISPATSLMI

SEQ ID NO: 166294 - protein, 119 aa, Heterodera glycines
  Coding regions on vcDNA: vcDNA=SeqID_92717; Strand=-; Position=8-367
KVFLQRVLRLKLNSGPKFASILCSESCSDTNKKRAIFRRKKCHKIGGISVSVTVRISANPSIQWHFFGRKSNHCAHRFRPFFSIFEFGDYDQYFPANIPVLFCPMKWHFHFKNYFISIN

SEQ ID NO: 166295 - protein, 134 aa, Heterodera glycines
  misc_feature (69)..(69): Xaa can be any naturally occurring amino acid
  misc_feature (103)..(103): Xaa can be any naturally occurring amino acid
  Homolog annotation: Hit_ID=NP_505777.1; Match level="QueryCoverage =99%, HitCoverage=63%, E-value=2e-22, Identity=39%"; Hit description =putative protein, with a transmembrane domain (24.9 kD) (5L375) [Caenorhabditis elegans] emb|CAA98457.1|
  Coding regions on vcDNA: vcDNA=SeqID_92718; Strand=+; Position=23-424
PRDQLGDSILIPYAKRSTQRIVLIWKICSRGSSPFGLVMIPLGASALWKPFTEGPAIAVFAGVPNVFLXLFAFTPILLHFLTKRFAQKVFFKKREQMFPTLHXDFFQRKRALGYTADQLVDASDLPKDRRFWLP

SEQ ID NO: 166296 - protein, 70 aa, Heterodera glycines
  Coding regions on vcDNA: vcDNA=SeqID_92719; Strand=+; Position=184-396
LNHRQRLNLPALVILLTILHFTSSEANVLIHTFPFPTGNSSASQLMDSFAIKMEINRLCETSPYSCSYSL

SEQ ID NO: 166297 - protein, 140 aa, Heterodera glycines
  Coding regions on vcDNA: vcDNA=SeqID_92720; Strand=+; Position=9-431
LFKMVANNSDNANPNSHEQKVQFSAPRRNSMNELSINEDINRKEGSSTSASHPSDLSTNLTIHVDEQSQMLMIHPMTEPSVDGKSQQKSTASAPAEFQRAKCLAESEVIKEKPSIRTRLIVFVVCGAIIAFCLIKLFIWK

SEQ ID NO: 166298 - protein, 35 aa, Heterodera glycines
  Coding regions on vcDNA: vcDNA=SeqID_92721; Strand=+; Position=34-141
EVLIYKINCDLDVGLRTTYKEKFIRVGLFAQINLT

SEQ ID NO: 166299 - protein, 130 aa, Heterodera glycines
  Homolog annotation: Hit_ID=CAE65008.1; Match level="QueryCoverage =71%, HitCoverage=47%, E-value=4e-29, Identity=58%"; Hit description =Hypothetical protein CBG09846 [Caenorhabditis briggsae]
  Gene Ontology: Mol. function=ligand-dependent nuclear receptor activity; Cellular component=nucleus; Biological process=neurogenesis
  Coding regions on vcDNA: vcDNA=SeqID_92722; Strand=+; Position=192-581
MGRLIPTQNLCKVCGDKTFGRHYGAWVCDGCSCFFKRSIRRSAEYKCVAGTGKCLVDKCRRNWCQACRFNKCIAEANMAKERVQKERGPRKAKRSKSGKRNEVPKEAEKSQRESGETDGRGQRSVVSSLP

SEQ ID NO: 166300 - protein, 57 aa, Heterodera glycines
  misc_feature (8)..(8): Xaa can be any naturally occurring amino acid
  Coding regions on vcDNA: vcDNA=SeqID_92723; Strand=-; Position=168-341
FFFFFFFXPKMFYLFVEVVNTLSRVTLLNQSDQSINPSNHIRYHIDLLTKCFWHISH

SEQ ID NO: 166301 - protein, 47 aa, Heterodera glycines
  Homolog annotation: Hit_ID=NP_497185.1; Match level="QueryCoverage =100%, HitCoverage=7%, E-value=4e-10, Identity=55%"; Hit description =alkyl-dihydroxyacetonephosphate synthase, with confirmed activity (66.6 kD) (ads-1) [Caenorhabditis elega
  Gene Ontology: Cellular component=peroxisome; Biological process =lipid metabolism
  Coding regions on vcDNA: vcDNA=SeqID_92724; Strand=+; Position=2-142
PRLSAGPDLNQMVLGTEGTLGIIVRATIKILPMPDIPRFDSTPFPHF

SEQ ID NO: 166302 - protein, 209 aa, Heterodera glycines
  Homolog annotation: Hit_ID=NP_501972.1; Match level="QueryCoverage =99%, HitCoverage=37%, E-value=1e-25, Identity=32%"; Hit description =flavin-containing monooxygenase (60.1 kD) (fmo-12) [Caenorhabditis elegans] emb|CAA94290.1| Hypothetical
  Gene Ontology: Mol. function=monooxygenase activity; Cellular component=integral to membrane; Biological process=oxygen and reactive oxygen species metabolism
  Coding regions on vcDNA: vcDNA=SeqID_92725; Strand=+; Position=3-629
GQRLVEELFDAVLICSGARLRRWRPPEYRMERAFKGTVIHSEQFTHSSDFRGQTVCVVGLGNSAVAISIALAHTAKQVFLCTRRGEWILPLLQSDGQKPWDWPFSSRWHFWGRRWVPKCLRNFCWEMSAQSVSPDCSQNNGIGRPMHRLLSANLTFGAEQLCPLLASGRIRIRPNILSLSDSNLVEFADRTVEQHVDALVICTGFEFDF

SEQ ID NO: 166303 - protein, 208 aa, Heterodera glycines
  Homolog annotation: Hit_ID=CAE74275.1; Match level="QueryCoverage =98%, HitCoverage=51%, E-value=2e-33, Identity=38%"; Hit description =Hypothetical protein CBG21967 [Caenorhabditis briggsae]
  Coding regions on vcDNA: vcDNA=SeqID_92726; Strand=+; Position=3-626
SESFFWVFLLFGLLFALVEVSLFALLVSPYLSKLPNSTIALLDHAIPFNPGGLAQMEHRFGCIFDQNLYETFKRQMNPRNTCDPFLLSSFVPRPLLFVFVLLRLLPILCFLFLVAAPQNALSISLAKCILRVKPTIRYKKNAKSTPSKSLPSYYSHNSPTKTTFGVKENVPISSPLPCGTQIPPKTPPLGYMDHRINYNNAAFFAVSG

SEQ ID NO: 166304 - protein, 141 aa, Heterodera glycines
  misc_feature (82)..(82): Xaa can be any naturally occurring amino acid
  Homolog annotation: Hit_ID=NP_572965.1; Match level="QueryCoverage =96%, HitCoverage=83%, E-value=4e-17, Identity=35%"; Hit description =CG5310-PA [Drosophila melanogaster] gb|AAF48378.2| CG5310-PA [Drosophila melanogaster] gb|AAF64469.1| typ
  Gene Ontology: Cellular component=extracellular space
  Coding regions on vcDNA: vcDNA=SeqID_92727; Strand=+; Position=48-608
MRPWTFGLVKPDGVANPIAVRWLLSAMHCEGFVITNGCRLTVTPDLAGELYSSHQDAFYYGRLIRHICSGPSVAMRMELRNXINRWRTLLGPSKLFANIYLSSCAEFDEIKCKNLRQMFAVSDTRNLCHGSDSLDSLCREF

SEQ ID NO: 166305 - protein, 101 aa, Heterodera glycines
  misc_feature (101)..(101): Xaa can be any naturally occurring amino acid
  Homolog annotation: Hit_ID=NP_508729.2; Match level="QueryCoverage =87%, HitCoverage=16%, E-value=4e-14, Identity=46%"; Hit description =putative endoplasmic reticulum protein, with at least 6 transmembrane domains, of eukaryotic origin (63.8
  Coding regions on vcDNA: vcDNA=SeqID_92728; Strand=+; Position=2-307
MFIWLLLLPSFLFLLRLSHANLLIPGIMTERVELAPKSQEYIGFLQSALNGTEVEIRVKCEEDVEIEFDVEFAIRSSPCAKEFIVDKMRFSQVNNLLQFYX

SEQ ID NO: 166306 - protein, 161 aa, Heterodera glycines
  Homolog annotation: Hit_ID=CAE73238.1; Match level="QueryCoverage =96%, HitCoverage=27%, E-value=4e-17, Identity=33%"; Hit description =Hypothetical protein CBG20647 [Caenorhabditis briggsae]
  Coding regions on vcDNA: vcDNA=SeqID_92729; Strand=+; Position=2-484
DPLTCWFRQQTDVRGRMLARIPNLASAISKRIAWSFLIEPGRPPTDLSKFFAEFDVLESFFDKAELSATESSQKAFDANSLLKVRNRRLTCADGSRVTFNVPAELGREGITHEEFAATKQHLRIVGDLDCPQISTRVEFGHGDFINASYVRGGPLLKRSFL

SEQ ID NO: 166307 - protein, 112 aa, Heterodera glycines
  Coding regions on vcDNA: vcDNA=SeqID_92730; Strand=-; Position=24-362
SIHSINFQYLSPILHANLSKLDIFSKNSCAFSAVFSIAYDEFVPFVSSPSIGNEMISLKLFLHSSSGHFSTKVIRQKAIERAKRSEREGGILRKYLADISAKFRKKNWKIIY

SEQ ID NO: 166308 - protein, 69 aa, Heterodera glycines
  Homolog annotation: Hit_ID=CAE66281.1; Match level="QueryCoverage =97%, HitCoverage=11%, E-value=5e-14, Identity=57%"; Hit description =Hypothetical protein CBG11527 [Caenorhabditis briggsae]
  Gene Ontology: Mol. function=transporter activity; Cellular component= integral to membrane; Biological process=transport
  Coding regions on vcDNA: vcDNA=SeqID_92731; Strand=+; Position=2-208
ILIVVAGASGLPALKTALEYGLDAVCMEKSVDIGGLWRYMENPGQGEGTVMKSAVIFSIKDMSAYTDLS

SEQ ID NO: 166309 - protein, 173 aa, Heterodera glycines
  misc_feature (146)..(146): Xaa can be any naturally occurring amino acid
  Homolog annotation: Hit_ID=NP_741868.1; Match level="QueryCoverage =94%, HitCoverage=12%, E-value=5e-23, Identity=39%"; Hit description =apical Junction Molecule AJM-1, Junction Associated Molecule JAM-1, putative protein, with 5 coiled coil-
  Gene Ontology: Mol. function=cytoskeletal protein binding; Cellular component=cell-cell adherens junction; Biological process =intercellular junction assembly and/or maintenance
  Coding regions on vcDNA: vcDNA=SeqID_92732; Strand=+; Position=46-564
MSSSTANFPRSSVRDIPIQRSASAFAPMFGRAAGGTVPPLPSSRTTTAAPTEYYRKEVLTRTLVTRSTEALSAPLPLGRSSPAAPFLTLEQLPPQRDEMPEEYWLRYSRNVEEEERRVREGQERRKREEEERRKRVDEQRRRWEQXEVEQLERIRRERERMEQALEAQALDRE

SEQ ID NO: 166310 - protein, 193 aa, Heterodera glycines
  Homolog annotation: Hit_ID=NP_492712.1; Match level="QueryCoverage =98%, HitCoverage=26%, E-value=2e-25, Identity=34%"; Hit description =nicastrin, Anterior PHarynx defective APH-2 (81.4 kD) (aph-2) [Caenorhabditis elegans] pir||T27570 hypoth
  Coding regions on vcDNA: vcDNA=SeqID_92733; Strand=+; Position=3-581
QFVLAARMDSFSTFRGAKGGDLSVLSSLVSLLLVAHSVGQKMDIFNRLASLSRRQLLFAFLHGESLGYIGSIFLVWDMGRGHFPAVAKNFSEESKNVRQIGVDELSFFMELQQIGASPKLYAHTDAQIYKQNKSLIDTVLHNAKGSGEHFHFVDPSSVPFGAAPPSSYHSIMKASDKVPGLILSSFGSADYEY

SEQ ID NO: 166311 - protein, 179 aa, Heterodera glycines
  misc_feature (108)..(108): Xaa can be any naturally occurring amino acid
  Homolog annotation: Hit_ID=NP_504498.1; Match level="QueryCoverage =83%, HitCoverage=45%, E-value=8e-44, Identity=59%"; Hit description =ADP ATP (5G168) [Caenorhabditis elegans] pir||T25728 hypothetical protein F25B4.7 - Caenorhabditis elegan
  Gene Ontology: Mol. function=adenine transporter activity; Cellular component=integral to plasma membrane; Biological process=transport
  Coding regions on vcDNA: vcDNA=SeqID_92734; Strand=+; Position=39-573
MHKNCVPMSSNVSNSPSTPPTNSVPQILLQQFGKDFVAGAVAACVAKTVIAPVERVKLILQLQTAQRTIAAASRYSSMVDCFVRLPREQGFLSFWRGNLSNIARAASXRQESLGMAFKELFKRWCVTESDRSANYRRFVAGNLLAGGLAGSVTFFFIYPLDFSRTRLAVDMGKDVATRE

SEQ ID NO: 166312 - protein, 136 aa, Heterodera glycines
  Coding regions on vcDNA: vcDNA=SeqID_92735; Strand=+; Position=80-490
MFPRLFAVGGAVTVMAVLLCMHTVVESAYTYQKLDDLMPELRQYLGRTHLGTLKARQYYDDDTAFQQQIRERKSNNLRNLMRIGKRSVPMPSQSLPADSGAKHAAELGVGAALGPIYYIPNDLVQAFRPQSVWLRR

SEQ ID NO: 166313 - protein, 204 aa, Heterodera glycines
  Homolog annotation: Hit_ID=CAE56281.1; Match level="QueryCoverage =77%, HitCoverage=88%, E-value=5e-43, Identity=51%"; Hit description =Hypothetical protein CBG23930 [Caenorhabditis briggsae]
  Gene Ontology: Mol. function=NADH dehydrogenase (ubiquinone) activity; Cellular component=membrane fraction; Biological process =growth
  Coding regions on vcDNA: vcDNA=SeqID_92736; Strand=+; Position=19-633
MQKYAAESLIRLQGVRPLFLSLRTLKELKNPFAAAILETPMEGQSKTFKQRNPIPLVDEPNKKSIKDILEPAKITGDLTQEIDPNKEIMEIGGVPEEHREGRNARIYMPARTAMQSGWDNTGVWKIELDERERWENATIGWASNADPLSNISMALSFASREDAINFCEKNRWSYIVEEPPSREIKPKAYGSNFSWNKRTRVSTK

SEQ ID NO: 166314 - protein, 26 aa, Heterodera glycines
  Coding regions on vcDNA: vcDNA=SeqID_92737; Strand=-; Position=3-80
EVEVNLVITDYCMPGMTGYDLLKKIK

SEQ ID NO: 166315 - protein, 65 aa, Heterodera glycines
  Coding regions on vcDNA: vcDNA=SeqID_92738; Strand=+; Position=46-243
MLLPRRPLPPRTVPKASVCGGFAPFCAKCPPPPPPRGRPSAVWSAAGTTTSSSTNSTTWVARTTI

SEQ ID NO: 166316 - protein, 209 aa, Heterodera glycines
  Coding regions on vcDNA: vcDNA=SeqID_92739; Strand=+; Position=11-637
GLKMSVCPLCDSPVPFGLAMLAPCHHVGHANCINNFVRHNGFCWVSNCAMPVLESDVLGLHIDSPQPNWIGLNDQQSVREVIGVIRQRLVGQSQCAANVTDNDFEEVANIFERLTSPRVNANTSGKTAADPSDEWQKLKDLLLKASPIIVFVVFALLCWYATPLVLSAGAALLEGVSSLVMGLGAFLRSFFPELVASGLAFFSAYVLGK

SEQ ID NO: 166317 - protein, 175 aa, Heterodera glycines
  Homolog annotation: Hit_ID=NP_510865.1; Match level="QueryCoverage =86%, HitCoverage=68%, E-value=3e-24, Identity=39%"; Hit description =androgen induced protein like (25.3 kD) (XS331) [Caenorhabditis elegans] emb|CAA20192.1| Hypothetical pro
  Coding regions on vcDNA: vcDNA=SeqID_92740; Strand=+; Position=10-537
KCRCFQLIQLLYHTTAAIVAICSIRPRSFMPKFHFIATAIVFPASFTVVMLFWGLYLMDPATVTRKEARFIFDFKWFNHALHTFPLFAMLLDFSIWHHRRPSKVSALKAILCFSLFYTIHIHFFYVCFNFWAYPILAQMSFRGRAWFILFCTIFMFCAFAIGDAFNRVLPRKLRV

SEQ ID NO: 166318 - protein, 108 aa, Heterodera glycines
  Coding regions on vcDNA: vcDNA=SeqID_92741; Strand=+; Position=282-608
MDTDAQLTDHIVNKHPEYMPNSLAANVAPATADSQIVPTYVDEQGELWRCVDIATNGELAEEMFQRNGAQPLQQQQQNEEVGRKGNLDTNLLINYNNCFFTIITFVSK

SEQ ID NO: 166319 - protein, 52 aa, Heterodera glycines
  Coding regions on vcDNA: vcDNA=SeqID_92742; Strand=+; Position=7-162
LTSVRSVGMFKFVHFFCSLATFPLLISAISSNCFYLPHIVLNGGTYDKFNAS

SEQ ID NO: 166320 - protein, 160 aa, Heterodera glycines
  Homolog annotation: Hit_ID=NP_501278.1; Match level="QueryCoverage =84%, HitCoverage=69%, E-value=4e-15, Identity=29%"; Hit description =putative protein, with a coiled coil-4 domain (4I530) [Caenorhabditis elegans] gb|AAB03148.1| Hypothetica
  Coding regions on vcDNA: vcDNA=SeqID_92743; Strand=+; Position=137-616
MNWFEPRVLRSARPFVPSGGERRDEVGKTGDDQAVVHMMCDLVLGEIQAEISRVEKEMERRRQDERRLTNQPDYSWLMDWRLRAKRPLSFRESSEVELLCSKVRAEEWRRLLKEWHIKVRFAESRDEVLDTFRALVDEMARERMRRKCVVQSVDEQQQLG

SEQ ID NO: 166321 - protein, 60 aa, Heterodera glycines
  Coding regions on vcDNA: vcDNA=SeqID_92744; Strand=-; Position=0-179
FVYFCDWFLIDRSIDHFSADRSFCPFAVPSLLLLSANCIVLGHNRRIGTRILFGNCLAPP

SEQ ID NO: 166322 - protein, 74 aa, Heterodera glycines
  Homolog annotation: Hit_ID=NP_498221.1; Match level="QueryCoverage =97%, HitCoverage=51%, E-value=2e-18, Identity=56%"; Hit description =ribosomal Protein, Small subunit (15.1 kD) (rps-12) [Caenorhabditis elegans] gb|AAK20077.1| Ribosomal pro
  Gene Ontology: Cellular component=eukaryotic 48S initiation complex; Biological process=protein biosynthesis
  Coding regions on vcDNA: vcDNA=SeqID_92745; Strand=+; Position=2-223
AAQTLDKREAHFCVLVKSCDEASFEKLVRSLCKEHIIPILEVEDKSKLCQMVGQCQYDKDGKARKILRCSVAVV

SEQ ID NO: 166323 - protein, 188 aa, Heterodera glycines
  Coding regions on vcDNA: vcDNA=SeqID_92746; Strand=+; Position=3-566
PIKMSSSVQRSLRPYIASSHQLNYHSEDNGGASAVNVCAELCAFLCANGFARAAKRRKTAPRIEENVTRDGNCLPAEMGNKKGRGVQLGLRSLLRFHNKRYTAPKSEEKTQRRLLVVLLDADFAKPIALRHVFALLALGPNSPSFFLLPGLSTSLSVPLNLPRISTVSFTSDGPPELVCLTAKIRKLL

SEQ ID NO: 166324 - protein, 106 aa, Heterodera glycines
  Homolog annotation: Hit_ID=NP_498638.1; Match level="QueryCoverage =97%, HitCoverage=17%, E-value=2e-36, Identity=66%"; Hit description =ALDH9B2, ALdehyde deHydrogenase (alh-12) [Caenorhabditis elegans]
  Gene Ontology: Mol. function=oxidoreductase activity, acting on the aldehyde or oxo group of donors, NAD or NADP as acceptor; Cellular component=cytosol; Biological process=carnitine metabolism
  Coding regions on vcDNA: vcDNA=SeqID_92747; Strand=+; Position=3-323
EIFGAVMLILPFKTEQEAIARANATQFGLASGLCTTNLARAHRVAAQLKVGTVFVNTYNDAEVHIPFGGFKNSGHGRENCVECLHEYSQVKSVYVNIDEGLQHNLG

SEQ ID NO: 166325 - protein, 116 aa, Heterodera glycines
  Homolog annotation: Hit_ID=CAE63542.1; Match level="QueryCoverage =93%, HitCoverage=95%, E-value=3e-11, Identity=29%"; Hit description =Hypothetical protein CBG08024 [Caenorhabditis briggsae]
  Gene Ontology: Mol. function=protein binding
  Coding regions on vcDNA: vcDNA=SeqID_92748; Strand=+; Position=250-597
MSQKSAAPSSPRPFTSSVPVPLHRSASYSPSVLANANKFLSDRPQLIDCPRCKQHGFTELKHVIGLFTWVSFLVLLITGLFVLPLFFLWVPFFIDTFKDVEHRCPNCKTHIGTFRR

SEQ ID NO: 166326 - protein, 210 aa, Heterodera glycines
  Homolog annotation: Hit_ID=1D4G; Match level="QueryCoverage=100%, HitCoverage=48%, E-value=4e-97, Identity=81%"; Hit description=Chain H, Crystal Structure Of S-Adenosylhomocysteine Hydrolase (Adohcyase) Complexed With A Potent Inhibitor D-
  Gene Ontology: Mol. function=adenosylhomocysteinase activity; Cellular component=cytoplasm; Biological process=one-carbon compound metabolism
  Coding regions on vcDNA: vcDNA=SeqID_92749; Strand=+; Position=1-630
INVNDSVTKSKFDNLYGCRESLIDGIKRATDVMIAGKVSVVAGYGDVGKGCAAALKGMGSRVIVTEVDPINALQAAMEGYEVTTMEEACREGNIFVTTTGCRDIITGEHFIHMKDDSIVCNIGHFDIELDVAWLKANAKSHSNIKPQVDRYLLANGRHIILLAEGRLVNLGCATGHPSFVMSNSFSNQVLAQIALWNAKPNEFPIGVHML

SEQ ID NO: 166327 - protein, 168 aa, Heterodera glycines
  Homolog annotation: Hit_ID=CAE61945.1; Match level="QueryCoverage =88%, HitCoverage=83%, E-value=1e-31, Identity=49%"; Hit description =Hypothetical protein CBG05943 [Caenorhabditis briggsae]
  Coding regions on vcDNA: vcDNA=SeqID_92750; Strand=+; Position=2-508
SFPPFSTSSALSKNVAGKFYNRRHLLKKNETLRLTYDMLRRPHHIGNHKAWMAWNTQNLKEFEQQPGLTIAQDEIIRRFCRALFFEFLPEIAGPTELVIKRRGNCAFVTGFLCWNDRTVASQRKLYWLWGFTEEILSNLLKHPLKLELQFVRSLDHLIVANIAPASSV

SEQ ID NO: 166328 - protein, 82 aa, Heterodera glycines
  Coding regions on vcDNA: vcDNA=SeqID_92751; Strand=+; Position=2-250
SFVPAPPPIPPIPPPPVPLNAIQLSGVNGMPKKKGRRPIPSRSNATYISQASQDIYQSNLLSGGGISQISQSSQLSQPYFGD

SEQ ID NO: 166329 - protein, 184 aa, Heterodera glycines
  Homolog annotation: Hit_ID=NP_503966.1; Match level="QueryCoverage =100%, HitCoverage=30%, E-value=3e-35, Identity=41%"; Hit description= CNT-like nucleoside transporter (63.5 kD) (5D941) [Caenorhabditis elegans]
  Gene Ontology: Mol. function=purine nucleoside transporter activity; Cellular component=integral to plasma membrane; Biological process =purine nucleoside transport
  Coding regions on vcDNA: vcDNA=SeqID_92752; Strand=+; Position=1-623
IEPSIITMTASEIHCMMTAGFACIAGALFSAYIALGNCPIHLLSATLMNSAISLGISKLVYPEVEHSQHKEAEKMKFAERDNEETILECITASSIRTSHFAIAIGANLVTYIALLAFLNSTIGWLGSMVGIAELSFNKILGFCFFPLAWAMGVSDAQNTEVMLDETMKVAELMGIKTALNEFIA

SEQ ID NO: 166330 - protein, 182 aa, Heterodera glycines
  misc_feature (13)..(14): Xaa can be any naturally occurring amino acid
  Homolog annotation: Hit_ID=CAE59725.1; Match level="QueryCoverage =100%, HitCoverage=99%, E-value=2e-79, Identity=75%"; Hit description= Hypothetical protein CBG03161 [Caenorhabditis briggsae]
  Gene Ontology: Mol. function=chaperone activity; Cellular component =endoplasmic reticulum; Biological process=mRNA splicing
  Coding regions on vcDNA: vcDNA=SeqID_92753; Strand=+; Position=3-552
SEWERLSEKLRHXXNPIVFFDIAEGGAPIGRITMELFGDVTPKTAENFRQLCTGELKKDGVPIGYKNSQFHRVIKDFMVQGGDFVNGDGTGMTSIYGPKFADENFEVKHSEPGILSMANAGPDTNGCQFFITCNKCDFLDAKHVVFGRVLDGLLTVRKIENVPTVQNNKPKIPIVIEQCGEL

SEQ ID NO: 166331 - protein, 168 aa, Heterodera glycines
  Homolog annotation: Hit_ID=NP_955890.1; Match level="QueryCoverage =97%, HitCoverage=41%, E-value=1e-29, Identity=43%"; Hit description =sirtuin 2 (silent mating type information regulation 2, homolog) 2 [Danio rerio] gb|AAH45510.1| Sirtuin 2
  Gene Ontology: Mol. function=DNA binding; Cellular component=nucleus; Biological process=gene silencing
  Coding regions on vcDNA: vcDNA=SeqID_92754; Strand=+; Position=153-656
MPNKEEVPKGSEEKVQNEAEVPNVEGVPSEAGSASQPSLYSQFVTSFESVINSLVSDDVATRPQQKLPSLDLEGVAAFIREERPEIVFMVGAGVSTSAGIPDFRTPGTGLYDNLKQYDIPNPQAIFDINYFRRNPEPFFVLANALFHESIMPTSAHHFIRLVADKGLL

SEQ ID NO: 166332 - protein, 196 aa, Heterodera glycines
  Homolog annotation: Hit_ID=CAE66975.1; Match level="QueryCoverage =69%, HitCoverage=26%, E-value=8e-44, Identity=60%"; Hit description =Hypothetical protein CBG12371 [Caenorhabditis briggsae]
  Gene Ontology: Mol. function=tRNA dihydrouridine synthase activity; Biological process=tRNA modification
  Coding regions on vcDNA: vcDNA=SeqID_92755; Strand=+; Position=27-614
MDQNAPQFGIDVLPSCSSVDEQKPADQQSSAEIICFVRKDAIIRPSAPFGADFLHWKSSFWRERITSIKNVVAPMVDQSELAFRMMLRSHSAHLCYTPMIHAHLFVTDPTYRKASFTTVDTDRPLIVQFCANDPQTLLSACRLVEGKCDGVDLNLGCPQLIAKKGRYGAFLQESPELIESMISAVHRHCHLPISAK

SEQ ID NO: 166333 - protein, 19 aa, Heterodera glycines
  Coding regions on vcDNA: vcDNA=SeqID_92756; Strand=-; Position=0-56
NIYVFKKHEKYKRIHKNNT

SEQ ID NO: 166334 - protein, 50 aa, Heterodera glycines
  Coding regions on vcDNA: vcDNA=SeqID_92757; Strand=-; Position=154-306
SALALSSLAPPAIVCGCAACCYCQWHCCWSQKRRARSSTAAVVTVFAERF

SEQ ID NO: 166335 - protein, 164 aa, Heterodera glycines
  Coding regions on vcDNA: vcDNA=SeqID_92758; Strand=+; Position=58-549
LFSNVFEQEFVMESAGSSSQPILNRDLQILVGEQIFTGICGPGQYISNGFFNLFEAGPTVKSSVVSVLSKMTVFTMNECRAQISSPTDKRKFLCIDFRKSSGYLFLNKLVQIMNESKGKFFEVLHLICLKGVYIERLFDIFLMLNDLTIINLPYEFDSFSRNGE

SEQ ID NO: 166336 - protein, 140 aa, Heterodera glycines
  Homolog annotation: Hit_ID=EAK81776.1; Match level="QueryCoverage =98%, HitCoverage=36%, E-value=3e-56, Identity=68%"; Hit description =hypothetical protein UM01034.1 [Ustilago maydis 521] ref|XP _398649.1| hypothetical protein UM01034.1 [Usti
  Gene Ontology: Mol. function=structural constituent of cytoskeleton; Cellular component=Arp2/3 protein complex; Biological process =intracellular protein transport
  Coding regions on vcDNA: vcDNA=SeqID_92759; Strand=+; Position=2-421
PGVIDNGTGYTKMGYAGNSDPQYILPTAIATAPTAAGASGAGAAKNLASKRGIEDLDFFIGDEAMGNAKTYNLQYPIRHGQIDNWDLMERYWEQSIFKYLRCEPEDHHFLLTEPPLNAPENREYTAEIFFESFNVPGMYI

SEQ ID NO: 166337 - protein, 61 aa, Heterodera glycines
  Coding regions on vcDNA: vcDNA=SeqID_92760; Strand=-; Position=4-189
IFEKQFIRNVRLRLMEAPLQATSISCSDNTHRRPALRCIRNPTVRIPPLCLCCASPNPRIV

SEQ ID NO: 166338 - protein, 191 aa, Heterodera glycines
  Homolog annotation: Hit_ID=NP_508212.2; Match level="QueryCoverage =60%, HitCoverage=29%, E-value=7e-20, Identity=42%"; Hit description =integrin precursor (XB733) [Caenorhabditis elegans]
  Coding regions on vcDNA: vcDNA=SeqID_92761; Strand=+; Position=59-631
MDLCSEGLPIMPTSATANDPQIERDVAAPTKQWERRRHFGRDGTFPLSAVCPPIFSVAAFFLLLSLCLSAEVALAQDESRQKCLSAEASKSCGACVSASVECAWCSDLRFNGTQRCDAKWAFAENERCAVTQLYSPSTEIKVAPQHNLPLGVKRADGVTVIQLEPQQVEIRMKPGDIVEVPFRYLHKLPLS

SEQ ID NO: 166339 - protein, 145 aa, Heterodera glycines
  Coding regions on vcDNA: vcDNA=SeqID_92762; Strand=+; Position=3-437
QIPSGNSSSFPIVSAKTTQIHTDSNFRTTKMPTTLAKTTPFFIDPPSNERIIFNDPRRQMKKHNSSREMGKSDAKTSEKEDKREGGEGEQSAKKMNQTEPIQPTLNHEATIGPQHLAIRRIRYPQMMEQRTALFRPSAASPMGRP

SEQ ID NO: 166340 - protein, 50 aa, Heterodera glycines
  Coding regions on vcDNA: vcDNA=SeqID_92763; Strand=+; Position=1-153
DDSAEEMRLVKSRMKGIMAHIRANEQLFTQIVQSLQLNTHQRTVLEQILA

SEQ ID NO: 166341 - protein, 99 aa, Heterodera glycines
  Coding regions on vcDNA: vcDNA=SeqID_92764; Strand=-; Position=2-298
HHKIKNSQVFFVCFVVFPTSLSALSLTISSFFSLIIRLTSVFTFACLTADAFFGGTIDLKPFLGPLVGAPFCARFIDFCFAPAGKVVFFFIPCCAICAA

SEQ ID NO: 166342 - protein, 162 aa, Heterodera glycines
  Homolog annotation: Hit_ID=CAE60750.1; Match level="QueryCoverage =81%, HitCoverage=94%, E-value=1e-21, Identity=40%"; Hit description =Hypothetical protein CBG04436 [Caenorhabditis briggsae]
  Coding regions on vcDNA: vcDNA=SeqID_92765; Strand=+; Position=54-542
MISSAGLLNAETNPTEDTHQQKQTDEPKYAMPTNNVSSHVLDIAVGRPAEGVKCTAYKWKMSEQRSEKNVTGDEHDEEGGTWELWGQTETNEQGRIAIVHPGKALSEGIFKLHFRTKEYFEGQKRNTFYPFIEIVFQIDDPTAHYHVPITLSNFGYSTYKGQ

SEQ ID NO: 166343 - protein, 68 aa, Heterodera glycines
  Coding regions on vcDNA: vcDNA=SeqID_92766; Strand=+; Position=66-272
KMSMTWPKYLGSYITLQNAFRMTLAALIPAVAKMYEDSEVARLTRFRDRSAMFGRPPPPPGVEEIPSW

SEQ ID NO: 166344 - protein, 82 aa, Heterodera glycines
  Coding regions on vcDNA: vcDNA=SeqID_92767; Strand=+; Position=85-333
MVRDAMASPQCQDPLNSAILRWELPRQKDTTWSVLFERAQALADQFPVKLKKATDGLPQIVDFSLTQNSLEQVFMSLTNVDV

SEQ ID NO: 166345 - protein, 42 aa, Heterodera glycines
  Coding regions on vcDNA: vcDNA=SeqID_92768; Strand=+; Position=1-129
QERAKEHSHLIQLGAIFLGFLVINALQLYEQLTNSGHHHHHH

SEQ ID NO: 166346 - protein, 86 aa, Heterodera glycines
  Coding regions on vcDNA: vcDNA=SeqID_92769; Strand=+; Position=20-280
MKPSFNFKLFASVFLVLCVASLVLCEHKRAAAAEACNHPKSAGTGNLALKRWWWDGRHCKQFTYKGQGGNTNNFPSKKHCDQVCKP

SEQ ID NO: 166347 - protein, 157 aa, Heterodera glycines
  misc_feature (148)..(148): Xaa can be any naturally occurring amino acid
  Homolog annotation: Hit_ID=BAC42496.1; Match level="QueryCoverage =100%, HitCoverage=72%, E-value=2e-76, Identity=81%"; Hit description= unknown protein [Arabidopsis thaliana] gb|AAO63298.1| At5g26220 [Arabidopsis thaliana] ref|NP_197994.1| C
  Gene Ontology: Cellular component=membrane; Biological process=cation transport
  Coding regions on vcDNA: vcDNA=SeqID_92770; Strand=+; Position=115-584
MVFWVFGYGSLVWNPGFDYDEKIIGFIKDYRRVFDLACIDHRGTPENPARTCTLEEKEGAICWGAAYCVRGGPEKEKLAMQYLERRECEYDRKTLVNFFKEGDSLHPTLTDVIVFTSTPDKVNNKYYLGPAPLEDMARQIATAYGPCXNNRDYIFLL

SEQ ID NO: 166348 - protein, 140 aa, Heterodera glycines
  Coding regions on vcDNA: vcDNA=SeqID_92771; Strand=-; Position=154-576
GAMTNMGSMKKERKKKSSPPPVQHANTINRCDTDSAGQHPHATSNALVLASTCCRCGVLPGIRPDSSPRPSSAAWSSFGPPRIESIHRVHDPDCAAGAGAGAETGGAGGGLVRACWKARKEDWNEDSAMVLIGRQALVCR

SEQ ID NO: 166349 - protein, 190 aa, Heterodera glycines
  Homolog annotation: Hit_ID=NP_491635.1; Match level="QueryCoverage =87%, HitCoverage=56%, E-value=2e-18, Identity=36%"; Hit description =carboxyl methyltransferase (1G151) [Caenorhabditis elegans] gb|AAB37832.1| Hypothetical protein M01E11.1
  Gene Ontology: Mol. function=C-terminal protein carboxyl methyltransferase activity; Cellular component=endoplasmic reticulum; Biological process=protein-membrane targeting
  Coding regions on vcDNA: vcDNA=SeqID_92772; Strand=+; Position=7-576
MSLCWPSHAIPKRFWSILWVDCRVRYAVLTFLFPNCSIPLVEPHLHSLLLTLLHHVLLVFICLFFVPMSRNRWKFNFQSFLLGVVNGWSIAFALVHSSRLHTVTFCIYAYFFSLFHFSEFLMTALTNVESLRPDSFLLDHSSAYWTAAICSWIEFWTRAWAFPTFCSLYISSIGVCCCICARIFSQIGNV

SEQ ID NO: 166350 - protein, 52 aa, Heterodera glycines
  Coding regions on vcDNA: vcDNA=SeqID_92773; Strand=+; Position=3-158
MTNEHFYDLLARAQKEPEPDYSNQFDAACAELLCKFKEGGKQLNHRVQKRMA

SEQ ID NO: 166351 - protein, 211 aa, Heterodera glycines
  Homolog annotation: Hit_ID=NP_494939.1; Match level="QueryCoverage =100%, HitCoverage=15%, E-value=3e-24, Identity=32%"; Hit description= phospholipase D, with tested activity similar to human phospholipase D2 [Nozawa group,Japanese Worm Meet
  Coding regions on vcDNA: vcDNA=SeqID_92774; Strand=+; Position=1-633
EAPSSVAVDDASFDYSAGGDELANKSTPRRRRGYIPYSTIYERQKGGYWVPGLQVEATIVHVERDVSSSYHILNPFIYTIELEHGRYKWRTIKRYKDFSALSSRLLAHRTAERIKAPVRRARNILEEVIEGNDDAEEEGKGEKPPHSQDNVLVRGLEFDESDERENGLRPDSTWDDLQGESSKTDEDLPMSSVPYFPMVPDSMIAEEHMEE

SEQ ID NO: 166352 - protein, 104 aa, Heterodera glycines
  Homolog annotation: Hit_ID=NP_505114.1; Match level="QueryCoverage =99%, HitCoverage=18%, E-value=8e-10, Identity=32%"; Hit description =carboxylesterase precursor family member (64.2 kD) (5I685) [Caenorhabditis elegans] gb|AAA96175.1| Hypoth
  Coding regions on vcDNA: vcDNA=SeqID_92775; Strand=-; Position=2-313
FYLWQYTQVISDLAFNLPIITELQHKLSRGWPIRFYIHGHVNEQSFPREVPIHESFHGNDLMSLFNSSVGQFPFNGPGKQIGQFLGGAFCRFVKRGNPSNLELF

SEQ ID NO: 166353 - protein, 157 aa, Heterodera glycines
  Coding regions on vcDNA: vcDNA=SeqID_92776; Strand=+; Position=23-493
FTTLLHFLLNLVALPISHTQIVCNMADSWQTETKDSDESGDRTNSAHQNESGNENWRLSAYQTQSTEEVPLPDDLSAIPVPTEHEMNPAWLIAQEALPSIGGRPDQHQQQHEQPQQFEGGSYEAAAALYGWPPTMGSSFNSYYHHQQQHMAYQDQQY

SEQ ID NO: 166354 - protein, 78 aa, Heterodera glycines
  Coding regions on vcDNA: vcDNA=SeqID_92777; Strand=-; Position=243-479
FFFLARAQILFKGGGSPPGALFQKKGPRGGKKGERPPPRGGFPPPNFFNIFSGGGGARIFNVLKWVLGPRLFLGETGL

SEQ ID NO: 166355 - protein, 193 aa, Heterodera glycines
  Homolog annotation: Hit_ID=NP_502402.2; Match level="QueryCoverage =98%, HitCoverage=61%, E-value=3e-29, Identity=37%"; Hit description =predicted CDS, inositol polyphosphate multikinase (4N313) [Caenorhabditis elegans] emb|CAB05842.2| Hypoth
  Coding regions on vcDNA: vcDNA=SeqID_92778; Strand=+; Position=44-622
MDVNAELPPDFEWYQNQIAGHLPSVIRNGVRQIGILHERGRTDVILKLVQEGIRGQREIGFYRRIAAICEGQGINCEETDEVEGTLLKELAMLIPRFYGCRQILLDENGPPKEFIQLEDVTEKFKCPCIMDVKMGRISADPLASEEKRMAEEVKSPLQKKIGFRILGHRVQNEDGLQISRERIWGRERTEENI

SEQ ID NO: 166356 - protein, 205 aa, Heterodera glycines
  Homolog annotation: Hit_ID=XP_510930.1; Match level="QueryCoverage =32%, HitCoverage=14%, E-value=4e-12, Identity=50%"; Hit description =PREDICTED: similar to hypothetical protein MGC13138 [Pan troglodytes]
  Gene Ontology: Mol. function=transcription factor activity; Cellular component=nucleus; Biological process=photoreceptor fate commitment (sensu Drosophila)
  Coding regions on vcDNA: vcDNA=SeqID_92779; Strand=+; Position=21-635
MNEHLRAENARLIQQQVNNVSSSSATSSAAGGSGGGIALPSANHPFVSPTSLVPQLEAANSFWQAVVGISSSSGSGGVGTTNDGNYAAGHQQQAVATSSALLFNRATTLTPAGIGSSSAADDDSKVGSSSRSAKLKRELRFHCDWPGCAYATAYGGDLNKHKRKHTGERPYQCDQCHATFGQHSSLSAHRYTHSDMKRFHCPQCE

SEQ ID NO: 166357 - protein, 38 aa, Heterodera glycines
  Coding regions on vcDNA: vcDNA=SeqID_92780; Strand=+; Position=22-135
TGRQKGIVTEETFALKDNDVINNNHTLVIFTNKSTNLV

SEQ ID NO: 166358 - protein, 155 aa, Heterodera glycines
  Homolog annotation: Hit_ID=CAE56797.1; Match level="QueryCoverage =98%, HitCoverage=60%, E-value=1e-54, Identity=48%"; Hit description =Hypothetical protein CBG24609 [Caenorhabditis briggsae]
  Gene Ontology: Mol. function=protein binding; Cellular component =nucleoplasm
  Coding regions on vcDNA: vcDNA=SeqID_92781; Strand=+; Position=2-469
TDPIKANQDAQRLWRAGEARLGTDEIAFNSILAVQNFAQLRMVFDEYQRQHGHSIEQAISNEFSGDIRDANLALVKSIRNRASYFAELLHNSMKGIGTRDTDLIRLVVTRSEVDLADIRQAYQNMYGTSLENAIASDCSGAYKDGLVAIVKGYYH

SEQ ID NO: 166359 - protein, 203 aa, Heterodera glycines
  Coding regions on vcDNA: vcDNA=SeqID_92782; Strand=+; Position=11-619
GLLIAKMCKKSFNKLLNSQKCSLALFIRHFFRFPTKFCQKISDQFMQNAITAEALSSLASPVHCFSTPMALAFIDHLRNEKQQNIVFVDAFTWLRWHFQCDRPYELSFTSSINSSDGIIDHFSRICFVRPFPFALLNFRFAILSPFTAFNLFGISTIGNEFTNVFLVNAICVESSPKFAPSFHVKLIDQHINSFPFECPLEPE

SEQ ID NO: 166360 - protein, 153 aa, Heterodera glycines
  Coding regions on vcDNA: vcDNA=SeqID_92783; Strand=+; Position=1-462
VFLFRRDLKQIFAALNVTISDTEQRDIEREYEKMKVIGNPKEMREEKPNERTHLLSEFEDEHMAKNNGGGQFGTKETVTAPIAEGGKGEEGTEASSNCNTTTTQWGTTGMSSDCNTTTAAAAQLEWHNEAEEQRTKNQLAKGKEEGDSGVIVP

SEQ ID NO: 166361 - protein, 112 aa, Heterodera glycines
  Coding regions on vcDNA: vcDNA=SeqID_92784; Strand=-; Position=35-373
AELHFGKVTNRLPALRGLGTEPRRSFALQKCCRFCPTPVLHGLEWSSECAPNCPVLESFVPLYRRGEKTVPKCVVNGQEKSQRRSPSSSCPPPPPPFAAVLVRPAFRQNSNP

SEQ ID NO: 166362 - protein, 198 aa, Heterodera glycines
  Homolog annotation: Hit_ID=CAE72607.1; Match level="QueryCoverage =77%, HitCoverage=38%, E-value=1e-51, Identity=61%"; Hit description =Hypothetical protein CBG19798 [Caenorhabditis briggsae]
  Coding regions on vcDNA: vcDNA=SeqID_92785; Strand=+; Position=45-638
MYYSLSQIENHLFLNSRDLNPNMAAGASTSRNLLNVASVEIAAQNECFTVWEPLQLRQEWTISNFAKALDLATPGICMRSKNFRDESMPEICWQLCLYPGGKREENSGNVSLFLKMSTTQSQREFTVRAEYHFYFVDEQGIAKFSNVNTGDFKVKPSKGSHSWGLRNIPRTKVKSCIRPDLSLHIVCQIELVPDFSKV

SEQ ID NO: 166363 - protein, 145 aa, Heterodera glycines
  Homolog annotation: Hit_ID=EAL21506.1; Match level="QueryCoverage =95%, HitCoverage=97%, E-value=2e-13, Identity=32%"; Hit description =hypothetical protein CNBD2000 [Cryptococcus neoformans var. neoformans B-3501A]
  Coding regions on vcDNA: vcDNA=SeqID_92786; Strand=+; Position=67-504
MSTLRFTPNPADAPTSHTLPGTHPEFSVHDAFRHGLHSVKHEVGAVAHHPLEPVLAQADQFAMQRKLTLQRQVYGLHAPLRVQMERSLLALKHQSPVFKSVNLGLEVMAGKDESIDVEDVLGDRDECVDDVDFHAVMERKLKIKV

SEQ ID NO: 166364 - protein, 132 aa, Heterodera glycines
  Homolog annotation: Hit_ID=NP_495844.1; Match level="QueryCoverage =96%, HitCoverage=16%, E-value=3e-19, Identity=36%"; Hit description =putative protein of bilaterial origin (2I960) [Caenorhabditis elegans] emb|CAA91257.1| Hypothetical prote
  Coding regions on vcDNA: vcDNA=SeqID_92787; Strand=-; Position=3-611
LSVVNHALQLPFVPTQCHDTLRAAVRIYLAWASALTASPHDCCPKHLLAHPDRYFRKILEALRHVFLDRPSAAHPSEFALCLSRQGAQIRIILNTVQHINATVVVEFKDECWSRSLLFLINTTDQLLSIGGS

SEQ ID NO: 166365 - protein, 176 aa, Heterodera glycines
  misc_feature (84)..(84): Xaa can be any naturally occurring amino acid
  Homolog annotation: Hit_ID=CAC21848.1; Match level="QueryCoverage =90%, HitCoverage=71%, E-value=1e-19, Identity=39%"; Hit description =hypothetical protein [Globodera rostochiensis]
  Coding regions on vcDNA: vcDNA=SeqID_92788; Strand=+; Position=3-532
ACHIGLKILGTQFLKVQKTDQSVGWSSVFATCCVPAESAGIFYFEVRIFHVLSCFTIGLATKQMPLAPQLAVPEHNSSSAPASXSRWHHPFVCIKPTQQGPTTLTTKRTTEFLCGDIVGFGIELANRRIFVTKNGRRLVIADLFFSAAQPLFPFVSLRDFGATIEANFGPNFKFNP

SEQ ID NO: 166366 - protein, 141 aa, Heterodera glycines
  Coding regions on vcDNA: vcDNA=SeqID_92789; Strand=-; Position=92-517
FNLEWIRILVWCWNFNLASDPPPPILGCTYTSNSLRHFCRCVLCVVLVLCPCTHAKHAPPKPLPSLIFLTSHLSISIFFTCQQFACSHQCLFYSDLGDGCGAEALSLSEGMGFVRIGWLCCKKATTAGGGWPAKDVVPASN

SEQ ID NO: 166367 - protein, 202 aa, Heterodera glycines
  Homolog annotation: Hit_ID=CAE72863.1; Match level="QueryCoverage =100%, HitCoverage=59%, E-value=9e-75, Identity=67%"; Hit description= Hypothetical protein CBG20162 [Caenorhabditis briggsae]
  Gene Ontology: Mol. function=tRNA methyltransferase activity; Cellular component=cytoplasm; Biological process=tRNA modification
  Coding regions on vcDNA: vcDNA=SeqID_92790; Strand=+; Position=30-635
MGKTSKDKRDIYYRLAKEEGWRARSAYKLLQIDEICKIFDGVFRVVDLCAAPGSWSQVLSKKLYVSEKDEEKRKRVKIVAVDLQPMAPLPGVIQLQGDITEVGTAQQIISYFDGSLAQLVVCDGAPDVTGLHAFDEYMQSQLVYSAFSITSHILQNGGTFVSKIFRAKNVNLLYAQMKCFFKEVSCCKPKSSRLSSCEAFIV

SEQ ID NO: 166368 - protein, 101 aa, Heterodera glycines
  Coding regions on vcDNA: vcDNA=SeqID_92791; Strand=+; Position=1-303
HNGTGTNIGSGTGNSHNGTGTLALRRPWGCPPLVRNVDRRRPRRSRKRTRGSYSDNSDGSAFTLFHGMHGSFDTWGTAGIDEWDQSAQSVHNYAMELMTLP

SEQ ID NO: 166369 - protein, 120 aa, Heterodera glycines
  Coding regions on vcDNA: vcDNA=SeqID_92792; Strand=-; Position=3-362
MHCWGDQIVRESGVIGTVGQHRDEWHKKGGTFGAKRTCSFGPNSVARKLQKPLGPGRSGGVNDTDNSGTAKGEHYQTVTGITLSVPHVVGKLFSWQFVFLFDDRLQLHNCNKKISRNIYL

SEQ ID NO: 166370 - protein, 43 aa, Heterodera glycines; identical to SEQ ID NO: 155978
  Coding regions on vcDNA: vcDNA=SeqID_92793; Strand=-; Position=2-130

SEQ ID NO: 166371 - protein, 105 aa, Heterodera glycines
  misc_feature (71)..(71): Xaa can be any naturally occurring amino acid
  Homolog annotation: Hit_ID=NP_505657.1; Match level="QueryCoverage =92%, HitCoverage=27%, E-value=9e-39, Identity=69%"; Hit description =actin like protein 2, Actin Related protein 2/3 compleX component ARX-2 (44.8 kD) (arx-2) [Caenorhabditis
  Gene Ontology: Mol. function=structural constituent of cytoskeleton; Cellular component=Arp2/3 protein complex; Biological process=actin filament organization
  Coding regions on vcDNA: vcDNA=SeqID_92794; Strand=-; Position=3-414
MVVAASRFGRPLVRSQQQLVNNIQIKDLMVGEECSELRHMLDVSYPMENGIVRNWDDMGHLWDYTFGPEKXEPPLNPNSNREKMFQVMFEQYGFHAIYIAIQVEP

SEQ ID NO: 166372 - protein, 139 aa, Heterodera glycines
  Homolog annotation: Hit_ID=NP_501783.1; Match level="QueryCoverage =91%, HitCoverage=23%, E-value=5e-21, Identity=45%"; Hit description =tbc1 domain family protein (56.5 kD) (4K665) [Caenorhabditis elegans] emb|CAB03042.1| Hypothetical protei
  Coding regions on vcDNA: vcDNA=SeqID_92795; Strand=+; Position=2-418
RRNWAHQNVPFPGSVKPVYGARYPPLQSSNESNETPAKTDNKFKNYEESVSDVWDPGVPVDDSLVLSAAAKVLERHAADFQTSGQSAGGTAMSQRHNAVMPVHYPSVPSRHSKMQAMQRLATQREPIPGVNPLPSSANS

SEQ ID NO: 166373 - protein, 196 aa, Heterodera glycines
  Homolog annotation: Hit_ID=AAL78214.1; Match level="QueryCoverage =75%, HitCoverage=75%, E-value=9e-11, Identity=28%"; Hit description =putative esophageal gland cell protein Hgg-20 [Heterodera glycines]
  Coding regions on vcDNA: vcDNA=SeqID_92796; Strand=+; Position=53-640
MNRRWICGDVWMDILPSFDHAQLGLKMALLSDRFDVLVDKHFDRKSELTIWRQIKISKDKGPKAKLSVEIGAKFVAFPLPNHSLPNKICFKDLRIDYIDHSVFAFLRSNKPILDRMGTKLEVFVHAIDTDVQPIWDVFIRQIWPLFAQNIHHLGFLDGDDLDNLCRRTSPTILTDLDQLISIDSGALFSDGIADDG

SEQ ID NO: 166374 - protein, 162 aa, Heterodera glycines
  misc_feature (45)..(45): Xaa can be any naturally occurring amino acid
  misc_feature (53)..(53): Xaa can be any naturally occurring amino acid
  misc_feature (78)..(78): Xaa can be any naturally occurring amino acid
  misc_feature (88)..(88): Xaa can be any naturally occurring amino acid
  Homolog annotation: Hit_ID=CAB88203.1; Match level="QueryCoverage =100%, HitCoverage=52%, E-value=4e-19, Identity=39%"; Hit description= putative cuticular collagen [Globodera pallida]
  Coding regions on vcDNA: vcDNA=SeqID_92797; Strand=+; Position=2-490
VCSLLAIITTDFHSDLLCYSDDRAQVNVGLRHTIEAFHFNTDSAXTDLMGLAXSCLPLANPRESPFNSLFIAKHPLPXDTDLLRHRPXRHNCPPDQPLAVAGPPGHSGFPPRTGQPLLSVQPVKAPPPCPTIIIRCLLCFDKSTRAPGGRGLLGQTCNASVP

SEQ ID NO: 166375 - protein, 70 aa, Heterodera glycines; identical to SEQ ID NO: 143743
  Homolog annotation: Hit_ID=CAE69217.1; Match level="QueryCoverage =97%, HitCoverage=94%, E-value=1e-15, Identity=54%"; Hit description =Hypothetical protein CBG15257 [Caenorhabditis briggsae]
  Coding regions on vcDNA: vcDNA=SeqID_92798; Strand=+; Position=25-237

SEQ ID NO: 166376 - protein, 198 aa, Heterodera glycines
  Homolog annotation: Hit_ID=CAE64726.1; Match level="QueryCoverage =81%, HitCoverage=45%, E-value=4e-26, Identity=38%"; Hit description =Hypothetical protein CBG09513 [Caenorhabditis briggsae]
  Gene Ontology: Mol. function=mRNA binding; Cellular component=snRNP U1; Biological process=regulation of transcription, DNA-dependent
  Coding regions on vcDNA: vcDNA=SeqID_92799; Strand=+; Position=39-632
MMTPHQDFHNSSVAMQQQQTLCPPESTLWMGDLKPEWDANFVREAFGENAGDVTNVKMRSTYCFVEFRDGPTARTAMLRVNGMTLPNDPSGTSRFNLAFANSPHHMSIEYNLFVNNLAPDVDDVALFRLFGERYMSCRGAKVYRNEDGASKEQGFVRFTSETDQQKALVELNKHKFHGRDLFLKLARPKTRGGPAEKR

SEQ ID NO: 166377 - protein, 182 aa, Heterodera glycines
  Homolog annotation: Hit_ID=NP_495003.2; Match level="QueryCoverage =93%, HitCoverage=93%, E-value=1e-40, Identity=45%"; Hit description =putative protein of bilaterial origin (2F649) [Caenorhabditis elegans] gb|AAN63414.1| Hypothetical protei
  Coding regions on vcDNA: vcDNA=SeqID_92800; Strand=+; Position=2-550
LKPFVFLFLILSSTKYICPNKHKDIRDYTDADIEKLYDQWEENDEDELPEDEKPPCQRKRPQIDLESLQQRTDSPDELLKLTKSGQTVMMFVSVKDQKSEGKTSKDFTDKISSLWLSNFHNNHIDAKVFIVDNDRVLYMFSEGSQAWDARDFLLSQPECVEVVLEGKTMAGKGSKEGKHTEF

SEQ ID NO: 166378 - protein, 204 aa, Heterodera glycines
  Homolog annotation: Hit_ID=CAE63596.1; Match level="QueryCoverage =100%, HitCoverage=39%, E-value=4e-74, Identity=65%"; Hit description= Hypothetical protein CBG08087 [Caenorhabditis briggsae]
  Gene Ontology: Mol. function=ATP binding; Cellular component=integral to membrane; Biological process=glucose transport
  Coding regions on vcDNA: vcDNA=SeqID_92801; Strand=+; Position=3-614
SPEFLIFGRLILGANMGLSTGLVPMYLMEITPTKYRGAAGTFHMVAVAFSDWFSLLLGLPEVLGSADNWPLAFAFPGFPAFLLCLVLPFCPESPKYTLFARGDHAKAMEDLKKLVDEDEAEFMYESLQSEAALMQDGSCCTFRQIFFEREFRLPLLITIVVMVTQQFTGCSAVFAYSTDMFIDAGLDPRTARFSTLAVGVAYFL

SEQ ID NO: 166379 - protein, 178 aa, Heterodera glycines
  Homolog annotation: Hit_ID=NP_732413.1; Match level="QueryCoverage =91%, HitCoverage=10%, E-value=1e-12, Identity=29%"; Hit description =CG31212-PA [Drosophila melanogaster] gb|AAF55658.2| CG31212-PA [Drosophila melanogaster]
  Coding regions on vcDNA: vcDNA=SeqID_92802; Strand=+; Position=14-547
MTGPPLSRKRRGAVPTRIEQLERMLDMTKFIDQLKRLIDQPIKIPGTLSIGPGQARNKQIPGKAKRDLLFFEDIWSERADRMADTSALYNTSDIGERKWLLDLLMEESDPDSGGEEHITEQDLKEIVKIHHKRRKFQKEYHSDLTNSQYTYYGAGLISAFDRFSENQKNVRKEFEVGT

SEQ ID NO: 166380 - protein, 109 aa, Heterodera glycines
  misc_feature (8)..(8): Xaa can be any naturally occurring amino acid
  Coding regions on vcDNA: vcDNA=SeqID_92803; Strand=-; Position=48-377
FFFFFFFXYFESFTENGDRNAFGWNTKTLLFARTELLRLLLLLGANCDPPAFACCGLGFGENLEPATFDWNSFGAGCGDPDFTKMFASKLANVSYFESFSFSYSNRSIG

SEQ ID NO: 166381 - protein, 181 aa, Heterodera glycines
  Homolog annotation: Hit_ID=NP_587996.1; Match level="QueryCoverage =79%, HitCoverage=69%, E-value=3e-36, Identity=51%"; Hit description =putative mitochondrial import inner membrane translocase subunit [Schizosaccharomyces pombe] emb|CAB53081
  Gene Ontology: Mol. function=protein transporter activity; Cellular component=mitochondrial inner membrane pre-sequence translocase complex; Biological process=protein-mitochondrial targeting
  Coding regions on vcDNA: vcDNA=SeqID_92804; Strand=+; Position=101-643
MSAAAAAPMDPRNQADSVSVASILDNVDLAAASKSLSPVGQLGSGVEYIFTNDVPFTGASGGFVPSRGWTDDLCYGTGTAYLSGLMVGGAWGFFQGLRTPLEIRSTKLRINAVLNGMTRRGPFVGNSVGMLAMIYNGLNSAISSQVEPQHKPVASIAAAAAAGALFKSTAGLRPMAITSLA

SEQ ID NO: 166382 - protein, 164 aa, Heterodera glycines
  Homolog annotation: Hit_ID=NP_104265.1; Match level="QueryCoverage =98%, HitCoverage=34%, E-value=4e-51, Identity=59%"; Hit description =glutamine synthetase [Mesorhizobium loti MAFF303099] dbj|BAB50051.1| glutamine synthetase [Mesorhizobium
  Coding regions on vcDNA: vcDNA=SeqID_92805; Strand=+; Position=2-496
VAGLLKYAAEYTFFLAPFINSYKRLQPNSWAPTKICWTVDNRTSSFRLCGQSSSNVHIECRIGGADLNPYLAFAALIAAGIAGIEEGLELPKAVACNVYASADAIPELPKSLRIAAELMANSEMLKRALGENVLRHYKNSACIELEDFEKEVTDWELRRAFDRC

SEQ ID NO: 166383 - protein, 165 aa, Heterodera glycines
  Homolog annotation: Hit_ID=CAE67311.1; Match level="QueryCoverage =90%, HitCoverage=42%, E-value=6e-21, Identity=38%"; Hit description =Hypothetical protein CBG12766 [Caenorhabditis briggsae]
  Coding regions on vcDNA: vcDNA=SeqID_92806; Strand=+; Position=2-499
SEDKGRVFGASHVPLPTMDEEAREQKIKELIAMTEETHRKRAERKRQRNEEEAEERRRLNRVRARMGLEPIPSSEDEEEEQKGAAEATELDVSAIPLPPSSPEAKTTKEPEQKKQRFGVREWDRGKIGCMRWAEEQRDEREDEFAPPSFYYGEENDARGKKKRKN

SEQ ID NO: 166384 - protein, 206 aa, Heterodera glycines
  Coding regions on vcDNA: vcDNA=SeqID_92807; Strand=+; Position=3-620
VAKLMTPEELTNPNVDEKSVMTYLSQFPRARPLYSASTRAPLEQQDSEGTTLDDSNQSDIPVPAIQPFSFDEEPLDNVGEECQQLTLSQMDDDDNNGVTTALTCVTKTTTSYTIGQQNEADDEFPNEPSLPTDMENIPQQNHQLYNLMVCESDLNDGIAETAAEPTTDFDAVRMTYRHEELQYEPLVVVSDEETVALGTTAVRPQP

SEQ ID NO: 166385 - protein, 140 aa, Heterodera glycines
  Homolog annotation: Hit_ID=AAV70960.1; Match level="QueryCoverage =61%, HitCoverage=12%, E-value=7e-09, Identity=43%"; Hit description =Vasa [Carassius auratus gibelio]
  Coding regions on vcDNA: vcDNA=SeqID_92808; Strand=+; Position=103-522
MMVLKSNIQRDKVRHNRFKLPERSHEDLFREKVRTGPAMKSLYENDELIDVRGGDGTALIMSDFDGFVPQLTKNIAEKGIERPTLIQKCVMPIILTKSEFDLLARAETGTGKTAAFLFPIIHLLESDRLAIGTKPSTGRK

SEQ ID NO: 166386 - protein, 104 aa, Heterodera glycines
  Coding regions on vcDNA: vcDNA=SeqID_92809; Strand=-; Position=1-312
FFFFFFFASVFYYQFHPTFPNQQINSFLPFFALLLRFTLSSSPKWAKLVLCSPHFRPFFLCSSVFPFLFFSTDLSRCPFASPPFCWANTQSEPFSRARNVSYSN

SEQ ID NO: 166387 - protein, 41 aa, Heterodera glycines
  Homolog annotation: Hit_ID=A34043; Match level="QueryCoverage=78%, HitCoverage=38%, E-value=2e-09, Identity=80%"; Hit description =hypothetical proline-rich protein 1 - polychaete (Owenia fusiformis) (fragment) sp|P21260|YPRO_OWEFU HYPOTHETI
  Coding regions on vcDNA: vcDNA=SeqID_92810; Strand=+; Position=3-128
HHKNAPPPAPDGDPPPPPPPGPPPPPPPPPPPGGGGRFSPR

SEQ ID NO: 166388 - protein, 184 aa, Heterodera glycines
  Coding regions on vcDNA: vcDNA=SeqID_92811; Strand=+; Position=69-620
MKPTAFLTATATATATACLLLLSCTGPAAAMPHPDPHPHPQNDCKACIEMIPACPACPAGELCARSSNTCQECASARCFKLAELAQLPPGFAPALGQQQPGTFTFPPMPTMSGGTVFSTSIGMTVINGTTVTPTATATPDTSSVSLTAPPTASPTGTQGAAGTGNGAGKSSGSSAAMALVVACV

SEQ ID NO: 166389 - protein, 65 aa, Heterodera glycines
  Homolog annotation: Hit_ID=NP_788670.1; Match level="QueryCoverage =98%, HitCoverage=43%, E-value=6e-19, Identity=67%"; Hit description =CG10851-PF, isoform F [Drosophila melanogaster] gb|AAN13578.1| CG10851-PF, isoform F [Drosophila melanoga
  Gene Ontology: Mol. function=pre-mRNA splicing factor activity; Cellular component=nuclear speck; Biological process=mRNA splice site selection
  Coding regions on vcDNA: vcDNA=SeqID_92812; Strand=+; Position=2-199
RIYVGHIPYEARERDVERFFKGYGRIHDILIKRGYAFVELDYPRDADDAAYDLNGRSLMGMRVLD

SEQ ID NO: 166390 - protein, 91 aa, Heterodera glycines
  misc_feature (33)..(33): Xaa can be any naturally occurring amino acid
  Homolog annotation: Hit_ID=CAE68692.1; Match level="QueryCoverage =94%, HitCoverage=9%, E-value=2e-16, Identity=47%"; Hit description =Hypothetical protein CBG14607 [Caenorhabditis briggsae]
  Coding regions on vcDNA: vcDNA=SeqID_92813; Strand=+; Position=32-304
QGAPIAFPRHSCTSGNECLVDSHCNGTICACRXGLLTLRIADSHNCVPGDPRKTRSTNNNGGLVIAFNPNNETDGSDSAAHNEQNVCVTTN

SEQ ID NO: 166391 - protein, 170 aa, Heterodera glycines
  Homolog annotation: Hit_ID=NP_499756.1; Match level="QueryCoverage =79%, HitCoverage=67%, E-value=7e-18, Identity=35%"; Hit description =polyposis locus protein 1 family member (3O468) [Caenorhabditis elegans]
  Gene Ontology: Cellular component=membrane; Biological process =membrane organization and biogenesis
  Coding regions on vcDNA: vcDNA=SeqID_92814; Strand=+; Position=3-512
STTSSASVVSVQLREVPIKDFKDVLPVLQKTLNELEHPFIKKAEEISGMEREKLFYITSSLVLLVLMLCPGNMLLSTLITVAYPMYASLLTLNTQNTSEYTQWLVYWCVFAEFCQFDYLFGSINGLLLLYVPLKTVFLLYLALPQTYGAHNLYVKHIRKVLAVTNVLDKM

SEQ ID NO: 166392 - protein, 152 aa, Heterodera glycines
  Homolog annotation: Hit_ID=CAE64382.1; Match level="QueryCoverage =75%, HitCoverage=16%, E-value=1e-18, Identity=42%"; Hit description =Hypothetical protein CBG09069 [Caenorhabditis briggsae]
  Coding regions on vcDNA: vcDNA=SeqID_92815; Strand=+; Position=92-547
MDRPFIMRSDGSALAVLRSPDRSLGGDALWHLCDGVPPTPFVSPTELGFTVFKHLCLSPDQRALYCLASGPRRASSLIRLDLSTDCHTVAVIREARAHSELSQLPLSVSSLITFTANGHSLEGYFYAPHSHTHCAPEGKLPPVVLFVHGGTT

SEQ ID NO: 166393 - protein, 128 aa, Heterodera glycines
  Coding regions on vcDNA: vcDNA=SeqID_92816; Strand=-; Position=12-398
FIFNNFLFHFCRQNFVQPGFSLSFFNPFICFFRFCLRIHAQVGGCWPSSKSLSAFNVSSWHSIFFCAGKQSRREEPIGSSVKHLSWFSMPKYFGGNAATPPTHLSTQPMSKRIQKTNGKLKKDFIFYQ

SEQ ID NO: 166394 - protein, 121 aa, Heterodera glycines
  Coding regions on vcDNA: vcDNA=SeqID_92817; Strand=-; Position=0-362
ASDQTTNGLVLLLFTDGTGGCCLIRLFMSTSLVNASSNVRTREAASSHLNWSPSNVPPPAAAAAMPLLLWLLLVTPLLPFCQRCAVPPPLLFIIIIAMKLDGSAAAAEAALSNSNDPAEAA

SEQ ID NO: 166395 - protein, 83 aa, Heterodera glycines
  misc_feature (70)..(70): Xaa can be any naturally occurring amino acid
  Homolog annotation: Hit_ID=CAB88204.1; Match level="QueryCoverage =100%, HitCoverage=27%, E-value=4e-23, Identity=61%"; Hit description= putative cuticular collagen [Globodera pallida]
  Coding regions on vcDNA: vcDNA=SeqID_92818; Strand=+; Position=2-250
CSLLAIIATVITLASLNSETYQMNLKVCAGVEAFRVHTDSTWTDLMDLRVVVTPATKPRDNPFNSVFFVXRPLPGLCQCSGLQ

SEQ ID NO: 166396 - protein, 78 aa, Heterodera glycines
  Homolog annotation: Hit_ID=CAB88203.1; Match level="QueryCoverage =100%, HitCoverage=26%, E-value=7e-33, Identity=87%"; Hit description= putative cuticular collagen [Globodera pallida]
  Coding regions on vcDNA: vcDNA=SeqID_92819; Strand=+; Position=6-242
MQETHIVLGIASVCSLLAIIATVVTLPSLYSEMSQMNSKVRDGVEAFRVNTDSAWTDLMDVQVVVTPPSKPRDNPFKA

SEQ ID NO: 166397 - protein, 146 aa, Heterodera glycines
  Coding regions on vcDNA: vcDNA=SeqID_92820; Strand=-; Position=2-439
IIAKVNFIVIGGCYLSVICRGRLIVGCCAELFDEYGIWSLSVAPFENGQFAERPFCVATDKRREEKACDGEHSIQMFVDKSAEGVEIRDNSAQFCADGGQFRRFRCACDGEQFGPQVLHFGGQCPFGPFLVQISSHFRRGLSVFPF

SEQ ID NO: 166398 - protein, 89 aa, Heterodera glycines
  Coding regions on vcDNA: vcDNA=SeqID_92821; Strand=-; Position=46-315
ALYFLYQDKYIQYMCTQNIHAKSVTKNQTSADRKYIIYEMIMIRDNSIQVAIVLRAHLLVIRSLNSFSARSVPRNGRSRIRKHRSNFVI

SEQ ID NO: 166399 - protein, 171 aa, Heterodera glycines
  Homolog annotation: Hit_ID=CAE71854.1; Match level="QueryCoverage =95%, HitCoverage=44%, E-value=1e-40, Identity=45%"; Hit description =Hypothetical protein CBG18898 [Caenorhabditis briggsae]
  Coding regions on vcDNA: vcDNA=SeqID_92822; Strand=+; Position=31-543
MGPLFSVRHLPLVLLLVLLLPSFLLSGMVNVCSDVKDCANCTRSFLNIFAFREYCMWCYSTNSCGGPLVCPSGVAVATRDPFKCPQKASTAKGRRYTDKLGRSLYALTLAAKQKDPSYCLKNSRSDVKVIKYYEVECDQAKNTCAGMIAVSEEAKALYIIYRDSTIDRQLL

SEQ ID NO: 166400 - protein, 53 aa, Heterodera glycines
  Coding regions on vcDNA: vcDNA=SeqID_92823; Strand=+; Position=299-457
QSSCGLPPKQGLSGPNVGLALQGGEGQPRRPAKPDRPVPTCPPQNIPCPRCPA

SEQ ID NO: 166401 - protein, 76 aa, Heterodera glycines
  Coding regions on vcDNA: vcDNA=SeqID_92824; Strand=+; Position=3-233
LYAENSKIADSLLAAHIDRSNQKGTINFCCIASKWDHLRALGTLRTRPIYRRHTRVVPSNIKYEKLFAMNVGINIF

SEQ ID NO: 166402 - protein, 153 aa, Heterodera glycines
  Homolog annotation: Hit_ID=NP_506658.1; Match level="QueryCoverage =96%, HitCoverage=65%, E-value=3e-24, Identity=38%"; Hit description =RETiculon protein (ret-1) [Caenorhabditis elegans] emb|CAB01523.1| Hypothetical protein W06A7.3b [Caenorh
  Gene Ontology: Mol. function=signal transducer activity; Cellular component=integral to endoplasmic reticulum membrane; Biological process=signal transduction
  Coding regions on vcDNA: vcDNA=SeqID_92825; Strand=+; Position=19-477
MGAKANNKRNGRVQYEPAKDFRGKMLELVYWRDPQKSGAVLASLFLCVYVFQHFSVLSVLINGALCLLLATVGFRVFKLAEAHFKKLPDASANPYQQYLDMEVAVPMDKLHHHVDLAVEYALFLAKKIRHIYLSDALLDSIKFGLILHSLSYV

SEQ ID NO: 166403 - protein, 60 aa, Heterodera glycines
  Homolog annotation: Hit_ID=CAE67084.1; Match level="QueryCoverage =98%, HitCoverage=22%, E-value=8e-11, Identity=57%"; Hit description =Hypothetical protein CBG12495 [Caenorhabditis briggsae]
  Coding regions on vcDNA: vcDNA=SeqID_92826; Strand=+; Position=50-229
RNLRRASASNNAKYPVDAAAVGGAVMGGPVGIAAGSLVAGIAAAVRGAFAGLYGGRVLKR

SEQ ID NO: 166404 - protein, 176 aa, Heterodera glycines
  Homolog annotation: Hit_ID=XP_233989.1; Match level="QueryCoverage =92%, HitCoverage=55%, E-value=9e-13, Identity=29%"; Hit description =similar to BCNT [Rattus norvegicus]
  Coding regions on vcDNA: vcDNA=SeqID_92827; Strand=+; Position=3-533
IAGEVEGNKVKELKAKEGEEEKAVDNGDESVEDDRAFGTKTPPASQLRQTPPLSASIRAPTVRKRCSAVFGARTSHTSTSGGGGGGLSALTSAMLGKKPRKQSVLDNAQSGWRSFVQEEQLEQEMESHMRSKDAYLDKQEFLLRADYSQFERERDLRAQERRVQQQQQANSGSKPR

SEQ ID NO: 166405 - protein, 129 aa, Heterodera glycines
  Homolog annotation: Hit_ID=ZP_00041351.2; Match level="QueryCoverage =96%, HitCoverage=16%, E-value=6e-37, Identity=56%"; Hit description =COG0620: Methionine synthase II (cobalamin-independent) [Xylella fastidiosa Ann-1]
  Gene Ontology: Mol. function=5-methyltetrahydropteroyltriglutamate -homocysteine S-methyltransferase activity; Biological process =cysteine metabolism
  Coding regions on vcDNA: vcDNA=SeqID_92828; Strand=+; Position=2-388
RVVQQKACLHLPPLPTTTIGSFPQRATVRAMLALFQAHKTADADYWAFINADTDRCIQMQDDIGLDVLVHSEFERHDMGEYFAEHLHGFCVTSNGWAQCYGSRCVKPPVLYGDVLKAGPKTVEMTQFAQ

SEQ ID NO: 166406 - protein, 93 aa, Heterodera glycines
  Coding regions on vcDNA: vcDNA=SeqID_92829; Strand=+; Position=214-492
LFYNNNSAFLIFLVIIFFSISLHSLSSLLFMVVPCPPPPFPCNCLIPKIPAQLTTPNQCLSPIYMISFVSSLPCSLNGTLRDDNLLFPEFNFR

SEQ ID NO: 166407 - protein, 172 aa, Heterodera glycines
  Homolog annotation: Hit_ID=NP_498684.1; Match level="QueryCoverage =99%, HitCoverage=20%, E-value=1e-85, Identity=86%"; Hit description =abnormal NuCLeoli NCL-1, regulator of rRNA synthesis and of cell and nucleolus size, RING finger and B-bo
  Gene Ontology: Biological process=oogenesis
  Coding regions on vcDNA: vcDNA=SeqID_92830; Strand=+; Position=2-517
FVVTERSPTHQIQIYNQYGQFIRKFGASILQHPRGVCVDSQGRIVVVECKVMRVLIFDMFFYILHKFSCSRYLEFPNGVCTTDKEEILISDNRAHSIKVFNYEGQFLRQIGGEGVTNYPIGVGINQLGEIVVADNHNNFNLTVFSQDGTLLSAFESKVKHAQCYDVALIDDS

SEQ ID NO: 166408 - protein, 154 aa, Heterodera glycines
  Homolog annotation: Hit_ID=CAE62750.1; Match level="QueryCoverage =81%, HitCoverage=73%, E-value=2e-17, Identity=36%"; Hit description =Hypothetical protein CBG06914 [Caenorhabditis briggsae]
  Coding regions on vcDNA: vcDNA=SeqID_92831; Strand=+; Position=12-476
MTNAEAELPDNAPKRRFINRGINRVELLGGVGGQPVVKQTAQGSAFASFNLYTNVDRRLSSGGTMTSTEVHNVIAFGVMARYVEKNVDRGTRVYLTGRLHYTGGQLNADGSRSPRICSVNLESIYPLSKPGAMYSLCGGGGGASREGADDGLKD

SEQ ID NO: 166409 - protein, 127 aa, Heterodera glycines
  misc_feature (52)..(52): Xaa can be any naturally occurring amino acid
  Homolog annotation: Hit_ID=EAA54824.1; Match level="QueryCoverage =95%, HitCoverage=15%, E-value=2e-20, Identity=38%"; Hit description =hypothetical protein MG05615.4 [Magnaporthe grisea 70-15] ref|XP _360241.1| hypothetical protein MG05615.4
  Gene Ontology: Mol. function=DNA binding; Cellular component =chromatin; Biological process=DNA replication
  Coding regions on vcDNA: vcDNA=SeqID_92832; Strand=+; Position=115-497
YLNKPTPIAILADKVNMLDTKLEDVLYTGFNWANMHQSRLSVVAISNTLDLXNGFFSQRIARPMGNNRLNFQPYEFKEIEEIIRGRLTECPEGAFDPKAIELASKKVAAISGDLHKAFELIRRGIDI

SEQ ID NO: 166410 - protein, 202 aa, Heterodera glycines
  Homolog annotation: Hit_ID=NP_510450.1; Match level="QueryCoverage =92%, HitCoverage=58%, E-value=3e-78, Identity=75%"; Hit description =succinyl-coa synthetase (33.8 kD) (XP373) [Caenorhabditis elegans] emb|CAA94107.1| Hypothetical protein C
  Gene Ontology: Mol. function=succinate-CoA ligase (ADP-forming) activity; Cellular component=mitochondrion; Biological process =succinyl-CoA metabolism
  Coding regions on vcDNA: vcDNA=SeqID_92833; Strand=+; Position=33-638
MSALPSPLLAFATSIRFCTSTRQNLKINQNTKVVVQGFTGKQGTFHGQQMIEYGTNVVAGVSPSKAGTEHFLKPIFATVKDARKKTGADASVIYVPAPFAAAAIDEAIDAEIPLVVCITEGIPQLDMVRVKNRLLKQNRTRLLGPNCPGIIAPGECKIGIMPGHIHEKGVIGIVSRSGTLTYEAVQQTTETGLGQTLCVGIG

SEQ ID NO: 166411 - protein, 187 aa, Heterodera glycines
  Homolog annotation: Hit_ID=NP_501273.2; Match level="QueryCoverage =85%, HitCoverage=45%, E-value=5e-37, Identity=52%"; Hit description =COLlagen structural gene (col-14) [Caenorhabditis elegans] gb|AAB03143.2| Collagen protein 14 [Caenorhabd
  Gene Ontology: Mol. function=structural constituent of cuticle; Cellular component=extracellular; Biological process=cuticle biosynthesis (sensu Nematoda)
  Coding regions on vcDNA: vcDNA=SeqID_92834; Strand=+; Position=8-568
AVIKWAPRKIREPLKAERQSLRPVAFAATCWATVAITSCLIIFPLIVHYIQTLEANVQLDLDFCKSRARDMFKEMFEIKTGGKGGEAAAARLANMAIQRRQLEKRDTLGDYWSRRLHDMALRDDPVDERAEGIGGRLGGSGGGATSPQAPTTGGVAKTAVTSNASKIGGTSSTRGGSSSSKESAPRA

SEQ ID NO: 166412 - protein, 57 aa, Heterodera glycines; identical to SEQ ID NO: 131660
  Coding regions on vcDNA: vcDNA=SeqID_92835; Strand=+; Position=94-267

SEQ ID NO: 166413 - protein, 176 aa, Heterodera glycines
  Coding regions on vcDNA: vcDNA=SeqID_92836; Strand=+; Position=2-532
MTDKREKKPSAQPQQQQHEDGAVQQQKGKGTNAKMAFDDEEELQDEETEQFYQQFAGSTTSSKLAAKSKKFSEDERNKYVGQFSVVMGMLQNVNHIEFDKTLARLSTNGDYRKAFPSAADLLAFITVNCPNIKAIKVSKQDVALLWSERSDELVSLLLQHVGKVILKKSVGKAYDY

SEQ ID NO: 166414 - protein, 191 aa, Heterodera glycines
  Coding regions on vcDNA: vcDNA=SeqID_92837; Strand=-; Position=39-614
LTNWTSADSRPFISFASSSEQFAMDAPARPLPLPKSATVGAKRRFLRHRIGRIFRLKHSEPRIYNWHLPSPTVVFVVCVGIVLLVPLGQREYHQWNFLRFRERFNSSCSLPEQFSCSSGVSFVICDCCRRWCASLSEKFARPPFLECVQSIGRQFEFIKVHAINKLGNDQKQNGQKGQKGRRSAKDGRECH

SEQ ID NO: 166415 - protein, 191 aa, Heterodera glycines
  Coding regions on vcDNA: vcDNA=SeqID_92838; Strand=+; Position=20-592
MSFKLILLIAVPMFVICCAILLKYWDRLKKPPKQQRDHRKIERVPEIVLTICSDEMSSDNQNEAEAKMAKAIFISADCWLCVFDLLTPSQLGHGIAMISHRFDFYVDEHFKTRKWTLKPIQIEITIGENGTKEMEIVNDDGEALPIPKMKMPRKVIGFKRIEISFIDKNVIAFLHRFGQLFAVCPINLFIG

SEQ ID NO: 166416 - protein, 167 aa, Heterodera glycines
  misc_feature (34)..(34): Xaa can be any naturally occurring amino acid
  Homolog annotation: Hit_ID=NP_499799.1; Match level="QueryCoverage =89%, HitCoverage=20%, E-value=6e-40, Identity=57%"; Hit description =fatty acid Coenzyme A ligase (75.8 kD) (3O630) [Caenorhabditis elegans] emb|CAA21744.1| Hypothetical prot
  Gene Ontology: Mol. function=long-chain-fatty-acid-CoA-ligase activity; Cellular component=peroxisome; Biological process =gametogenesis
  Coding regions on vcDNA: vcDNA=SeqID_92839; Strand=+; Position=13-514
EKPGHVLKGREENIDRKKHIFKLAQGEYVAPEKXIKSVYVQCPLVQQVYVDGDSLERNLVAIVVPPEKTLKRLYKELHGTAQNGDLEKRFQEICTDKKIVEAVLKQMQQMGKEQKLSSIEQVKAIFLEVEPFSVENGLLTPTLKSKRPQLRQKYREQIAALYRTGEK

SEQ ID NO: 166417 - protein, 128 aa, Heterodera glycines
  Homolog annotation: Hit_ID=CAE66693.1; Match level="QueryCoverage =96%, HitCoverage=89%, E-value=2e-33, Identity=50%"; Hit description =Hypothetical protein CBG12033 [Caenorhabditis briggsae]
  Gene Ontology: Mol. function=calcium ion binding; Cellular component =extracellular space; Biological process=protein folding
  Coding regions on vcDNA: vcDNA=SeqID_92840; Strand=+; Position=2-385
FRPTPGPRWREEDGLEIEVTHKIEESACRRSAPGDTIHQHYTLNLADGTFIDSSFSRSKPFIFRLHHGEVIAGMDRAMTSMCEGERRRVVIPAALGYGGQGRDNIPRRRHSLLLTLSCANLIKPTAEE

SEQ ID NO: 166418 - protein, 127 aa, Heterodera glycines
  misc_feature (62)..(62): Xaa can be any naturally occurring amino acid
  Homolog annotation: Hit_ID=CAA65474.1; Match level="QueryCoverage =98%, HitCoverage=65%, E-value=4e-18, Identity=42%"; Hit description =collagen [Globodera pallida]
  Gene Ontology: Mol. function=structural constituent of cuticle; Cellular component=collagen type III; Biological process=cuticle biosynthesis (sensu Nematoda)
  Coding regions on vcDNA: vcDNA=SeqID_92841; Strand=+; Position=2-382
YYIFFAKLQLPRRLSTQRGLQHSRCSPGSSGPFGPPGQPGTFCEAHDRPDSAGQPGKTAPPXPTKKIPWPHWPAGPPCRLGETGPPGEQREPAKPVTPDYGGGPVTPRAAGPQGQSVLPGLPRGSGQ

SEQ ID NO: 166419 - protein, 191 aa, Heterodera glycines
  Homolog annotation: Hit_ID=CAE60421.1; Match level="QueryCoverage =36%, HitCoverage=3%, E-value=2e-10, Identity=43%"; Hit description =Hypothetical protein CBG04027 [Caenorhabditis briggsae]
  Coding regions on vcDNA: vcDNA=SeqID_92842; Strand=+; Position=3-578
NVNKLRSVLIGQEVTESSGAGPEAADTSGGSSRSGGHSPAFSPQLVRPHFEFVDLGGGSFIKVVSSEACALLSALTELIKKGEPEDVLLERVPLLLATLLQVLAALVDTQYSSAQKHAVVPERDATVGNGNGRKRRFRLIDDDHSMPTISEQQRHSFIITDCSKFCCYCCGFNDAVYAHNGFRRRCNAITY

SEQ ID NO: 166420 - protein, 149 aa, Heterodera glycines
  misc_feature (99)..(99): Xaa can be any naturally occurring amino acid
  misc_feature (105)..(105): Xaa can be any naturally occurring amino acid
  misc_feature (123)..(123): Xaa can be any naturally occurring amino acid
  Homolog annotation: Hit_ID=CAB88203.1; Match level="QueryCoverage =100%, HitCoverage=50%, E-value=4e-42, Identity=59%"; Hit description= putative cuticular collagen [Globodera pallida]
  Coding regions on vcDNA: vcDNA=SeqID_92843; Strand=+; Position=2-451
HIVLWIASVCSLVNIIATVGTLPSLYSEMRQMNNKVRDGLEGFGVNTDSSCTDLMDVQVDMTPTSKPRDNPFNSIFFVKRQLAGHCQCACLPLVRCRTXPPRPDXLPGTAGPDGRGRTGREGXQGQPGSPLSGWTKMVPLAPFGPRGKP

SEQ ID NO: 166421 - protein, 62 aa, Heterodera glycines
  misc_feature (38)..(38): Xaa can be any naturally occurring amino acid
  misc_feature (54)..(54): Xaa can be any naturally occurring amino acid
  Homolog annotation: Hit_ID=CAB88203.1; Match level="QueryCoverage =98%, HitCoverage=20%, E-value=1e-14, Identity=60%"; Hit description =putative cuticular collagen [Globodera pallida]
  Coding regions on vcDNA: vcDNA=SeqID_92844; Strand=+; Position=2-187
EMSQMNSKVRDGDEAFPRSTDSAWPDLMDVHPAATPPXKPRDHPCDSIFFAKRXLSGNCQCA

SEQ ID NO: 166422 - protein, 77 aa, Heterodera glycines
  misc_feature (32)..(32): Xaa can be any naturally occurring amino acid
  Homolog annotation: Hit_ID=CAB88203.1; Match level="QueryCoverage =98%, HitCoverage=25%, E-value=3e-14, Identity=52%"; Hit description =putative cuticular collagen [Globodera pallida]
  Coding regions on vcDNA: vcDNA=SeqID_92845; Strand=+; Position=2-232
STCSLMGIWATRMDLASVLSERTPMNTRVHDXIHVFHSNACSNWTDLMDVQVAVTSTTECRDKPFNSILGARSLLPS

SEQ ID NO: 166423 - protein, 80 aa, Heterodera glycines
  Coding regions on vcDNA: vcDNA=SeqID_92846; Strand=-; Position=1-240
FSVASICPFLSLCLSSAPLALIRFVFFVCVRSNGCPRADQCPGDQSGRFNAPFSSSNCFRLRWRQSLRRCRPPAQHQLGL

SEQ ID NO: 166424 - protein, 46 aa, Heterodera glycines
  Homolog annotation: Hit_ID=CAA65474.1; Match level="QueryCoverage =100%, HitCoverage=15%, E-value=3e-09, Identity=60%"; Hit description= collagen [Globodera pallida]
  Coding regions on vcDNA: vcDNA=SeqID_92847; Strand=+; Position=2-139
TERTELMDVQVVETTPRKTRDNPFNSIFCAKRRMSGHCQCAGLKQP

SEQ ID NO: 166425 - protein, 79 aa, Heterodera glycines
  Coding regions on vcDNA: vcDNA=SeqID_92848; Strand=+; Position=146-382
MALNRSHLLTFDVNSLIAIYSLSLSLENDQSADSLSLECLAEIRIAEFLPHPNCLVSMDQTRLNFYSDAVPFCDDLDSL

SEQ ID NO: 166426 - protein, 200 aa, Heterodera glycines
  Coding regions on vcDNA: vcDNA=SeqID_92849; Strand=+; Position=1-600
FKMSDEIKELKAITLQILKNQTLMIAHLVNQARQNKPQQHVQPPLMLKQVKTEPCEPPSTVSKRKAPSAVEQPLNEISFINKNNGGCATVNKRRRMSAPNTAGMATKQNNTKFCKICDAVVDENSLVSHIWEHILKKMMKEKADLSNAYSFVCDVNGCVFRTNKLEAAGGHAIKHPEVERNKVVLDNRENSEPLFLATLA

SEQ ID NO: 166427 - protein, 117 aa, Heterodera glycines
  misc_feature (69)..(69): Xaa can be any naturally occurring amino acid
  misc_feature (99)..(99): Xaa can be any naturally occurring amino acid
  misc_feature (109)..(109): Xaa can be any naturally occurring amino acid
  Homolog annotation: Hit_ID=CAA65474.1; Match level="QueryCoverage =96%, HitCoverage=38%, E-value=2e-23, Identity=47%"; Hit description =collagen [Globodera pallida]
  Coding regions on vcDNA: vcDNA=SeqID_92850; Strand=+; Position=2-355
RTRPDRVQAFRPSPSLPGMPCMDVQGVERTPTKGRDNPLPSNFRALCCLPAHCQCPGLRRAGCPPGPPXPTGPDGQSGHPGGGGPPGHSEDPGHPTPRXSSQNVPRPRXPARAPGRP

SEQ ID NO: 166428 - protein, 103 aa, Heterodera glycines
  Coding regions on vcDNA: vcDNA=SeqID_92851; Strand=+; Position=1-312
QSSWRLQPKQGLFGAEVGMPLEGLESPRTWTTLSNLRLGTCFSKRVAFCRLTWKCVTFSTIQIRQLLFKTTLTQFPIVSTTVVTFWSDDSQKLKTQPCQFFEF

SEQ ID NO: 166429 - protein, 62 aa, Heterodera glycines
  Homolog annotation: Hit_ID=CAE62810.1; Match level="QueryCoverage =91%, HitCoverage=17%, E-value=3e-14, Identity=62%"; Hit description =Hypothetical protein CBG06986 [Caenorhabditis briggsae]
  Gene Ontology: Mol. function=structural constituent of cuticle; Cellular component=extracellular; Biological process=cuticle biosynthesis (sensu Nematoda)
  Coding regions on vcDNA: vcDNA=SeqID_92852; Strand=+; Position=5-193
RTRENGQPGQSGNPGPQGYPGDGGSPGQPGNPGGSCEPGQPGAQGSSGQCYHCPCYNTAPGY

SEQ ID NO: 166430 - protein, 192 aa, Heterodera glycines
  Homolog annotation: Hit_ID=AAL78214.1; Match level="QueryCoverage =77%, HitCoverage=79%, E-value=2e-13, Identity=32%"; Hit description =putative esophageal gland cell protein Hgg-20 [Heterodera glycines]
  Coding regions on vcDNA: vcDNA=SeqID_92853; Strand=+; Position=71-646
RNGKRDLHLCRLLAQSVRFAAALSGLGIAMISRRFDYYVDEHFKTRKWTLGVMKIQSKIVQNGAKKMEIVNSDGKELPIPQNPLPNKVIGFRNIWIFFLDHNVLIFLRHFHRFFPTCATKLEVETENVRVSEFLLLNIWPMLKDTIREMSLDDFNRRQIRQLAPSMLNDCQSLISVTFYGPIYPEFPPDDSA

SEQ ID NO: 166431 - protein, 119 aa, Heterodera glycines
  misc_feature (34)..(34): Xaa can be any naturally occurring amino acid
  misc_feature (38)..(38): Xaa can be any naturally occurring amino acid
  Homolog annotation: Hit_ID=CAB88203.1; Match level="QueryCoverage =61%, HitCoverage=24%, E-value=1e-17, Identity=57%"; Hit description =putative cuticular collagen [Globodera pallida]
  Coding regions on vcDNA: vcDNA=SeqID_92854; Strand=+; Position=2-358
VGIASHCSVVAILDTLVVIPQLCPTIYEMNNRVXDGVXAFRVQTDSAWTEMMLVHISVTPPTHLREHPFNSIFLRASFYGIASPMRFRDCSISCPSWSMPGAVWARPRHPGRATGGVGG

SEQ ID NO: 166432 - protein, 190 aa, Heterodera glycines
  Coding regions on vcDNA: vcDNA=SeqID_92855; Strand=+; Position=7-579
MRIYFCLIFYFCCFSLLVCRPKKAKTKKPKNKKFDYNKLRDPDRKGCYGGTADFHYFGNKSEAVDNSKCIRWLSVTKWIMHQFRGYQLYYFADEFTEHNHCRNIDLTIYTPNPKLSNASAHLFLGYDEQIAKGPWCYVEKKGDMPEHLTAKWKGYHLTDPGNSKKTIRFPDKINQLKMKYEPKPCFKMCK

SEQ ID NO: 166433 - protein, 161 aa, Heterodera glycines
  Homolog annotation: Hit_ID=CAE65236.1; Match level="QueryCoverage =100%, HitCoverage=99%, E-value=1e-72, Identity=74%"; Hit description= Hypothetical protein CBG10119 [Caenorhabditis briggsae]
  Coding regions on vcDNA: vcDNA=SeqID_92856; Strand=+; Position=51-536
MDESAKKTLKQIPLLKTNAGPRDGPLWLERLKEEYNSLIAFIEHNKQGDADWFRLESSADGTRWFGKCWTYHNKIKYEFDVEFDVPITYPKTAPEIALPELDGKTAKMYRGGKICLSDHFKPLWARNVPKFGIAHAFSLGLGPWMAVEIPDLIERGVLTLK

SEQ ID NO: 166434 - protein, 193 aa, Heterodera glycines
  Homolog annotation: Hit_ID=NP_496819.1; Match level="QueryCoverage =96%, HitCoverage=33%, E-value=6e-20, Identity=32%"; Hit description =GLP 480 24400 23237 like (2N663) [Caenorhabditis elegans] emb|CAB60423.1| Hypothetical protein Y48C3A.20
  Coding regions on vcDNA: vcDNA=SeqID_92857; Strand=+; Position=1-579
VNFVLALNVPMSVLLREAVVERLVEPAWAAMSMSPKELLSRQLMPKIGKATGLRPSLNSDLTLTVTLENDEFVQSDFDFLVLYFPDEFMRGHAPKRRRRGGGSRTPNSGGTNVVVEDHAVVDMASSLLTKMKIKAARDQMSRAVANIFKFSPASLPCTCKSVTLERLPLFIGGRYCKYSRALPQSPWIGASDE

SEQ ID NO: 166435 - protein, 120 aa, Heterodera glycines
  misc_feature (6)..(6): Xaa can be any naturally occurring amino acid
  misc_feature (27)..(27): Xaa can be any naturally occurring amino acid
  misc_feature (57)..(57): Xaa can be any naturally occurring amino acid
  Homolog annotation: Hit_ID=CAH72141.1; Match level="QueryCoverage =98%, HitCoverage=70%, E-value=3e-43, Identity=66%"; Hit description =OTTHUMP00000060266 [Homo sapiens] gb|AAD34121.1| CGI-126 protein [Homo sapiens] sp|Q9Y3C8|CGC6_HUMAN Prote
  Coding regions on vcDNA: vcDNA=SeqID_92858; Strand=+; Position=3-361
MEKTLXSFPLLKTNAGPRDGPLWLERXKEEYNSLIAFIEHNKQGDADWFRLESSFFXFTRWFGKCWTYHINTPYEFHVEFDVPMTYPKTAPKIALPELDGKTAKMYRGGKICLSDHFKPL

SEQ ID NO: 166436 - protein, 210 aa, Heterodera glycines
  Coding regions on vcDNA: vcDNA=SeqID_92859; Strand=+; Position=3-632
SLRSPDPRICAKFACDGTTDPIRNGQSSLFQQRRNYENVNSTTFCAPATEEIEEDGICKTDDDSFNDYEFFHPRQTTCSTIRGEEAEAKREKKGTEDNNNLSSSSSVSTITAMTRTKTLPNGAKQHEEGHKKRSLHQEPLSRKKSSNQVLERSSLISSPSSDHTELEVFHPSDCSLAPSSSSCSSSDSLENHRQSRHCPELANNLQSQSH

SEQ ID NO: 166437 - protein, 170 aa, Heterodera glycines
  Coding regions on vcDNA: vcDNA=SeqID_92860; Strand=-; Position=23-535
DACDVTAVTNARFKDQCLVQKCNFSHFDTPSDRTATQRLRSSELIAIMVDRRRRKSDDHFDQKQCLVSNWVSDLIFRNRSLSGSNLLMFLGSCTSSTDLLGSIHTISPQLNQTVYSEAQRGNLYSLRGEREFQTQMSDFPAPNSTPRVTIPTIFDFLCELELESISKLRF

SEQ ID NO: 166438 - protein, 59 aa, Heterodera glycines
  Coding regions on vcDNA: vcDNA=SeqID_92861; Strand=-; Position=102-281
IYNDREGVNLANGEKNLSRHRRHHHHHTAPPIDKFCDQKVPCALFRADGGGAARRRRRF

SEQ ID NO: 166439 - protein, 146 aa, Heterodera glycines
  misc_feature (80)..(80): Xaa can be any naturally occurring amino acid
  Homolog annotation: Hit_ID=CAE58447.1; Match level="QueryCoverage =97%, HitCoverage=18%, E-value=1e-12, Identity=36%"; Hit description =Hypothetical protein CBG01584 [Caenorhabditis briggsae]
  Coding regions on vcDNA: vcDNA=SeqID_92862; Strand=+; Position=160-598
MDDEELEDESESDEEEEQQMVKSLKAGTPTVAQTQQQIANAKSAVPSKKEQLSTQTDKYKGIAAEEERRRAERDKVTLFXRCETLQKMTDGEIKALHPDALAVRTNNRAFCWMVFASEPTADKAFAVLSKKGRIGGKELYVDKCGT

SEQ ID NO: 166440 - protein, 123 aa, Heterodera glycines
  Coding regions on vcDNA: vcDNA=SeqID_92863; Strand=+; Position=51-422
SGGNECLRPCHSTQEYAQVNLNIAGYTVRSLIYFVDDSEFTVARDYSVIVGWDVFEKLPPIKFDHLNGKFFVGDNESKLCYRSILTERFARVGREKHTHSGRLPNIGRCFNRIIPKPKKFILH

SEQ ID NO: 166441 - protein, 136 aa, Heterodera glycines
  Homolog annotation: Hit_ID=CAE63953.1; Match level="QueryCoverage =52%, HitCoverage=15%, E-value=3e-10, Identity=50%"; Hit description =Hypothetical protein CBG08535 [Caenorhabditis briggsae]
  Coding regions on vcDNA: vcDNA=SeqID_92864; Strand=-; Position=47-457
AAQGQPTRQKKFAEVKTWHGGYISNFLNLFTERDKRTATKHSPYVQRYIDKVLALNRSLSQTTTPPAPTNPPWTTTTNPPRTTTTNPPRTTATITKTRSTIWSTKATTRPNAWTTTTTPMSRTMDYRTTTAAHSGN

SEQ ID NO: 166442 - protein, 141 aa, Heterodera glycines
  Coding regions on vcDNA: vcDNA=SeqID_92865; Strand=-; Position=153-578
KRGNERRSGVPERRRWRCWWRSRKDCSISKTLGRSSTRGNSLCSAFGWNVKYCCCCCFCRSSPPSRRKVPPFASANVCLCWVAYLFSWMPIGSRSPPPPPCCSVTAFADGKKVPEGRGRRWQTGNERGEAQQQHWSAAQRR

SEQ ID NO: 166443 - protein, 193 aa, Heterodera glycines
  Homolog annotation: Hit_ID=CAE70871.1; Match level="QueryCoverage =100%, HitCoverage=62%, E-value=2e-24, Identity=31%"; Hit description= Hypothetical protein CBG17660 [Caenorhabditis briggsae]
  Gene Ontology: Mol. function=peroxidase activity; Cellular component =extracellular space; Biological process=thyroid hormone generation
  Coding regions on vcDNA: vcDNA=SeqID_92866; Strand=+; Position=1-579
ERWLRSGLSQEKADADNDYDLNLDGTTLNEFAAAVGLFYLTMFDGKLAHLSADGIRSMDRPLSEWMYEPSPLMFSERIDGIFRFLLRQPGLMPGLHMSGELRDKLFRQGGPHGLDLAALIVQMGRDHGLPGYTRVREACGEMPQVKSFDDLAEIVVEPKRILPILARHFRRVQDVDLFLLGLAERPRRGALVG

SEQ ID NO: 166444 - protein, 61 aa, Heterodera glycines
  Coding regions on vcDNA: vcDNA=SeqID_92867; Strand=-; Position=75-260
RRFLSKLSTPKVSSPPEKVLLLFCCCCCFSLASFRSNGISAQLLSFWSSTCRPNSDGGGER

SEQ ID NO: 166445 - protein, 73 aa, Heterodera glycines
  Coding regions on vcDNA: vcDNA=SeqID_92868; Strand=+; Position=359-577
VSQQKGVSQREVAKFPVFPSNNIFIHFFKMYVNPKNILFLLQKYFKKYNEETSLNDPEIAIAKNFASEIERCL

SEQ ID NO: 166446 - protein, 149 aa, Heterodera glycines
  Coding regions on vcDNA: vcDNA=SeqID_92869; Strand=+; Position=30-476
VPINYLSSFDLAMSLALCAAPFFLFALSSASPPFLATFNGCPQLIDGQLLDFVNSGGIRLTKSKTGNCDRLISCDLIGAPVELTKVEWYVNGRKIQRTNEGTEREETAENAQSENERTERSAIGVGEVSHRFCADNWLVDEPSLNENGM

SEQ ID NO: 166447 - protein, 101 aa, Heterodera glycines
  Coding regions on vcDNA: vcDNA=SeqID_92870; Strand=+; Position=171-473
NSGSLPPFPRFFPSLPFPPLFYLPFPSLSFPLLSPRFSLLPFSPPFSWQIKAFPSINFSFPILIAEGCQPPFRCPPLFSFSDSDCERFFRFSIHSPLYTGG

SEQ ID NO: 166448 - protein, 150 aa, Heterodera glycines
  Coding regions on vcDNA: vcDNA=SeqID_92871; Strand=+; Position=37-489
SFYHCLTNHLTDHSHFDILLHPSISICQMPQHSITKSILPCHPSPYPKNAIKIKHRLRRALLGPCFAVVLPPPPPSAIGAEFVPPPVPLMCTCDTVVAIALAPSRLSSRMLAGKDTPALPRRALSTLVRATVYDYELGKRRKLSASMRTE

SEQ ID NO: 166449 - protein, 82 aa, Heterodera glycines
  Coding regions on vcDNA: vcDNA=SeqID_92872; Strand=+; Position=32-280
MEVEVKQQEGFYLKAIVTDVLENSLDVVYDRGCRKPETVEFSQCRAVIIENAQQKRPSKCGDIVDALVPIDNSTMTSRPTRR

SEQ ID NO: 166450 - protein, 40 aa, Heterodera glycines
  Coding regions on vcDNA: vcDNA=SeqID_92873; Strand=-; Position=334-456
TNILNLYCLQFNCQSKVAMQTMPLCYLKCHSKFKFLKFII

SEQ ID NO: 166451 - protein, 217 aa, Heterodera glycines; identical to SEQ ID NO: 145942
  misc_feature (36)..(36): Xaa can be any naturally occurring amino acid
  Homolog annotation: Hit_ID=NP_510849.1; Match level="QueryCoverage =100%, HitCoverage=16%, E-value=1e-56, Identity=48%"; Hit description= predicted CDS, zn-finger, CCHC type and RNA-directed DNA polymerase and Integrase, catalytic domain cont
  Coding regions on vcDNA: vcDNA=SeqID_92874; Strand=-; Position=1-649

SEQ ID NO: 166452 - protein, 165 aa, Heterodera glycines
  misc_feature (61)..(61): Xaa can be any naturally occurring amino acid
  misc_feature (111)..(111): Xaa can be any naturally occurring amino acid
  Homolog annotation: Hit_ID=CAE60299.1; Match level="QueryCoverage =95%, HitCoverage=33%, E-value=2e-64, Identity=75%"; Hit description =Hypothetical protein CBG03884 [Caenorhabditis briggsae]
  Gene Ontology: Mol. function=translation factor activity, nucleic acid binding; Cellular component=eukaryotic translation initiation factor 2 complex; Biological process=locomotory behavior
  Coding regions on vcDNA: vcDNA=SeqID_92875; Strand=+; Position=11-507
MGSTTNEQNEEQQNCLMKQDFEKLNLVKIVHRLTEELISRQVTINIGTIAHVAHGKVNTRXGISGVHTVKFKNELERNITIKLGYANAKIFRCSNIKCPRPHCYRSAGSSXPDRFPCERPDCGGDFVCVRHVSFVDCPGHDILMATMLNGAAVMDAALLLVAGNE

SEQ ID NO: 166453 - protein, 97 aa, Heterodera glycines
  Coding regions on vcDNA: vcDNA=SeqID_92876; Strand=+; Position=234-527
FFNGRGQFRFYETNEFKIVFFCVICGADHKYDLCFSKFRTPNPNENSKFINYNEDIFLGVFEVAENGYGSRFALENTRTRTKKSIFSQQTLGCNDNS

SEQ ID NO: 166454 - protein, 84 aa, Heterodera glycines
  Coding regions on vcDNA: vcDNA=SeqID_92877; Strand=-; Position=168-422
CTKFRAQFAESTCRSMFLLTSKIKSERVGRWQTLVKFVKFFGGLQVKNTEKMGYFKTNVIVEGAGELMPNYNGCREYVWSGSTD

SEQ ID NO: 166455 - protein, 80 aa, Heterodera glycines
  Coding regions on vcDNA: vcDNA=SeqID_92878; Strand=-; Position=297-539
IKMRKRHKKCKKAAKINFDKIFFIKFTKNSQFFFYPLTIQKNKLFRSFLFLKKNFFLVFVFRHLVMNPIKLVFTREPRDR

SEQ ID NO: 166456 - protein, 112 aa, Heterodera glycines
  Coding regions on vcDNA: vcDNA=SeqID_92879; Strand=-; Position=211-549
LGTPKTCACAERPRPIPLVEHLCKRFNCSAHELHVLFQNLEKRRDIVEHLRSAQLRTAHLRPFVRNFPVRCNDLSILDAHSVPAYRGFLGITVLFGNLVDIIKDFRYECITT

SEQ ID NO: 166457 - protein, 113 aa, Heterodera glycines
  Coding regions on vcDNA: vcDNA=SeqID_92880; Strand=-; Position=75-416
ISCGTGPSKASVSRIYEFLRISIFISKIVPYILIFLFIIFITGENLNILVNFEKNGKSQNIKIEFLKKKKFTGGTAKFSNNEKQMPVGEVKTTHNDGQQTPTVVCTTTTVTII

SEQ ID NO: 166458 - protein, 118 aa, Heterodera glycines
  Coding regions on vcDNA: vcDNA=SeqID_92881; Strand=+; Position=3-359
IIFMENQGTSTASLSSTSEASPENVSELCKKLHVATANLVRQSNKLPMLGDGHELYSSFADYAEFMRVQRNRAIIMLRRLTNYQCRLNESVLNDGMGPLIGFCDAFVDRAVCFRSFEG

SEQ ID NO: 166459 - protein, 48 aa, Heterodera glycines
  Coding regions on vcDNA: vcDNA=SeqID_92882; Strand=-; Position=249-395
FFFFFFLGQLHPFLRRALFKENLGNRGRGPAVPIGAAGKILVIFNEIC

SEQ ID NO: 166460 - protein, 161 aa, Heterodera glycines
  Homolog annotation: Hit_ID=NP_741262.1; Match level="QueryCoverage =91%, HitCoverage=16%, E-value=2e-29, Identity=47%"; Hit description =V-ATPase a subunit; ATP-dependent proton pump involved in the acidification of intracellular compartments
  Gene Ontology: Mol. function=transporter activity; Cellular component= integral to plasma membrane; Biological process=negative regulation of locomotion
  Coding regions on vcDNA: vcDNA=SeqID_92883; Strand=+; Position=150-632
MSLRSEPLKLCQLIVQRDAAYSCVVELGQYSLVQFKDLNHHLTTFQRTYVREVRRCAEIERCLRYLETEVVEGGVSDHIPPLDTTRTDITLLREMYDLESHLYDIERDIRQFLANEAQLKRNFNDLKQFKSVYEKVEAFFRVHIENTAKTELESEQLEIND

SEQ ID NO: 166461 - protein, 84 aa, Heterodera glycines
  Coding regions on vcDNA: vcDNA=SeqID_92884; Strand=-; Position=188-442
IILIFPKICGVLKNSCKFKNFYKQNLADYLFLLMESAWILFAKNPNIYYIYIYICVPKTPKIFAKILKRPNICQKLKQNCSRNK

SEQ ID NO: 166462 - protein, 212 aa, Heterodera glycines
  Homolog annotation: Hit_ID=NP_497203.1; Match level="QueryCoverage =87%, HitCoverage=30%, E-value=2e-15, Identity=28%"; Hit description =cell division cycle protein 23, Metaphase-to-Anaphase Transition defect MAT-3, Polarity and Osmotic sensi
  Coding regions on vcDNA: vcDNA=SeqID_92885; Strand=+; Position=4-639
MDTAESASVAPNPTGEVGETVEPSRVVSDLMWLTDQCERRCMFECAKWASEQLSHLPDQHFEAFELQNPDQRQSIGCEATNRMPTKRRALVSFVRALILNRDYDRAKSFFLSTDIGQMSCLEAFLFYFSWYMLSVRNRVENEADELDRNDEFENNELANLRTEMEAAKLKQPDLFDCFLNYLLGTVQKESGADELAIRTFTEAIQMDKRCWP

SEQ ID NO: 166463 - protein, 183 aa, Heterodera glycines
  Homolog annotation: Hit_ID=NP_497599.2; Match level="QueryCoverage =98%, HitCoverage=44%, E-value=9e-57, Identity=38%"; Hit description =myotactin, LEThal LET-805 (479.6 kD) (let-805C) [Caenorhabditis elegans] gb|AAK21414.2| Lethal protein 80
  Gene Ontology: Mol. function=transmembrane receptor protein tyrosine phosphatase activity; Cellular component=integral to plasma membrane; Biological process=transmembrane receptor protein tyrosine phosphatase signaling pathway
  Coding regions on vcDNA: vcDNA=SeqID_92886; Strand=+; Position=1-549
DTEPVIMENVQDKQVLLDNLHPGSEYEVTVTLRQPPGVDRRVAPKKAVQRFQTADQPPSGAPNKLRVEVLWDTKLAFGWEPPECLEQNGEISQYEYELNGLDEWNQGTRQGVSPRTRADIGELLPGSLYRFRVRAFTSAGPGPWSEPIDARTTGSELGPPRELSPISSLQNAIQLAWLPPHPE

SEQ ID NO: 166464 - protein, 42 aa, Heterodera glycines
  misc_feature (4)..(4): Xaa can be any naturally occurring amino acid
  misc_feature (12)..(12): Xaa can be any naturally occurring amino acid
  misc_feature (25)..(26): Xaa can be any naturally occurring amino acid
  Coding regions on vcDNA: vcDNA=SeqID_92887; Strand=-; Position=93-221
GVAXSAGMKGTXLYKSSSGRHLGAXXGRSRGQFCYLVLLVAN

SEQ ID NO: 166465 - protein, 62 aa, Heterodera glycines
  Coding regions on vcDNA: vcDNA=SeqID_92888; Strand=-; Position=250-438
MKIQAQKELLTAVEKSKNGGKAKSDGLPKRGGAVGGDKGDAKAKNGIPTAPLMNGKKNVGNG

SEQ ID NO: 166466 - protein, 178 aa, Heterodera glycines
  Homolog annotation: Hit_ID=CAE75218.1; Match level="QueryCoverage =99%, HitCoverage=27%, E-value=2e-81, Identity=79%"; Hit description =Hypothetical protein CBG23167 [Caenorhabditis briggsae]
  Gene Ontology: Mol. function=gamma-aminobutyric acid transporter activity; Cellular component=integral to membrane; Biological process=transport
  Coding regions on vcDNA: vcDNA=SeqID_92889; Strand=+; Position=2-535
LCESNRTIAGYFNVKILTDDHLNEYRKQFFIGPKVNFTICTEADLSVRSPVKEFWDHRVLGISEGIEHVGSLRQDLALYLLICWIICYFCIFKGVKWTGKVVYLTASFPYLMLFFLLLRGLSLPGASLGLEFYLKPDFSKLLESKVWVDAVTQVFFSYGLGVGALVALGSYNKYHNNV

SEQ ID NO: 166467 - protein, 187 aa, Heterodera glycines
  Coding regions on vcDNA: vcDNA=SeqID_92890; Strand=+; Position=10-570
WEIGKLQNELEAYRTHVQLLSQKNSGFNCVIQMFDNRLQSIMTALAKLQQKQNVKRDEVEKLCNEIEQLRAMSVKAGVTPYWNTEGAQGTVAKGGKEEEQPQQNGRGSKKSWIRSSFSRAFHKGNKKSKQQQQKENNDAADNNSLNSFSSFAHSNPSKSANAISSSSSVSVTSKMDTANRTQLGELS

SEQ ID NO: 166468 - protein, 140 aa, Heterodera glycines
  misc_feature (21)..(21): Xaa can be any naturally occurring amino acid
  Homolog annotation: Hit_ID=CAE60636.1; Match level="QueryCoverage =96%, HitCoverage=28%, E-value=6e-55, Identity=73%"; Hit description =Hypothetical protein CBG04280 [Caenorhabditis briggsae]
  Gene Ontology: Mol. function=carboxypeptidase C activity; Cellular component=vacuole; Biological process=proteolysis and peptidolysis
  Coding regions on vcDNA: vcDNA=SeqID_92891; Strand=+; Position=33-452
ASESHEITDALPRLFFELNFXHFSAFLQVSPTHFLHYWFVTSQEDSSKDPLVFWFDGGPGCSSLDGLVNEMGPYLVNPDGQTLRENPFSWNKFASMVYIEAPAGVGFSYATDGNTTTNDDLTSLRNYEAIKQFFAKHPSF

SEQ ID NO: 166469 - protein, 176 aa, Heterodera glycines
  Homolog annotation: Hit_ID=NP_496207.1; Match level="QueryCoverage =89%, HitCoverage=36%, E-value=2e-10, Identity=25%"; Hit description =cyclin-like F-box and g-protein beta WD-40 repeat (46.2 kD) (2K528) [Caenorhabditis elegans] emb|CAA88747
  Coding regions on vcDNA: vcDNA=SeqID_92892; Strand=+; Position=8-535
MPASVSSPNDNQNGPVNEIARIDNAHTGWIWCISVAPDGRHFYSAGWDAQIQQWHLAESRIERGLALNFPSLAALWCVLEDQNVLYASTYRRGPILFDLRAGTHPQHELNVHNNFPVFELATGPNCNQLFSIGEDNRLVSVDKRRFSALLSEHRAPVSHVDYADGHLCLSLKNGQL

SEQ ID NO: 166470 - protein, 81 aa, Heterodera glycines
  misc_feature (59)..(59): Xaa can be any naturally occurring amino acid
  Homolog annotation: Hit_ID=CAE72594.1; Match level="QueryCoverage =100%, HitCoverage=16%, E-value=8e-23, Identity=63%"; Hit description= Hypothetical protein CBG19783 [Caenorhabditis briggsae]
  Gene Ontology: Mol. function=interleukin-8 receptor binding; Cellular component=cytoplasm; Biological process=apoptosis
  Coding regions on vcDNA: vcDNA=SeqID_92893; Strand=+; Position=2-244
LTDAQQKRKERIVRNLQEVIGDEKLTKQIGAGKNIHVYWGTATTGRPHVGYLVPIPKIXDFLRNDIRVTILFADLHAVLDH

SEQ ID NO: 166471 - protein, 105 aa, Heterodera glycines
  Coding regions on vcDNA: vcDNA=SeqID_92894; Strand=+; Position=1-318
PGLKCPAQAKNFFYFREKIEIFPKKIPVDRARKTMFWKWSSFFWENSLKILKIQKPENRFLGLARKILKIFEILKSEKIELIELYNKSAGHPALRSNPNELFAWY

SEQ ID NO: 166472 - protein, 117 aa, Heterodera glycines
  Homolog annotation: Hit_ID=NP_509512.2; Match level="QueryCoverage =94%, HitCoverage=15%, E-value=3e-11, Identity=39%"; Hit description =protein kinase (XJ560) [Caenorhabditis elegans]
  Coding regions on vcDNA: vcDNA=SeqID_92895; Strand=+; Position=3-353
SQSFGVIDSANLQIGTRLGGGAFGCVNEAKWTLSCAKEAEKQQGKTGKASKSSKRVAIKTFTNFADMEKEAGLLKQLDHPNILRMFGVTKLDDKNAMVIELMNLGDLKTYVDGRKPK

SEQ ID NO: 166473 - protein, 45 aa, Heterodera glycines
  misc_feature (16)..(16): Xaa can be any naturally occurring amino acid
  Coding regions on vcDNA: vcDNA=SeqID_92896; Strand=-; Position=7-144
NFYKKITKSSIKICFXLVTLCFGEMHFSSNIYSAPFRPLRIFFPL

SEQ ID NO: 166474 - protein, 103 aa, Heterodera glycines
  Coding regions on vcDNA: vcDNA=SeqID_92897; Strand=+; Position=97-408
SVRSFGDDPSPPNWLSNWPSSDAPNWPTSAASPILVPATTPPSNLTEQNDRLKKWKQNSERAKRPFESDGGEESSDGKRTILSMGIGIVHAILTLFASLFLML

SEQ ID NO: 166475 - protein, 82 aa, Heterodera glycines
  Coding regions on vcDNA: vcDNA=SeqID_92898; Strand=-; Position=0-245
VEPPMGEVLSFKLLLNVPEGEKRSLPSLSRSAPAPAIGSFCVCFGIVPSSAVPPSLCFLSLFVPTFAFASFVWLPPLLPIPL

SEQ ID NO: 166476 - protein, 203 aa, Heterodera glycines
  misc_feature (13)..(13): Xaa can be any naturally occurring amino acid
  misc_feature (33)..(33): Xaa can be any naturally occurring amino acid
  misc_feature (57)..(57): Xaa can be any naturally occurring amino acid
  misc_feature (99)..(99): Xaa can be any naturally occurring amino acid
  Homolog annotation: Hit_ID=NP_740937.1; Match level="QueryCoverage =97%, HitCoverage=23%, E-value=7e-62, Identity=65%"; Hit description =AdaPTin or adaptin-related protein (91.6 kD) (apt-1) [Caenorhabditis elegans] emb|CAD21660.1| Hypothetica
  Gene Ontology: Mol. function=transporter activity; Cellular component= Golgi trans face; Biological process=intracellular protein transport
  Coding regions on vcDNA: vcDNA=SeqID_92899; Strand=+; Position=2-610
GPDLVEMIISSTXSLLNEKHHGVLPGGHYTRLXMCDLSADVPIHFEKMAPNLERILXNLLMSDHSADHDVAGICDPFLQGEILKLLRILGIYDPGDNEXMNDILAQVATNTETTKNVGNVILYETVLTIMANKSESGLRALAVNILGRFLLYSDIYIRYVALNTLLKTDAIDFHSVLRHRSTVVECQRDADISVLKTARGRSF

SEQ ID NO: 166477 - protein, 189 aa, Heterodera glycines
  Coding regions on vcDNA: vcDNA=SeqID_92900; Strand=+; Position=2-568
FGFSAVLMIRINKFEPKEEPRDENEFEGQSPRKSDEKIIVKTDFRQQNSAESDDPPSDVAAVGLSDILGLSEKELAKRIYQAETGIKCLYFVLIRKTEQMRYLVKARKLKTIFAEQKPSTEEIVPGRPRKSLTNFDPTCADYRSLHRILMSDKERAEMYRKRNQQQRERRRQMTKDELAEARAKARQKA

SEQ ID NO: 166478 - protein, 121 aa, Heterodera glycines
  Homolog annotation: Hit_ID=NP_492243.1; Match level="QueryCoverage =88%, HitCoverage=19%, E-value=6e-23, Identity=49%"; Hit description =krev interaction trapped 1 (1I804) [Caenorhabditis elegans] emb|CAB03514.1| Hypothetical protein ZK265.1
  Gene Ontology: Mol. function=protein binding; Cellular component =cytoplasm; Biological process=regulation of CDK activity
  Coding regions on vcDNA: vcDNA=SeqID_92901; Strand=+; Position=270-632
RSPTEFWEQQYPLHKHAFDGNAERIRELLAQGDDPNEQDNDLWTPLHYCAFYNRLEACETLLLHPRTNVNVVNGTGATPLHFAALNGNIYVAELILSHQLADINIRDATGKTPLDLCVLVP

SEQ ID NO: 166479 - protein, 117 aa, Heterodera glycines
  Coding regions on vcDNA: vcDNA=SeqID_92902; Strand=+; Position=3-353
IRQQFDEAEVLQEQLQNQEEQQNDENVDPRLHQQRAAQQAQYERLVRLQLRESRRFRIGVASSVLVPPPLFWEGECVICTNARANFYNIRCGHVCLCADCAVAAVIQRITVCGFVPC

SEQ ID NO: 166480 - protein, 105 aa, Heterodera glycines
  Homolog annotation: Hit_ID=CAE68789.1; Match level="QueryCoverage =51%, HitCoverage=9%, E-value=2e-15, Identity=68%"; Hit description =Hypothetical protein CBG14734 [Caenorhabditis briggsae]
  Coding regions on vcDNA: vcDNA=SeqID_92903; Strand=+; Position=54-371
MAAWLDAFVQKYRSNRRVLLCIVYVALFLDNMLLTTVVPIIPEYLLRIQHPNSTDVAEQPVQRAGHGHGSSNGHSLITAAGKSADETANGDRMGQRGVGKATGER

SEQ ID NO: 166481 - protein, 189 aa, Heterodera glycines
  misc_feature (186)..(186): Xaa can be any naturally occurring amino acid
  Coding regions on vcDNA: vcDNA=SeqID_92904; Strand=+; Position=41-607
EKQLFLMEQNFQIFNVDDTKFRHPFTLTISGSTGSGKSEWVMRFLKNVDTLITNGPINKVFYCYGEFNQNIASLQKMGSIGGVQVSTHSGAPDEEMVKQKSRDAKGKLLMVLDDLMVGIGQNFLDTIFTRGSHNWGVSVVLVTQHLFSKELRIARNNSHYMVLMRNPAGALQVRTLATQLFPGRVXHLM

SEQ ID NO: 166482 - protein, 69 aa, Heterodera glycines
  Coding regions on vcDNA: vcDNA=SeqID_92905; Strand=+; Position=184-393
FLHTFKYSHAILVFAYVLPLTQNYKIRKIIFNFRYRMKQILRLLLKQLCQIPTELRKHIGQPLNRISKP

SEQ ID NO: 166483 - protein, 72 aa, Heterodera glycines; identical to SEQ ID NO: 136757
  Homolog annotation: Hit_ID=NP_498362.1; Match level="QueryCoverage =72%, HitCoverage=6%, E-value=2e-15, Identity=80%"; Hit description =membrane protein 1 (85.1 kD) (3H339) [Caenorhabditis elegans] gb|AAC24442.1| Hypothetical protein T12A2.2
  Coding regions on vcDNA: vcDNA=SeqID_92906; Strand=-; Position=3-218

SEQ ID NO: 166484 - protein, 132 aa, Heterodera glycines
  Coding regions on vcDNA: vcDNA=SeqID_92907; Strand=+; Position=173-568
KGADGWIFDVKSISVCFSFCKIRLKCQISARKCRLRFAFHFCCSFSALSFGLRCFLPFKGFFRPLSVSSPFSPHRLPKGSAVSRSSSEVAKSVRFDPFLMAKKCRSFADAQSQIVANLFANYDPNQRPPVRG

SEQ ID NO: 166485 - protein, 30 aa, Heterodera glycines
  Coding regions on vcDNA: vcDNA=SeqID_92908; Strand=-; Position=29-121
WDDKILEMRVQKINFTLFWSFSGEFLATIE

SEQ ID NO: 166486 - protein, 43 aa, Heterodera glycines
  Coding regions on vcDNA: vcDNA=SeqID_92909; Strand=+; Position=261-389
FLSLTLTSSLSQFGRTETCVNYIKYILIFFQIIYFVVHFFVKS

SEQ ID NO: 166487 - protein, 58 aa, Heterodera glycines
  misc_feature (2)..(2): Xaa can be any naturally occurring amino acid
  misc_feature (9)..(9): Xaa can be any naturally occurring amino acid
  misc_feature (17)..(17): Xaa can be any naturally occurring amino acid
  misc_feature (34)..(34): Xaa can be any naturally occurring amino acid
  misc_feature (41)..(41): Xaa can be any naturally occurring amino acid
  Homolog annotation: Hit_ID=AAQ12016.1; Match level="QueryCoverage =100%, HitCoverage=20%, E-value=5e-18, Identity=82%"; Hit description= tropomyosin [Heterodera glycines]
  Coding regions on vcDNA: vcDNA=SeqID_92910; Strand=+; Position=2-175
AXEKKRQAXKIEKDNAXDRADAAEEKGRQTQERXERVEEEXRDTQKKTTATENELDKA

SEQ ID NO: 166488 - protein, 210 aa, Heterodera glycines
  Coding regions on vcDNA: vcDNA=SeqID_92911; Strand=+; Position=3-632
MTQCNELCSELLQNGSPNNYNSSNTTNCDNDADSANSLATGTKLVAAGRNFSNKKVPVSSPKCVPTTAENVIKRPPLFYDSKRRRVDKFYQKQSSLVEYFEQDSKQIQNYQQRRLNSNCSLDVRRTLSSDSRNFSSANFNGQHSLENGGEEPAQEFDDSTVSRLLEPPPLSLGVKNVGNGTISLPKVRVIRPAGSLRNCAAQHCPSLAMS

SEQ ID NO: 166489 - protein, 56 aa, Heterodera glycines
  Coding regions on vcDNA: vcDNA=SeqID_92912; Strand=+; Position=470-637
MHKLLIKYINYSPPPRAFPSKFAPTNRWRRPAQSWSAPCCTWCTAWRMFCSATPSS

SEQ ID NO: 166490 - protein, 220 aa, Heterodera glycines
  Homolog annotation: Hit_ID=CAE67028.1; Match level="QueryCoverage =98%, HitCoverage=48%, E-value=1e-73, Identity=60%"; Hit description =Hypothetical protein CBG12429 [Caenorhabditis briggsae]
  Gene Ontology: Mol. function=homogentisate 12-dioxygenase activity; Biological process=phenylalanine catabolism
  Coding regions on vcDNA: vcDNA=SeqID_92913; Strand=+; Position=3-662
IKNEAEQLSGTAFTAPRCSNRRSWLYRVRPSVLHRPFRRLEGNGRFTNDFSQFAPNPNQMRWKPHPMPNSVANGAPSLDFVQGLYTFCGAGHPTIRNGLAIHFYTCNAKMDQKAMYNSDGDFLIVPQHGILHIVTEMGVINVGPQEIAVVPQGVRFSVDVSVPSRGYLLEVFDEHFRLPELGPIGANGLANAHWFRIPTAWFEERETSFCIINRFQGQLF

SEQ ID NO: 166491 - protein, 203 aa, Heterodera glycines
  Homolog annotation: Hit_ID=AAH79686.1; Match level="QueryCoverage =100%, HitCoverage=31%, E-value=5e-63, Identity=39%"; Hit description= MGC80263 protein [Xenopus laevis]
  Gene Ontology: Cellular component=intracellular; Biological process =RNA processing
  Coding regions on vcDNA: vcDNA=SeqID_92914; Strand=+; Position=1-609
EDAVECERADCPLTSKAIIQNVLAVGVEDEDRKHTWMEDAEWFITQGALQCARAVFSFTLNTFPKKKGIWTRAAFFEREHGTVEAYEELLKKATENCADAENLWLMHAKSRWQGGDVEGSRQILSQAFKHNPNSEEIWTAAVKLESENQEFDRARKLLERARNSAPSPRFWMKSARLEWCLDNLDRANELLAEGIGRYPDFEK

SEQ ID NO: 166492 - protein, 210 aa, Heterodera glycines; identical to SEQ ID NO: 124829
  Homolog annotation: Hit_ID=NP_508324.1; Match level="QueryCoverage =100%, HitCoverage=8%, E-value=1e-36, Identity=43%"; Hit description =predicted CDS, peptidase family A16 and RNA-directed DNA polymerase and Integrase, catalytic domain and Z
  Coding regions on vcDNA: vcDNA=SeqID_92915; Strand=-; Position=2-631

SEQ ID NO: 166493 - protein, 109 aa, Heterodera glycines; identical to SEQ ID NO: 155810
  Coding regions on vcDNA: vcDNA=SeqID_92916; Strand=-; Position=236-565

SEQ ID NO: 166494 - protein, 115 aa, Heterodera glycines; identical to SEQ ID NO: 125617
  Homolog annotation: Hit_ID=NP_492097.1; Match level="QueryCoverage =100%, HitCoverage=11%, E-value=7e-36, Identity=61%"; Hit description= related kinase (1I38) [Caenorhabditis elegans] emb|CAA98148.1| Hypothetical protein ZK524.4 [Caenorhabdi
  Coding regions on vcDNA: vcDNA=SeqID_92917; Strand=-; Position=1-582

SEQ ID NO: 166495 - protein, 196 aa, Heterodera glycines
  Coding regions on vcDNA: vcDNA=SeqID_92918; Strand=+; Position=2-589
IDPTFVHQMTVAEVNNQMASTGHEAPPPVKKYYGMREKHDGGRPNERQTYGEEDKSNAQNQMLTRDERRKIRRERKAMSDLADDGTRIPEGLVELKFEAPAAAAEEQLIEGETSTKSAFVSKFSTHPLGPWVPVKKEEKRPDLDSADSELQPHGKKRAKHYDDLPEQSYGPGSADYSQTPAELLEIAEMDPDDLSF

SEQ ID NO: 166496 - protein, 33 aa, Heterodera glycines
  Coding regions on vcDNA: vcDNA=SeqID_92919; Strand=+; Position=190-288
MINLSSPPPPPSPILFSICVLSRHFVNFLQKTR

SEQ ID NO: 166497 - protein, 68 aa, Heterodera glycines
  Coding regions on vcDNA: vcDNA=SeqID_92920; Strand=-; Position=1-204
FYNGFKVKMNGQFAAQSGGQNGAKDGLGFINFIFNFQFFLMICPPFRHAFARAVGCNGYSPTRAFALR

SEQ ID NO: 166498 - protein, 187 aa, Heterodera glycines
  Homolog annotation: Hit_ID=CAE67294.1; Match level="QueryCoverage =100%, HitCoverage=28%, E-value=3e-30, Identity=43%"; Hit description= Hypothetical protein CBG12746 [Caenorhabditis briggsae]
  Coding regions on vcDNA: vcDNA=SeqID_92921; Strand=+; Position=2-562
YEEGRRKLLEEEAKERMEGLSSEESDFDSYIPGRQRKREQEHLLLLLKNLIHSSALSESQADKEWKRQTEELLAQKRKKKEEEKKAEESKKSLLEKHNELLHQEHDDDREEIDKPMEQEDKILQSVTQTSALATVAEIAKGVRYTESIKTWWKPPRHIRHQTLQDHEKFRTLEGHSIEGEHCPQAIG

SEQ ID NO: 166499 - protein, 94 aa, Heterodera glycines
  Coding regions on vcDNA: vcDNA=SeqID_92922; Strand=+; Position=178-462
MNPNVTFRDSWNLIPGPLSSMVPMFGLDVQDKPFFPHLANRPENYGCQIFPSKTDYLADGMNLEKRKEFDTWYQQNRNTPFLLDEALARYLILC

SEQ ID NO: 166500 - protein, 191 aa, Heterodera glycines
  Homolog annotation: Hit_ID=NP_508448.1; Match level="QueryCoverage =86%, HitCoverage=42%, E-value=1e-45, Identity=54%"; Hit description =glycosylasparaginase precursor (39.4 kD) (XD90) [Caenorhabditis elegans] gb|AAA91260.2| Hypothetical prot
  Gene Ontology: Mol. function=N4-(beta-N-acetylglucosaminyl)-L -asparaginase activity; Cellular component=lysosome; Biological process=protein deglycosylation
  Coding regions on vcDNA: vcDNA=SeqID_92923; Strand=+; Position=2-574
STWDSFDFQAAAQKAFDIFRQGPVGWNTSSSYRRLNAIVEGLSECEKRRCDRTVGFGGSPDERGETTLDALVMDGPGHKSGAVAELRRIKSAAKVAWAVMNYTEHSLLAGEKATEFALAMGFEEESLSTEESLEMHRNWLKAKCQPNFWRNVQPDPHSQCGPYKPNWREADGADFLSPTKQLDNSIGFGFR

SEQ ID NO: 166501 - protein, 44 aa, Heterodera glycines
  Coding regions on vcDNA: vcDNA=SeqID_92924; Strand=+; Position=2-133
ICPSALSSDEQNEAQKIRNLLSSFKGTEDDLLGYLFEDCLENPK

SEQ ID NO: 166502 - protein, 92 aa, Heterodera glycines
  Coding regions on vcDNA: vcDNA=SeqID_92925; Strand=-; Position=128-406
LSFFIFNFSFFVFLVPFSASFSISVHSFSKRAMFSPSGSSELNEHHQDLKVYITTVTGNSEVNIFKATIIEQSVPSVNQKMPKKLGKNVLLE

SEQ ID NO: 166503 - protein, 157 aa, Heterodera glycines
  Homolog annotation: Hit_ID=AAO53177.1; Match level="QueryCoverage =73%, HitCoverage=10%, E-value=1e-15, Identity=38%"; Hit description =similar to Dictyostelium discoideum (Slime mold). Adenylyl cyclase
  Coding regions on vcDNA: vcDNA=SeqID_92926; Strand=+; Position=2-475
NSPINSEYNLINNGYNPYRNGYYSVYNPTNNYNTHNNGYNPYNNEYNGGYNPMNNGYNQYSNGYNPYINEYNGGYNPMNNAYNQDSNGYNPYSNGYLNNNGYNQNSNDCFTASMVQDQRACNAMQGQCSNPLIAQTCRQTCCNMQFASGVAFPQFGG

SEQ ID NO: 166504 - protein, 68 aa, Heterodera glycines
  Coding regions on vcDNA: vcDNA=SeqID_92927; Strand=-; Position=305-511
LRRCCNWALTCAIISSQISGIPGYGSFGYKQRNSDQWVNIGENIPVFICCCSLPNLRQAFLSLGYSES

SEQ ID NO: 166505 - protein, 96 aa, Heterodera glycines
  Homolog annotation: Hit_ID=CAC21848.1; Match level="QueryCoverage =64%, HitCoverage=28%, E-value=5e-13, Identity=58%"; Hit description =hypothetical protein [Globodera rostochiensis]
  Coding regions on vcDNA: vcDNA=SeqID_92928; Strand=+; Position=173-514
EITNYGRIESTNANGNFVNILENVPRFGTGDVVGCGLNWATRQVFFTINGQRLNNTNLYVDDGTADLYPTVSMLSHRAAVEANFGPNFRYDLSKKF

SEQ ID NO: 166506 - protein, 73 aa, Heterodera glycines
  Coding regions on vcDNA: vcDNA=SeqID_92929; Strand=+; Position=94-315
SKIKRTQCQWSTFTARFWVIPILSFLAFILLVRPSKFLFITELRGRPVYGFCAASKKEAKKACALRLLDILMT

SEQ ID NO: 166507 - protein, 81 aa, Heterodera glycines
  Homolog annotation: Hit_ID=AAH76765.1; Match level="QueryCoverage =86%, HitCoverage=12%, E-value=2e-14, Identity=54%"; Hit description =Adprtl2-prov protein [Xenopus laevis]
  Gene Ontology: Mol. function=ATP binding; Cellular component=nucleus; Biological process=base-excision repair
  Coding regions on vcDNA: vcDNA=SeqID_92930; Strand=+; Position=230-600
MESKNPMEICQGKITKEQLRFGYEALGRIERHVQKGTFGRDFVEAMNDYYTRIPHSFGMRTPPPIKSPEELKRENELLEML

SEQ ID NO: 166508 - protein, 212 aa, Heterodera glycines
  Coding regions on vcDNA: vcDNA=SeqID_92931; Strand=+; Position=2-637
TDRLTFSTSANHYAMAENEDFYQQQQQIKKHQTAAPPMSRSNVAFLAASNCTKNLVWSALDKDPRLFMWRDSQLQKTLNSANILPVSESLSSMDNFSANFQSSADDGIGTQQNAFSITALEVMDLSNCGTDKERWRNEKGDEGEEEEQLLVGTSNGVVLIVRGIEMSPISAFRPFCSVQRIICCPPPFGQSSSSCRILQKELLHSSTKKAPL

SEQ ID NO: 166509 - protein, 63 aa, Heterodera glycines
  Coding regions on vcDNA: vcDNA=SeqID_92932; Strand=+; Position=423-611
IQNILENFARSSPEENVPPLPPRSPAPNENEPPRPPRSPAPNENEPPRPPHSPPPKENEPPRP

SEQ ID NO: 166510 - protein, 85 aa, Heterodera glycines; identical to SEQ ID NO: 126349
  misc_feature (47)..(47): Xaa can be any naturally occurring amino acid
  Homolog annotation: Hit_ID=NP_741716.1; Match level="QueryCoverage =95%, HitCoverage=10%, E-value=5e-13, Identity=44%"; Hit description =putative protein, with at least 10 transmembrane domains, of ancient origin (68.2 kD) (XB658) [Caenorhabd
  Coding regions on vcDNA: vcDNA=SeqID_92933; Strand=+; Position=2-259

SEQ ID NO: 166511 - protein, 111 aa, Heterodera glycines
  Coding regions on vcDNA: vcDNA=SeqID_92934; Strand=+; Position=122-457
VIYEHFANLLKITLFIPPPLFLLIMPFAFPSLFKTHPSEVHFVDDCAEAFSAVLAIFRRFASAADGEQFDEQTFPHVPCQGAYLGTEIAHFLENENSIPNFLNKQINKLMN

SEQ ID NO: 166512 - protein, 127 aa, Heterodera glycines
  Homolog annotation: Hit_ID=A39652; Match level="QueryCoverage=71%, HitCoverage=16%, E-value=6e-10, Identity=35%"; Hit description=Hobo element transposase HFL1 - fruit fly (Drosophila melanogaster)
  Coding regions on vcDNA: vcDNA=SeqID_92935; Strand=-; Position=48-431
IIGQLENKRRTSVCFCNRFCSKHAKGKKKLIPTQSEIKAFTEVDENFNKILPFSDPFEWWKKHGPKLPMLSKLAMKYLSAPATSVPSEQTFKVARDVYDYRRSRLKPKTAEMLIFFNKAIPMLDYKY

SEQ ID NO: 166513 - protein, 113 aa, Heterodera glycines
  Homolog annotation: Hit_ID=AAO18686.1; Match level="QueryCoverage =57%, HitCoverage=9%, E-value=5e-13, Identity=49%"; Hit description =semaphorin 2a [Trichinella spiralis]
  Coding regions on vcDNA: vcDNA=SeqID_92936; Strand=+; Position=204-595
LPFRPFLPSPPSPLFLSRHSLLKVFHRLSVVPFSVLLLAIYRIPSTKKLHAMAILPNEYLYLATEEKVSQFRLGQCALYGSDCVRCARDPYCSWSIARRQCFPTVRRQQRIGL

SEQ ID NO: 166514 - protein, 205 aa, Heterodera glycines
  Homolog annotation: Hit_ID=NP_740892.1; Match level="QueryCoverage =100%, HitCoverage=25%, E-value=7e-56, Identity=52%"; Hit description= n-ethyl maleimide Sensitive membrane Fusion factor related (nsf-1) [Caenorhabditis elegans] emb|CAB09531
  Gene Ontology: Mol. function=ATPase activity; Cellular component =extrinsic to plasma membrane; Biological process=synaptic vesicle priming
  Coding regions on vcDNA: vcDNA=SeqID_92937; Strand=+; Position=2-616
VQVQPFSFTPGQRIITSISLTVDFQKKPSNPSEPLDSDAMAREFLMQFANMVFTVTQELVLEYVQQKRSTGGGEKATAMNATTYTLKLVVKRMEGANLNSSPEEISIGPLSPNAVVIFDRPENSQINLIGRSKGKSTHRSLINPDWDFQQMGIGGLDKEFSSIFRRAFASRVFPPEFIEQLAMKHVRGILLYGPPGTGKTLIARQ

SEQ ID NO: 166515 - protein, 77 aa, Heterodera glycines
  Coding regions on vcDNA: vcDNA=SeqID_92938; Strand=+; Position=395-628
KNLGLSGRPAGLIKSGFFSQRLKTCRIGVKFCANKQWYTLNLTFRDLLIFNPAENAKKKVGWNQGRAKPGLALKVEA

SEQ ID NO: 166516 - protein, 146 aa, Heterodera glycines
  misc_feature (16)..(16): Xaa can be any naturally occurring amino acid
  misc_feature (41)..(41): Xaa can be any naturally occurring amino acid
  misc_feature (82)..(82): Xaa can be any naturally occurring amino acid
  misc_feature (94)..(94): Xaa can be any naturally occurring amino acid
  Homolog annotation: Hit_ID=NP_497763.1; Match level="QueryCoverage =97%, HitCoverage=50%, E-value=3e-20, Identity=37%"; Hit description =galectin (32.4 kD) (lec-4) [Caenorhabditis elegans] emb|CAA88850.1| Hypothetical protein C44F1.3 [Caenorh
  Coding regions on vcDNA: vcDNA=SeqID_92939; Strand=+; Position=2-444
ADVSLSSVHWGGRYFXMPYQMTFHDHALERGQPLFVYGIPXGDFPVSLITNSLEELFIMNALLRQANCGPKCPNGQIMGSRXSEGGPFPFIKGXGFNLIILNKPLELQISINGTPFCSFFHRTIDAHKDYTKVRINAEVELTGHGK

SEQ ID NO: 166517 - protein, 200 aa, Heterodera glycines
  Coding regions on vcDNA: vcDNA=SeqID_92940; Strand=+; Position=3-602
TLCIFGRAMSDGTGRSVTDGRRETVHGDSEEKGIQSESIVLSNNCQNWRKCRENGRRTKSRGNGEDGTTNAGTATTKSDKWQSKRRKSNENDENGGKWRTNANEKTKTTEVIANEKNEAKTAEEQQQKTPTIIMSKSVVQLISKTTEEAEEEKPKERSHSAMDGCDTNRTVSTLVLPPVSPTRTVILSGSSFDTVRLNFS

SEQ ID NO: 166518 - protein, 112 aa, Heterodera glycines
  Coding regions on vcDNA: vcDNA=SeqID_92941; Strand=-; Position=0-335
IDILTKFHLWVWYCFSRSFGILPCLLSVDRTHFQLLVFFRHKKRVNNYRGSEVVTPITYHLDELQLIVALLKKGAVKAQRRSAAVRCGHSAPSVRLASGSSGGHWHGGGEKR

SEQ ID NO: 166519 - protein, 115 aa, Heterodera glycines
  Coding regions on vcDNA: vcDNA=SeqID_92942; Strand=+; Position=2-349
AVCDRSPQSPPVVATASITDVPLSTLCDDRRIADAAEQSNSSDRRAVTDGCCCCRCRGDPSISAGKAVRGESNGTAVPTYASYMDTPALLGTFAAKAGNEWSCGRSFTVWLSYRH

SEQ ID NO: 166520 - protein, 48 aa, Heterodera glycines
  Coding regions on vcDNA: vcDNA=SeqID_92943; Strand=-; Position=3-146
IFRIIFALFLFFKLFIFYFFLLDFGISFGIIFLRDQTAECAVLSPNGA

SEQ ID NO: 166521 - protein, 121 aa, Heterodera glycines
  Coding regions on vcDNA: vcDNA=SeqID_92944; Strand=+; Position=14-379
MGKYDPEEGYDSNLTDLKLFEAGEPFEMQIKLLKRPSEDNLPMTEILSSISLSLTMTVIVSTPKGTSQTNYTLDSESYRDMNYITVRGDLELFAEPSLLNDITHPILPVLILHRYRLYWYR

SEQ ID NO: 166522 - protein, 155 aa, Heterodera glycines
  Coding regions on vcDNA: vcDNA=SeqID_92945; Strand=-; Position=1-465
RDPLNSRFKFGYILDGIVCNVMLICSLNTFWDDNLSIPPLLLFVECPPMAKMLHLLATIALTAGPIDEGRDSKAERGEEEEEAACWGSTDLLVTHIKPQREGKAHPSAPSLFFFSSRHQTLFLEGVGLLRPRQYGGLLINMEIEANLERALNRQT

SEQ ID NO: 166523 - protein, 106 aa, Heterodera glycines
  Coding regions on vcDNA: vcDNA=SeqID_92946; Strand=+; Position=233-550
SLKNRCFTIASTSAPFASTKVQQNGVDSNHSPAAKQSSASSPVASTKTFRRRTAFETSEAMREIFGAYSPFSSQKKENSGEFNRKKMELENGRTMNGTQQNNKTAI

SEQ ID NO: 166524 - protein, 135 aa, Heterodera glycines
  Coding regions on vcDNA: vcDNA=SeqID_92947; Strand=+; Position=138-542
NWAAARCSTSRQFAERERQLAPMAPLLPISKTKCGSELIRTSAVLLDKSLNERKRQFQNAKKYCCCLPRNVAKKIEEVFVIYGKVMNEVKAQLLAKLDSTREEQVRLNDKVAKEVSFFEWTIKEQKAKFELGNSE

SEQ ID NO: 166525 - protein, 73 aa, Heterodera glycines
  misc_feature (58)..(58): Xaa can be any naturally occurring amino acid
  misc_feature (60)..(60): Xaa can be any naturally occurring amino acid
  misc_feature (72)..(72): Xaa can be any naturally occurring amino acid
  Coding regions on vcDNA: vcDNA=SeqID_92948; Strand=+; Position=1-219
GNLEPMPFVRKWGSAVDGENGAEASQPVISDERFENDAAKMASSAKHRNRSHSKSPSXRXRKRLARSPEKKXH

SEQ ID NO: 166526 - protein, 139 aa, Heterodera glycines
  Coding regions on vcDNA: vcDNA=SeqID_92949; Strand=+; Position=1-417
LGSRKKSKRSRVVSSISQASTIPTTTTTTTIVATAAADVTTASNFISSSGHSSLYNYTNINNNNSIIKLNGAELNGHCGTGVCASVATTICNTTTTRKRTTTTTVVMNVHCCVRMLNALVRSHSCTRSVKLWNCRLTRR

SEQ ID NO: 166527 - protein, 176 aa, Heterodera glycines
  misc_feature (143)..(143): Xaa can be any naturally occurring amino acid
  misc_feature (157)..(157): Xaa can be any naturally occurring amino acid
  misc_feature (162)..(162): Xaa can be any naturally occurring amino acid
  misc_feature (164)..(164): Xaa can be any naturally occurring amino acid
  Homolog annotation: Hit_ID=NP_741957.1; Match level="QueryCoverage =100%, HitCoverage=19%, E-value=5e-49, Identity=55%"; Hit description= carboxyl ester lipase like (XS293) [Caenorhabditis elegans] gb|AAM69068.1| Hypothetical protein T23E7.2e
  Coding regions on vcDNA: vcDNA=SeqID_92950; Strand=+; Position=1-528
DYMPYDQDIVREAQPARLPTATSFSSYSPAEQETYKPHSPWVDQSSKYRNEYTVGEPPVAPAAYTAFFDDMVATGPFASSLYSTSRLLERSRSRTRERRQALRSQSQARNYFRFASQYPAPLRTRDYSTPPSSYITRTPTAGXSFVSVLDNYGAKQXDLARXQXLDRSSVYNSNLA

SEQ ID NO: 166528 - protein, 64 aa, Heterodera glycines
  Homolog annotation: Hit_ID=CAC33829.1; Match level="QueryCoverage =100%, HitCoverage=19%, E-value=7e-15, Identity=64%"; Hit description= annexin 2 [Globodera pallida]
  Coding regions on vcDNA: vcDNA=SeqID_92951; Strand=+; Position=2-193
IHLVCTVSNQQRQELAREFKILYVENLFFKLNNALSGDFEELNLALLEPPDVYDAQHMHRAMSG

SEQ ID NO: 166529 - protein, 77 aa, Heterodera glycines
  misc_feature (53)..(53): Xaa can be any naturally occurring amino acid
  misc_feature (63)..(63): Xaa can be any naturally occurring amino acid
  Homolog annotation: Hit_ID=CAC81951.1; Match level="QueryCoverage =100%, HitCoverage=29%, E-value=7e-11, Identity=54%"; Hit description= KDEL receptor [Ciona intestinalis]
  Gene Ontology: Mol. function=KDEL sequence binding; Cellular component=integral to membrane; Biological process=intracellular protein transport
  Coding regions on vcDNA: vcDNA=SeqID_92952; Strand=+; Position=299-529
MNAFRLIGPISPFCLYLSISNLADLSHLFAILILLWKIWKTPSCAGLSGKSQXLFALVFTWRXLGHPFTLFPFTTTL

SEQ ID NO: 166530 - protein, 184 aa, Heterodera glycines
  Coding regions on vcDNA: vcDNA=SeqID_92953; Strand=-; Position=2-553
SHRATPQRTLALIKKLRIAQTSASGRKDRRCGRLHHLLHIEMFGILYRRLCKWRSAMHRPKWKLGPTGAAYTAPPEKASRHISGRHSRIIDGQCFKNVQHRLLFYGCHLRLLLLGQQLIGLSRHGKLLLGTANSSLQLLRLANLLLRQLLRIQLDQFFEREKLWCLCRNSVCLIVFERWNERQE

SEQ ID NO: 166531 - protein, 135 aa, Heterodera glycines
  Coding regions on vcDNA: vcDNA=SeqID_92954; Strand=+; Position=120-527
FGPNRSLLPLLPNEFSFPFLLLFLSLPFSLFVSHFVIVSRFGQIIFSLRLSKNMFFSQHLAERIRRMVHQIHAQICIFWPNALKFVPIILFLFALCFFFPSLLFLFSFPFVLSSANFVNVRFSFLPLFLFLTPKK

SEQ ID NO: 166532 - protein, 92 aa, Heterodera glycines
  Coding regions on vcDNA: vcDNA=SeqID_92955; Strand=-; Position=337-615
GSMILLLLLKINGFFFYLILIKIVLSSASHHKKKPKHFSSVPSVFFLICASIFHGSPFMCTFSLNRRLPNFPPANFDIFSICNASVVLPKDY

SEQ ID NO: 166533 - protein, 51 aa, Heterodera glycines
  Coding regions on vcDNA: vcDNA=SeqID_92956; Strand=-; Position=225-380
WWKNKLSIKIIILLKPYLGSRTIRQWQSVSGQSVSGQSVGKWTIRQWTISQ

SEQ ID NO: 166534 - protein, 94 aa, Heterodera glycines
  Coding regions on vcDNA: vcDNA=SeqID_92957; Strand=+; Position=242-526
NLFKSPLRPSVPRLAKYLSITSSSETRMLRNALFPPLSCHAAFANDVQTLEVNDKQNKTNIMPKFAILCQNLRLSGANLSGGDYNMRTPLHVAV

SEQ ID NO: 166535 - protein, 76 aa, Heterodera glycines
  Homolog annotation: Hit_ID=NP_506570.1; Match level="QueryCoverage =100%, HitCoverage=22%, E-value=2e-09, Identity=43%"; Hit description= DeHydrogenase, Short chain (37.2 kD) (dhs-22) [Caenorhabditis elegans] emb|CAB02732.1| Hypothetical prot
  Gene Ontology: Cellular component=mitochondrion
  Coding regions on vcDNA: vcDNA=SeqID_92958; Strand=+; Position=2-229
RIVNVSSSVHLHADSVYPEVVESCSRFGIIATYARSNLDNVMHVVALTKRILTNDSGSKVMSNACHPGRVNAEVVR

SEQ ID NO: 166536 - protein, 82 aa, Heterodera glycines
  misc_feature (5)..(5): Xaa can be any naturally occurring amino acid
  misc_feature (8)..(8): Xaa can be any naturally occurring amino acid
  misc_feature (12)..(12): Xaa can be any naturally occurring amino acid
  misc_feature (14)..(14): Xaa can be any naturally occurring amino acid
  misc_feature (16)..(16): Xaa can be any naturally occurring amino acid
  misc_feature (36)..(36): Xaa can be any naturally occurring amino acid
  Coding regions on vcDNA: vcDNA=SeqID_92959; Strand=-; Position=3-248
TLLAXASXSFIXFXFXNLILYSIFSIICYRTFNLIXYSIFSIICYRTFNLILYSIFSIICYRTFNLILYSIFSIICYRTFNL

SEQ ID NO: 166537 - protein, 182 aa, Heterodera glycines
  Homolog annotation: Hit_ID=NP_956607.1; Match level="QueryCoverage =84%, HitCoverage=15%, E-value=2e-23, Identity=40%"; Hit description =similar to chromodomain helicase DNA binding protein 1-like [Danio rerio] gb|AAH50498.1| Similar to chrom
  Gene Ontology: Mol. function=general RNA polymerase II transcription factor activity; Cellular component=SWI/SNF complex; Biological process=anti-apoptosis
  Coding regions on vcDNA: vcDNA=SeqID_92960; Strand=+; Position=1-546
LGLNLTAADTAIFLDWDFNPQNDKQAAARCHRIGQDKPVKIIRLVAKHTVEELIKQRAAKKLKLSENVLGTDEKEGPSLMFDLSKLLLEGLTDLEKEQKKHTQFHILTDKQLEERLGRTDQNGHWQIKGDDKENIEDEQIEDEAEGRTLYMFEGLYFHEFAITYQRRWKLLTTGYEHQHTCR

SEQ ID NO: 166538 - protein, 181 aa, Heterodera glycines
  Coding regions on vcDNA: vcDNA=SeqID_92961; Strand=+; Position=87-629
PWGDEMPIPQCHLPYSFTYWPKGGIGFPYPPYSTHGQSILRPKRVGPPVHQRNPQLDPVIPTQHILNAALSCSRVLACLFYRLFVAPLSPYPYELYKCPVWQFQLRLGIILQLNGSTKAEEITMSPGVTHHWPLAKLSVTFTPSGLPPLPILGSDFIANRSHAGLVPEWHSHLHCDSEFAG

SEQ ID NO: 166539 - protein, 114 aa, Heterodera glycines
  misc_feature (65)..(65): Xaa can be any naturally occurring amino acid
  Coding regions on vcDNA: vcDNA=SeqID_92962; Strand=+; Position=3-344
KVAGQRFLYTTHGGALGGTAGTHHHCPLDVVKTRLQSLNGDEMRLQVQMERLGAGTASTKSTSSXPTEASSSTATAHFARCLRLLHQSVIFRSFHSVWREGRLRALYKGLGPNL

SEQ ID NO: 166540 - protein, 99 aa, Heterodera glycines
  misc_feature (24)..(24): Xaa can be any naturally occurring amino acid
  misc_feature (33)..(33): Xaa can be any naturally occurring amino acid
  Homolog annotation: Hit_ID=NP_608458.1; Match level="QueryCoverage =98%, HitCoverage=26%, E-value=1e-12, Identity=43%"; Hit description =CG14621-PA [Drosophila melanogaster] gb|AAF50956.1| CG14621-PA [Drosophila melanogaster] gb|AAO39543.1| R
  Coding regions on vcDNA: vcDNA=SeqID_92963; Strand=+; Position=2-298
KIHVSYALTDKFTMTLISEVLSRXSVANVRPCXVCLSLFSIITGVFITTATELQFDGFGLCFSLLSKRILAFLNVLAKKVLNETPMHPINLVSLNSQLG

SEQ ID NO: 166541 - protein, 53 aa, Heterodera glycines
  Coding regions on vcDNA: vcDNA=SeqID_92964; Strand=+; Position=3-161
RTQKHRPAPSTTHAQSPTDHAFSRTVCDQIIQNWNFLKFNCFLENHFNYFSKK

SEQ ID NO: 166542 - protein, 91 aa, Heterodera glycines
  Homolog annotation: Hit_ID=CAE64436.1; Match level="QueryCoverage =97%, HitCoverage=11%, E-value=2e-09, Identity=33%"; Hit description =Hypothetical protein CBG09139 [Caenorhabditis briggsae]
  Coding regions on vcDNA: vcDNA=SeqID_92965; Strand=+; Position=15-290
TASKAFHRCVDIDPSHFEALNNLGASYFLMGERQRAEKIFLEAQKLNRQNSHVLENLHIIEAEAKAKKEAEKLAKNQEVIAKKGGDSSNLG

SEQ ID NO: 166543 - protein, 37 aa, Heterodera glycines
  Coding regions on vcDNA: vcDNA=SeqID_92966; Strand=-; Position=61-174
PSSLNNKHTHPKKKITHQEGNNKHTSLKELYTTHKST

SEQ ID NO: 166544 - protein, 183 aa, Heterodera glycines
  Coding regions on vcDNA: vcDNA=SeqID_92967; Strand=+; Position=65-613
LLNLCPGNLSIINFRYILPNFPTALSMGILEWSVSARDSFLYLAFCLSIPSAVLYLAEIVNILRHKQFHKSFYALSIIRAVPTSKMIGGLAFFLTGYTFQANNLATAFILLNRLTAIAWPIKHEQFWRKFRPMVALVVFSVYLFAFIGRCSTRTDCSRWTAPTQRNTISSSMRQMIFTSYANT

SEQ ID NO: 166545 - protein, 43 aa, Heterodera glycines; identical to SEQ ID NO: 141081
  Coding regions on vcDNA: vcDNA=SeqID_92968; Strand=+; Position=165-296

SEQ ID NO: 166546 - protein, 110 aa, Heterodera glycines
  Homolog annotation: Hit_ID=CAE59600.1; Match level="QueryCoverage =77%, HitCoverage=45%, E-value=1e-15, Identity=50%"; Hit description =Hypothetical protein CBG03007 [Caenorhabditis briggsae]
  Coding regions on vcDNA: vcDNA=SeqID_92969; Strand=+; Position=323-652
MSDELNIDGAFAMNMGMPAGATEVPEGVVQLNVGGTCFLTTIDTLKRDSGALLSQLLTLEGLEKNSKVAKRMSNGTIFIDRDGELFAYVLDYLRTGKLLLPENFRELARL

SEQ ID NO: 166547 - protein, 163 aa, Heterodera glycines
  Coding regions on vcDNA: vcDNA=SeqID_92970; Strand=+; Position=6-494
ALFTILSSKMLSAQRLISLSKPERVLPGHLFPLNNNRGLLDLEDVYAATVFADSSVDGSDKEAKVVSPGSDGTQTMEGAKGQEIVGFGLFHKCTPNQFYCSLLSVSKHIEPLFVNVERVAELKKSETEKEENANKGTGRHILLRLTDVHQSLPNLSSLPQYFS

SEQ ID NO: 166548 - protein, 172 aa, Heterodera glycines
  Homolog annotation: Hit_ID=NP_501005.1; Match level="QueryCoverage =99%, HitCoverage=31%, E-value=1e-10, Identity=33%"; Hit description =TraB determinant (4H346Co) [Caenorhabditis elegans]
  Coding regions on vcDNA: vcDNA=SeqID_92971; Strand=+; Position=54-569
MKSMSIEQNGWKNGPCASELQSAVSQVDSASNYIADDGEQQSDEQQQTEDEGSEEEGNAAEEAEEDEEEEEEEGQAGPTSFEAMARSLVRRYYVDSKVYLCDGYAFGRNRAKSPVLNRDTVTVLNYPFEPVTIPPGIDSDEFRRAFSAAQLYLVGTAHFSKESCRDVMQTVL

SEQ ID NO: 166549 - protein, 122 aa, Heterodera glycines
  Homolog annotation: Hit_ID=NP_498057.1; Match level="QueryCoverage =98%, HitCoverage=27%, E-value=3e-23, Identity=46%"; Hit description =putative cytoplasmic protein of eukaryotic origin (47.2 kD) (3G76) [Caenorhabditis elegans] gb|AAL02444.1
  Coding regions on vcDNA: vcDNA=SeqID_92972; Strand=+; Position=2-367
GALQLFNREILQREEDANWLMPILYVLCSDLRLIARIADKRGCVLWGVHHQRKSADSQTATFYEEAAASIMDSYRICVEERSDTTTEKVSVLSLTNQLFRIYFVINQVHLLKPLIHIIDHTG

SEQ ID NO: 166550 - protein, 123 aa, Heterodera glycines
  misc_feature (94)..(94): Xaa can be any naturally occurring amino acid
  Homolog annotation: Hit_ID=NP_872170.1; Match level="QueryCoverage =92%, HitCoverage=11%, E-value=2e-31, Identity=51%"; Hit description =ankyrin and patatin family member (5V188) [Caenorhabditis elegans] emb|CAD54162.1| Hypothetical protein W
  Gene Ontology: Mol. function=transcription factor activity; Biological process=regulation of transcription, DNA-dependent
  Coding regions on vcDNA: vcDNA=SeqID_92973; Strand=-; Position=1-672
TTTRAEFFPVQLELMRNYKLPTNDEENEELGYRTPDDLLLWKVLRRSSAAPTYFASVDNKYIDGGIIANNPSLELLQEIQFWNSFNKYKNFPQXAVNVGCFLSIGTGVIPPTPLKVFLKTKCH

SEQ ID NO: 166551 - protein, 149 aa, Heterodera glycines
  Homolog annotation: Hit_ID=CAE60034.1; Match level="QueryCoverage =95%, HitCoverage=20%, E-value=2e-28, Identity=46%"; Hit description =Hypothetical protein CBG03543 [Caenorhabditis briggsae]
  Gene Ontology: Mol. function=oxidoreductase activity; Cellular component=integral to membrane; Biological process=embryogenesis and morphogenesis
  Coding regions on vcDNA: vcDNA=SeqID_92974; Strand=+; Position=106-552
MDLVASSLHYVGSLFDMVDLVVIGALAVFAIAYYVRSQSLSAHNKIKFSESTPTLRNGGTLQDSGRTDRSFLGRMKSEDRQILILFGSQTGTAEELAGRMAKDLCRYGKKPLLMDPEEIEVDDLPKIVELSDPVLLLFVTTYGEGDPTD

SEQ ID NO: 166552 - protein, 162 aa, Heterodera glycines
  Coding regions on vcDNA: vcDNA=SeqID_92975; Strand=+; Position=89-574
SQQPPVHPSDIPYRPRRMTSPTTFNGARVFAKLSGNSNQQQQAIEHKMAELRAAYAIQPAQTPTVAKSGANSTQNKSSAPPPRRPGRTSLPTPSLGDMLELPQLSSRSCVPSRRASTVTACFSPAPSLMDLASSAGLLSLSPSDLVFESSVLGIAYYDFVLS

SEQ ID NO: 166553 - protein, 128 aa, Heterodera glycines
  Homolog annotation: Hit_ID=XP_419862.1; Match level="QueryCoverage =94%, HitCoverage=18%, E-value=1e-18, Identity=41%"; Hit description =PREDICTED: similar to Phosphoacetylglucosamine mutase (PAGM) (Acetylglucosamine phosphomutase) (N-acetylg
  Gene Ontology: Mol. function=phosphoacetylglucosamine mutase activity; Biological process=cell organization and biogenesis
  Coding regions on vcDNA: vcDNA=SeqID_92976; Strand=+; Position=2-388
VHQNRFIYGTSGFRCKAVLLSPDVRRTAFYAAIKARSLSKTVGLMITGSHNPISDNGIELVDPDRRMLPFECEIELTNIVNATDDEFERIEKEMMAKTSDATGGRRAAVFVGTDTRPSSPDLLGTAVE

SEQ ID NO: 166554 - protein, 158 aa, Heterodera glycines
  misc_feature (59)..(59): Xaa can be any naturally occurring amino acid
  Homolog annotation: Hit_ID=CAE73665.1; Match level="QueryCoverage =96%, HitCoverage=49%, E-value=2e-39, Identity=50%"; Hit description =Hypothetical protein CBG21174 [Caenorhabditis briggsae]
  Coding regions on vcDNA: vcDNA=SeqID_92977; Strand=+; Position=6-479
MREKKRLLKFAEYLGHCSREATDYGKCVATNAERIRKGDCSTEFDRLIACLKKRQVRLXIAAPMKVKRLKRAAHILTFYRYNFHFLPPFSVLLDGTFCQAALQSKINLREQMLKYLAQSVEMVVTKCVLNELHQLGKPLHGALVICEQFRIAFCPHKP

SEQ ID NO: 166555 - protein, 198 aa, Heterodera glycines
  Homolog annotation: Hit_ID=NP_502425.2; Match level="QueryCoverage =78%, HitCoverage=41%, E-value=5e-17, Identity=37%"; Hit description =putative protein of ancient origin (4N471) [Caenorhabditis elegans] emb|CAB02264.2| Hypothetical protein
  Coding regions on vcDNA: vcDNA=SeqID_92978; Strand=+; Position=1-594
PFRIGRFGCSIIEPHLAVNVLANAQLFASFAGRLECSRFRSPRAVFLSSCTAHAGELSLLLENEEKFWCRRINDYKSYADSKLLLGIYVKHLSHVLKIRQSKIAVVSVHPGVVPGKLYRNVFWPFRLFINGFLRPFLRSPLLAATRVLDVAFSDDLCEGAYYEDSRVTALKCADDPEFVWSVGTSVRDMIVDSNANSF

SEQ ID NO: 166556 - protein, 199 aa, Heterodera glycines
  Coding regions on vcDNA: vcDNA=SeqID_92979; Strand=+; Position=1-597
GFSELFLPMGTLEDNTGATSAIFGNSTGPNGDETVRKFCDRKISSVRFLHDHSEYSSRFVTGTWCSPAGSGGNVTLWTVQQQRDEQSREGGRRIVQNGRIELPNCDVGDICVVNAQQFVVSTTAGDVQIVESPLASNGANLADGIAKISSVAKYPRVHKFASSTALCLLDEEIFSGSDSGQIIRIRPDSQSSQSTRAFA

SEQ ID NO: 166557 - protein, 149 aa, Heterodera glycines
  Homolog annotation: Hit_ID=NP_509485.1; Match level="QueryCoverage =65%, HitCoverage=47%, E-value=4e-09, Identity=35%"; Hit description =titin like (XJ383) [Caenorhabditis elegans] gb|AAA82383.1| Hypothetical protein M02D8.1 [Caenorhabditis e
  Coding regions on vcDNA: vcDNA=SeqID_92980; Strand=+; Position=32-481
MHFPPTIHNAQIRHGPLKPPNMSRSPTQPDTSLGKVYLECVASFSEPTKAKWLFGESELSKTDGRFEFSQEQQDTNRDKFICEIKNLDKSLTGVYKLVLISAEGRENIATFNLPLVGIEKCNWTNVAASLTMDPMVVREVPLQPLVPIR

SEQ ID NO: 166558 - protein, 35 aa, Heterodera glycines
  Coding regions on vcDNA: vcDNA=SeqID_92981; Strand=-; Position=0-104
KASLKNATFWVMQIQNVQNSVPIWLNCVISITLFS

SEQ ID NO: 166559 - protein, 41 aa, Heterodera glycines
  Coding regions on vcDNA: vcDNA=SeqID_92982; Strand=-; Position=2-124
RSFKVQKGIVVEPIKTTMLATLLNAFLQKFFRLNSSEATLI

SEQ ID NO: 166560 - protein, 165 aa, Heterodera glycines
  Coding regions on vcDNA: vcDNA=SeqID_92983; Strand=+; Position=1-498
ATRPLRFDRPAPQPQRVHPLSLIQMVTAAKIVDEQKRAKERTQTPLVYRMDPKLLIREATFNKMAQKQAAAKYLATKKRREKDEQREREFVRRAVTPPDFGQMDADAMVKLSDFMPAVPAQFDRSFRYETLTAPVKVPSDGVYSSDDILIIGAQMELANKTMTAK

SEQ ID NO: 166561 - protein, 188 aa, Heterodera glycines
  Coding regions on vcDNA: vcDNA=SeqID_92984; Strand=+; Position=3-569
YNQKIKTSNPLYGRGYFIEQKEYSNSNGCGFRKANRPLVPSNAADIESWEPKVMSTQEISKLTARCVGVTDAFIKLDNYVDSVKKYNPSNHDLLRMQRMQHQSKTLTEDPDKYAELIVQCVANPNKFNGTRHCLELVIGRRALEEFISRNEWTEERLKDYDINANWKFEPNELTVPPIPIYTGSLSSA

SEQ ID NO: 166562 - protein, 122 aa, Heterodera glycines
  Coding regions on vcDNA: vcDNA=SeqID_92985; Strand=+; Position=97-465
TLSNQWLIGNNNNNNNHILSTQLTTDTAGQSPIWYHWASMAQLCPSAHLKEAKPTRPREVPFLQHCRQCKVKTVRRPSLAARKCHLRWARVCSGNGLAPHRWHLGALLIGGDALCSQKLSDH

SEQ ID NO: 166563 - protein, 110 aa, Heterodera glycines
  Homolog annotation: Hit_ID=NP_499520.1; Match level="QueryCoverage =70%, HitCoverage=86%, E-value=5e-14, Identity=41%"; Hit description =putative endoplasmic reticulum protein, with a transmembrane domain (11.3 kD) (3M822) [Caenorhabditis ele
  Coding regions on vcDNA: vcDNA=SeqID_92986; Strand=+; Position=15-347
MPLASKSVAFLPSFSSSLCSAFLLLQFLLPFCASADFDLSTKSGSKVCVGEICADSSPFHYYECCGQIYNECCLRLQTWLIAVLLVVAICAIASFLIGLIKCICCCNGNR

SEQ ID NO: 166564 - protein, 192 aa, Heterodera glycines
  misc_feature (165)..(165): Xaa can be any naturally occurring amino acid
  misc_feature (178)..(178): Xaa can be any naturally occurring amino acid
  Homolog annotation: Hit_ID=NP_502244.1; Match level="QueryCoverage =97%, HitCoverage=30%, E-value=2e-25, Identity=32%"; Hit description =BTB domain containing (67.7 kD) (4M616C) [Caenorhabditis elegans] emb|CAB01179.1| Hypothetical protein F3
  Gene Ontology: Mol. function=protein binding
  Coding regions on vcDNA: vcDNA=SeqID_92987; Strand=+; Position=19-594
MSSKPETLVERMKHLLSSGDDADVLFLVGEGEGKEHVPAHRAILNSASDVFEAMFRFDTTKNATDNESAGGEAKGPVEVTDIDAHVFKVMLNFIYADDLSELNGDNAMAVLYTAKKYNLNALAKACLNVPISELGNVFLAYDQSRLLSEKDFSRRCLDYIDQNAXSLIQSDAFLEVNXNLLYEILERDQLKI

SEQ ID NO: 166565 - protein, 212 aa, Heterodera glycines
  Homolog annotation: Hit_ID=CAE62876.1; Match level="QueryCoverage =100%, HitCoverage=30%, E-value=7e-49, Identity=47%"; Hit description= Hypothetical protein CBG07062 [Caenorhabditis briggsae]
  Gene Ontology: Mol. function=ATP dependent RNA helicase activity; Cellular component=nucleolus; Biological process=ribosomal large subunit assembly and maintenance
  Coding regions on vcDNA: vcDNA=SeqID_92988; Strand=+; Position=3-638
RCRVIHEFNAGRWPYIIASECNDIFDGDNEQEQNGEQETAKNGDEAKEQQGDTTKQQKIRKRKELKKKSKRRQLDKESGIGRGIDFHSVSNVINFDFPLSTDMYVHRVGRTARGFNKGTAISFASQEELNLFEVVRTEINERMGQAVIQPYEVRMKDFESFQLRARDVIAACTKTVIRETRMAEIRAELLKSKRLDAYFEKNPREKRALEQD

SEQ ID NO: 166566 - protein, 165 aa, Heterodera glycines
  Homolog annotation: Hit_ID=AAP30774.1; Match level="QueryCoverage =95%, HitCoverage=84%, E-value=4e-86, Identity=100%"; Hit description= putative gland protein G30E03 [Heterodera glycines]
  Coding regions on vcDNA: vcDNA=SeqID_92989; Strand=+; Position=1-498
PRAEFGTRPCCPGSQHVVSMMKDHTGTFSASMPKSSLCLSAERVAAAVENQLKTIWCPGNGGQTLINEINAAQSSSDECARSLGFIRAMFEIAASAASHAGANAELANLAVQFREQVGTIDTNCAALGIHVGQISLGTPKGDHPQVHDSESVLSNPGTSGSHKRI

SEQ ID NO: 166567 - protein, 182 aa, Heterodera glycines
  Homolog annotation: Hit_ID=AAR39410.1; Match level="QueryCoverage =97%, HitCoverage=59%, E-value=1e-93, Identity=93%"; Hit description =beta tubulin [Chlamys farreri]
  Gene Ontology: Mol. function=MHC class I protein binding; Cellular component=tubulin; Biological process=natural killer cell mediated cytolysis
  Coding regions on vcDNA: vcDNA=SeqID_92990; Strand=+; Position=3-548
MVGFAPLTSRGSQQYRALTVPELTQQMFDAKNMMAASDPRHGRYLTVAAMFRGRMSMKEVDEQMLNVQNKNSSYFVEWIPNNVKTAVCDIPPKGLKMSVTFLGNSTAIQELFKRISDQFTAMFRRKAFLHWYTGEGMDEMEFTEAESNMNDLVSEYQQYQDATADDEGELDEEEGEGEAEAA

SEQ ID NO: 166568 - protein, 200 aa, Heterodera glycines
  misc_feature (15)..(15): Xaa can be any naturally occurring amino acid
  Homolog annotation: Hit_ID=NP_493548.1; Match level="QueryCoverage =100%, HitCoverage=31%, E-value=1e-50, Identity=49%"; Hit description= beta-glucuronidase precursor (1P268) [Caenorhabditis elegans] emb|CAC70111.1| Hypothetical protein Y105E
  Gene Ontology: Mol. function=beta-glucuronidase activity; Cellular component=lysosome; Biological process=glycosaminoglycan catabolism
  Coding regions on vcDNA: vcDNA=SeqID_92991; Strand=+; Position=2-601
GFDRAAMVKDMNMFXWLNGNCYRTSHYPYAEERAYWADRRGIAVITEVPAVGIWKLYSSALLKLRGEMIAEMVSRDRNHPSVIMWSLSNEPKMPADSTPYKYFKNLVTLTKRLDATRPVTAVFGHASAAVKVASLLDVICVNEYFGWYRNIGMLGLIRDQLLDQFPKWRHNYTKPVILSEYGAEAITGFNDQPSVPFSER

SEQ ID NO: 166569 - protein, 150 aa, Heterodera glycines
  Homolog annotation: Hit_ID=EAA16908.1; Match level="QueryCoverage =72%, HitCoverage=8%, E-value=7e-17, Identity=48%"; Hit description =Drosophila melanogaster CG8797 gene product-related [Plasmodium yoelii yoelii]
  Coding regions on vcDNA: vcDNA=SeqID_92992; Strand=+; Position=86-538
QPDGGVRQLRLGRQQPDGGIRQLRLGQQQQQPVGGIRQSQLWQQQPDGGIRQPQLWQQQPIGGIRQPQLWQQQPIGGIRQPQLGQQQPDGGIRQPQLGQQQPDGGIRQPQFWEWHCPATGCQWQKQRRRTVSGAVATPAAGAGATTGHSA

SEQ ID NO: 166570 - protein, 209 aa, Heterodera glycines
  Homolog annotation: Hit_ID=NP_497707.1; Match level="QueryCoverage =95%, HitCoverage=87%, E-value=7e-38, Identity=43%"; Hit description =putative cytoplasmic protein of ancient origin (3E515) [Caenorhabditis elegans] emb|CAA91342.1| Hypotheti
  Coding regions on vcDNA: vcDNA=SeqID_92993; Strand=+; Position=15-641
MDNTNNKFILLKNGAKLFYASEECVRQEAKNFVGGIVGLNGPSDLEEGIYEGGLKIWECTVDLCNFLLSNYQTMSGIDILELGCGAALPSILALSMGADSICVQDFNTFVVECFTKRNFKLNGHKIDGGKCAFINGRWGGEILGKIGQKKFGLIITCETIYNEANYASLHETMDALLADDGKILLAAKSHYFGVGGSVLAFVEFVRSRG

SEQ ID NO: 166571 - protein, 30 aa, Heterodera glycines
  Coding regions on vcDNA: vcDNA=SeqID_92994; Strand=-; Position=0-89
LLPTFVGRLAQPNCHNRRRNWKIPSQLNWT

SEQ ID NO: 166572 - protein, 122 aa, Heterodera glycines
  Homolog annotation: Hit_ID=2014260A; Match level="QueryCoverage=92%, HitCoverage=42%, E-value=8e-16, Identity=39%"; Hit description =orotidine monophosphate decarboxylase
  Gene Ontology: Mol. function=orotidine-5'-phosphate decarboxylase activity; Biological process=UMP biosynthesis
  Coding regions on vcDNA: vcDNA=SeqID_92995; Strand=+; Position=3-371
QLSTDGALTDGAYAAKCARIGRECGDKLVAGFICQQRCSGESNDATEQQQFLHWTPGVNLSGAPGDGLGQRWRTPAEAVARDACDIVVVGRGITGAADVGAEAKRYARVAWDALRAARAWTD

SEQ ID NO: 166573 - protein, 192 aa, Heterodera glycines
  Homolog annotation: Hit_ID=CAE63469.1; Match level="QueryCoverage =79%, HitCoverage=67%, E-value=7e-12, Identity=33%"; Hit description =Hypothetical protein CBG07936 [Caenorhabditis briggsae]
  Coding regions on vcDNA: vcDNA=SeqID_92996; Strand=+; Position=1-576
VCQTLSDLSDFLDKFDGRDKTIRSLHFALVLIANRFRDRRKSDRLMAFAKQFSQTRLICRLFSQPSLLLSVLRIPRAFRLSRDRVDCALASSVSVLYLFCGWNELISLLAESGFVGRAKANILKCHGNALHFWVLALAFCIVRCLRQIALRGMPKANALARHQHNDRQWLRSIHFSHWLFRRFCSRCQFVAP

SEQ ID NO: 166574 - protein, 197 aa, Heterodera glycines
  Homolog annotation: Hit_ID=CAE57679.1; Match level="QueryCoverage =100%, HitCoverage=31%, E-value=1e-34, Identity=43%"; Hit description= Hypothetical protein CBG00673 [Caenorhabditis briggsae]
  Gene Ontology: Cellular component=nucleolus; Biological process=growth
  Coding regions on vcDNA: vcDNA=SeqID_92997; Strand=+; Position=69-659
MAKYCLKKQSKRLTCKKKFKIQRKVREHSRKLKKMSKESERKKKTEKQISVPSKCPFKEEILMEAEQKRTEAKEMEQERKARQKAAKKAGGGVVKKQSKKLATTNPLSSIEALAKRVAKDEDNYNANQFLVDSLPEVPGATTENNDTKSGARANAKSVRSFAAEVRRTIENADIVIEVLDARDPLGSRSAQIETLVL

SEQ ID NO: 166575 - protein, 205 aa, Heterodera glycines
  Homolog annotation: Hit_ID=NP_501547.1; Match level="QueryCoverage =90%, HitCoverage=42%, E-value=3e-28, Identity=37%"; Hit description =serine threonine protein phosphatase family member (4J668) [Caenorhabditis elegans] sp|P48460|YY06_CAEEL
  Gene Ontology: Mol. function=protein serine/threonine phosphatase activity; Cellular component=cytoplasm; Biological process=protein amino acid dephosphorylation
  Coding regions on vcDNA: vcDNA=SeqID_92998; Strand=+; Position=32-646
MSSAPPSPAQLLAHKVASKIIETESVNGITDAEMMALLKYGTELLEKEPARVPLEAPCYIFGDIHGNLPGFLLFFTKANVESRLLQLHSPKCNLLVLGDFVDRGLYSLEVASLLISFKLLFCDKIFVVRGNHEIESTNFEYGFKEEVDAKRPDQAEQIYNAWNCLFAKLPLCAVISNTFLCMHGGLPRPGGWDFMMGSAFVKPAD

SEQ ID NO: 166576 - protein, 100 aa, Heterodera glycines
  Coding regions on vcDNA: vcDNA=SeqID_92999; Strand=+; Position=177-476
VPSQCSPSALPNCPLPTPARPPRTAALLVAPDGSAICRLFIGLGGQRNNGTEVSQRGRLRRRLLREEKALRRYKRPTGEDSKKYPKKECPENREGNKYPK

SEQ ID NO: 166577 - protein, 222 aa, Heterodera glycines
  Homolog annotation: Hit_ID=CAE68383.1; Match level="QueryCoverage =100%, HitCoverage=9%, E-value=2e-82, Identity=66%"; Hit description =Hypothetical protein CBG14139 [Caenorhabditis briggsae]
  Gene Ontology: Mol. function=structural constituent of cytoskeleton; Cellular component=spectrin; Biological process=body morphogenesis (sensu Nematoda)
  Coding regions on vcDNA: vcDNA=SeqID_93000; Strand=+; Position=2-667
EQSAAIEQRHRAVIQRWQQLLANSLERRRKLTEAQAHFKQIEDLYLTFAKKASAFNSGLENAEEDLTDPARCNSLEEIRALREAHTEFQKSLVGAEDDFRQLQELDRQIKSYNGGANPYTWFTIEALSETWQNLQEIIKERELELQKEHRRQEDNDKLRREFARQANEFHQWLADTRGEMMEASGSLGAQLETIRRNGQDIKAQRAKLKKVEDWGALLEEHL

SEQ ID NO: 166578 - protein, 66 aa, Heterodera glycines
  Coding regions on vcDNA: vcDNA=SeqID_93001; Strand=+; Position=2-202
GAETSARPPPPAEELCADDVKVAFIEANFMPDCERACRYYEDFADVAFETMFFGKTDEERVTKLSF

SEQ ID NO: 166579 - protein, 36 aa, Heterodera glycines
  Coding regions on vcDNA: vcDNA=SeqID_93002; Strand=+; Position=3-113
LYVYFILQIVIYIMLLVTRNQTEKFWNYSQDISLFD

SEQ ID NO: 166580 - protein, 197 aa, Heterodera glycines
  Coding regions on vcDNA: vcDNA=SeqID_93003; Strand=+; Position=6-596
MGICRWLGRKEEVSLFDNGLRIESSLKILTDDKWQNRYVVCQRRCLSEAPLLGIFKNGGCRERGEHLELFYLQNYIGYEYGFKFKRSNKTLAILIQGQTLIFSFSNVESMVFWKEWLKDVCGRSAMYFVKCHTIPKDNSVIKLNSRSARIHITRYALVIVQEVPPKQRLYLNLEDLSDVECVQNRFAFRALTYPWTP

SEQ ID NO: 166581 - protein, 132 aa, Heterodera glycines
  Coding regions on vcDNA: vcDNA=SeqID_93004; Strand=+; Position=37-435
NKSVLFSVFCSKSTALTSRWTARTFNGQPFTTTTAHFLAMGLVTVYGLGVRTLRRRTCSNRTTCDQRELSPGADPNNKCQIYCCNNANSVVTVHHRLLVLFRFGDLLIGALIRTNSFLRWPFLSHSLPVGTE

SEQ ID NO: 166582 - protein, 178 aa, Heterodera glycines
  misc_feature (13)..(13): Xaa can be any naturally occurring amino acid
  Homolog annotation: Hit_ID=CAG08368.1; Match level="QueryCoverage =100%, HitCoverage=65%, E-value=6e-69, Identity=56%"; Hit description= unnamed protein product [Tetraodon nigroviridis]
  Gene Ontology: Mol. function=protein serine/threonine kinase activity; Cellular component=nucleus; Biological process=signal transduction
  Coding regions on vcDNA: vcDNA=SeqID_93005; Strand=+; Position=1-535
VILTEDDVKFYMXEIILALEHLHSLGIVYRDLKPENILFDSDGHINLTDFGLSKESLDVPGQVTYSFCGTVEYMAPEVVNRRGHSVAADWWSLGVLMYEMLTGHLPFQGKDRHDTMNLILRAKLPMPVYLSGDAQSLLRALFKRNPANRLGGGAQGAAALRDHRFFASVNWQRLAQRQ

SEQ ID NO: 166583 - protein, 201 aa, Heterodera glycines
  Homolog annotation: Hit_ID=CAE68360.1; Match level="QueryCoverage =76%, HitCoverage=60%, E-value=5e-36, Identity=48%"; Hit description =Hypothetical protein CBG14099 [Caenorhabditis briggsae]
  Gene Ontology: Mol. function=electron transporter activity; Cellular component=extracellular space; Biological process=electron transport
  Coding regions on vcDNA: vcDNA=SeqID_93006; Strand=+; Position=15-617
MRRRPFLSLFILFLSLRFTPILAHTDNENAEEAENSNKVEPERPKSDGEGEISKDPSGGFGTDIEWVPWDQAVSVALDLNRPIFLLIHKTWCGACDALKKSFATSPKRKELLELSKQFVMVNTEDEEEPEEEEYAPDGRYIPRLFILNKHGKRLPVDNKKNYPSNVAYFPQVPDVIRAMKEGTEEFEKEQKGTERTEEGEN

SEQ ID NO: 166584 - protein, 25 aa, Heterodera glycines
  Coding regions on vcDNA: vcDNA=SeqID_93007; Strand=-; Position=3-77
QGISTTNPKFTIMYNNSSKAWHIVQ

SEQ ID NO: 166585 - protein, 127 aa, Heterodera glycines
  Homolog annotation: Hit_ID=NP_741677.1; Match level="QueryCoverage =99%, HitCoverage=31%, E-value=5e-17, Identity=32%"; Hit description =aspartic protease (42.7 kD) (asp-1) [Caenorhabditis elegans] emb|CAC51056.1| Hypothetical protein Y39B6A.
  Coding regions on vcDNA: vcDNA=SeqID_93008; Strand=+; Position=2-382
QIGKYRSYRDYTAAVDTGTELIGGPVHLMQMIIAATNADYCEEDNLYTVPCDQRPKLASIVLKVNGKDIVVPAEEYIIDLNLPDGKCALGLFGQYGVGFTTDWVLGALFLNAYCTMFDYDKGQVSFS

SEQ ID NO: 166586 - protein, 122 aa, Heterodera glycines
  Coding regions on vcDNA: vcDNA=SeqID_93009; Strand=+; Position=1-369
QELLRRRNSPVDPRDRFGSIAAKKVHMPQTERIYYGFQPDVWNEGAQIERLLHERQNAFMADDERVEDEFAEGRVPQIVEPAQGTCPGLKKHARIQRKRREWRTLMKAERKRKAVATDPGCV

SEQ ID NO: 166587 - protein, 188 aa, Heterodera glycines
  Coding regions on vcDNA: vcDNA=SeqID_93010; Strand=+; Position=1-564
EMRSDPTQSRRYKHNTAAAANGFTTAGVFVGHRTRRQWRFLLLLSVLFSVTFIFGFWAFQSDEWSSFSPPYHKLEQLASAPWNNTTSTTTAEGTKEPNGKEEGLSAEKAKTNRAENATENVPNVSSTFAVPSRHSVPDLPPACADHPPGLIGPIPVWMDGPGFETEFLIEFKNIRLKCRAEFANSCPE

SEQ ID NO: 166588 - protein, 173 aa, Heterodera glycines
  Coding regions on vcDNA: vcDNA=SeqID_93011; Strand=+; Position=1-522
GILLLLRRCYGFQRHASGKLLYVRAVGIAETVASWVFYSYAPVYAALLYDLARYSSLPLSYLKANYDPSVFYLIEMLLRIDKQIQLRDLPSVINDCRSFGLRELILSIIYIKLAERVYDLNHAIGYTSLETVKHMVQETLSTYVELAERLQSPEIKNLLTYVAKKALENGRKK

SEQ ID NO: 166589 - protein, 170 aa, Heterodera glycines
  Homolog annotation: Hit_ID=CAE64875.1; Match level="QueryCoverage =98%, HitCoverage=22%, E-value=3e-14, Identity=28%"; Hit description =Hypothetical protein CBG09687 [Caenorhabditis briggsae]
  Coding regions on vcDNA: vcDNA=SeqID_93012; Strand=+; Position=12-521
MPDEPLITERINEILESAEATRGSQQPWPPRVRLKVIYSGRWLDIPPINGRKWGPNHFAGKVANAAEMIVVRAVHPEKKAKNVNDEQLQNILGSRTDDICSVDEMVGKYYTQCDFKSRLSVLSEITMGKQLQEYSNTEATTQFKFTAADKALSDSIRTQIDAMTAKVKGM

SEQ ID NO: 166590 - protein, 43 aa, Heterodera glycines
  Coding regions on vcDNA: vcDNA=SeqID_93013; Strand=+; Position=3-131
TFCVVYFPNLFFHFVFFFCYFFKLSPFLLLYKFILIKKKKKKK

SEQ ID NO: 166591 - protein, 48 aa, Heterodera glycines
  Coding regions on vcDNA: vcDNA=SeqID_93014; Strand=+; Position=3-149
VGQSVPHLSGEAGVTPPICQCQCSNCEAGPRDSCAEETLKQIRAAYNF

SEQ ID NO: 166592 - protein, 82 aa, Heterodera glycines
  misc_feature (28)..(28): Xaa can be any naturally occurring amino acid
  Homolog annotation: Hit_ID=NP_740829.1; Match level="QueryCoverage =95%, HitCoverage=22%, E-value=4e-13, Identity=48%"; Hit description =poly U binding factor 68kD like (rnp-6) [Caenorhabditis elegans] gb|AAM81102.1| Rnp (rrm rna binding doma
  Gene Ontology: Cellular component=nucleus; Biological process =cystoblast cell division
  Coding regions on vcDNA: vcDNA=SeqID_93015; Strand=+; Position=167-412
RYNRYAMHRSMTYIMLKQRYALRQQQPXVSLYTQALSIMSWVYIGSINFDICEEHLRQVSAPNGPIKLINMCRDPPTDNHKA

SEQ ID NO: 166593 - protein, 116 aa, Heterodera glycines
  misc_feature (42)..(42): Xaa can be any naturally occurring amino acid
  Homolog annotation: Hit_ID=NP_496170.1; Match level="QueryCoverage =58%, HitCoverage=8%, E-value=2e-09, Identity=51%"; Hit description =procollagen-lysine precursor, LEThal LET-268 (84.4 kD) (let-268) [Caenorhabditis elegans] emb|CAA91321.1|
  Coding regions on vcDNA: vcDNA=SeqID_93016; Strand=+; Position=56-406
MFNSYKLSKLGIAIDSMSYIFQNLNGMQEFVGISPQSAKNSXDFVMLENFLYNTNPLILHGNGPSKSQLNVLENYLTRGKIYQVFEVSVFQQSWKNVEDITFVPEEHMGNSTKNCE

SEQ ID NO: 166594 - protein, 126 aa, Heterodera glycines
  Coding regions on vcDNA: vcDNA=SeqID_93017; Strand=+; Position=3-383
TFVHFSINIVFFVPFISGILPLIPFISSSAASFGVTSKQSPLLNLGGAVNNAKELPVLAGAMVMLSLFQLAAAFSLLLYGCRTFGRTMRHVENIQRGINALQSQQNPGGEIGEQEKDAGGEMRRKL

SEQ ID NO: 166595 - protein, 122 aa, Heterodera glycines
  Homolog annotation: Hit_ID=NP_497227.1; Match level="QueryCoverage =99%, HitCoverage=67%, E-value=8e-35, Identity=53%"; Hit description =cysteine-rich hydrophobic protein similar to CHIC1 and CHIC2 (19.8 kD) (3B256) [Caenorhabditis elegans] g
  Coding regions on vcDNA: vcDNA=SeqID_93018; Strand=+; Position=2-370
PEPIVIRGVGHLTMCGLNSHFSTEIPRALTGKVAPEEFDDTLQRANYDLHRNESRNLRWVICGVLFCCCTFRISVWSVVCLNGTTIAALEKTLDHDNQLVYYKLSLHWKMARMPDDPINRLT

SEQ ID NO: 166596 - protein, 57 aa, Heterodera glycines
  Homolog annotation: Hit_ID=NP_500801.2; Match level="QueryCoverage =100%, HitCoverage=12%, E-value=2e-15, Identity=66%"; Hit description= brg1 brm-associated factor 53A (48.4 kD) (4G161) [Caenorhabditis elegans] gb|AAF60947.2| Hypothetical pr
  Gene Ontology: Mol. function=chromatin binding; Cellular component =SWI/SNF complex; Biological process=signal transduction
  Coding regions on vcDNA: vcDNA=SeqID_93019; Strand=+; Position=2-175
TIKIRVSNPNYSTSTERRFGAWIGGSIVSSLGTFQQLWISKGEYEETGKSIVERKCP

SEQ ID NO: 166597 - protein, 193 aa, Heterodera glycines
  Coding regions on vcDNA: vcDNA=SeqID_93020; Strand=+; Position=49-630
RIEMCCSDKWTCCCCCHVTKGAHVLAWFCLAIGILMVPVLWFFLAASLFLFFIGLLWVLPYFTGIPIILGELRGKRTHRMYLPFLIVFGIGLVFMIFYGGADIFVKMNENVPNNSTNASAVEHNRTIKKADTELSKTTLHTIKIGSYFFSWFLTLALNVWLYSIVLRAYFFMKRQNQNMNGAERNQKFENIAL

SEQ ID NO: 166598 - protein, 198 aa, Heterodera glycines
  Homolog annotation: Hit_ID=CAF92976.1; Match level="QueryCoverage =94%, HitCoverage=36%, E-value=7e-24, Identity=36%"; Hit description =unnamed protein product [Tetraodon nigroviridis]
  Gene Ontology: Mol. function=protein binding
  Coding regions on vcDNA: vcDNA=SeqID_93021; Strand=+; Position=30-623
MPKPEALVDRMKLLLSTGEDADVHFLVGDEKDKKLLKAHKIVLKSASDVFEAMFRFDSQNAKNAAGEAPSSSAELFSAVEVPDVDAGAFEAMLRFIYEGNLSELNGENAMALLYAAKKYDIGGLVRACVNIHIPNLRNVFLAFAQARFLQENDFSQQCLNYIDSNADSLIRSDAFLQIDQNLLTEILERDQLKIEHEI

SEQ ID NO: 166599 - protein, 212 aa, Heterodera glycines
  Coding regions on vcDNA: vcDNA=SeqID_93022; Strand=-; Position=3-638
LSLAWASRAVRRLLPMRNFAFSTVVVVVVLVALLFVSARVVLLRLIVVLLQPLRRRHEITDKTTMPSTTMAKMRNDENGATAIGGQITRLCEILSPELEPAPNWISLGSLTIARRSSSARRLKELTLQPAQPGHHVLLRDVQPPVTALSTTSLAILSPAEPTELEVFEQSLDGGWPRSVLSSSPSVYITGRNRLIGREDVSSPVTTAEMSGS

SEQ ID NO: 166600 - protein, 201 aa, Heterodera glycines
  Homolog annotation: Hit_ID=CAE62115.1; Match level="QueryCoverage =90%, HitCoverage=48%, E-value=2e-53, Identity=56%"; Hit description =Hypothetical protein CBG06153 [Caenorhabditis briggsae]
  Gene Ontology: Mol. function=neuropeptide receptor activity; Cellular component=integral to plasma membrane; Biological process=G-protein coupled receptor protein signaling pathway
  Coding regions on vcDNA: vcDNA=SeqID_93023; Strand=+; Position=35-637
SSSLNPRTEQLAQSQKFGLCSHLRASFPELVDLLPIQLSFSALYFLIWLAAILGNASVLYVVSLKQVQLSSVRSVFICSLAASDILMSFTSLPITAISIFTRDWVFPSPFCKLMGIFQGGTVFVSSFTLTAIAVDRYILIKHPTKQKIEFRTAICIVIGVWTLGYACALPVGLFSSTQEYPPFCGTFCEENWPDTEEQTGR

SEQ ID NO: 166601 - protein, 159 aa, Heterodera glycines
  misc_feature (32)..(32): Xaa can be any naturally occurring amino acid
  Homolog annotation: Hit_ID=NP_495993.1; Match level="QueryCoverage =86%, HitCoverage=42%, E-value=2e-33, Identity=43%"; Hit description =grey-lethal osteopetrosis like (2J643) [Caenorhabditis elegans] pir||T22084 hypothetical protein F42A8.3
  Coding regions on vcDNA: vcDNA=SeqID_93024; Strand=+; Position=1-478
MFSLIFFFIFATISHLNGNDDELWDINLSCKXFIKSLAAKYSDLVRCAVENNSPSQVCTKCVRQYINFSEQHYQSLHLANTTSLDNRTCTTVIYNSYRISYAQKMNSALSESIWEASNCHDCLRIDWNFEHGNSTFEFDNKTVQFKNYLWQWRNCVVQQ

SEQ ID NO: 166602 - protein, 26 aa, Heterodera glycines
  Coding regions on vcDNA: vcDNA=SeqID_93025; Strand=-; Position=1-78
FFFILFFTHGTVLLWTLPFYWSLRAL

SEQ ID NO: 166603 - protein, 19 aa, Heterodera glycines
  Coding regions on vcDNA: vcDNA=SeqID_93026; Strand=-; Position=2-58
NYYRHYMIFTKPYKIKKRL

SEQ ID NO: 166604 - protein, 125 aa, Heterodera glycines
  Coding regions on vcDNA: vcDNA=SeqID_93027; Strand=-; Position=139-516
AKTFYTLTTIANLFQEKASRTGSNASTTSGGSCAGLYNGVRKSAAAVSSDEAGNCVSEDDDVDSHEDENECVVNGSDDGGRTNNHVEDGQQQQQHEEDDGEASQRQIQSKGPSSDYLPFSSVLHH

SEQ ID NO: 166605 - protein, 152 aa, Heterodera glycines
  Homolog annotation: Hit_ID=CAA70694.1; Match level="QueryCoverage =100%, HitCoverage=43%, E-value=1e-87, Identity=99%"; Hit description= cathepsin S-like cysteine proteinase [Heterodera glycines]
  Gene Ontology: Mol. function=cathepsin S activity; Cellular component= lysosome; Biological process=proteolysis and peptidolysis
  Coding regions on vcDNA: vcDNA=SeqID_93028; Strand=+; Position=3-461
GGLMDSAFEYVRDNNGLDTEESYPYEAVTGKCQFKNETVGGTVVSFKDLKEGDEEQLKIAVATIGPISVALDASNLSFQFYKTGVYYERWCSNRYLDHGVLLVGYGTDETHGDYWLVKNSWGPHWGENGYIRIARNKQNHCGIATMASYPVV

SEQ ID NO: 166606 - protein, 101 aa, Heterodera glycines
  misc_feature (94)..(94): Xaa can be any naturally occurring amino acid
  Coding regions on vcDNA: vcDNA=SeqID_93029; Strand=+; Position=3-305
HLSGTVWHRKGITCPSQGKFGHLRFLRQALLLRDALSVPSVPSVLKVPFDVKHNELEMILLFYFTGLFHFSFLISKQFFLICKFFIIYINFHLXKKKKKKK

SEQ ID NO: 166607 - protein, 84 aa, Heterodera glycines
  Coding regions on vcDNA: vcDNA=SeqID_93030; Strand=+; Position=1-255
VNVTTNSNQISVYAASKFRVDINVSTRDESHLNNKYEILMEINTTDGGKQTILLDSKALVFLHDQLDALTRTFPKCYVCVDEKK

SEQ ID NO: 166608 - protein, 195 aa, Heterodera glycines
  Coding regions on vcDNA: vcDNA=SeqID_93031; Strand=+; Position=13-597
MSSSIASPDTFLRSETDQTPAASAAEEVGKYEVFSWHGNLSDQLSAELFVTDQQLLKECREKLAKSELKETKLLWNNGELNAENRALKAELEKQKLMTEHIELKAKVFNMEQEKQQFEKKYVSVDVFNSLAERIKQLEYQQQEKREEDRNVSVGQLLEKFLAGEKQQKQQKKDNAQQRLDGKCSVVDKNNVAGTS

SEQ ID NO: 166609 - protein, 158 aa, Heterodera glycines
  Coding regions on vcDNA: vcDNA=SeqID_93032; Strand=+; Position=1-474
VHLSQNHIFCLPYNFISMVCLSRPLQIVVKKGGETVWKEVSFNKLPKDQQNANLSRMPIYFLVLPFCAASFGYYAMAQYQFNPESWVAIQIGKVTDILFPSQSTKSPNPIISLKNNALTNYKEFIETERAMRRPTEEVQMETKTEEQMRKEAEELWEQ

SEQ ID NO: 166610 - protein, 124 aa, Heterodera glycines
  Coding regions on vcDNA: vcDNA=SeqID_93033; Strand=+; Position=244-615
LDFDQRATATEPPKAAGKRFLSALLPGKKKVRLGLSISEPPLNFDIEPSKNDFEPTEIKRGENAKGGQIADHQQNFGERNRLCDGISDGSRKSRPNFAGALQNVREKLNVRPSSNSHRSSAFSP

SEQ ID NO: 166611 - protein, 58 aa, Heterodera glycines
  Coding regions on vcDNA: vcDNA=SeqID_93034; Strand=-; Position=2-175
IRINIIGTFLNTLAASFKLSINSLALFPSFCAIPLFCPALNSSTRCCCCCLLLRSATR

SEQ ID NO: 166612 - protein, 203 aa, Heterodera glycines
  Coding regions on vcDNA: vcDNA=SeqID_93035; Strand=+; Position=16-624
MNIPPKSFNLAPIAEQEGCDLDRSVSSSSFTNHQQIGQARRSHPRGMPRMIRLRRKRRDDPFGTLIQSTKKMRLNDQWNSSEGQASGVEGTTTIAKNFAMIGERAPSGSHNISKMDGVLFTEDEEDELLFYYGGQDEEDDSDADGYDDESDSNAEEYYKNDYPDEENGKFISFADGVRTNEYENDSTSGDDNFDHYGDEATKY

SEQ ID NO: 166613 - protein, 132 aa, Heterodera glycines
  Coding regions on vcDNA: vcDNA=SeqID_93036; Strand=+; Position=86-481
MASKADITQLPTTSSTVQSPAALPSAEGSVNPRHASPSSQTRFAARNTNKLNKSNNGANSSRRPHQLENQNTSESLALSAFVQSSSCSANDQDNNLDGRNSLHENYDNYDSPSVGAPGNRILSETNLYIRGL

SEQ ID NO: 166614 - protein, 117 aa, Heterodera glycines
  Homolog annotation: Hit_ID=CAB03869.1; Match level="QueryCoverage =99%, HitCoverage=11%, E-value=1e-48, Identity=80%"; Hit description =Hypothetical protein C09H6.2a [Caenorhabditis elegans] pir||T19171 hypothetical protein lin-10 - Caenorhab
  Gene Ontology: Mol. function=protein binding; Cellular component =synaptic vesicle; Biological process=synaptic vesicle docking
  Coding regions on vcDNA: vcDNA=SeqID_93037; Strand=+; Position=1-351
GETIRKSPRVICHIFESEESAFIAQSIGQAFQVAYVEFLRANGIEDPNYLRDIDYQEVLNSQELLGEELEMLARKETQKDVVVSKKSGETLGIVVVESGWGSMLPTVVIANMSPGGS

SEQ ID NO: 166615 - protein, 136 aa, Heterodera glycines; identical to SEQ ID NO: 147069
  Homolog annotation: Hit_ID=AAO33475.1; Match level="QueryCoverage =100%, HitCoverage=100%, E-value=5e-76, Identity=100%"; Hit description=gland-specific protein g5d08 [Heterodera glycines]
  Coding regions on vcDNA: vcDNA=SeqID_93038; Strand=+; Position=56-466

SEQ ID NO: 166616 - protein, 113 aa, Heterodera glycines
  misc_feature (30)..(30): Xaa can be any naturally occurring amino acid
  misc_feature (69)..(69): Xaa can be any naturally occurring amino acid
  Homolog annotation: Hit_ID=CAE61802.1; Match level="QueryCoverage =100%, HitCoverage=38%, E-value=3e-32, Identity=60%"; Hit description= Hypothetical protein CBG05768 [Caenorhabditis briggsae]
  Coding regions on vcDNA: vcDNA=SeqID_93039; Strand=+; Position=2-340
SLHNRLKDIHIKLDRTRRGEDRYLHLLTEXHAAITSERELLSSFEQLEANERDAFNLLSSKDDINHERXRERDERTKYWTVTGSMVGAFLGIFGTTIANELRMRRVLEMIPSG

SEQ ID NO: 166617 - protein, 209 aa, Heterodera glycines
  Homolog annotation: Hit_ID=XP_425257.1; Match level="QueryCoverage =95%, HitCoverage=44%, E-value=1e-27, Identity=34%"; Hit description =PREDICTED: similar to KIAA0265 protein [Gallus gallus]
  Coding regions on vcDNA: vcDNA=SeqID_93040; Strand=+; Position=1-627
EQSDGKTKEVLYIAGGTTGHVYNMDIWRLERPLGQPRIPWICTPLHRDGLEIGRYRLEMAAHGQKLYTFGGGAPEFCAEFDEILAFDLSTNRFGKIRALPDPKYGVPIGRKCHALVQKGNLAYLIGGCRDAETQQNQNRSHQLIADVWKFDMNTAQWVRMRNNLAKAVFFHSAALTSDDCLFVFGGCTDELSERRCNSLQQMWLQPPSL

SEQ ID NO: 166618 - protein, 61 aa, Heterodera glycines
  Coding regions on vcDNA: vcDNA=SeqID_93041; Strand=+; Position=3-185
QIKQAKMSKFVPLFLFLFSALLLIFLCPPTSAQGRPPPSKSGRPTQHGRVTTDGEDKDGTA

SEQ ID NO: 166619 - protein, 176 aa, Heterodera glycines
  Homolog annotation: Hit_ID=NP_542128.2; Match level="QueryCoverage =94%, HitCoverage=19%, E-value=7e-27, Identity=37%"; Hit description =ubiquitin conjugating enzyme 7 interacting protein 1 isoform A [Mus musculus] gb|AAH65066.1| Ubiquitin co
  Coding regions on vcDNA: vcDNA=SeqID_93042; Strand=+; Position=1-531
LEESLGEAKLDQLERCKSCNFAIIIEVSAEEHRVFACLKCHAEHCRLCGKPWDEFHLGKPCNEVETEKEQMKRYFENRLSEAVIHRCRRCSLPFVKQMGCNRMYCRCGATQCYVCRAHNIQYNHFCQHYRNPGQVKCKQCTLPCLLWERESHATKRAIDGVLREAEQMGIALDPLE

SEQ ID NO: 166620 - protein, 112 aa, Heterodera glycines
  Homolog annotation: Hit_ID=NP_496059.2; Match level="QueryCoverage =73%, HitCoverage=15%, E-value=3e-24, Identity=67%"; Hit description =UDP-glucuronosyltransferase (61.1 kD) (2J876) [Caenorhabditis elegans] emb|CAA85328.2| Hypothetical prote
  Coding regions on vcDNA: vcDNA=SeqID_93043; Strand=+; Position=1-339
YKEEMLIFQDMVIDVPYTELNHSAFWVEFIVRHQEVPHARSGADDLNIFQYFLVDVILFLVGLSLLVLYLFILLLKLFFRLIIFLIKWPFSAGWGANKEKKGTKHAMAKKRD

SEQ ID NO: 166621 - protein, 78 aa, Heterodera glycines
  Homolog annotation: Hit_ID=NP_493672.1; Match level="QueryCoverage =92%, HitCoverage=21%, E-value=2e-13, Identity=50%"; Hit description =mitochondrial ribosomal protein L28 (36.4 kD) (2A446) [Caenorhabditis elegans] gb|AAC26291.1| Hypothetica
  Gene Ontology: Biological process=positive regulation of growth rate
  Coding regions on vcDNA: vcDNA=SeqID_93044; Strand=+; Position=1-237
EQREYICDKYADYVLPLEEADWYGLELNTACRKLQDLEDNTRAQPMKYAFEKELMAQLQREAAADGTEKQRQPTKLVG

SEQ ID NO: 166622 - protein, 60 aa, Heterodera glycines
  Coding regions on vcDNA: vcDNA=SeqID_93045; Strand=-; Position=312-494
FPLLKSSLSTHITYTNHFWLCCCCCKCSIFFLSPSSIIGCPRPLFRWCSPRAPSRRPSFR

SEQ ID NO: 166623 - protein, 59 aa, Heterodera glycines
  Coding regions on vcDNA: vcDNA=SeqID_93046; Strand=-; Position=3-179
FFFSLCIFMPFFYTFTENFDRNQRIWLLRKKIVLNAKNVMDLSWDHFLLELVLLGQFKN

SEQ ID NO: 166624 - protein, 144 aa, Heterodera glycines
  Homolog annotation: Hit_ID=CAE74062.1; Match level="QueryCoverage =68%, HitCoverage=49%, E-value=1e-15, Identity=43%"; Hit description =Hypothetical protein CBG21714 [Caenorhabditis briggsae]
  Coding regions on vcDNA: vcDNA=SeqID_93047; Strand=+; Position=49-480
MISCRRSVSKCLLPQITNRLTSNFGHLQPCCSSQKVPMCASASNRSSVRLSAIFPRMLSSSVGDKSHERPQMYQLEHIQKRLEYTVPLMFNARLDYTFYTKDVFVDNQILGSQLRSLEGFMHHISLITVAAQFCCTHIETQILN

SEQ ID NO: 166625 - protein, 85 aa, Heterodera glycines
  misc_feature (24)..(24): Xaa can be any naturally occurring amino acid
  misc_feature (63)..(63): Xaa can be any naturally occurring amino acid
  Homolog annotation: Hit_ID=NP_956055.1; Match level="QueryCoverage =94%, HitCoverage=28%, E-value=9e-15, Identity=46%"; Hit description =Unknown (protein for MGC:65775) [Danio rerio] gb|AAH57251.1| Unknown (protein for MGC:65775) [Danio rerio
  Gene Ontology: Mol. function=RNA binding; Cellular component=nucleus; Biological process=RNA splicing
  Coding regions on vcDNA: vcDNA=SeqID_93048; Strand=+; Position=35-289
PPPLKKERTPEPQPRQLCVRDLTXNITEARLKEIFALFGALISCELPMYRVHVHLLRLYCYEXYEQAEDADKALKHMHGGQIDGL

SEQ ID NO: 166626 - protein, 189 aa, Heterodera glycines
  Coding regions on vcDNA: vcDNA=SeqID_93049; Strand=+; Position=3-572
MFRFLLQFFAFLSVTIAQNFETGDNSTVHGCSNHCSYGDRDLGCWNRSLLFFEKILLGQMRNYVAVQMNVDQWRRRNVRPYKEEFEEAKRHSIHTMIAQKHIGDDVVNNRTIETVVGALVDLAALQSNHSLVKWMPHFQCPIPCEHRYTVWRNLFILSSVLNVCLFIAILPLVKRMHNSDSTESLIQRG

SEQ ID NO: 166627 - protein, 158 aa, Heterodera glycines
  Homolog annotation: Hit_ID=XP_314735.1; Match level="QueryCoverage =81%, HitCoverage=18%, E-value=1e-13, Identity=34%"; Hit description =ENSANGP00000013083 [Anopheles gambiae]
  Gene Ontology: Mol. function=ubiquitin-like activating enzyme activity
  Coding regions on vcDNA: vcDNA=SeqID_93050; Strand=+; Position=1-477
PRAEFGTRAPFPKCYVCSGKGEVIVHVNLNEMLLTTFRQNVLVGALNMLKPDVMDLCQNHRILLSSEEGETDSILDRSLGLLGVLNGTQLECDDYAQQLNFKLILFNDNTLTGEQFKKVEDQATKGAKSISDDKQKRENEIDEEEGVPVKKAKILCET

SEQ ID NO: 166628 - protein, 160 aa, Heterodera glycines
  Homolog annotation: Hit_ID=EAK94184.1; Match level="QueryCoverage =97%, HitCoverage=29%, E-value=7e-37, Identity=51%"; Hit description =hypothetical protein CaO19.9953 [Candida albicans SC5314]
  Gene Ontology: Mol. function=glutamate-tRNA ligase activity; Cellular component=mitochondrion; Biological process=glutamyl-tRNA aminoacylation
  Coding regions on vcDNA: vcDNA=SeqID_93051; Strand=+; Position=1-480
VRVRFAPSPTGSLHLGGLRTALYNYLLSRSQLAQGSGKFILRIEDTDQSRLVPGASQQLVRDLEWARLPFDEGPGKPSPVGPFVQSHRLQLYRKYAHQLVADGHAYKCYCSPRKPPSSLAATPNATGYDGTCRDLSQKQLEWHAGQPFVIRFRSPRSGLN

SEQ ID NO: 166629 - protein, 178 aa, Heterodera glycines
  Homolog annotation: Hit_ID=XP_422117.1; Match level="QueryCoverage =94%, HitCoverage=69%, E-value=3e-47, Identity=53%"; Hit description =PREDICTED: similar to Fas apoptotic inhibitory molecule 1 (rFAIM) [Gallus gallus]
  Coding regions on vcDNA: vcDNA=SeqID_93052; Strand=+; Position=3-536
MDVVSSESDLVATWQVPMSDKMHKIEFEHGTTTGKRILRVDGKEILRHEWMFKLVGREMFELNGVRCAINIDAAGIFAYEYSLTVGGKAFEKFREQQKKALQVWHVRMGEREIRVCLEKDTMDVWVNGSKVNTTGEFADEGTKTHLELATGSSAYILSESSGNRHIGMVHRLFVNDSL

SEQ ID NO: 166630 - protein, 162 aa, Heterodera glycines
  Coding regions on vcDNA: vcDNA=SeqID_93053; Strand=+; Position=2-490
SASQIPPFHFSPSFNYKMPFCAEFAPFLWHFFCRCPLHQIVLSALFVLCHFSFASSSFHISPSKMAPLPAEFFGPMGRRPSKHSFRRHHRMKVSRDYWLFDDNLKRREICEGRRLSPLVQNALVGLLLGEEAAEMPNDSVDLLRTTALPLRMAQNDPLNAAD

SEQ ID NO: 166631 - protein, 179 aa, Heterodera glycines
  Coding regions on vcDNA: vcDNA=SeqID_93054; Strand=+; Position=6-542
MVVHQSLSVTPTLSADGTVLVPLDQQQTQRHLAFHHHRHFGPTSPSSAMAPSSSSAAAAMTPLGVILVSKDESAERVLFMYPFERRVSPHSAHINNREKCYEHKDTVVPMIGKEVPKLGGGGMADDVRCQSAAIDRGDQQQQHLGDSIALDGTSIGFSVKMLAPLLVAKGSNGNGTPFE

SEQ ID NO: 166632 - protein, 89 aa, Heterodera glycines
  Homolog annotation: Hit_ID=CAE69397.1; Match level="QueryCoverage =97%, HitCoverage=21%, E-value=4e-26, Identity=64%"; Hit description =Hypothetical protein CBG15526 [Caenorhabditis briggsae]
  Gene Ontology: Mol. function=methionine adenosyltransferase activity; Cellular component=cytoplasm; Biological process=amino acid metabolism
  Coding regions on vcDNA: vcDNA=SeqID_93055; Strand=+; Position=3-269
LVQISYAIGVAEPLSVMVTHFGTSPFKDNDLLKIVETNFDLRPGAIIRQLGLTRPIYQRTAENGHFGNDEFPWEKPKTLALPKNLHETL

SEQ ID NO: 166633 - protein, 149 aa, Heterodera glycines
  Coding regions on vcDNA: vcDNA=SeqID_93056; Strand=+; Position=2-448
FFALDEGLPTLLKGLFTFLYQQIKESRVIAPRDGRMFGLDEFKSLYVDEDKRIEKKWRFSLVNIQDPLELSHNVAANVGKQSLASLRWKVMYGIAMLKRSPNDFRPLFRLNDPEQLKEERRAEKAQNQAIRQQQNHGGRPGRRKGEKME

SEQ ID NO: 166634 - protein, 111 aa, Heterodera glycines
  misc_feature (41)..(41): Xaa can be any naturally occurring amino acid
  Homolog annotation: Hit_ID=NP_496966.1; Match level="QueryCoverage =99%, HitCoverage=31%, E-value=3e-13, Identity=36%"; Hit description =mevalonate decarboxylase (41.5 kD) (2O512) [Caenorhabditis elegans] emb|CAB54454.1| Hypothetical protein
  Gene Ontology: Biological process=embryogenesis and morphogenesis
  Coding regions on vcDNA: vcDNA=SeqID_93057; Strand=+; Position=5-337
MNDELILPLNDSIAITIDHLTATTHITIAPDVNTDSETFNXVGIDITGMSRFRNIFQQIREYSNKKQQLKGDHASNGCHTNIDSSTNFPNSERLTSSATYFAAIAFGLGKI

SEQ ID NO: 166635 - protein, 125 aa, Heterodera glycines
  Coding regions on vcDNA: vcDNA=SeqID_93058; Strand=-; Position=0-374
GLNDALEFLLSVLGSFRVLPDLLVQEVHCGADVADDFAFNERSFTALSDWRRFEFVARNLFDFVDFAARNFFVLCALRRVFDFVASCLEGCCRLNFGILFGGFPLKGANEDTEQNSGNWEKEHFL

SEQ ID NO: 166636 - protein, 75 aa, Heterodera glycines
  Homolog annotation: Hit_ID=CAE74539.1; Match level="QueryCoverage =97%, HitCoverage=24%, E-value=2e-10, Identity=46%"; Hit description =Hypothetical protein CBG22296 [Caenorhabditis briggsae]
  Coding regions on vcDNA: vcDNA=SeqID_93059; Strand=+; Position=2-226
FSIIEDSQRMGDWIRHIHERTGLTEWQLMRVLNALDQLILARIINEVVSTKNTYIQSRLEGDDTLTGGTFYSDPH

SEQ ID NO: 166637 - protein, 96 aa, Heterodera glycines
  Homolog annotation: Hit_ID=EAK86066.1; Match level="QueryCoverage =80%, HitCoverage=50%, E-value=9e-12, Identity=55%"; Hit description =hypothetical protein UM05663.1 [Ustilago maydis 521] ref|XP _403278.1| hypothetical protein UM05663.1 [Usti
  Coding regions on vcDNA: vcDNA=SeqID_93060; Strand=+; Position=293-580
MASQGLSPDVLAAESRKAQAKYGNITPKKGLLAKSLKGQERKYFDSGDYAMSKAGKAGPDTTVGSAHPTPEMIPHSHPPTVSASTSPAKESSLLKK

SEQ ID NO: 166638 - protein, 176 aa, Heterodera glycines
  Coding regions on vcDNA: vcDNA=SeqID_93061; Strand=+; Position=3-530
SPVSSRIPVNVSSLTARSARHRQFSTLQKSDIEAIQQQQKKQSLRPVLSSSKSTAGHRHKIMQNSERKVGAMRRKSIVGEQKDEESAGSSKGSGRKKGRFSNLARKLNIRRKPSIGLHSKRLSPALAPQPTPRALQSKVNELVEQNKLLTGINEAHVLTFQELAAKIKQLEMEMSD

SEQ ID NO: 166639 - protein, 167 aa, Heterodera glycines
  Homolog annotation: Hit_ID=EAL26247.1; Match level="QueryCoverage =74%, HitCoverage=20%, E-value=2e-10, Identity=30%"; Hit description =GA21040-PA [Drosophila pseudoobscura]
  Coding regions on vcDNA: vcDNA=SeqID_93062; Strand=+; Position=4-507
MNELSTLAWYPAAEFLEFERINKAYSFNVPAFSVDTSTTDGPKYTQIMNALSEQLQQHVAKANLLISLNEKIPQFDVEVEEMMRIAIGRTQLLLNKRMKQFREHLSRHLKPIPGQKVTKLNDLHALWVLIDMQLDDIRSIFNSIEQFRLRCWAVAEPKAAATAASGN

SEQ ID NO: 166640 - protein, 185 aa, Heterodera glycines
  Homolog annotation: Hit_ID=NP_498909.1; Match level="QueryCoverage =98%, HitCoverage=26%, E-value=5e-42, Identity=46%"; Hit description =DumPY : shorter than wild-type DPY-19, putative protein, with at least 10 transmembrane domains, of eukar
  Coding regions on vcDNA: vcDNA=SeqID_93063; Strand=+; Position=3-557
LLGIRFSRFRVFLAVLFFAGMAIPGWTNIREQLEIQGEYNNPEQERLFHWIDKNTRKDAVFAGTMALMANVKLSTLRPIFNHPHYESEEVRNRTLLVYSLYSRKSLTEVYHSLRSSNIHFYVFQPQQCIEKHPKNGCSYLEMWDEHDASNKGRPSLCHHIWKAGKNGQQMAPFRPVYWSSTYVVL

SEQ ID NO: 166641 - protein, 76 aa, Heterodera glycines
  Coding regions on vcDNA: vcDNA=SeqID_93064; Strand=-; Position=1-228
FFFCFFWVVFLIFNNKNEEDKELEQKQNSRPEFTQAHPIFSSQNQRFPPTNCFGAFTCLAAFVFVGAAFLSIFCCF

SEQ ID NO: 166642 - protein, 64 aa, Heterodera glycines
  Coding regions on vcDNA: vcDNA=SeqID_93065; Strand=+; Position=1-195
VHLRVLFTDVMQNSIRDLSEIDPAWLQHIAPHYYEFGSNLPDGSRRKAAEEESNFAEGRLANLN

SEQ ID NO: 166643 - protein, 132 aa, Heterodera glycines
  Coding regions on vcDNA: vcDNA=SeqID_93066; Strand=+; Position=24-419
MFRLQSFQTVGKHFRQAMAMQQIAKRSISASAVRQSALRDPFFRDPIDLWLYDPLRPMRRMLRRASDPFAMLDHFFDDRWVPHVRDNAAKLGIDEKGNFTYSVDTSGYRPEELNVSIEGDEVVIQGEHKETV

SEQ ID NO: 166644 - protein, 75 aa, Heterodera glycines
  Homolog annotation: Hit_ID=NP_071448.1; Match level="QueryCoverage =96%, HitCoverage=34%, E-value=5e-17, Identity=55%"; Hit description =lin-7 homolog B [Homo sapiens] gb|AAQ89104.1| LIN-7B [Homo sapiens] gb|AAH27618.1| Lin-7 homolog B [Homo
  Gene Ontology: Mol. function=protein binding; Cellular component =plasma membrane; Biological process=exocytosis
  Coding regions on vcDNA: vcDNA=SeqID_93067; Strand=+; Position=86-310
EFDYTQLRSAADRSEETAFLSNADANDTVAVCSANQGSAHPRVIDLPKTDQGLGFNVMGGKDQNSPIYVSPIIPG

SEQ ID NO: 166645 - protein, 193 aa, Heterodera glycines
  Coding regions on vcDNA: vcDNA=SeqID_93068; Strand=+; Position=1-579
IEPDMNARKLPLPPIREGQRIIANLWHNKLNNFYLVHSYVLAEKFKQPGERDDHYQLPVRLQLGTSSASATPSTSSASETTSQFLVKVNNSIFKDFYSCEQLGFALISDPRRLLRNATHLEHLDGFPVWISAVPDEFRLARFAIMALAYPTKNYSRLERSGRHPDIHGHGILIVSSTGIVFSKDHPQTRIRLL

SEQ ID NO: 166646 - protein, 73 aa, Heterodera glycines
  Coding regions on vcDNA: vcDNA=SeqID_93069; Strand=-; Position=0-218
LNPYFTFYWVQHSKSPFRLALLWLIGDASASINFRLNVLQAFVLCFRHEFHRKYNAQNGHCGEHEEHILTKSG

SEQ ID NO: 166647 - protein, 79 aa, Heterodera glycines
  Homolog annotation: Hit_ID=XP_397276.1; Match level="QueryCoverage =83%, HitCoverage=3%, E-value=6e-16, Identity=56%"; Hit description =similar to CG8566-PD [Apis mellifera]
  Coding regions on vcDNA: vcDNA=SeqID_93070; Strand=+; Position=10-249
DHSSGTDLDVQFPPHIAKGSEFIFRLTVVELLNVPKEYTDVFCQFNFLHRHDEAFSTEPVKGIAKGEHRTLPYNYVQVA

SEQ ID NO: 166648 - protein, 141 aa, Heterodera glycines
  Homolog annotation: Hit_ID=BAD38019.1; Match level="QueryCoverage =98%, HitCoverage=97%, E-value=1e-23, Identity=44%"; Hit description =putative ubiquitin / ribosomal protein CEP52 [Oryza sativa (japonica cultivar-group)]
  Gene Ontology: Biological process=cell cycle
  Coding regions on vcDNA: vcDNA=SeqID_93071; Strand=+; Position=16-441
MQLFLRNLVGKTIVVETDQQFGTVRSIKEQIEQIEGIPTDDQILIFAGHILHDDQQLASNCSSSSAGDLSSGSSIHLSLRLNGGGSYDRCDPKLVQLAKSFRWDKLICRNCYARLPLRASNCRKCGSSDLRKRKTMLSKPL

SEQ ID NO: 166649 - protein, 29 aa, Heterodera glycines
  Coding regions on vcDNA: vcDNA=SeqID_93072; Strand=-; Position=2-91
ERSTMPRMSRMMDTFIAVIFWAIKFSKTK

SEQ ID NO: 166650 - protein, 118 aa, Heterodera glycines
  Homolog annotation: Hit_ID=CAE68451.1; Match level="QueryCoverage =97%, HitCoverage=46%, E-value=3e-29, Identity=55%"; Hit description =Hypothetical protein CBG14241 [Caenorhabditis briggsae]
  Coding regions on vcDNA: vcDNA=SeqID_93073; Strand=+; Position=67-420
MDHLITTPAHHHVSPLVRSRSRSETRAGTFVGYRRTRSASFTSNSAGGFTLPSYGYGGGFMARSLSRSNSSLSLFGRGLHSSALDRTPPFHNIAVQRPTPHYTDKYPFVRYSYGNIET

SEQ ID NO: 166651 - protein, 158 aa, Heterodera glycines
  Coding regions on vcDNA: vcDNA=SeqID_93074; Strand=+; Position=3-479
SLRNYSILKMIALPLFAVVLCLGLPFQSIALLSCKVGMYTTYAAHIDKQECSSADEQYCIAYGCKKDQYDVSIVWKCSVNANCDQFNAGGKADGGGAINASVCECKIGEKGANFDNAKFTFPIAEAKTMEIPSGRSSRENAGIFWAMMAIALAFLCLI

SEQ ID NO: 166652 - protein, 71 aa, Heterodera glycines
  Coding regions on vcDNA: vcDNA=SeqID_93075; Strand=+; Position=1-216
AKSAEFIAHGWLRCDIQRDTVTGSEQVLYHWGPRSETVVSKKRMLESFCDIYGTNPNNFPNHAKVAGLRGK

SEQ ID NO: 166653 - protein, 195 aa, Heterodera glycines
  Homolog annotation: Hit_ID=XP_318627.1; Match level="QueryCoverage =98%, HitCoverage=17%, E-value=4e-57, Identity=59%"; Hit description =ENSANGP00000020973 [Anopheles gambiae]
  Gene Ontology: Mol. function=ATP dependent RNA helicase activity; Cellular component=nucleolus; Biological process=RNA localization
  Coding regions on vcDNA: vcDNA=SeqID_93076; Strand=+; Position=1-585
DNGKKLSGLVELGYRKRVLQRLGYATEEDTITEKGRVACELSSADELLLTEMIFTGAFTDLSPADAAALLSCFVFQERAPIGKLSDSLSEHLRTMQGMAKKIAKISIECKLELDEEKYVESFCPAMMTVVSKWCSGATFAEILETSDIFEGSIIRCMRRLEELLQEMVNAARSMGDRPLEQKFEQARSLLKRDIV

SEQ ID NO: 166654 - protein, 82 aa, Heterodera glycines
  misc_feature (24)..(24): Xaa can be any naturally occurring amino acid
  Homolog annotation: Hit_ID=NP_492476.1; Match level="QueryCoverage =100%, HitCoverage=7%, E-value=3e-17, Identity=52%"; Hit description =RNA polymerase (1J858) [Caenorhabditis elegans] emb|CAA99827.1| Hypothetical protein F14B4.3 [Caenorhabdi
  Gene Ontology: Mol. function=DNA-directed RNA polymerase activity; Cellular component=DNA-directed RNA polymerase I complex; Biological process=growth
  Coding regions on vcDNA: vcDNA=SeqID_93077; Strand=+; Position=2-247
SMHFGIKGREINVQCFFSIGYYQXSRHMIADRFRVRSTMTAYALTLQTINGRKKGGDIPFSNEELDGLIAHGTAFCLPDRLL

SEQ ID NO: 166655 - protein, 169 aa, Heterodera glycines
  Homolog annotation: Hit_ID=XP_319724.1; Match level="QueryCoverage =96%, HitCoverage=45%, E-value=1e-43, Identity=56%"; Hit description =ENSANGP00000006498 [Anopheles gambiae]
  Gene Ontology: Mol. function=RNA binding; Cellular component=nucleus; Biological process=embryogenesis and morphogenesis
  Coding regions on vcDNA: vcDNA=SeqID_93078; Strand=+; Position=45-554
MTMDYLAELIQEKGTVAAFHNYFKHVDRLIDLEIARVRAQLFHFNTDEDLPKMPELDQEDIVTLHEKVYVPKKEHPEFNFVGRILGPRGMTARQLEHETGCKIMDRGRGSLRDAAKEEMNRGKPSGEHLEDDLHILSHVRTMKKVRAPTRTTVDKVKKCSSHRVDGSIV

SEQ ID NO: 166656 - protein, 38 aa, Heterodera glycines
  Coding regions on vcDNA: vcDNA=SeqID_93079; Strand=+; Position=24-137
IYRMVKKERRKIKLFFSFFLNIFNFMFFFTLKISIKFA

SEQ ID NO: 166657 - protein, 110 aa, Heterodera glycines
  Coding regions on vcDNA: vcDNA=SeqID_93080; Strand=+; Position=3-335
QLTALKGIGEMGGQRVELNTGDDSEEQEQRAILRRLYSKYGSNARDLLQRVENLLLLAEDGISAKKTVNEPNDSGKSQKMKRRQAEEDKGLIRKYLEQLMDSETGRNKTK

SEQ ID NO: 166658 - protein, 135 aa, Heterodera glycines
  Homolog annotation: Hit_ID=NP_498114.1; Match level="QueryCoverage =80%, HitCoverage=16%, E-value=7e-12, Identity=36%"; Hit description =tryptophanyl (W) tRNA Synthetase (wrs-2) [Caenorhabditis elegans] gb|AAA19066.2| Tryptophanyl (w) trna sy
  Coding regions on vcDNA: vcDNA=SeqID_93081; Strand=+; Position=20-424
MSYFSADADASELITAQRRDDEQIQWVYDRMSDCVLRLFGERIWIGYHRWLPSLAAFIYLSATNLREKQSVGEEYVGLVQIGSDRRFPSLLNRLLFVFFEVISRAPLLSFLLLQQHPLILQMHSLFHPVGIDQIH

SEQ ID NO: 166659 - protein, 125 aa, Heterodera glycines
  Coding regions on vcDNA: vcDNA=SeqID_93082; Strand=+; Position=3-380
SRMILPAFYSFTFGLTSCTSATFRDEDDSWNWIAASAICGLAHATIRNNIPQGFALAAIGSLLGVSFQAVRISHNGFGMVHNRMTQGFLPFTGPLDWKHIPTDAVDVFFEFGAESFTFRHFLPKA

SEQ ID NO: 166660 - protein, 192 aa, Heterodera glycines
  Homolog annotation: Hit_ID=CAE69165.1; Match level="QueryCoverage =100%, HitCoverage=37%, E-value=2e-70, Identity=73%"; Hit description= Hypothetical protein CBG15197 [Caenorhabditis briggsae]
  Gene Ontology: Mol. function=protein binding; Cellular component=COPI vesicle coat; Biological process=intracellular protein transport
  Coding regions on vcDNA: vcDNA=SeqID_93083; Strand=+; Position=1-576
VLIAASIFTKSGKALVTRQYVADMTRARLEGLLNAFPKLITSDKAQRQHTFVETNSVRYVYQPMDNIYMVLITTKASNILEDLETLRLFSRVIPEYCRSNDESEITDKAFDLIFAFDEIVVLGYRESVNLAQIRTFTEMDSHEERVFNQIQIAQQRAAHTLMKEKEKEIKRQEKLKKHLKGGIGGTAASATG

SEQ ID NO: 166661 - protein, 93 aa, Heterodera glycines
  Coding regions on vcDNA: vcDNA=SeqID_93084; Strand=+; Position=62-343
ALFRPDNYLNRLNMAEKNRSEMVDIMAAIAFCNHMSTDAFLLAARLCDVFMTKKTQTMTRKKAHKLSVAAINIGSKFDVSFMDTFYYYKWRKC

SEQ ID NO: 166662 - protein, 120 aa, Heterodera glycines
  Homolog annotation: Hit_ID=CAE62813.1; Match level="QueryCoverage =86%, HitCoverage=12%, E-value=6e-26, Identity=52%"; Hit description =Hypothetical protein CBG06989 [Caenorhabditis briggsae]
  Coding regions on vcDNA: vcDNA=SeqID_93085; Strand=+; Position=1-363
KIQVLKSLPLYGAFHTKMMEKAASKVAECLGSIELREPRVNVYSNFTGKCHTRRLTQMRTDIARQVNNPVKWEQIMQILFNKRKDEEFPSYFEVGPGRELGTILHQIGKKASRTYVNYPA

SEQ ID NO: 166663 - protein, 46 aa, Heterodera glycines; identical to SEQ ID NO: 135630
  Coding regions on vcDNA: vcDNA=SeqID_93086; Strand=+; Position=211-351

SEQ ID NO: 166664 - protein, 134 aa, Heterodera glycines
  Homolog annotation: Hit_ID=NP_741939.1; Match level="QueryCoverage =100%, HitCoverage=15%, E-value=5e-26, Identity=51%"; Hit description= DYNamin related (94.4 kD) (dyn-1) [Caenorhabditis elegans] emb|CAC42251.1| Hypothetical protein C02C6.1b
  Gene Ontology: Mol. function=protein binding
  Coding regions on vcDNA: vcDNA=SeqID_93087; Strand=+; Position=3-407
EESPLEAQKREEILRMYQSCKEALRIISDVNMATMATDLPPPVVSPANDFRNNSSPVPRPAPAPPGQIPTNRPAPQPPMGARPIGMVAGAQPIMPIQNRPLPGPPGQAPMPPIHANDLNKPRIPERPQIPSRPF

SEQ ID NO: 166665 - protein, 80 aa, Heterodera glycines
  misc_feature (54)..(54): Xaa can be any naturally occurring amino acid
  Homolog annotation: Hit_ID=NP_491530.1; Match level="QueryCoverage =98%, HitCoverage=18%, E-value=6e-26, Identity=69%"; Hit description =2-kinase fructose-2 6-bisphosphatase (1F701) [Caenorhabditis elegans] gb|AAK68884.2| Hypothetical protein
  Gene Ontology: Mol. function=6-phosphofructo-2-kinase activity; Biological process=fructose 26-bisphosphate metabolism
  Coding regions on vcDNA: vcDNA=SeqID_93088; Strand=+; Position=2-241
FRVPNAIALIRLPAPGKTYISHKLCRYLNWIGIKTMAFNVGEYRLHSCHFFQPXASEFFNPNNQIGTPITDHCAKLAMED

SEQ ID NO: 166666 - protein, 198 aa, Heterodera glycines
  Coding regions on vcDNA: vcDNA=SeqID_93089; Strand=+; Position=3-596
RSEDILPRKKRPLSATSHFDDAPAPKRQTLQASEPDNKMTRTDQKQTGKGPQNVIKLRLAKQNFRLLQQNREQDKKADQRDNMDSSTSSGMSESANTPRAPSSNLAEEPTQHSDGKLSSGQSAVATFAPRFENGKNLSVDHFASRARELKKSGNNERDKVHQILLYFESVAFYIMTASSLNSKPEKMHSSLTDVVNFL

SEQ ID NO: 166667 - protein, 59 aa, Heterodera glycines
  Coding regions on vcDNA: vcDNA=SeqID_93090; Strand=-; Position=10-189
FFINNIILFIFFLKLSQSESDRLSAEQLLNEHKRDFDRQYEENKARLEHISNTVRIWRC

SEQ ID NO: 166668 - protein, 108 aa, Heterodera glycines
  Homolog annotation: Hit_ID=AAM73861.1; Match level="QueryCoverage =95%, HitCoverage=9%, E-value=1e-48, Identity=87%"; Hit description =putative serine/threonine protein kinase; HcSTK [Haemonchus contortus]
  Gene Ontology: Mol. function=protein serine/threonine kinase activity; Cellular component=membrane; Biological process=asymmetric protein localization involved in cell fate commitment
  Coding regions on vcDNA: vcDNA=SeqID_93091; Strand=+; Position=1-327
CPLGIEEVKPRSLRFTWSMKTTSSLAPDEIMKEIRKVLDSNGCEYEQRERYLLLCAHGDPSKDSLIQWEMEVCKLPRLSLNGVRFKRISGSSIGFKNIASKIAQELNL

SEQ ID NO: 166669 - protein, 97 aa, Heterodera glycines
  Coding regions on vcDNA: vcDNA=SeqID_93092; Strand=-; Position=15-308
RTSHFDLISEYTREASQHSNALETFRRKRNNQKENSEQNHENQNAEAQADAHLRNTATIHRTVRSKSRSCGSGASASRYSFCEPVEKTVDFRHCDAV

SEQ ID NO: 166670 - protein, 18 aa, Heterodera glycines
  Coding regions on vcDNA: vcDNA=SeqID_93093; Strand=-; Position=1-54
QVRHIWLLRWLLMLLLMN

SEQ ID NO: 166671 - protein, 58 aa, Heterodera glycines
  Homolog annotation: Hit_ID=AAC69868.1; Match level="QueryCoverage =98%, HitCoverage=14%, E-value=2e-11, Identity=65%"; Hit description =dorsal esophageal gland-specific protein [Heterodera glycines]
  Coding regions on vcDNA: vcDNA=SeqID_93094; Strand=+; Position=2-175
MNNHNCNAVGGVKAEEPPVQQLHQQLFASSSHDMQMAASTSTVGEEAAAENVHHTNQK

SEQ ID NO: 166672 - protein, 54 aa, Heterodera glycines
  Homolog annotation: Hit_ID=CAE63854.1; Match level="QueryCoverage =100%, HitCoverage=31%, E-value=3e-11, Identity=51%"; Hit description= Hypothetical protein CBG08414 [Caenorhabditis briggsae]
  Coding regions on vcDNA: vcDNA=SeqID_93095; Strand=+; Position=2-163
FMRGTMPLRRTFYYLGRGKIHLPEEVKVFPIAFHNFPNVAHERAKEFPFWHWAQ

SEQ ID NO: 166673 - protein, 112 aa, Heterodera glycines
  Homolog annotation: Hit_ID=CAE69252.1; Match level="QueryCoverage =100%, HitCoverage=49%, E-value=5e-28, Identity=51%"; Hit description= Hypothetical protein CBG15299 [Caenorhabditis briggsae]
  Gene Ontology: Mol. function=ribulose-phosphate 3-epimerase activity; Cellular component=cytosol; Biological process=pentose-phosphate shunt
  Coding regions on vcDNA: vcDNA=SeqID_93096; Strand=+; Position=2-337
YVHLDIMDGHFVPNLTVGPPLIECLRNKLGNDAELDVHMMVSNPSEWLDPLHIAGIHHFTFRWEALGDDEAVDTLIVRVQSWGIRCGLSIIPMTPLDKLMKFCEFIDTSLLM

SEQ ID NO: 166674 - protein, 116 aa, Heterodera glycines
  Coding regions on vcDNA: vcDNA=SeqID_93097; Strand=+; Position=3-350
SPLPIRQCPQLIAWPPVPIANHSSRSAGDQFQIHPQSSALESTREATTAATTIASAIACPSGVGQQKVPLCLLPHGHLLSFPLASLQSTARHLLFSQRTHFRRQSLPKGATISDCS

SEQ ID NO: 166675 - protein, 168 aa, Heterodera glycines
  Homolog annotation: Hit_ID=NP_499083.1; Match level="QueryCoverage =82%, HitCoverage=20%, E-value=6e-11, Identity=27%"; Hit description =putative nuclear protein of bilaterial origin (3K554) [Caenorhabditis elegans] pir||S28283 hypothetical p
  Coding regions on vcDNA: vcDNA=SeqID_93098; Strand=+; Position=1-504
GVHSNQQYVVSRLRTLCQNIALEEFKWDGGGEQTVRDESDSFDRFITWGPQLPTDTELIWHLFCTYLDFHISPSSDGVSELSKPFSNVFFVNSSDGKFPLALMHATIQPTKQQIVPDELADEKYFIRLASARPPTFEIVVDGGETVILPCKNQPQNFWYVLILFLAHV

SEQ ID NO: 166676 - protein, 89 aa, Heterodera glycines
  misc_feature (67)..(67): Xaa can be any naturally occurring amino acid
  Homolog annotation: Hit_ID=AAH60757.1; Match level="QueryCoverage =97%, HitCoverage=25%, E-value=5e-23, Identity=55%"; Hit description =MGC69160 protein [Xenopus laevis]
  Gene Ontology: Mol. function=ribonuclease E activity; Cellular component=nucleus; Biological process=RNA catabolism
  Coding regions on vcDNA: vcDNA=SeqID_93099; Strand=+; Position=1-267
MASEKDLFPLPNWIARPPKGSHLDVLKGEKLIQKLLVDEKGFYYFGRNPSDCDFLSEHASCSRVHAXSPLPKPVKRFALVYLQSNHGTF

SEQ ID NO: 166677 - protein, 119 aa, Heterodera glycines; identical to SEQ ID NO: 164591
  Homolog annotation: Hit_ID=NP_509822.2; Match level="QueryCoverage =96%, HitCoverage=99%, E-value=2e-39, Identity=63%"; Hit description =Acyl-coA-binding protein, ACBP family member (13.2 kD) (XL523) [Caenorhabditis elegans] emb|CAA91987.2| H
  Coding regions on vcDNA: vcDNA=SeqID_93100; Strand=+; Position=50-409

SEQ ID NO: 166678 - protein, 71 aa, Heterodera glycines
  Coding regions on vcDNA: vcDNA=SeqID_93101; Strand=-; Position=1-213
IAIINYFLLLVFGFCTFGQLFVPHVARNTVLGPLKTDHSFLLPPAVLCFFGIRCPQNRCRNETGVLKFGQQ

SEQ ID NO: 166679 - protein, 189 aa, Heterodera glycines
  misc_feature (107)..(107): Xaa can be any naturally occurring amino acid
  Homolog annotation: Hit_ID=CAE72477.1; Match level="QueryCoverage =94%, HitCoverage=20%, E-value=9e-47, Identity=48%"; Hit description =Hypothetical protein CBG19653 [Caenorhabditis briggsae]
  Gene Ontology: Mol. function=heparin N-deacetylase/N-sulfotransferase activity; Cellular component=integral to membrane; Biological process= protein amino acid sulfation
  Coding regions on vcDNA: vcDNA=SeqID_93102; Strand=+; Position=16-581
MFGAKPNQHWLVRVALLDAVTFLAPAIHDDDLERFVQIDIDDVFIGAIGSRMVADDVDYLSILQGKLREHIADFHFTLGFSGNFFRHGDPAEIQGDEILAMRTNSTXFPHMWRHNHPPEFSADYLLALMTQNRVFAENVGISANLSYAVSPQHSGVYPIYQPLYDAWSKIWSIQVTSTEEYPHLKPASG

SEQ ID NO: 166680 - protein, 177 aa, Heterodera glycines
  Coding regions on vcDNA: vcDNA=SeqID_93103; Strand=+; Position=1-534
KFSPFLLRRPQFLLLLSSQFLPFFSLIIRFLLLLIFPGVAQCARGRRLRVQRERVLEKSAQLREEGQQQTERSGDHLAQRFRNGPQPTLIRRLRIENGFDLFLLENDRGNELLAPHRDCQLTPFLCAAPTTNQIFVVYAVANERAQRVQCLVCVQRLHVAMVGASGECQLSLQLNVF

SEQ ID NO: 166681 - protein, 49 aa, Heterodera glycines
  misc_feature (3)..(3): Xaa can be any naturally occurring amino acid
  misc_feature (10)..(10): Xaa can be any naturally occurring amino acid
  misc_feature (18)..(18): Xaa can be any naturally occurring amino acid
  misc_feature (24)..(24): Xaa can be any naturally occurring amino acid
  misc_feature (45)..(45): Xaa can be any naturally occurring amino acid
  Homolog annotation: Hit_ID=CAB88204.1; Match level="QueryCoverage =97%, HitCoverage=16%, E-value=1e-10, Identity=62%"; Hit description =putative cuticular collagen [Globodera pallida]
  Coding regions on vcDNA: vcDNA=SeqID_93104; Strand=+; Position=2-148
APXKPRDNPXNATSRAKXQPPGHXQRAGPKQPSRPPGPPGPAGPXGQPG

SEQ ID NO: 166682 - protein, 185 aa, Heterodera glycines
  Homolog annotation: Hit_ID=BAC43174.1; Match level="QueryCoverage =42%, HitCoverage=51%, E-value=4e-23, Identity=65%"; Hit description =putative 50S ribosomal protein L27 [Arabidopsis thaliana] gb|AAO39902.1| At2g16930 [Arabidopsis thaliana]
  Gene Ontology: Mol. function=structural constituent of ribosome; Cellular component=mitochondrial ribosome; Biological process =protein biosynthesis
  Coding regions on vcDNA: vcDNA=SeqID_93105; Strand=+; Position=8-562
MFSRLLTSTSSAAVAAAARPSIGTLLPLPGSAVVAPPILSLSQKRWATKRSGGSTKNGRDSHSKRLGLKNYCGQSVIPGNILVRQRGTEFHAGPNVGMGRDHTLYALTPGHVHFFKAYKVKVLAGGKRTLAKEYQYVQVINRDTHAAAFDKESGKLDLAKAVLESDSVRKSLERARDIKLPPVPA

SEQ ID NO: 166683 - protein, 153 aa, Heterodera glycines
  Homolog annotation: Hit_ID=NP_495705.1; Match level="QueryCoverage =100%, HitCoverage=19%, E-value=7e-38, Identity=55%"; Hit description= transitional endoplasmic reticulum ATPase TER94 (89.6 kD) (2I431) [Caenorhabditis elegans] emb|CAA88314.
  Gene Ontology: Mol. function=protein binding; Cellular component =cytosol; Biological process=microtubule cytoskeleton organization and biogenesis
  Coding regions on vcDNA: vcDNA=SeqID_93106; Strand=+; Position=2-460
KPPREMIFSDRQAGQTHGDHAFPHKTATLYSQPNGTEINRKIAGESDPNSRKPYSHCEKNSPAIHNINQTDPLVLKRKKTHGETQHHSVSQLLTLIHGLHHHPKVNVIGATNRPNSFDPALRPFGRFDREIDIGIPDAIGRLDIQRIHTTNMK

SEQ ID NO: 166684 - protein, 30 aa, Heterodera glycines; identical to SEQ ID NO: 139364
  Coding regions on vcDNA: vcDNA=SeqID_93107; Strand=-; Position=2-91

SEQ ID NO: 166685 - protein, 106 aa, Heterodera glycines
  Coding regions on vcDNA: vcDNA=SeqID_93108; Strand=-; Position=9-329
PPITLLYKVWSAASAAPSATAERWRRRRPATARQSLTRSPRRVPQGRRWRNLSPVDPLAVSALAPPPRAVGSRALRLRTPDLSPALYLHRLRAEFCRPSVRARRRL

SEQ ID NO: 166686 - protein, 209 aa, Heterodera glycines
  Homolog annotation: Hit_ID=CAH72257.1; Match level="QueryCoverage =83%, HitCoverage=36%, E-value=1e-39, Identity=52%"; Hit description =OTTHUMP00000059032 [Homo sapiens]
  Gene Ontology: Cellular component=alpha-ketoglutarate dehydrogenase complex (sensu Eukarya)
  Coding regions on vcDNA: vcDNA=SeqID_93109; Strand=+; Position=8-634
MFLLHKFLPNLLTKCHYQQFASYHFSKSLFKLVQFNLSDIGEGIAEVQVKEWHVKEGDSIAEFDELCSVQSDKASVTITSRYNGKIKKMYYQPDEIAKVGLPLVDIEIAELSSEEEKEAPTNVLPTVKTDAPSSLLSQSPKVIASPAVRRLIREYGINTVGLTGSGRDGRILKEDILKLAYVPPPTSFGKSPDSVTAFHSRDKPSGVEI

SEQ ID NO: 166687 - protein, 127 aa, Heterodera glycines
  Coding regions on vcDNA: vcDNA=SeqID_93110; Strand=+; Position=10-393
MLSNFFCGEIKKLPVPTAASLILLLVLLSVIALVVIVTLGVLFYKKYKQTRRTKAVSSNKSETPEVPSDLADEAAESSDSDEGRGGVSTAPPDMESVVADEAAEFLDFDEGRGGVSTAPPDLESGRK

SEQ ID NO: 166688 - protein, 192 aa, Heterodera glycines
  Homolog annotation: Hit_ID=EAK94179.1; Match level="QueryCoverage =97%, HitCoverage=22%, E-value=3e-09, Identity=25%"; Hit description =potential GRIP domain Golgi protein [Candida albicans SC5314]
  Coding regions on vcDNA: vcDNA=SeqID_93111; Strand=+; Position=53-628
MDTANSPSVSDQQLKSIGEQKRIAQLEHKIASVSKQLDEKGTKLKETLEQNASLKDRIGTLEQEKLEVSLLIETLTKSRDRLLQEKTDLRNELLGLEKRKDQLELQVAKLNSEKHRHLEDISELRQKCDELWGERTELQSQIDDFQSDKALIVYDKEQWKREKDILLASKQWYIDEIADREKKINELIQAKS

SEQ ID NO: 166689 - protein, 158 aa, Heterodera glycines
  Coding regions on vcDNA: vcDNA=SeqID_93112; Strand=+; Position=3-476
GAPFPQFQSVRLSMPPLLFPSPSRPFLFVHRSLSPSLRRNFCFLLTSNIGKPCINCPSDVQSRHFSLDIRRMSAKSEKGLWAKFEEKKRRKYAETGSMKKQKGSKPTVNIFDGMNLRHLAIALDCDFDALCLRLLDIVSDFKLDSILSDPNAPLDRLL

SEQ ID NO: 166690 - protein, 162 aa, Heterodera glycines
  Coding regions on vcDNA: vcDNA=SeqID_93113; Strand=+; Position=3-491
EKEPYLRDDLIKRPLQLLTVDELVDVLRDQRARNITVIQLSDDESNNSKPFVIICSPFNARHGKALMIILRAFLKRNFIIKNLQVEVPERHAVPPRWNVLNMAGTIVHILDEELRLRYDLESLFLGLDCDEEGNSSAASWQVEFRLPASKLIKMPSQLGLLS

SEQ ID NO: 166691 - protein, 94 aa, Heterodera glycines; identical to SEQ ID NO: 158271
  Coding regions on vcDNA: vcDNA=SeqID_93114; Strand=+; Position=3-287

SEQ ID NO: 166692 - protein, 132 aa, Heterodera glycines
  misc_feature (75)..(75): Xaa can be any naturally occurring amino acid
  Homolog annotation: Hit_ID=CAE65166.1; Match level="QueryCoverage =72%, HitCoverage=66%, E-value=3e-25, Identity=52%"; Hit description =Hypothetical protein CBG10036 [Caenorhabditis briggsae]
  Gene Ontology: Mol. function=DNA-directed RNA polymerase activity; Cellular component=DNA-directed RNA polymerase I complex; Biological process=transcription from Pol I promoter
  Coding regions on vcDNA: vcDNA=SeqID_93115; Strand=+; Position=3-402
TRLPPTAAPQKVELLNIEDYKKDRTMITAILYEEDHTVGNALKHIICQMPDVEFCGYNVPHPLEDKILVRIHTVXGVAAGDVLLRGLEDLARIFDTIERKFKAAHRAAHFGVSDRMEEDRNEYEEEEEEMTI

SEQ ID NO: 166693 - protein, 164 aa, Heterodera glycines
  Homolog annotation: Hit_ID=CAE67202.1; Match level="QueryCoverage =94%, HitCoverage=23%, E-value=1e-37, Identity=56%"; Hit description =Hypothetical protein CBG12638 [Caenorhabditis briggsae]
  Coding regions on vcDNA: vcDNA=SeqID_93116; Strand=+; Position=7-498
MCKESEEPFKFIPVCCYEDAQAIRAVAFHPSGGYFAIGTNSRNLLICRYQSYERRTSLNDDFLHGFVPPPTILMSRSKHHRGSVYCAAFNQTGNLLATGSNDKTIKLMAMQIDPNGCRIGVEMDLQQVHDGTVRDLLFMEDRTSACNSSSCSTLISGGAGGCRL

SEQ ID NO: 166694 - protein, 48 aa, Heterodera glycines
  Coding regions on vcDNA: vcDNA=SeqID_93117; Strand=-; Position=31-177
ESSSCEMGFTYKKSDDPISQRASFRQFNHPSVQFVSSVLLVIRPAGSA

SEQ ID NO: 166695 - protein, 69 aa, Heterodera glycines
  Coding regions on vcDNA: vcDNA=SeqID_93118; Strand=+; Position=304-513
LFFPVSGFHAKHLHRRNVSSLFSHLLTCASTGVSTDFHIIYSLNVYPSEATGLNYSNRNRMNIPTNKCC

SEQ ID NO: 166696 - protein, 69 aa, Heterodera glycines
  Coding regions on vcDNA: vcDNA=SeqID_93119; Strand=+; Position=77-286
GDVERKFDSAVVNSVTVLLLRDQRQDDKYDIYFCYRNAGSSALYESNQLKILGFYTITLYMFEQTLSFW

SEQ ID NO: 166697 - protein, 48 aa, Heterodera glycines
  Coding regions on vcDNA: vcDNA=SeqID_93120; Strand=-; Position=2-145
THFMNHIMHKQIQLNSLWSSTQFIYWKAETSSIAANPCTKLSAKSWLT

SEQ ID NO: 166698 - protein, 179 aa, Heterodera glycines
  Homolog annotation: Hit_ID=AAN32892.1; Match level="QueryCoverage =98%, HitCoverage=83%, E-value=3e-85, Identity=88%"; Hit description =secretory protein 4D06 [Heterodera glycines]
  Coding regions on vcDNA: vcDNA=SeqID_93121; Strand=+; Position=3-539
IVFLVCCNAMPNFPCCPGSQQVVAVMSNYIGTFTSEDKSTVCSTAKNTVDGIKSELSSRGGCPSGGEAQIVNEIDRQLTNIAKMKINYEDGCPYNLGFARAMFDLAAAAAGHAGNGTEWQTMKGQFEQESQAIKAIGQEMNIEVTDVHFGHPSKGFSAHQNVPSPSHVIANPGQQSSVG

SEQ ID NO: 166699 - protein, 206 aa, Heterodera glycines
  Homolog annotation: Hit_ID=AAH77866.1; Match level="QueryCoverage =89%, HitCoverage=57%, E-value=8e-53, Identity=55%"; Hit description =Kctd10-prov protein [Xenopus laevis]
  Coding regions on vcDNA: vcDNA=SeqID_93122; Strand=+; Position=28-645
MVDSNSEEAANKPSLQKHLFASHGQYVKLNVGGSLFLTTVDTLTKYNSMLKAMFSGRMEVRRDTDGYVLIDRCGKHFGLILNFLREGTLPLPDCRTEVLEILIEAKYYLLQELVDLCYSSLKALHHDQLVSTLGICRVPVVVSKKQVEQIVQSCAGKPVIELLMNRQNNKYSYNASSDENFLRNQELFDKLILRFNNRGLFIKNIG

SEQ ID NO: 166700 - protein, 34 aa, Heterodera glycines
  Coding regions on vcDNA: vcDNA=SeqID_93123; Strand=-; Position=13-117
IFFHQISSKKILIHSGSKTSRSHQLPVQPPVWPS

SEQ ID NO: 166701 - protein, 176 aa, Heterodera glycines
  Homolog annotation: Hit_ID=NP_500020.1; Match level="QueryCoverage =98%, HitCoverage=38%, E-value=1e-48, Identity=55%"; Hit description =zn-finger, C-x8-C-x5-C-x3-H type and Zn-finger, RING (48.1 kD) (4B749) [Caenorhabditis elegans] gb|AAF607
  Gene Ontology: Cellular component=intracellular
  Coding regions on vcDNA: vcDNA=SeqID_93124; Strand=+; Position=3-533
QMEEAFAKARSEEKQCGICMEQIVEKGLRFGILQNCTHCFCLDCIRKWRRQTDEEIKTKTVRSCPECRVHSDYVIPSKVWIDLKSDKDKLVSVFKRNTKKIACKYVVNGDVDKCPFGNKCFYKHQLPDGSIVEGKSPTQLRKNRRNDAIMFSLYDFLPSDSDWEDDFFNDNSDLFD

SEQ ID NO: 166702 - protein, 106 aa, Heterodera glycines
  Coding regions on vcDNA: vcDNA=SeqID_93125; Strand=+; Position=1-321
RIWHMLLFPHRHPRFRENWRSFLGLQRNSRRSLWRHILLPSSHATPYSLNAASAFDEEQQRLVTVKTDIGNGHSTTQQQEGTPLIADSPQSSTETNNSADDNILMI

SEQ ID NO: 166703 - protein, 166 aa, Heterodera glycines
  Coding regions on vcDNA: vcDNA=SeqID_93126; Strand=+; Position=3-503
PIKESEMIKKSAVIPSLLLCAILVAQFIEQANAYCCKVSDWPIGHPPNCNIFGCNCHCLHCVNVIEKGCCIAQKTGLTDGCSETRLKRHALPQQPKRAEAKEVFQQADTDGDGALSMDEAVNFLVSKWNMTEGELTNPDKRHWFTEIDVNRNEKLEPEEIDEAMTK

SEQ ID NO: 166704 - protein, 33 aa, Heterodera glycines
  misc_feature (9)..(9): Xaa can be any naturally occurring amino acid
  Coding regions on vcDNA: vcDNA=SeqID_93127; Strand=-; Position=83-184
FFFFFFFFXEATFTDFTKKHQREVWRNGVDSSK

SEQ ID NO: 166705 - protein, 192 aa, Heterodera glycines
  Homolog annotation: Hit_ID=NP_741460.2; Match level="QueryCoverage =53%, HitCoverage=14%, E-value=7e-10, Identity=34%"; Hit description =actin cytoskeleton modulator WASP homolog (83.9 kD) (wsp-1) [Caenorhabditis elegans] gb|AAN84882.1| Wasp
  Coding regions on vcDNA: vcDNA=SeqID_93128; Strand=+; Position=79-654
MEKRRESNQKSQQGRRGSAGTAVIQNQRKSPAHPSHKKTTAPCFPPSHLQDGIQSSHYHHQHPVGGITSMGVMPHFGLHHLSTKKTTKKDRDGKKRKVTKEDIGIPTDFVHKAHIGWDGNTYSASSVGDAMDEKFLNMCQKINEDPSKMDREELGFALEFYAKNESKYPNENIGGFSQNTPFFAQNPTLATR

SEQ ID NO: 166706 - protein, 186 aa, Heterodera glycines
  Homolog annotation: Hit_ID=AAV28475.1; Match level="QueryCoverage =100%, HitCoverage=25%, E-value=1e-12, Identity=27%"; Hit description= nicastrin [Danio rerio]
  Gene Ontology: Cellular component=integral to membrane
  Coding regions on vcDNA: vcDNA=SeqID_93129; Strand=+; Position=4-561
MLSLKKSQFLILLLFNCFVLRVFAYDGVEDQIFIRLNNTDVQCVRMLNGTHSIGCQSSRNGNVGVLTEIVHAKDVQNAIGILPLGLSNIIAVIQLTNINDALIGILRSHAQVVGILLIHRGKDKPKEFSEDGSCPNRQFTFYSNEKTIESCHGWNQKNAIHSDGLKFIDFNKPLRLVTSNEEIDLI

SEQ ID NO: 166707 - protein, 149 aa, Heterodera glycines
  Homolog annotation: Hit_ID=CAE68286.1; Match level="QueryCoverage =100%, HitCoverage=67%, E-value=2e-21, Identity=39%"; Hit description= Hypothetical protein CBG13971 [Caenorhabditis briggsae]
  Gene Ontology: Cellular component=snRNP U1; Biological process =primary sex determination, soma
  Coding regions on vcDNA: vcDNA=SeqID_93130; Strand=+; Position=2-448
FSHDGDNIDILVFNHLNMRGHSHVIFIEINTSRHCPPFLLGFPFYHEPMRFQFSKEDSDVISRATGTFVYRPIKNITVSNDKTTLAEGPNMEIKTSGLYGQLRSTAPTISILVITNLPPECTEEMLRVVFQPLPGLRDILQVSNRTDIA

SEQ ID NO: 166708 - protein, 203 aa, Heterodera glycines
  Coding regions on vcDNA: vcDNA=SeqID_93131; Strand=+; Position=1-609
PLTTADGNWVPNEGNVSRLSSQMSFSADGLMTPLGTLDTQETGEATLDTARSMVVTPGGTSDNYCSSAAELEQYAEDGGDDCGDGDNDGGDSVIVHRRCSSGLSTEIVNDAMANAIRNVSRASKASATTAEGQQPATGDEQPKMRHGREFQLELDKRVSAHRLSSGSSSSASGAAAGRDVHVRTPLNDPRSPFKPLAYTSFEP

SEQ ID NO: 166709 - protein, 199 aa, Heterodera glycines
  misc_feature (70)..(70): Xaa can be any naturally occurring amino acid
  Homolog annotation: Hit_ID=CAE60543.1; Match level="QueryCoverage =97%, HitCoverage=68%, E-value=1e-49, Identity=50%"; Hit description =Hypothetical protein CBG04170 [Caenorhabditis briggsae]
  Gene Ontology: Mol. function=rRNA binding; Cellular component =nucleolus; Biological process=ribosome biogenesis
  Coding regions on vcDNA: vcDNA=SeqID_93132; Strand=+; Position=42-637
MKVEKIKTRRGKKFLEDRAPKLVENDKVTLFVKGKKCSVMLNKILGELYQLKKPLANRLQRLNWPFFNDXSHKFDASLFVFGSSTKKRPNSLLFGRMYDHQMLDMVELQVENFVSSDEFKQVKSVTLGSKPCIILQGHLFESNGILQRIGNLMVDLFRGPKVEYLRLQGTELIISLTAVSEERIKFRVYRASLKKDMES

SEQ ID NO: 166710 - protein, 209 aa, Heterodera glycines
  Coding regions on vcDNA: vcDNA=SeqID_93133; Strand=+; Position=3-629
EREEKDKEKRMEVEVEVSTDGMFVRAKNAVRYPIPNSMDSPELRVYFVGNDQSNGKLCQLKSQIEFRGTSKFAVPPTTPITPIDRSSQILPPIIRIDHKWPYSRKRPKIPRRSTMAAQRLLTPAHYASPSNSAQPFIQRKSQLLNPVHFGEKSPAESMETSTTATYIDIIRDRQLYEEVQRSKTNELNSRWSTTFFVFMLLVAFLIATS

SEQ ID NO: 166711 - protein, 197 aa, Heterodera glycines
  Homolog annotation: Hit_ID=NP_660626.1; Match level="QueryCoverage =94%, HitCoverage=54%, E-value=4e-64, Identity=59%"; Hit description =biotin synthase [Buchnera aphidicola str. Sg (Schizaphis graminum)] gb|AAM67837.1| biotin synthase [Buchn
  Gene Ontology: Mol. function=biotin synthase activity; Biological process=coenzymes and prosthetic group metabolism
  Coding regions on vcDNA: vcDNA=SeqID_93134; Strand=+; Position=59-649
MPPPIGSIISKWTFSEALSVFSLPFPELIFRAQNVHQQHHNPSRVQISTLLSIKTGACPENCSYCPQSGYHKTGLKKEPLMEVEQVLEAAKRAKASGATRFCMGAAWRGPKDRDLDKVCEMVAKVKQLGGLETCATLGLLKNEGQAQRLKKAGLDFYNHNIDCSKDFYHKIITTRRFDDRISTIEKIRSAGIKVCCG

SEQ ID NO: 166712 - protein, 132 aa, Heterodera glycines; identical to SEQ ID NO: 126737
  Coding regions on vcDNA: vcDNA=SeqID_93135; Strand=+; Position=100-498

SEQ ID NO: 166713 - protein, 132 aa, Heterodera glycines
  misc_feature (108)..(108): Xaa can be any naturally occurring amino acid
  Homolog annotation: Hit_ID=AAH81180.1; Match level="QueryCoverage =99%, HitCoverage=46%, E-value=1e-30, Identity=46%"; Hit description =MGC84363 protein [Xenopus laevis]
  Gene Ontology: Mol. function=carboxylesterase activity; Cellular component=cytosol; Biological process=formaldehyde catabolism
  Coding regions on vcDNA: vcDNA=SeqID_93136; Strand=+; Position=2-397
ELIESRWINGYHKIIEHNSAQIKCRMRIGDYLPDSLPESKLPVLFYLSGLKCTEENFVVGSAMQRFASGREIIVVNPDTSPRGVVTGDGEDPSFGAAAGFYLDATETXWARNYRMYSYMVEELVPLVLTTFS

SEQ ID NO: 166714 - protein, 74 aa, Heterodera glycines
  Homolog annotation: Hit_ID=CAE72607.1; Match level="QueryCoverage =100%, HitCoverage=18%, E-value=6e-13, Identity=51%"; Hit description= Hypothetical protein CBG19798 [Caenorhabditis briggsae]
  Coding regions on vcDNA: vcDNA=SeqID_93137; Strand=+; Position=2-223
ECFSVWEPLRLRQEGTIINFVNGLDLATPGLCMPTFNFRDDFLSEIYWLLCHYPGGIREENSGNVSLFLSMSAT

SEQ ID NO: 166715 - protein, 65 aa, Heterodera glycines
  Homolog annotation: Hit_ID=AAC25820.1; Match level="QueryCoverage =100%, HitCoverage=50%, E-value=4e-18, Identity=70%"; Hit description= Cell death abnormality protein 10, isoform a [Caenorhabditis elegans]
  Gene Ontology: Mol. function=GTPase activity; Cellular component =rhabdomere; Biological process=rhabdomere development
  Coding regions on vcDNA: vcDNA=SeqID_93138; Strand=+; Position=1-198
DKLRERRLAPISVAQGHQMAREIKATKYLECSALTQIGLKQVFDEAIRAVLCPVQVKPKKSCAIL

SEQ ID NO: 166716 - protein, 130 aa, Heterodera glycines
  Homolog annotation: Hit_ID=CAE66815.1; Match level="QueryCoverage =76%, HitCoverage=54%, E-value=1e-09, Identity=34%"; Hit description =Hypothetical protein CBG12180 [Caenorhabditis briggsae]
  Coding regions on vcDNA: vcDNA=SeqID_93139; Strand=+; Position=53-445
MPNSASTPMEEFEEMVAVLQLDGVLDFDAVRRAVSSGAIRVRECDAETPMVQIGSHLYSGQWSQTLGTDMLLCPSSMSDYHHHEGHQRLELVAVSDTRLCAQKVLLATDESPTNGNGTRNEQSTSNSSKA

SEQ ID NO: 166717 - protein, 95 aa, Heterodera glycines
  Coding regions on vcDNA: vcDNA=SeqID_93140; Strand=+; Position=3-287
NSSSDAPAAFGRAFALCWRANTNSKNSQTRNCRSYRWECSKSKEVEECDPSADGRNSSLFALHIVKQISYLLFYNNLNRIKRKSAKKKKKKKKKK

SEQ ID NO: 166718 - protein, 160 aa, Heterodera glycines
  Coding regions on vcDNA: vcDNA=SeqID_93141; Strand=+; Position=2-481
LNMSEASSSNAPHNANANNSSNATNGGSRDRMNQSQIWKCFEKMPDYEAAKCRLCTSMLSFKRASTKGLWDHLKCKHRSEYDMLKQNFELLTPSNSDAFKAPKIKKRKMEPKSDVCVDSDNSLVSGMGTPQTEVIRVGGLANEGRTEAQLNGAGGGGGAN

SEQ ID NO: 166719 - protein, 175 aa, Heterodera glycines
  Homolog annotation: Hit_ID=XP_310200.1; Match level="QueryCoverage =34%, HitCoverage=15%, E-value=1e-13, Identity=56%"; Hit description =ENSANGP00000010968 [Anopheles gambiae]
  Gene Ontology: Cellular component=cytoplasm
  Coding regions on vcDNA: vcDNA=SeqID_93142; Strand=+; Position=36-560
MRWVLNLDGGPRRVNHAALAIGDKIYSFGGYAASDPLDSQSDFIDIHMLNTFSYRWEHLPVFAPLAFSRETTAKFPSKPRSATISAPGISDFVESVPSTSAAGDRDFPPADVRRRRARSLTEMHPLALIRSANPPLEDDQQQQLMANNIVHRRRSTPNRCEALRFRSSRVRPAID

SEQ ID NO: 166720 - protein, 183 aa, Heterodera glycines
  Coding regions on vcDNA: vcDNA=SeqID_93143; Strand=+; Position=2-550
THQMNSNLISTSSVMQKSISHAPREPSIKEEPMGGDSAKDDDNGSDKFWSMATKTTSQHGEAPAIPTMTKKRTSIELCEATQIGHREELGQLVSPKPATDRTAPTADFIRMGLHQSPSMPPMVMKALAANDNDFTISSTASDEAATTTEGKLTKSATGAHISADPTLSHIVDIGAQTSTAVQN

SEQ ID NO: 166721 - protein, 212 aa, Heterodera glycines
  Coding regions on vcDNA: vcDNA=SeqID_93144; Strand=+; Position=1-636
QLEEREMHTEGTEGRITIGTKRKPSKTTLMGTTDNSEWLGGNHIEEGSEEAMSRTSQRGRMSTKAPPPTAATPSWSSTRWKSGGETNDAKENKKAHETSRTAATERTEGNVNFRLLAIAGIIAVLFIMVGIGSICTGRYVRKSRQLHGKYRPAAYELQTTRPPPLTSSSMTFAPSNRMANSNELQQNRHFEFGQIHQIPPPVHCPHQLTMNG

SEQ ID NO: 166722 - protein, 47 aa, Heterodera glycines
  Coding regions on vcDNA: vcDNA=SeqID_93145; Strand=-; Position=3-143
HQNLIELPCEERRKGQISEEKEGQKSLVKWAESAETKNNELIKKKQF

SEQ ID NO: 166723 - protein, 56 aa, Heterodera glycines
  Coding regions on vcDNA: vcDNA=SeqID_93146; Strand=-; Position=3-170
QDLGYSAYNIDILAAFLSLSRLKNLRFLVIRHYGKVLQQILLKNVLNVPRIAMRHL

SEQ ID NO: 166724 - protein, 137 aa, Heterodera glycines
  Homolog annotation: Hit_ID=CAE62053.1; Match level="QueryCoverage =87%, HitCoverage=94%, E-value=3e-20, Identity=41%"; Hit description =Hypothetical protein CBG06071 [Caenorhabditis briggsae]
  Gene Ontology: Mol. function=tubulin binding; Cellular component =prefoldin complex; Biological process=tubulin folding
  Coding regions on vcDNA: vcDNA=SeqID_93147; Strand=+; Position=3-416
KNTATAEDQQQINRFARLHKAYSAAKEKLISLDNDVNNLNDASDEILLMDDEAAADSIPFLVGSVFVHFDQDTVNGRLELLKVSTQAEMDALRSQVGTMERELGELRAVLYAKFGDNIHLETEEDEESGDATRRNGR

SEQ ID NO: 166725 - protein, 201 aa, Heterodera glycines
  Homolog annotation: Hit_ID=AAP06023.1; Match level="QueryCoverage =74%, HitCoverage=88%, E-value=4e-12, Identity=29%"; Hit description =similar to NM_003197 transcription elongation factor B polypeptide 1- like [Schistosoma japonicum]
  Gene Ontology: Biological process=reproduction
  Coding regions on vcDNA: vcDNA=SeqID_93148; Strand=+; Position=33-635
MSNNENENVMNGEAVGGVEIKVEANEEVNTESQEDGEEAKIPQFSKEQMERSVMCCTNEGEIVNAPWHLMAQSKTFMQMWESLDMEEKTQEDFTDFVFPLNDITSDCFQQILAWMREHHNLPEPIVKEDPVTQERIWFKFTDWERQFFDVDFERVKEYFLASNFLDIRSLYLYCAQECARCIMDKSAEEIREMLCLEDDLT

SEQ ID NO: 166726 - protein, 145 aa, Heterodera glycines
  misc_feature (80)..(80): Xaa can be any naturally occurring amino acid
  Homolog annotation: Hit_ID=AAL25495.1; Match level="QueryCoverage =94%, HitCoverage=68%, E-value=4e-14, Identity=35%"; Hit description =SD02661p [Drosophila melanogaster]
  Gene Ontology: Mol. function=protein binding; Cellular component =nucleus; Biological process=chromatin silencing
  Coding regions on vcDNA: vcDNA=SeqID_93149; Strand=+; Position=1-436
YVDCVRIFHNFIFSKSCENCITMWKFGNLSEGISGKGTLGCAETYAAHTAVMEMPRTEMWFIKMAVDPSRRFLVCGSEEXELRIWRLDTEKLPNRKSDFCLVAPTKELRKCIRQVAFSPDGRVMLSVGDGGVVSRYNLQEKEETD

SEQ ID NO: 166727 - protein, 148 aa, Heterodera glycines
  Homolog annotation: Hit_ID=CAE62811.1; Match level="QueryCoverage =91%, HitCoverage=98%, E-value=3e-64, Identity=83%"; Hit description =Hypothetical protein CBG06987 [Caenorhabditis briggsae]
  Gene Ontology: Biological process=mRNA splicing
  Coding regions on vcDNA: vcDNA=SeqID_93150; Strand=+; Position=18-464
MAMAARGGRGGKLPPEVNRILFIKNLPYKITAEEMYDIFGKFGAIRQIRIGNTPESRGTAFVVYEDVFDAKNACDHLSGFNVSNRYLVVLYYQATKAWKRMDTDKARVKLEEVKDRYGLGGDIEKEKEKMGIYTPKHTPGVSTPRHKH

SEQ ID NO: 166728 - protein, 145 aa, Heterodera glycines
  Homolog annotation: Hit_ID=CAE67504.1; Match level="QueryCoverage =93%, HitCoverage=40%, E-value=2e-27, Identity=41%"; Hit description =Hypothetical protein CBG13014 [Caenorhabditis briggsae]
  Coding regions on vcDNA: vcDNA=SeqID_93151; Strand=+; Position=3-440
ISLFLASPTPMLNALTNATAGFVRDHPDLPVSNTTETLTAIVYICRHMLERKEFYDRLSGDERNFFLRVMVSALILFDHIDSAGAFCRHSQVDVRGVVEVVKQKGTEQQANQLMDVLRYTSKHLNDLETPKSMRALFNERVERNI

SEQ ID NO: 166729 - protein, 197 aa, Heterodera glycines
  Coding regions on vcDNA: vcDNA=SeqID_93152; Strand=+; Position=26-616
MISSSKFCTNFDQLFNHLRLLCSNDAGAAHYGTELMPIIKENPFFGALCSVMAEEKQKIRAMTAEISCAAMALAFSLDSPTDDAKDKNCAVDQTLSECKKYYLEENELDGETKDKMKQTLEEHEQFGQLIEQNSVACLHTSRRLFAVHAQLRPVTLGDVQQFGIVLKLSTKKWQNELKDAVCSQLLLIKSRAGQKKK

SEQ ID NO: 166730 - protein, 176 aa, Heterodera glycines
  misc_feature (128)..(128): Xaa can be any naturally occurring amino acid
  Homolog annotation: Hit_ID=CAA78915.1; Match level="QueryCoverage =98%, HitCoverage=44%, E-value=8e-57, Identity=60%"; Hit description =p46Eg265 [Xenopus laevis] gb|AAH72133.1| LOC397925 protein [Xenopus laevis] sp|Q91820|STK6_XENLA Serine/th
  Gene Ontology: Mol. function=protein serine/threonine kinase activity; Cellular component=spindle; Biological process=reproduction
  Coding regions on vcDNA: vcDNA=SeqID_93153; Strand=+; Position=10-536
MSSEIENIVPNGAIDDHQKEMNKFSWTLNDFEIGKPLGKGKFGTVYLARERETKYLTALKVLFKKDMDKHGVSHQMKREIEIQYHLRHPNILRLYGYFYDEDRVYLSLEFASRGSVFQLLRKSNAFRXPYSARLIYQLADALIYCHSRNVIHRDIKPENLLINTNGDLKIADFGWS

SEQ ID NO: 166731 - protein, 135 aa, Heterodera glycines
  Coding regions on vcDNA: vcDNA=SeqID_93154; Strand=+; Position=1-408
LLSVSSQMSSGQSLSLLVFSVFLAILCSFCSSFPLQQMPSQSRPMFGKIGTSAQIVANVLPELQMVEPFPFDQISDNSQQLKSEWDGNGRGGEVQTQRLQFSSFPHFLFPVEVKRQMDDTKRGSLGPRPLSFGRR

SEQ ID NO: 166732 - protein, 49 aa, Heterodera glycines
  Coding regions on vcDNA: vcDNA=SeqID_93155; Strand=-; Position=227-376
KIKNILGLFLKYLYKHIRSFSIFSHFSKIHHKILQNQKSTTEGFVEYFF

SEQ ID NO: 166733 - protein, 60 aa, Heterodera glycines; identical to SEQ ID NO: 128156
  Coding regions on vcDNA: vcDNA=SeqID_93156; Strand=+; Position=39-221

SEQ ID NO: 166734 - protein, 66 aa, Heterodera glycines; identical to SEQ ID NO: 152131
  Homolog annotation: Hit_ID=NP_509897.1; Match level="QueryCoverage =60%, HitCoverage=4%, E-value=2e-11, Identity=73%"; Hit description =guanylyl cyclase (gcy-9) [Caenorhabditis elegans] emb|CAA91488.1| Hypothetical protein ZK455.2 [Caenorhabd
  Coding regions on vcDNA: vcDNA=SeqID_93157; Strand=-; Position=163-363

SEQ ID NO: 166735 - protein, 59 aa, Heterodera glycines
  Coding regions on vcDNA: vcDNA=SeqID_93158; Strand=+; Position=199-378
GSRCTFYINFITYHNKKFILDYLVCEMSIFGCVGEMSEFGLAGEMSIHTFLIVIFLPYC

SEQ ID NO: 166736 - protein, 31 aa, Heterodera glycines
  Coding regions on vcDNA: vcDNA=SeqID_93159; Strand=-; Position=182-277
FFFFFFFYISPAILRKLRQYKLRALYTCRNS

SEQ ID NO: 166737 - protein, 110 aa, Heterodera glycines
  Coding regions on vcDNA: vcDNA=SeqID_93160; Strand=+; Position=68-400
LSAEFGFYPSIKSNQSLRFPNHQISYFWFKSIQLIIPFFTLFCFYFPMTIIKTFLSVCALLCFFKCNSYADENEVRQMSAVNDQFQLGPRAMNIQFTPSPFANGIIFIRN

SEQ ID NO: 166738 - protein, 201 aa, Heterodera glycines
  misc_feature (162)..(162): Xaa can be any naturally occurring amino acid
  Homolog annotation: Hit_ID=CAE58624.1; Match level="QueryCoverage =99%, HitCoverage=28%, E-value=3e-43, Identity=49%"; Hit description =Hypothetical protein CBG01792 [Caenorhabditis briggsae]
  Gene Ontology: Mol. function=metallopeptidase activity; Cellular component=mitochondrion; Biological process=mitochondrial processing
  Coding regions on vcDNA: vcDNA=SeqID_93161; Strand=+; Position=3-605
RFQHVAGTRCPTDFAEVPSNLMECFFNDPRVLQKIWRDSSGRAPTDEKTELLEGIANSRRVFDALHTTRQALYALFDLELHGERAAEIAEGRMSTTELFGHLQSKALPGLKNGDQIAYHHRIAHLFTYGAKYYSYLVARAGASLIYERLFADDPLSGRNGLXWAKVQSHGGEHPSDVLMAMALDSPEGKAPTAAELVAALD

SEQ ID NO: 166739 - protein, 97 aa, Heterodera glycines
  Coding regions on vcDNA: vcDNA=SeqID_93162; Strand=-; Position=114-407
MSPLLTPSSTVVCCKRKLDGSDCCEPAKKPYRMPFCPLPNPALQSTVELTEGELTAICCCCLCKVTSFSWRKPFFILPLGSIVCGPCDPLNWLSSEC

SEQ ID NO: 166740 - protein, 176 aa, Heterodera glycines
  misc_feature (145)..(145): Xaa can be any naturally occurring amino acid
  misc_feature (147)..(147): Xaa can be any naturally occurring amino acid
  Homolog annotation: Hit_ID=AAH83716.1; Match level="QueryCoverage =87%, HitCoverage=29%, E-value=2e-27, Identity=45%"; Hit description =Unknown (protein for MGC:94607) [Rattus norvegicus]
  Gene Ontology: Mol. function=protein binding; Cellular component =cytoplasm; Biological process=galactose metabolism
  Coding regions on vcDNA: vcDNA=SeqID_93163; Strand=+; Position=21-549
MVFRCPVKNAIDDGPSSAVVRLFRQRFDNCDPQWLIRCPGRVNLIGEHIDYSDYSVLPMAIEHSTWVAVGPSPERTVQLVNEEEEKYPPFTLAISDSFSGASSNGAVPKWHHYFLAGWRGILESLAQREGVNTETEALQRAKGMXCXVASRIPPSAGLSSSSALVCAAALATLCVQ

SEQ ID NO: 166741 - protein, 44 aa, Heterodera glycines
  Homolog annotation: Hit_ID=NP_498620.1; Match level="QueryCoverage =100%, HitCoverage=19%, E-value=7e-09, Identity=56%"; Hit description= -related (24.4 kD) (3I436) [Caenorhabditis elegans] gb|AAK68310.1| Hypothetical protein F08F8.7 [Caenorh
  Coding regions on vcDNA: vcDNA=SeqID_93164; Strand=+; Position=2-133
IEPLISPTISHTDLSDFANECPKLMAAGADYLHLHIMDGHFRPN

SEQ ID NO: 166742 - protein, 60 aa, Heterodera glycines
  Coding regions on vcDNA: vcDNA=SeqID_93165; Strand=-; Position=1-180
MLEFFIASSYKNAMSALSVEDVHFFSVSFRVLRRVKIVGMRSLEMYSFFCGEFCSSGSTI

SEQ ID NO: 166743 - protein, 213 aa, Heterodera glycines
  Homolog annotation: Hit_ID=CAE57904.1; Match level="QueryCoverage =100%, HitCoverage=39%, E-value=1e-65, Identity=55%"; Hit description= Hypothetical protein CBG00954 [Caenorhabditis briggsae]
  Gene Ontology: Mol. function=UDP-glycosyltransferase activity; Cellular component=membrane fraction; Biological process=steroid metabolism
  Coding regions on vcDNA: vcDNA=SeqID_93166; Strand=+; Position=2-640
LRTESAWANQSPSPPSYIPVPGTGLTDDLSFWERTYNLVAHLRQLYIHQHIILRRVDKLFQKHFPGKLPDSFTLERNASINFVNNPPIFDFARPYMPRVNFVGGLHCKNQTKWTMDRKLLQFVNASSDQKGFILISGGFSAQWSHAPAEVIENLDGAIRELPDILFVWQFNGPPLRDTPNNLFAAEWLPQQELLAHPKCRAHLSHGGVNSVIE

SEQ ID NO: 166744 - protein, 178 aa, Heterodera glycines
  Homolog annotation: Hit_ID=AAL78214.1; Match level="QueryCoverage =89%, HitCoverage=78%, E-value=2e-19, Identity=35%"; Hit description =putative esophageal gland cell protein Hgg-20 [Heterodera glycines]
  Coding regions on vcDNA: vcDNA=SeqID_93167; Strand=+; Position=51-584
MWKNPKKAKKEWKEISLCGDCWLSVFQFIGPYELGLKFALLSDRFDHLVDEHFKTKKWAMGFLEIRLSSRGKRAVIVNNFGDGQRSFYPIPQKPLPSNIVGFESIRISYVDQHVVQFLHRIRRLFDSVPTNLYIATAALAETVYRLKHFVRSCEAIRQHILPLLRANVRALFLSSPIF

SEQ ID NO: 166745 - protein, 17 aa, Heterodera glycines
  Coding regions on vcDNA: vcDNA=SeqID_93168; Strand=+; Position=3-56
TCYEMYKNNFIILNIIL

SEQ ID NO: 166746 - protein, 150 aa, Heterodera glycines
  misc_feature (114)..(114): Xaa can be any naturally occurring amino acid
  Homolog annotation: Hit_ID=NP_495993.1; Match level="QueryCoverage =99%, HitCoverage=49%, E-value=2e-16, Identity=29%"; Hit description =grey-lethal osteopetrosis like (2J643) [Caenorhabditis elegans] pir||T22084 hypothetical protein F42A8.3
  Coding regions on vcDNA: vcDNA=SeqID_93169; Strand=+; Position=2-451
CANVAGEYIVFTEQHDRSLHLANTNGLHRLECTTWHLQQYILLMYAQDMNSVLIESMWDESNCGDCLPIDRNWERGNSTFDFDARTSQFEQCLRQWPDRVVRHNESSICQGCRXPYDTLLVCYCDIFSDAHTVYCIDVDSEMNDTMKLWQ

SEQ ID NO: 166747 - protein, 26 aa, Heterodera glycines
  Coding regions on vcDNA: vcDNA=SeqID_93170; Strand=+; Position=1-78
VTPYIFLYIVIVLTHRAMFYLAKKKK

SEQ ID NO: 166748 - protein, 47 aa, Heterodera glycines
  Coding regions on vcDNA: vcDNA=SeqID_93171; Strand=+; Position=3-143
QALSLTRHASVSLVARHRGIDDCLGYRDCSSSSCRRAYRPRVPTSHN

SEQ ID NO: 166749 - protein, 143 aa, Heterodera glycines
  misc_feature (49)..(49): Xaa can be any naturally occurring amino acid
  misc_feature (135)..(135): Xaa can be any naturally occurring amino acid
  Homolog annotation: Hit_ID=CAE62713.1; Match level="QueryCoverage =97%, HitCoverage=86%, E-value=8e-23, Identity=43%"; Hit description =Hypothetical protein CBG06867 [Caenorhabditis briggsae] gb|AAA89169.1| globin gb|AAA89168.1| globin
  Coding regions on vcDNA: vcDNA=SeqID_93172; Strand=-; Position=1-430
MSAREEIQAVGVQSLKQLKIGAGEAEFPKGKAFYKCVFLNYPTPRVYLXGAEKLEAEDVQKLVPLEKQGQRILMAKQWIAKVDSNGMFSSAQGRETANSHCQLKREPSLWKALCTVRTGFSETKVDPAEQAKLAXMSVGEDFA

SEQ ID NO: 166750 - protein, 51 aa, Heterodera glycines
  Coding regions on vcDNA: vcDNA=SeqID_93173; Strand=+; Position=3-158
ALRTVGHADETTGCFAHQIHTEMAMMMPNWMFEIASKLQIKSIEKKNRGNS

SEQ ID NO: 166751 - protein, 72 aa, Heterodera glycines
  Coding regions on vcDNA: vcDNA=SeqID_93174; Strand=-; Position=30-248
QININLWPFSPQVFMCCLAKCQGKCLSGFAVDLQQMATPTVPASVIFVRNAILAVSTARAFLASSFSAGGGH

SEQ ID NO: 166752 - protein, 185 aa, Heterodera glycines
  Homolog annotation: Hit_ID=CAE75456.1; Match level="QueryCoverage =84%, HitCoverage=85%, E-value=9e-25, Identity=35%"; Hit description =Hypothetical protein CBG23451 [Caenorhabditis briggsae]
  Coding regions on vcDNA: vcDNA=SeqID_93175; Strand=+; Position=68-622
MEPMAATESAATSSTPAKRLLTRLGTTRVGRYVQQLAIDYAASFRDIVVGMRQRPLRAVACGAALASLVFTLKSNPDEIALRARLAQLRQQMVLIPASIHSTRADERLEQYTVLLNGNRLELVDFLLFSVLVERPFDKKNEFYAAHDKTLRGWPWTELWRNAWDIGALGRFWALERSFDNCDVRH

SEQ ID NO: 166753 - protein, 210 aa, Heterodera glycines
  Coding regions on vcDNA: vcDNA=SeqID_93176; Strand=+; Position=2-631
SAAVPGEVYSLDQFVPELSEVHLRELQEEAMQFFRQNESVQKLVNLGISSVVAKRLGNPLRYGNPSRRCFLSLKIVALAKLTQTIHKVNVKEIRKLSVKEVESLSFIPPKMLCHIREEFLSIPQNQKGRVFYELSAEKRSRILAELLCLLLLFDDPEFTLPISPIVQDFYVSENVLKNLLVAMGCVVSVASETQALSLNTIRIARLVGPP

SEQ ID NO: 166754 - protein, 180 aa, Heterodera glycines
  misc_feature (67)..(67): Xaa can be any naturally occurring amino acid
  Homolog annotation: Hit_ID=NP_497276.2; Match level="QueryCoverage =100%, HitCoverage=68%, E-value=5e-42, Identity=48%"; Hit description= RNA-binding protein S1 serine-rich domain like (rnp-4) [Caenorhabditis elegans] gb|AAK21429.2| Rnp (rrm
  Gene Ontology: Mol. function=single-stranded DNA binding; Cellular component=nucleolus; Biological process=RNA splicing
  Coding regions on vcDNA: vcDNA=SeqID_93177; Strand=+; Position=1-539
RRRSSSSSSSGSSSSTGSSSSGSSSSSSTTASRSPSPKKQRAAARPSARDDRTTRRSPRRSRSPHRXPTENREKHCQLSPRHERAAPSPPPVKRERTPEPPPRRLCVRNLSRNITKAHMEEIFALFGALKSCELPMDRVHVHLPRGYGYVEYEKAEDAEKALKHMDGGQIDGLEIQCEMT

SEQ ID NO: 166755 - protein, 199 aa, Heterodera glycines
  Coding regions on vcDNA: vcDNA=SeqID_93178; Strand=+; Position=3-599
FTADPSKRPKPTELLNHSFMRNKCNETKARINIGVEPKGEVQWNSKRRSLRLDMMAVHSYYGQLKERDLMFAILNAIKLVREGTIPPIFIEKLSAVVHDKFVAVDASLAFQQSEEWSRDVLNISNASPSPEGTKRLTLREHKTPHCSGEQINTGHNNSRFPREEREYQRCEMVFFVNRNWSREHRQLFVAYQFARWFSR

SEQ ID NO: 166756 - protein, 181 aa, Heterodera glycines
  Homolog annotation: Hit_ID=CAE62968.1; Match level="QueryCoverage =95%, HitCoverage=20%, E-value=7e-30, Identity=45%"; Hit description =Hypothetical protein CBG07185 [Caenorhabditis briggsae]
  Coding regions on vcDNA: vcDNA=SeqID_93179; Strand=+; Position=25-567
MDESTDGFDEDEQQRRDHIEKLRKQREEHAIKLDAVLNRSGLSTKMQELMGKFVLVEQFYMTQSVRKAIDMDSIEEGALTSTLLDDVFFIVRKSIRRSISSSSVDCVCAMLNNGATLLETDFLKYISAPIKSGYPSTGWSAESAYQTAQNVMQGKGEVVGGLEKQRSAFITALNNLRSSID

SEQ ID NO: 166757 - protein, 145 aa, Heterodera glycines; identical to SEQ ID NO: 133769
  Coding regions on vcDNA: vcDNA=SeqID_93180; Strand=-; Position=1-435

SEQ ID NO: 166758 - protein, 209 aa, Heterodera glycines
  Homolog annotation: Hit_ID=CAE57406.1; Match level="QueryCoverage =98%, HitCoverage=25%, E-value=7e-57, Identity=55%"; Hit description =Hypothetical protein CBG00360 [Caenorhabditis briggsae]
  Gene Ontology: Cellular component=mitochondrion; Biological process =embryogenesis and morphogenesis
  Coding regions on vcDNA: vcDNA=SeqID_93181; Strand=+; Position=2-628
ELPIHLTDEAHWWVSTNIPPRKYYFSMPLQIVIIAELLVLSGLFSGLNLGLMSLTPQKLTLIKNSGSPKERKNAQTILPMRKSGNRLLCSLLIRNVCINSAISILFDDLTSGTAALIISSTGIVVFGEIIPQALCVKKGLAAGACTIWVTRFCMMLTLIGSYPISLILDKLLGEQVESYDRKRLIELIKLNTKNAAQADELKIAIDAFE

SEQ ID NO: 166759 - protein, 118 aa, Heterodera glycines
  Homolog annotation: Hit_ID=EAA16792.1; Match level="QueryCoverage =98%, HitCoverage=17%, E-value=3e-16, Identity=47%"; Hit description =ookinete protein-related [Plasmodium yoelii yoelii]
  Gene Ontology: Mol. function=RNA helicase activity; Cellular component=cytoplasm; Biological process=post-embryonic development
  Coding regions on vcDNA: vcDNA=SeqID_93182; Strand=-; Position=1-354
KGQQGSSSSNTNPYGGYGTGGTSPYGNIPNGYGIGTGMNGYGMGTMPYKKNGYGMGTMNGYGMGTMNGYGMGTMNGYGTGTMPYGMNGYGMGTMNGYGMGTMNGYGMGTMNGYGTGTM

SEQ ID NO: 166760 - protein, 137 aa, Heterodera glycines
  Coding regions on vcDNA: vcDNA=SeqID_93183; Strand=-; Position=0-410
KSTTQPMPKPKGSHRNATKRFPFDYNRLEAILILDKLPDINGREGSDRIRAFFRKFEIGTEGWTNAEKLKALQLKVTGKAERSLNAAVDFERTASKIGMREVKFDLIKKEMLQTLDELDARETSAFDELFTGLQRRS

SEQ ID NO: 166761 - protein, 116 aa, Heterodera glycines
  Coding regions on vcDNA: vcDNA=SeqID_93184; Strand=-; Position=200-550
RHFGLCRPQQQQQQQHNNAKVKRMEQSATNSIASKYSSKPVGGSKMPALRSLISEKSNGGGFTLFLFADATAFDERMRAEVPFSTTAGGEAAKLLRKKSQPSAGLATSDRLFLFVS

SEQ ID NO: 166762 - protein, 195 aa, Heterodera glycines
  Homolog annotation: Hit_ID=NP_506130.1; Match level="QueryCoverage =97%, HitCoverage=40%, E-value=2e-68, Identity=63%"; Hit description =innexin, putative gap junction protein, OPUs gap junctional protein (54.6 kD) (inx-11) [Caenorhabditis el
  Gene Ontology: Biological process=jump response
  Coding regions on vcDNA: vcDNA=SeqID_93185; Strand=+; Position=5-589
LSLMMIETLISMVRYLSARKDDDFSDRMNYLYTPNILLAFSVLISFKQFGGRPLECMFPNKFPGSWEQYAENFCWSEDTYYLPPEVHVAQIQESERYSSGRKLSYYQWVPFFLLFQAACFRFPSLLWKAINLSSGLRVHDVVTKALDSQNMEESNRQRTLQILANHLARALSFQTQILRRHLIVHQTFRFLNVTC

SEQ ID NO: 166763 - protein, 103 aa, Heterodera glycines
  misc_feature (2)..(2): Xaa can be any naturally occurring amino acid
  Coding regions on vcDNA: vcDNA=SeqID_93186; Strand=-; Position=104-415
FXNICILFSHFNKKTKAGPFESFVCLLSLLPTETAQPRNARFFSGRRDIFSDFFGVLSDCRGQVTCARRPTFGRSNSASRPIPFCALSFVHLSLCRHFVLTLW

SEQ ID NO: 166764 - protein, 200 aa, Heterodera glycines
  Homolog annotation: Hit_ID=NP_508501.1; Match level="QueryCoverage =99%, HitCoverage=37%, E-value=2e-30, Identity=38%"; Hit description =strabismus (60.1 kD) (XD507) [Caenorhabditis elegans] gb|AAK68677.1| Hypothetical protein B0410.2b [Caeno
  Gene Ontology: Biological process=morphogenesis of embryonic epithelium
  Coding regions on vcDNA: vcDNA=SeqID_93187; Strand=+; Position=1-600
VHNPFLDHSRRSSAFAHFRPLPTPSAGFKLYDIDGRGEGVVLPQAAERILMHSAVQRRVAGHSEMFRRECEWERHFRKRKCRLINCTEDVFEQVQQMNIDSVERSAQQKVEPMDPRLAAKSVLESIARPLRKYLRFIGQEAFFRHDDSLAHLQRCLAFGFSARTFLQRFFSSSTPLQEVLSESKWSVLCDSRVSGPLRHG

SEQ ID NO: 166765 - protein, 188 aa, Heterodera glycines
  Coding regions on vcDNA: vcDNA=SeqID_93188; Strand=-; Position=2-568
RAVSPSHRSRSVSSTSSSGESAESVCSEEEQQKPAEETELKAIVEDEEKPVATEETSPIAKKSPSPMFVQMAEESEQMLEGHATVEELDGEEMNMEELEQIEEEQSIDGSKEVEICREETYVRVQELRDGRTEEATRPLTGQSKPRTDFAFAERRLLSASDQRRTSRDQLLFGPGSVTERAAGRTAHF

SEQ ID NO: 166766 - protein, 99 aa, Heterodera glycines
  misc_feature (62)..(62): Xaa can be any naturally occurring amino acid
  misc_feature (68)..(68): Xaa can be any naturally occurring amino acid
  Homolog annotation: Hit_ID=NP_505582.2; Match level="QueryCoverage =100%, HitCoverage=28%, E-value=5e-23, Identity=53%"; Hit description= yip1 interacting factor homolog (39.1 kD) (5K530) [Caenorhabditis elegans] emb|CAA94831.2| Hypothetical
  Coding regions on vcDNA: vcDNA=SeqID_93189; Strand=+; Position=8-304
LMYDPLLNTARHLGGQGADQQQQELTQYLSYTSGHLKYYFAVDNHYVRPKLGIILFPLFHRXWGQQMXGDAPVLPCHDVNARDLYISMMEYIAYVLVTG

SEQ ID NO: 166767 - protein, 109 aa, Heterodera glycines
  Homolog annotation: Hit_ID=NP_509131.1; Match level="QueryCoverage =74%, HitCoverage=17%, E-value=2e-25, Identity=65%"; Hit description =yeast SMF (divalent cation transporter) homolog (smf-2) [Caenorhabditis elegans] gb|AAC46568.1| Yeast smf
  Gene Ontology: Mol. function=transporter activity; Cellular component= integral to plasma membrane; Biological process=transport
  Coding regions on vcDNA: vcDNA=SeqID_93190; Strand=+; Position=3-332
LLSNGRIPLFAGVLITMVDTFTFLLIDRYGFRKLEFIFAVLISTMAITFGFEFVVVKPDGWDLMAGTLLPYCPGCGRQEFLLVFEWGSLRSPSLMIYLLFFSKNFPRKS

SEQ ID NO: 166768 - protein, 199 aa, Heterodera glycines
  Homolog annotation: Hit_ID=EAL18462.1; Match level="QueryCoverage =96%, HitCoverage=42%, E-value=3e-37, Identity=39%"; Hit description =hypothetical protein CNBJ1040 [Cryptococcus neoformans var. neoformans B-3501A]
  Gene Ontology: Mol. function=monocarboxylic acid transporter activity; Cellular component=membrane; Biological process=transport
  Coding regions on vcDNA: vcDNA=SeqID_93191; Strand=+; Position=8-604
MNHDEPPDGGRDAWLVVLASFLAHFVVFGIQYSFGVYQSFFVNNDFKSSSPASVSLIGTVGFAAIFCVGIVSGKLAEAYGYRRTIFAGTILITSGLVLASFSSTLWQLILTQGLMVGLGSSLVYYPSVSVPSQWWKRRRSFATGIAVAGSGLGSLTITAVTDAMLRTAGLRWTLLATALMSATLLLIALVFLKTRIPRP

SEQ ID NO: 166769 - protein, 123 aa, Heterodera glycines
  Homolog annotation: Hit_ID=NP_492730.2; Match level="QueryCoverage =99%, HitCoverage=13%, E-value=2e-24, Identity=46%"; Hit description =FAD dependent oxidoreductase and glycine cleavage T protein (94.9 kD) (1L16) [Caenorhabditis elegans] emb
  Coding regions on vcDNA: vcDNA=SeqID_93192; Strand=+; Position=2-370
LIGESDQARGYFIINGMNAQGLSFGGGLGDLLAQWVLQGRPPVTTQSVVDTLDESRFLPLHAHPQYVFLRMPEVASNIYKNFTASHQCHSVRNLRTFAIHRHLQEAGAVFAYNMGYERTIRYD

SEQ ID NO: 166770 - protein, 80 aa, Heterodera glycines
  Homolog annotation: Hit_ID=CAE70349.1; Match level="QueryCoverage =78%, HitCoverage=34%, E-value=5e-12, Identity=47%"; Hit description =Hypothetical protein CBG16897 [Caenorhabditis briggsae]
  Coding regions on vcDNA: vcDNA=SeqID_93193; Strand=+; Position=2-244
STTDDDTAAFAWLSEKIFTTARGWDYYGPEGAYGALAGHDATRGLGTMDVQPIKDQFDDHGGIDPSDLEETTEWQQSLSL

SEQ ID NO: 166771 - protein, 97 aa, Heterodera glycines
  misc_feature (46)..(46): Xaa can be any naturally occurring amino acid
  Homolog annotation: Hit_ID=NP_497802.2; Match level="QueryCoverage =82%, HitCoverage=31%, E-value=1e-15, Identity=48%"; Hit description =putative N-myristoylated protein (28.3 kD) (3F80) [Caenorhabditis elegans] emb|CAA84649.2| Hypothetical p
  Coding regions on vcDNA: vcDNA=SeqID_93194; Strand=+; Position=3-295
QISLLSMHFGAEQVNRRIYGFKADFFATIANSLATECVFLDGASHXATDAIEAWAELVEMMFSSVRDGYYAEVRRRRRCSGGASGETKSGQNEKIIK

SEQ ID NO: 166772 - protein, 192 aa, Heterodera glycines
  misc_feature (90)..(90): Xaa can be any naturally occurring amino acid
  Homolog annotation: Hit_ID=EAL34328.1; Match level="QueryCoverage =100%, HitCoverage=42%, E-value=4e-67, Identity=61%"; Hit description= GA12041-PA [Drosophila pseudoobscura]
  Gene Ontology: Mol. function=URM1 activating enzyme activity; Biological process=coenzymes and prosthetic group metabolism
  Coding regions on vcDNA: vcDNA=SeqID_93195; Strand=+; Position=2-577
KLTNDEILRYGRQLILPSLGIHGQTSLKNSSALIVGTGGLGAPSSMYLAAAGISTLGLVDLDVVDTTNLHRQVVHAEEAQDLPKVTSARXSLQRLNSHVKYVEHNCLISAANALEIVAPYDIVLDCSDNVATRYLLNDACVLLGKPLVSGSALRLEGQLTIYNHANGPCYRCLFPTPPPDETVTNCSDGGVM

SEQ ID NO: 166773 - protein, 164 aa, Heterodera glycines
  Coding regions on vcDNA: vcDNA=SeqID_93196; Strand=+; Position=11-502
DYKAMENEEEPQLHIDVLLNVAEKLIFSPDNDFRLDLRDPNADIVNFMFAGPACRWSFFSQFRKLTQVSVNSAELQLYAPKPIQGIRGTLSNNKEFFQGPFVVTDQFFYTLFCRGILRPTVVDTFFIFGNDVVTFDSVPSSSASIMMNDWREQLEDGEETEEGE

SEQ ID NO: 166774 - protein, 201 aa, Heterodera glycines
  Homolog annotation: Hit_ID=AAQ91190.1; Match level="QueryCoverage =97%, HitCoverage=24%, E-value=2e-15, Identity=29%"; Hit description =dipeptidyl peptidase-like protein 2 [Homo sapiens]
  Gene Ontology: Mol. function=dipeptidyl-peptidase IV activity; Cellular component=integral to membrane; Biological process =proteolysis and peptidolysis
  Coding regions on vcDNA: vcDNA=SeqID_93197; Strand=+; Position=1-603
VASPQERNWRGIATALLVIVAMCSIIALAVLVLTPPLLDADQPQKRVTLADVLTHRFLNSVESLEWLDSRRLLVKEAESVRVLELNEGAENGGPIGWTWKTLPGDLFRFGKPSSVSLSPGGRFIILNYAPSKRSPKSTYRIYDTEKQIFENVGPKQSGDENVRVLAWSPNGDHFAYVHENDVFFQRSPSASLSVQLTNESS

SEQ ID NO: 166775 - protein, 153 aa, Heterodera glycines
  misc_feature (47)..(47): Xaa can be any naturally occurring amino acid
  misc_feature (95)..(95): Xaa can be any naturally occurring amino acid
  Homolog annotation: Hit_ID=CAE67869.1; Match level="QueryCoverage =79%, HitCoverage=20%, E-value=6e-26, Identity=50%"; Hit description =Hypothetical protein CBG13461 [Caenorhabditis briggsae]
  Coding regions on vcDNA: vcDNA=SeqID_93198; Strand=+; Position=64-523
KLGLHCVLCVSGWIEDREDSAFRHHLATYEQGASSTRENKYLEELGXAFIDFFVSFVFSYAIQRSLMETMLASLVSAIAWPLVLLGSSCVIDNPXNICTRRARQVGEHLAEVLLTRQHCRRPIHSDRFFRSVQMITSDRLLAWRPRVLIFIIL

SEQ ID NO: 166776 - protein, 55 aa, Heterodera glycines
  Coding regions on vcDNA: vcDNA=SeqID_93199; Strand=+; Position=1-168
VLLAWKLSWIIFSNFMAKLFSCGLSSCSVTLLMSSPMIIFVELKMKNCEKNKAKH

SEQ ID NO: 166777 - protein, 135 aa, Heterodera glycines
  Coding regions on vcDNA: vcDNA=SeqID_93200; Strand=+; Position=6-413
MKSDLYSQIDRKFEESSTSNEGSDNELVADDNASLNSMYMKLDFLDRVKAEIIFNSLSVDKEPKRSTTRRLMSLDGTIITAKFSSDDQKSLIRSANNFFDMCQLSKSCIDMARNYAYKSPKMKTVQIPTKKKHNK

SEQ ID NO: 166778 - protein, 54 aa, Heterodera glycines
  Coding regions on vcDNA: vcDNA=SeqID_93201; Strand=+; Position=158-319
RYFAELHPCVQPVDILLARVLGYGDAHTSYLLTIAEAELGVVIGRSQNRERLLP

SEQ ID NO: 166779 - protein, 127 aa, Heterodera glycines
  Coding regions on vcDNA: vcDNA=SeqID_93202; Strand=-; Position=75-458
MNLGACDFDTEHSVSNTVQSLVRVVNPNDRHCLARAVLLGLRDRETRQPNGGGRDAFDAYAARQHQHGPEAVVLLTRAGIAVDKDLYTLEDVGHLQRLIINEHGVGQIRLVVFEKEQEYRIVFKGEG

SEQ ID NO: 166780 - protein, 137 aa, Heterodera glycines
  Coding regions on vcDNA: vcDNA=SeqID_93203; Strand=+; Position=67-480
VDIYRTKCNARHGATAKSAVPTVDELFRAQLGHFYAQIDGIVFEDFVRSAVLGQLLRLHLSSARWPCVAWAPTGPSPPFGPRLARPSPRTVGRLPSHGRGGQSGTIAAETGPKKAQKRDGHAEDDDGMSAELRRQMT

SEQ ID NO: 166781 - protein, 60 aa, Heterodera glycines
  Coding regions on vcDNA: vcDNA=SeqID_93204; Strand=+; Position=6-188
IDRRSAQLNSRRKPGTVTVLMLLNALTRKKTIPHFGLTYYAHFILSPTYDTVQCFFFLHL

SEQ ID NO: 166782 - protein, 152 aa, Heterodera glycines
  Coding regions on vcDNA: vcDNA=SeqID_93205; Strand=+; Position=42-497
MYATAHLAPQLLIRLLSFCLCATVASAFVYGSRGGGAYGDGLRGYGGAVYGSGGHYGDWDEDGPYRPPVYRRPMYKPVPGPLYGYNKRPPVYGGGSGNNYYYPAPAPKPPTPCPPAEKPSTVVPTSSLAPPSTQQSTQTATHTSTTAQTSPK

SEQ ID NO: 166783 - protein, 180 aa, Heterodera glycines
  Homolog annotation: Hit_ID=NP_741561.1; Match level="QueryCoverage =100%, HitCoverage=39%, E-value=8e-63, Identity=58%"; Hit description= tumor differentially expressed 1 like, possibly N-myristoylated (50.0 kD) (5H541) [Caenorhabditis elegan
  Gene Ontology: Cellular component=membrane
  Coding regions on vcDNA: vcDNA=SeqID_93206; Strand=+; Position=1-540
CSLCCSFCPTSKNSTSTRVMYALMLLVGTLTSCVMLSEWVQKMLAKGGWFCSATGSAGIPVCDMVTGYQAVYRICMGMTSFFLLFMLLMLGVKSSRDGRAPIQNGFWFFKYLLLGLLIFGFFYLRDGGWATPMMWIGMLGAFIFILIQLVIIVDFAHGLAENWVSTYEENESRWCFAGMI

SEQ ID NO: 166784 - protein, 97 aa, Heterodera glycines
  misc_feature (10)..(10): Xaa can be any naturally occurring amino acid
  Homolog annotation: Hit_ID=AAM64597.1; Match level="QueryCoverage =100%, HitCoverage=18%, E-value=1e-39, Identity=82%"; Hit description= beta-amylase-like proten [Arabidopsis thaliana] gb|AAM98271.1| At5g18670/T1A4_50 [Arabidopsis thaliana] g
  Coding regions on vcDNA: vcDNA=SeqID_93207; Strand=-; Position=2-292
KAITAGLKAXTLPGVEVTELPIFWGVVEKEAAGTYEWFGYLAVAEIVKKVGLKFHASLSFHGSSQAEIGIHDGVAKIGDVDPGIFFADRYGQQYKDC

SEQ ID NO: 166785 - protein, 90 aa, Heterodera glycines
  Coding regions on vcDNA: vcDNA=SeqID_93208; Strand=+; Position=67-339
MIKDRMKRQLSGTQMTNKNLLKHVATVMDPFRKYDFRPLFTKCGYGIPGAFDPGCGFPDSLLEKHAETMVARDDDGTDSQGEGVDFEVEE

SEQ ID NO: 166786 - protein, 186 aa, Heterodera glycines
  Homolog annotation: Hit_ID=EAA69694.1; Match level="QueryCoverage =90%, HitCoverage=9%, E-value=1e-27, Identity=38%"; Hit description =hypothetical protein FG00284.1 [Gibberella zeae PH-1] ref|XP _380460.1| hypothetical protein FG00284.1 [Gibb
  Gene Ontology: Cellular component=plasma membrane
  Coding regions on vcDNA: vcDNA=SeqID_93209; Strand=+; Position=31-588
MPKVGQPQLLDTYAEHRFWRFMLTAPMATHQSLKVEYMVDGCGSATFNVPSKNEQFKWAFMTCNGFSSDVKPRVQAQHSGIDPMWTDILREHAQKEFHGMVVGGDTVYMDDIWTVPAVKEWLDMRGDKATKVSAPWTAKMNSQTHKFYFDRYMAHFTLNGFAQGLAAMPYLCVWDDHDIFDGFRSY

SEQ ID NO: 166787 - protein, 136 aa, Heterodera glycines
  Coding regions on vcDNA: vcDNA=SeqID_93210; Strand=+; Position=1-408
APPPLPRHRRRFNDDIPQQKLFSDFGHTAAAFVRRRVQQQKMVVETQEQLNIDHHPSAFHRVGSATVAPQPPAAVVETNVVAGTMPTAHMNQHNQLGTGTAAQQHQYILAMLQQVMIFLWLLTKFTFVYLLFFIFG

SEQ ID NO: 166788 - protein, 149 aa, Heterodera glycines
  Coding regions on vcDNA: vcDNA=SeqID_93211; Strand=+; Position=11-460
DGRFDCLIIDACGAKSPPPGQKYPLICPFEGFVNPETIVDKMYKMLRADGTLIINTFVVPNGENESKVSEVRQFLLELFRHHFGGHCYYIGLHFSNKLLVCNLALSSAEPMTEKLFDHRMNKLPKWLQGELRTEMSIENEVWRRPKSEI

SEQ ID NO: 166789 - protein, 114 aa, Heterodera glycines
  Coding regions on vcDNA: vcDNA=SeqID_93212; Strand=+; Position=3-347
KLRARMNQSMSGQSFLSRSSSLHHSVQQQLNSAQNANAIATRPSASSSSSNFTSIWEERSSPAQCLQTPGNEKRIKKKRKDKTTALRLGAKKSADNDARGDGEGMGVAESIVLC

SEQ ID NO: 166790 - protein, 86 aa, Heterodera glycines
  Coding regions on vcDNA: vcDNA=SeqID_93213; Strand=+; Position=1-258
VLRTAPPTAFTISFNESSPATVLPPPSDPLCESIDDSREFSLQEAARQAPTVFLLMATRRSVPPRPMPEKGERIGATDSGSEAGDP

SEQ ID NO: 166791 - protein, 184 aa, Heterodera glycines
  Homolog annotation: Hit_ID=XP_318007.1; Match level="QueryCoverage =84%, HitCoverage=40%, E-value=8e-48, Identity=57%"; Hit description =ENSANGP00000010800 [Anopheles gambiae]
  Gene Ontology: Biological process=tyrosine catabolism
  Coding regions on vcDNA: vcDNA=SeqID_93214; Strand=+; Position=16-567
SVAPLPLAPPTQHFTKPSMTSYSDKGPKPDVGKYHGFDHVTLWVGNAKQAAMWYTLTMGFEPIAYRGLETGHRDVVSHVVRQDKITLVLQSPLNPNGVKAMNEHMAHHGDGVKDIAFDVDDVRAIFKAAVARGAKVVREPWEETDANGTVVMATIQAYNDTEHTFVERKNYKGSVFCRIFAAPA

SEQ ID NO: 166792 - protein, 33 aa, Heterodera glycines
  Coding regions on vcDNA: vcDNA=SeqID_93215; Strand=-; Position=9-110
MSINLSQYQSVDLVSFLGDSSLESVIASFGGSF

SEQ ID NO: 166793 - protein, 75 aa, Heterodera glycines
  Coding regions on vcDNA: vcDNA=SeqID_93216; Strand=+; Position=2-226
CRTILQWVGPYHRAFFCDDDSIRLPYKSSTVPDWLLLVYALGVPPFVFAFGEFICLSKPPALAIRQRLNDFEFGE

SEQ ID NO: 166794 - protein, 78 aa, Heterodera glycines
  Coding regions on vcDNA: vcDNA=SeqID_93217; Strand=+; Position=135-368
FKNNLKSFSQSNGQFGFGCSPSPPRLFLCRGRGGRAVFLRNGHLVRETDEGVHISRFARGRREFVGAVGVTVLIGAKV

SEQ ID NO: 166795 - protein, 162 aa, Heterodera glycines
  Coding regions on vcDNA: vcDNA=SeqID_93218; Strand=+; Position=3-488
LRTKYSKMNNENVNNAMVNDTRVNVNDNCQNPNDTRVHVNDTRSVFASINPLKRRVSFRDIPNIREFEQPSSSSTAPSPLPSLFLDTTHTIFKSLMVAQTPTKLLKVDEVAKYGSLDEQLDVTHVIQHTPFHNRHQSPLLLDDLTKQHASSLLFGSQDNYGL

SEQ ID NO: 166796 - protein, 126 aa, Heterodera glycines
  Homolog annotation: Hit_ID=CAF96189.1; Match level="QueryCoverage =93%, HitCoverage=39%, E-value=2e-20, Identity=43%"; Hit description =unnamed protein product [Tetraodon nigroviridis]
  Coding regions on vcDNA: vcDNA=SeqID_93219; Strand=+; Position=1-378
PGLRFPDEGDDPATDFRGMGMLVLHQLVFFAQFDLDNCQRVLSLSNHPIIGFPFAICGITITALCKELLFDDLLKNHFYNALDQPSLREDLCFQVYCRAFSLFSDFWVFLRASSVMEFNVAKQRFD

SEQ ID NO: 166797 - protein, 160 aa, Heterodera glycines
  Coding regions on vcDNA: vcDNA=SeqID_93220; Strand=+; Position=3-482
PFKIFLLIDMSPSLYLSPIIEVIRCQICAHSQFVHRDAQLVPRDQLLAHIAAHINYGPSSEKNERLKQICQREYEHCICIDFAERLGHLSGEDGHRHHEQQQANMTFPAAPPPPHFASSIPNLRSLSSNSSSCLPPSSFADALPSLASSSSSSKSVSSSS

SEQ ID NO: 166798 - protein, 167 aa, Heterodera glycines
  Coding regions on vcDNA: vcDNA=SeqID_93221; Strand=+; Position=1-501
VCNGESSSSDDEYYNNFSKYKAKAALALRRNDCKSGKEITKNGKSTTKKVSSEPSDVEVFTSCPLSEQLISRAEVDPEICVVQFADTSVNSVVDHLVTETYSTTECASPLRTNPTFLTNVCRINISSKGQQKIFFCDLNEPLLNVINEFAERTNVDPKRVNLYTKQY

SEQ ID NO: 166799 - protein, 180 aa, Heterodera glycines
  misc_feature (132)..(132): Xaa can be any naturally occurring amino acid
  Homolog annotation: Hit_ID=NP_498783.1; Match level="QueryCoverage =83%, HitCoverage=35%, E-value=6e-21, Identity=38%"; Hit description =inositol (45.2 kD) (3J250) [Caenorhabditis elegans] gb|AAA27979.1| Hypothetical protein C50C3.7 [Caenorha
  Gene Ontology: Mol. function=phosphatidylinositol-bisphosphatase activity; Cellular component=Golgi membrane; Biological process =lipid metabolism
  Coding regions on vcDNA: vcDNA=SeqID_93222; Strand=+; Position=11-551
MEGIANATELIQRLNSMEEGDEMKAEIAKLLQSHDQLTKARAKREAFGEFTEAEIGFKPTYRTLVRSGAYDSLRVPSWCDRILCEGDMDALRITKYSSCPSITLSDHFPVSAQFELHFQKEKRHQLSETIFXWLIRVEHIPTWEEFIPLVCRIAIPNDIWADLCSYRDWIGIYHNSLNSI

SEQ ID NO: 166800 - protein, 61 aa, Heterodera glycines
  Homolog annotation: Hit_ID=CAE59693.1; Match level="QueryCoverage =98%, HitCoverage=6%, E-value=1e-10, Identity=55%"; Hit description =Hypothetical protein CBG03117 [Caenorhabditis briggsae]
  Coding regions on vcDNA: vcDNA=SeqID_93223; Strand=+; Position=2-184
RKPIDRDEVPIHPAPFQLAIGTPLHRVHTLLAMLGLNHAYATNRGRRVCYFARRERRAALA

SEQ ID NO: 166801 - protein, 41 aa, Heterodera glycines
  Coding regions on vcDNA: vcDNA=SeqID_93224; Strand=+; Position=126-248
FYGNESILFLFTVTLIIPSSLFFVQITKFSTKETPIYICGF

SEQ ID NO: 166802 - protein, 182 aa, Heterodera glycines
  misc_feature (148)..(148): Xaa can be any naturally occurring amino acid
  Homolog annotation: Hit_ID=XP_393273.1; Match level="QueryCoverage =89%, HitCoverage=41%, E-value=2e-25, Identity=39%"; Hit description =similar to ENSANGP00000005501 [Apis mellifera]
  Gene Ontology: Mol. function=RNA binding; Biological process=oogenesis
  Coding regions on vcDNA: vcDNA=SeqID_93225; Strand=+; Position=33-578
MDQNRQQNLFKMPTLLPPNLNQGALLGLSQGLLLQQSAVGASPLGHSALNLSVPSAIHSVLPTTPPNLPIISPSCSIVSRMTPANPSYPIDKYNRGPDGCNLFIYHLPQDFADTDLYSLFAHFGQILSGKVFVDKQTNLSKCFGFGKXSEESSAQNAISANNGSKLAPHGWKVRVNKSESDP

SEQ ID NO: 166803 - protein, 117 aa, Heterodera glycines
  Coding regions on vcDNA: vcDNA=SeqID_93226; Strand=+; Position=3-353
AKNVANLCLVADTYFAALLKKACTKFISSNHKSVLRSPEWKELKTHRGSLANELLESVLDHADGESILEMGSSFDGGNSDAIVSSSSFGNNNFGYLFPRNNSSTAISANLSSLPVST

SEQ ID NO: 166804 - protein, 85 aa, Heterodera glycines
  Coding regions on vcDNA: vcDNA=SeqID_93227; Strand=+; Position=7-264
ELKHLNMFRQHFLLTTMLLCALLYPIIIGVGPPAYLAICQWKDCVDEKPAPGGSHTMICLPATRPAQCPEEAWNQLTELNELEPC

SEQ ID NO: 166805 - protein, 167 aa, Heterodera glycines
  Homolog annotation: Hit_ID=XP_392474.1; Match level="QueryCoverage =100%, HitCoverage=29%, E-value=3e-33, Identity=45%"; Hit description= similar to CG32758-PA [Apis mellifera]
  Gene Ontology: Mol. function=protein C-terminus binding; Cellular component=membrane; Biological process=endosome transport
  Coding regions on vcDNA: vcDNA=SeqID_93228; Strand=+; Position=2-502
EQFTAYSLLMAGRHLGSRRYSEFLQLNKLLKEEFPDFPFPKLPRKWPFRHSEQQLDSRRRMLEQYLEKVCAGIVIAESDTVQEFLMEDSGGALSAPFVDISLRVIVCGNTLALNIKRHSDTREVFGRVCEELKLGTDAGHFCTLFEVIEDSFSRKLHHHERPQILIV

SEQ ID NO: 166806 - protein, 159 aa, Heterodera glycines
  Homolog annotation: Hit_ID=NP_494846.1; Match level="QueryCoverage =78%, HitCoverage=26%, E-value=1e-44, Identity=63%"; Hit description =protective protein for beta-galactosidase precursor (53.6 kD) (2F29) [Caenorhabditis elegans] gb|AAC46812
  Gene Ontology: Mol. function=carboxypeptidase C activity; Cellular component=endoplasmic reticulum; Biological process=vacuolar protein catabolism
  Coding regions on vcDNA: vcDNA=SeqID_93229; Strand=+; Position=1-477
IRPFLLFLPFLLFSPSAAFVDDPNLCLRLTSAAHDEIQELPGLSFRPNFKHYSGFLKTTSKNLFHYWFVTSENKPCFDPLLFWFNGGPGCSSLGGLLDELGPYLINADGKTLRKSPYPWNKNASIVYIESPAGVGFSHSVDGLPAPSSDDSAAAENYEA

SEQ ID NO: 166807 - protein, 39 aa, Heterodera glycines
  Coding regions on vcDNA: vcDNA=SeqID_93230; Strand=+; Position=2-118
IGVLRGADSVRLVEEFAEDGQFFTAVQQGGGNSREINRR

SEQ ID NO: 166808 - protein, 73 aa, Heterodera glycines
  Homolog annotation: Hit_ID=AAP30754.1; Match level="QueryCoverage =60%, HitCoverage=23%, E-value=4e-14, Identity=84%"; Hit description =putative gland protein G11A06 [Heterodera glycines]
  Coding regions on vcDNA: vcDNA=SeqID_93231; Strand=+; Position=26-244
MSSPSSAASLLAIVTIFCLLCKCCVSAPHECAHSLGFVRAMFVIAASASSHVSNNSEWQALSAQFGQQISEID

SEQ ID NO: 166809 - protein, 110 aa, Heterodera glycines
  Coding regions on vcDNA: vcDNA=SeqID_93232; Strand=+; Position=2-334
KIFGGTAGQLKDLGRKPKEDGGEKMKQEKGTTERTNLNGSKTKGAKMADDFLKVMGDRDAEMRFTYLPLKDKYDGTFARELQLGEFVVLEDDCPRTEPSLAHQIDVFCDF

SEQ ID NO: 166810 - protein, 43 aa, Heterodera glycines
  Coding regions on vcDNA: vcDNA=SeqID_93233; Strand=+; Position=121-249
AMLWNYTIKSSKYLSLIPSLLIYSFSVISPFGIAYILHDGLFS

SEQ ID NO: 166811 - protein, 132 aa, Heterodera glycines
  Homolog annotation: Hit_ID=CAE66027.1; Match level="QueryCoverage =95%, HitCoverage=28%, E-value=1e-15, Identity=35%"; Hit description =Hypothetical protein CBG11221 [Caenorhabditis briggsae]
  Coding regions on vcDNA: vcDNA=SeqID_93234; Strand=+; Position=1-396
AREFVDFVLNELNVTRLLAQLNGGFFGMDEHFWQSLSGSESLDAPGGFPHECFVKGNESFSKYKYITRFAKWSDSSPGKCLSVFWRHSVCVFGLEDLLGPGSEMDRLPHLFVNKLMPGFDFYAVLCWHQRMR

SEQ ID NO: 166812 - protein, 83 aa, Heterodera glycines
  Coding regions on vcDNA: vcDNA=SeqID_93235; Strand=-; Position=60-311
SLFVFPALSQHIPSPPFFCLLLIEIGAEKMPVPMRSVKWPIHLGIRLRCQSLRDAPCVPHAVVRRRLFAVWLFSAAVHNIYGL

SEQ ID NO: 166813 - protein, 120 aa, Heterodera glycines
  Coding regions on vcDNA: vcDNA=SeqID_93236; Strand=+; Position=1-360
RRIDQRESFGLKCAKCECAIEEPMVSQACLHRFCAFCARGANCCPFCGVSTHFKIDLNFALIISKVKARGKFFVKRRIVYVLYGDGANISSFGNGRLSRMSATQEKERERTAHPSSTRLV

SEQ ID NO: 166814 - protein, 78 aa, Heterodera glycines
  Coding regions on vcDNA: vcDNA=SeqID_93237; Strand=-; Position=3-236
VGLCQRPLSLIGRRRPAAVLPARAMEHQIGGYNLPSKRLRDVTVLFHDHLLLAGDCLGLRRDGLAVLMGQVRNGGYKS

SEQ ID NO: 166815 - protein, 94 aa, Heterodera glycines
  Homolog annotation: Hit_ID=NP_497833.1; Match level="QueryCoverage =59%, HitCoverage=33%, E-value=5e-10, Identity=53%"; Hit description =polypeptide 18kD (19.0 kD) (3F261) [Caenorhabditis elegans] emb|CAA86742.1| Hypothetical protein C16C10.4
  Coding regions on vcDNA: vcDNA=SeqID_93238; Strand=+; Position=2-286
RYAMHEVGMTISGQRSQDDDKTLSQCKFEVGDFIDVVISPPEAGGRGNGGPMGGSYGGLGRRMGGGDRGMGMERERVSSAVCSGGGRFSGGFMR

SEQ ID NO: 166816 - protein, 78 aa, Heterodera glycines
  Coding regions on vcDNA: vcDNA=SeqID_93239; Strand=-; Position=2-235
KQAQPLAECFGSAFVSVILILSFFFKFSQLKGSLLCVTPFLVLALGVDDAYLMLIAWQRLRIRRALAFLAQFAQILVH

SEQ ID NO: 166817 - protein, 108 aa, Heterodera glycines
  Coding regions on vcDNA: vcDNA=SeqID_93240; Strand=+; Position=1-324
DSINNNNGTNNAYAHNLSGNEPCHSDKDKAMSSSMSHPLTLSEFARTVNKNRSAYAQCQDESEPKQTKNRRGSLFQRIVQTVRSGVDSQGKGRRLLQGDGRCRTNTAT

SEQ ID NO: 166818 - protein, 196 aa, Heterodera glycines
  Homolog annotation: Hit_ID=XP_394169.1; Match level="QueryCoverage =98%, HitCoverage=30%, E-value=2e-17, Identity=32%"; Hit description =similar to helicase RM62-like protein E [Apis mellifera]
  Gene Ontology: Mol. function=RNA helicase activity; Cellular component=polar granule; Biological process=mRNA processing
  Coding regions on vcDNA: vcDNA=SeqID_93241; Strand=+; Position=2-589
DRDGCDVLVATPGRLEEFLLKNRIELDCLQFLVIDEMDKFFSDFEFLRLFHELNENNRQCKSTVWPFPTFLFSATSDSLDGDVPFLRPDFFRVIAGPVNQSVAHVRQRIISTNIFMRIHPLELILQREEINGACRKTVIFVNECRRCDRLAILLSYYGYKEISINGNRSLGQRTKAMAQFDDGTYDILVRTDVISR

SEQ ID NO: 166819 - protein, 155 aa, Heterodera glycines
  Coding regions on vcDNA: vcDNA=SeqID_93242; Strand=+; Position=1-468
PTAKSAVPTVGELFRAQLGHFYAQIGDIKFEDPPSSVNFYASICLLLVGHVLQGHRPTLLRRVGPAWLGRVREQLADWRAMDEADKAAQQQKQSHKNPQKRDEHVDDDDGMSAELRRRMAQSVEQQQLFRMNMFTFQLDEAERRVQEALDGSSEE

SEQ ID NO: 166820 - protein, 150 aa, Heterodera glycines
  Homolog annotation: Hit_ID=CAC21848.1; Match level="QueryCoverage =94%, HitCoverage=63%, E-value=6e-11, Identity=37%"; Hit description =hypothetical protein [Globodera rostochiensis]
  Coding regions on vcDNA: vcDNA=SeqID_93243; Strand=+; Position=1-453
VFAKHPISLDNSTDIFYFEITVLQKIGDSILGFAVKPARTWIEFTSSPIRTYAYENDGCLKATFVNGTFTFPQRINAKYSYGVCDTVGIGVICANRQIVFTKNGQRLDSSDFIVAPSFVGQLFPFVSLVHSGAEIEANFGPNFQFDLTTL

SEQ ID NO: 166821 - protein, 64 aa, Heterodera glycines
  Coding regions on vcDNA: vcDNA=SeqID_93244; Strand=-; Position=259-453
MAKVTLPRFCAKCCRQPPPAPPSPFRRTTDPVRAKDRGHQTTIGRRPQELLPRLVLQSLTKKDV

SEQ ID NO: 166822 - protein, 35 aa, Heterodera glycines
  Coding regions on vcDNA: vcDNA=SeqID_93245; Strand=-; Position=19-126
ACIRFLNRVFFSLESFNNLDVAFIFIYFNILLNVI

SEQ ID NO: 166823 - protein, 192 aa, Heterodera glycines
  Homolog annotation: Hit_ID=EAK83533.1; Match level="QueryCoverage =99%, HitCoverage=44%, E-value=5e-16, Identity=31%"; Hit description =hypothetical protein UM02495.1 [Ustilago maydis 521] ref|XP _400110.1| hypothetical protein UM02495.1 [Usti
  Coding regions on vcDNA: vcDNA=SeqID_93246; Strand=+; Position=2-577
MSSSAMQIDPNPRAFLASARQSAQAAGHAQVVDAINRFDELYDRKLWHQLSVEMDKFIALQQAQEYLTNFYFQFVRDFESKLNKLSLVAGVGQAVAKHLPDNTSRITYLLALADRVKPTPPKSGEEHLHVLDMESTSAHLLATTQAAYYQLLDGQYDTVLAHISASEKRLDALDGVDTRVSSAFYRVAADYY

SEQ ID NO: 166824 - protein, 22 aa, Heterodera glycines
  Coding regions on vcDNA: vcDNA=SeqID_93247; Strand=+; Position=32-100
MLFSLSQFRKQPFLRKTTFFGQ

SEQ ID NO: 166825 - protein, 182 aa, Heterodera glycines
  Homolog annotation: Hit_ID=CAE68398.1; Match level="QueryCoverage =82%, HitCoverage=86%, E-value=1e-11, Identity=32%"; Hit description =Hypothetical protein CBG14167 [Caenorhabditis briggsae]
  Coding regions on vcDNA: vcDNA=SeqID_93248; Strand=+; Position=7-555
MMLIKFALPLLFVLLHPFVCSAAEENAGAAEIPQQFYGAFKLDHSDNWDDYLIAKGYSDPEMRKKVELPRFTRILYRFPNGTYRMMVGTGLEGSKWVKGSKKNADWQFKPNEPFIGNYWDGSKHEITFTYDPKESRLTERHVKVDGTGTPEEFNYKIDQDNNLEFYVFFKDVKLVHHYHRTD

SEQ ID NO: 166826 - protein, 169 aa, Heterodera glycines
  misc_feature (76)..(76): Xaa can be any naturally occurring amino acid
  misc_feature (84)..(84): Xaa can be any naturally occurring amino acid
  misc_feature (101)..(101): Xaa can be any naturally occurring amino acid
  misc_feature (108)..(108): Xaa can be any naturally occurring amino acid
  misc_feature (123)..(123): Xaa can be any naturally occurring amino acid
  Homolog annotation: Hit_ID=AAL78227.1; Match level="QueryCoverage =86%, HitCoverage=59%, E-value=6e-43, Identity=61%"; Hit description =hypothetical protein Hgg-18 [Heterodera glycines]
  Coding regions on vcDNA: vcDNA=SeqID_93249; Strand=+; Position=89-592
HKQSQFRKKLRQPKPKRTKAKKRSRKRKKPKRKRKKRRRRSRKRKKQRKERAKRKKLRKMKPKRRSRKRRGQKGRXQSPVPRPXLTEAADNVNKAVDDLSXLNRQKHXKNAAEATAEKTPEEXGKSIERSGRKRRKRTAEDGCQQNFGGKSEKRRGIGKRSENENGNTF

SEQ ID NO: 166827 - protein, 40 aa, Heterodera glycines
  Coding regions on vcDNA: vcDNA=SeqID_93250; Strand=+; Position=1-123
TIMNHDQLQLVNREGWAKLAFYLVSFFIYLYGMIYTMVTT

SEQ ID NO: 166828 - protein, 88 aa, Heterodera glycines
  Coding regions on vcDNA: vcDNA=SeqID_93251; Strand=-; Position=38-304
TQSNLKIKAFLFFEFEYLCFRTNKNNQDTLIYFQIRLIGYLWKSQIKQQKIIILNDFYRIYFLEFFGKNFKYENNYFILCLLMIKNII

SEQ ID NO: 166829 - protein, 210 aa, Heterodera glycines
  Homolog annotation: Hit_ID=NP_506387.1; Match level="QueryCoverage =93%, HitCoverage=38%, E-value=2e-36, Identity=41%"; Hit description =i-43 protein (5O161) [Caenorhabditis elegans] emb|CAB03152.1| Hypothetical protein F58G11.6 [Caenorhabdit
  Coding regions on vcDNA: vcDNA=SeqID_93252; Strand=+; Position=2-631
MFSYSPLSAPFFSKSFSSPSTNEQRKIDLKFTDLCEYFFISHPFSGRKEGSEHRRVMYFHPAKESISKQIEFTGMSEAVVNFTDGFSKSDCESNISAQHDFDYRYVTSTNTKEVVLVVEGGEFLIGASFNKKNCTAKDYFLHLPTINSLLFNAYNAYKLHYGYFSYRFRAESNEFKEILDRFFTPFLHLNRVNKIPLVDLFNGGDFLSIG

SEQ ID NO: 166830 - protein, 154 aa, Heterodera glycines
  Homolog annotation: Hit_ID=CAE56653.1; Match level="QueryCoverage =83%, HitCoverage=65%, E-value=9e-09, Identity=31%"; Hit description =Hypothetical protein CBG24417 [Caenorhabditis briggsae]
  Coding regions on vcDNA: vcDNA=SeqID_93253; Strand=+; Position=31-492
MMDPKNDFYDENADVVTFKAEVSAEAPKGMPSVQSGHTLVVNGKTICVNKYILAAHSVFFRKLFFGKNAEKTPRIQLEGNAKAVPNFERLIATMAPMNLELDDGCVESVLLLAHRFQLDSVLNRCADFLLKKSKKTAICKFRLAHQCEMVAMKK

SEQ ID NO: 166831 - protein, 82 aa, Heterodera glycines
  misc_feature (32)..(32): Xaa can be any naturally occurring amino acid
  misc_feature (67)..(67): Xaa can be any naturally occurring amino acid
  Homolog annotation: Hit_ID=NP_492207.1; Match level="QueryCoverage =98%, HitCoverage=28%, E-value=1e-12, Identity=41%"; Hit description =cytochrome c1 (31.0 kD) (1I600) [Caenorhabditis elegans] emb|CAA99820.1| Hypothetical protein C54G4.8 [Ca
  Gene Ontology: Cellular component=mitochondrion; Biological process =positive regulation of embryonic development
  Coding regions on vcDNA: vcDNA=SeqID_93254; Strand=+; Position=2-247
THRGVMDAIDMRSVRRCYGGSEPLCAPCRSLXFFRDHHFANNFLTQHEANTDDADGLIPDLDDNGVXILRPGLFPYTLPGPY

SEQ ID NO: 166832 - protein, 197 aa, Heterodera glycines
  Homolog annotation: Hit_ID=NP_502512.1; Match level="QueryCoverage =74%, HitCoverage=58%, E-value=5e-22, Identity=33%"; Hit description =putative protein (28.1 kD) (4N847) [Caenorhabditis elegans] emb|CAA94333.2| Hypothetical protein C39E9.8a
  Coding regions on vcDNA: vcDNA=SeqID_93255; Strand=+; Position=25-615
MCYKNVLLFIVTTVAIFETSFGAENNATQPQKKQELTFEKTMEEMIISAKTGKFVRQCSCDEQEPCLKDILTDFQACFETCWEQKNSGKIAPKPEVLKQCFESRLGLVNQFISCINTTAKTCFPTKSGPQIEYVSVQRIVAAGEQRMAAQASGFERAMGPANKPVVQAAEELASCMKDCFLDKDAGQKCFGKSGCQP

SEQ ID NO: 166833 - protein, 206 aa, Heterodera glycines
  Homolog annotation: Hit_ID=NP_498308.1; Match level="QueryCoverage =100%, HitCoverage=21%, E-value=1e-101, Identity=83%"; Hit description=translation Elongation FacTor (110.5 kD) (eft-1) [Caenorhabditis elegans] gb|AAA91248.1| Elongation fac
  Gene Ontology: Mol. function=pre-mRNA splicing factor activity; Cellular component=snRNP U6; Biological process=signal transduction
  Coding regions on vcDNA: vcDNA=SeqID_93256; Strand=+; Position=3-620
DKELLKTVRESPIQGFQWATREGPLCEEPIRNVKFKMLDAQIAKEPLYRGGGQIIPTSRRCAYSAFLMATPRLMEPYYFVEVIAPADCVTAIYTVLSKRRGHVTTDAPIPGSPLYTIKAFIPVIDSFGFETDLRTHTQGQAFCMCVFSHWQIVPGDPLDKSIAIRPLELQPAPHLAREFMIKTRRRKGLSEDVSVNQFFDDPMLVE

SEQ ID NO: 166834 - protein, 207 aa, Heterodera glycines
  Coding regions on vcDNA: vcDNA=SeqID_93257; Strand=+; Position=1-621
GRNMCSKNDSSVRIDLKRCPCIHSLAQLVDVTLQSLLYQRQMIPEPASTLLHGCTPVADQFRDTYQKVQQILRGTFRSANGDGRIREFVILVGATPFSPKEIYRVRVPPTICRPSAADQQKSAEKAVPTSPESGRRMMAKALANEADDDDNDYRHKNGREEDGAENGGGRGGGTDLASAKCRCGGATVCDALNAKERRLVFSAVALS

SEQ ID NO: 166835 - protein, 168 aa, Heterodera glycines
  Coding regions on vcDNA: vcDNA=SeqID_93258; Strand=+; Position=27-533
MAPGSIPSCCLTSEQKDALIDAVRQRPVIWDCSLDAYQEVQNRRTAFVEVAELLSDEKSKYTGPEMQVEWKKLRDIFNRTLKKVVASGGSDAEVTWRYWTKLQFIADHERSHITRTRKWPKKEELSPPPVSSPSSSSSSSVARARKRMPKHRRWTELWTIRHFHWSNN

SEQ ID NO: 166836 - protein, 132 aa, Heterodera glycines
  Coding regions on vcDNA: vcDNA=SeqID_93259; Strand=+; Position=1-399
MNRRAAINNPEEARQRMTDVKSTSQILQEAIRILQQGIENETLPIVPPNQATMLEPFADRTVLLHTTLNGVKNFARLSHCFGNRTVMVAWKTLLNVFEKCEETLGESLYEVGPMDGTSKLNEIQVGLQKPIG

SEQ ID NO: 166837 - protein, 52 aa, Heterodera glycines
  Coding regions on vcDNA: vcDNA=SeqID_93260; Strand=+; Position=67-225
SSLTFFYLCFCPFHEPAIVDHGFSPMYVTSMTACIYIKFKVMQLIIYSHFPH

SEQ ID NO: 166838 - protein, 167 aa, Heterodera glycines
  Coding regions on vcDNA: vcDNA=SeqID_93261; Strand=-; Position=2-502
MVIVCYSIIIWLPIVRTDWPIVRIGWSFVRPIPILSPSVVCCCCCSLPLRLHLFHQRLQVFVLVAVLVNLHVRVHEQTFEPFVHHYVAQQCVLFRFCHSSSHGSAMVSRNCVFCRCCWCRQRWLFSCFTSKSAVLIVGTGFAVNIHCVRRHRRRFVDGQFGLQTGGQ

SEQ ID NO: 166839 - protein, 92 aa, Heterodera glycines
  misc_feature (22)..(22): Xaa can be any naturally occurring amino acid
  misc_feature (57)..(57): Xaa can be any naturally occurring amino acid
  misc_feature (73)..(73): Xaa can be any naturally occurring amino acid
  misc_feature (76)..(76): Xaa can be any naturally occurring amino acid
  Homolog annotation: Hit_ID=CAE66975.1; Match level="QueryCoverage =100%, HitCoverage=17%, E-value=4e-19, Identity=50%"; Hit description= Hypothetical protein CBG12371 [Caenorhabditis briggsae]
  Gene Ontology: Mol. function=tRNA dihydrouridine synthase activity; Biological process=tRNA modification
  Coding regions on vcDNA: vcDNA=SeqID_93262; Strand=+; Position=2-277
PMVDHSDLAFGMMLRKHSPRLXYPPKIHCHLFGTDPAYRKANFTTLDTDRPLIVQFXANDPQTLLIARRLVEXIVXGVDLSLTCPQLIALQG

SEQ ID NO: 166840 - protein, 134 aa, Heterodera glycines
  misc_feature (133)..(133): Xaa can be any naturally occurring amino acid
  Coding regions on vcDNA: vcDNA=SeqID_93263; Strand=+; Position=1-402
PSFNASCSASSLFPPTLVTTNTTGGNNNNNRPSTSASTSPTSSCSSPLVLLNNSNNTGGAAGGCLLSAGGGPLHYQQQQHQNQQYHQQQHYFPPSLMLNANTFSGSGGGNTGGGVGGGGCGCCGCTGGGGGVXG

SEQ ID NO: 166841 - protein, 21 aa, Heterodera glycines
  Coding regions on vcDNA: vcDNA=SeqID_93264; Strand=-; Position=2-64
ALSVPDLLLRIFLNITIILKI

SEQ ID NO: 166842 - protein, 41 aa, Heterodera glycines
  Coding regions on vcDNA: vcDNA=SeqID_93265; Strand=+; Position=1-126
LQIHPDQSNDGLIRRIRTAWTPSEQFLISCFISTFLPFRNL

SEQ ID NO: 166843 - protein, 79 aa, Heterodera glycines
  misc_feature (20)..(20): Xaa can be any naturally occurring amino acid
  Homolog annotation: Hit_ID=NP_492859.1; Match level="QueryCoverage =100%, HitCoverage=45%, E-value=9e-14, Identity=39%"; Hit description= putative protein family member (18.8 kD) (1L625) [Caenorhabditis elegans] emb|CAB63390.1| Hypothetical p
  Coding regions on vcDNA: vcDNA=SeqID_93266; Strand=+; Position=2-238
TQTSVEVDCPSRKNRMNNCXVDHDDCYSKQWGQTNCDNVFCDCLERATKRSSRCETYDGPRLCHLVHTYGASDYRASVP

SEQ ID NO: 166844 - protein, 188 aa, Heterodera glycines
  Coding regions on vcDNA: vcDNA=SeqID_93267; Strand=+; Position=3-566
SLPYGDSPLLKSPAISPSKSADDIASLQKQFHLPNRRLDGASIFGSLKSDKTPPAKQLDVTKNSTADLNASFLDQSLTYKPLVLLPSVGFGAALGLHQSPKLKSNRSDSMLRSIASEDEKNVKSLDISVVYESVQQSRLNEIDDSHLSSDIQNPPSRLEFQRTPEKSTRSEPSATSAEISTHNQSPLS

SEQ ID NO: 166845 - protein, 161 aa, Heterodera glycines
  Coding regions on vcDNA: vcDNA=SeqID_93268; Strand=+; Position=2-484
ALSSAIFLLSVAKISDEDSEDSNEAGSADNQLATEIVAEFLAKFGTLAASTADVGAYMERVSLSAHVFLKLAFPIGSIIASSLQISTKKQSDEYKALVNLRDSMQKNHESIMKAISFAQEMIGMESKLDDYTNNVRIPIKNLFVHMRKFWDPSTDKSPEAV

SEQ ID NO: 166846 - protein, 130 aa, Heterodera glycines
  Coding regions on vcDNA: vcDNA=SeqID_93269; Strand=+; Position=154-543
LLFSFLFLANFSATVVQNLKRFWVRSIVSVPIPSCSMRSSFGVWNKEMPTVPPPTDTFKKETFELFNPGSAAQLISEISALPSEGRPRNFFPQQPTPQPQPNPTFFRATEPTPFVVATTPSFFRPNQQFQ

SEQ ID NO: 166847 - protein, 50 aa, Heterodera glycines
  Coding regions on vcDNA: vcDNA=SeqID_93270; Strand=+; Position=2-154
GYGGRDGYEQSGYGGYAQRGYGEKDGYEKSGYGGKDGYQNEYHDYYKNNR

SEQ ID NO: 166848 - protein, 106 aa, Heterodera glycines
  Homolog annotation: Hit_ID=AAH87561.1; Match level="QueryCoverage =98%, HitCoverage=57%, E-value=8e-13, Identity=35%"; Hit description =Unknown (protein for MGC:97698) [Xenopus tropicalis]
  Coding regions on vcDNA: vcDNA=SeqID_93271; Strand=+; Position=2-322
TQLIFRTANSILMTDCILHGDLANILMGQYCLFGKGSIIRPPYKYFNLSFADLPVHCGDYIFIDRGCGDRAPYFCALAAMGHNTIDVHNWGVKDSSCIPTDKVLMR

SEQ ID NO: 166849 - protein, 134 aa, Heterodera glycines
  misc_feature (128)..(128): Xaa can be any naturally occurring amino acid
  Coding regions on vcDNA: vcDNA=SeqID_93272; Strand=+; Position=2-403
PRRSDHFAASVDKCSDHSVPSSALSRGVETNPSAVRPANSAAALFQLPAEYDNGQPKRIRQHRTNDHRRLGYFWRSGQLRRHSASFIVTRKRYALPEIRTKVPSFVHIISLICKYVYSFHRKKQVYFXKKKKKK

SEQ ID NO: 166850 - protein, 77 aa, Heterodera glycines
  misc_feature (36)..(36): Xaa can be any naturally occurring amino acid
  misc_feature (39)..(39): Xaa can be any naturally occurring amino acid
  Homolog annotation: Hit_ID=CAE59244.1; Match level="QueryCoverage =100%, HitCoverage=7%, E-value=5e-15, Identity=50%"; Hit description =Hypothetical protein CBG02570 [Caenorhabditis briggsae]
  Gene Ontology: Mol. function=electron transporter activity; Biological process=glycine catabolism
  Coding regions on vcDNA: vcDNA=SeqID_93273; Strand=+; Position=2-235
DVSLFDLDKTFCITHGEREARHGPYGSRRYLGPILXGHXLMPIKGNPSGAVAASPWGSSTILTITCESIRLMGAVGL

SEQ ID NO: 166851 - protein, 185 aa, Heterodera glycines
  Homolog annotation: Hit_ID=NP_509790.1; Match level="QueryCoverage =87%, HitCoverage=51%, E-value=2e-21, Identity=37%"; Hit description =phosphatidic acid phosphatase (XL315) [Caenorhabditis elegans] pir||H89632 protein F13E6.5 [imported] - C
  Gene Ontology: Mol. function=phosphatidate phosphatase activity; Cellular component=integral to membrane
  Coding regions on vcDNA: vcDNA=SeqID_93274; Strand=+; Position=71-625
MLQYVPWRQITFTGRLFDVGEGRATTLLFLLKCLIYMALDIVIWVALTFVSYKLLVWTFFTPFERGFYCNDQSIREPLVPNTVSTSLLIAITLGTPFFFIFLADLMRTTRPRRRNITQVINRSTLEYLNYCIAFWLMTLAIDAFKCLIGRIRPNFLSMCKPREWSEVCTVTPDAYVKLAHCTVGW

SEQ ID NO: 166852 - protein, 180 aa, Heterodera glycines
  Homolog annotation: Hit_ID=EAA50666.1; Match level="QueryCoverage =93%, HitCoverage=31%, E-value=1e-30, Identity=46%"; Hit description =hypothetical protein MG04425.4 [Magnaporthe grisea 70-15] ref|XP _361980.1| hypothetical protein MG04425.4
  Gene Ontology: Mol. function=phenylalanine-tRNA ligase activity; Cellular component=cytoplasm; Biological process=tRNA modification
  Coding regions on vcDNA: vcDNA=SeqID_93275; Strand=+; Position=87-626
MPSPSAAFSVEDLSLHVLAVLNASPTGALESTATLTYPGTSTVIDSTALHGILLSLESKEMVTFTAVEHDRWTLTAEGAEIAASGSHEAKVFAAVPAGDEGISIAELSAKVGDAVAKIGQGKAFKNKWIGKAKSGNLVKLVKSIQDTTQEELKVVQETAGHKDPKVLVELKKRKLCDKEK

SEQ ID NO: 166853 - protein, 86 aa, Heterodera glycines
  misc_feature (26)..(26): Xaa can be any naturally occurring amino acid
  misc_feature (42)..(42): Xaa can be any naturally occurring amino acid
  misc_feature (51)..(51): Xaa can be any naturally occurring amino acid
  Homolog annotation: Hit_ID=CAE57999.1; Match level="QueryCoverage =100%, HitCoverage=29%, E-value=4e-20, Identity=60%"; Hit description= Hypothetical protein CBG01062 [Caenorhabditis briggsae]
  Coding regions on vcDNA: vcDNA=SeqID_93276; Strand=+; Position=2-259
LMVPLKHFSVEDEINPWMKRGTVVDXRKAMDQWTQLKKAIEXGGESTMLTXDQGSGLPDMVFSCNSGLFYRNELYLSHFRRAQRLG

SEQ ID NO: 166854 - protein, 143 aa, Heterodera glycines
  Homolog annotation: Hit_ID=NP_611208.1; Match level="QueryCoverage =100%, HitCoverage=49%, E-value=6e-40, Identity=55%"; Hit description= CG4802-PA [Drosophila melanogaster] gb|AAF57869.1| CG4802-PA [Drosophila melanogaster] gb|AAO49165.1| GM
  Gene Ontology: Mol. function=5'-methylthioadenosine phosphorylase activity; Biological process=phosphorylation
  Coding regions on vcDNA: vcDNA=SeqID_93277; Strand=+; Position=2-430
GTGLKDPHIMERSGEVRVQTPYGRPSDALIEGNVAGVPGVLLSRHGRRHHDAPTDINYRANIWALKNAGVNDIAAACACGSLQEELEPGELKLIDSLIDRTTKREQTFYDGLPGHPPGICHMPMHAALDERLRRALLATATRL

SEQ ID NO: 166855 - protein, 129 aa, Heterodera glycines
  Coding regions on vcDNA: vcDNA=SeqID_93278; Strand=-; Position=203-592
ATKRYFSGTYPADGLPRCSKFPCSLIVNLVRLIFASFAHRISIQDPAGMPGTHWCAIWAQSPAVAYFFDSYGEMPIRLIKKYLSDNFKNIYYNKTRFQSVLSNVCGHYVITFVYFMSIRDWVSKMLCKF

SEQ ID NO: 166856 - protein, 126 aa, Heterodera glycines
  Coding regions on vcDNA: vcDNA=SeqID_93279; Strand=+; Position=1-381
CKSSVTTLIKRIKQIPMGLPGPPVDGVPQSAARFYSENAYIELSCFINNQPNLPRATDFNELGLNSNAENYVPTLLQRINAMVLNCTKSPEATAEVLGQLGIFLSVKNEGVNRSFKIRSSSAAGGE

SEQ ID NO: 166857 - protein, 93 aa, Heterodera glycines
  misc_feature (77)..(77): Xaa can be any naturally occurring amino acid
  misc_feature (82)..(82): Xaa can be any naturally occurring amino acid
  misc_feature (85)..(85): Xaa can be any naturally occurring amino acid
  Homolog annotation: Hit_ID=NP_506019.2; Match level="QueryCoverage =96%, HitCoverage=15%, E-value=9e-14, Identity=41%"; Hit description =aspartyl(D) tRNA Synthetase (drs-2C) [Caenorhabditis elegans] emb|CAB04081.2| Hypothetical protein F10C2.
  Gene Ontology: Mol. function=diacylglycerol O-acyltransferase activity; Biological process=regulation of nurse cell apoptosis
  Coding regions on vcDNA: vcDNA=SeqID_93280; Strand=+; Position=2-280
SFSLRTHNCGELRLSDVGSRAKLFGWMAAKRMNKFVLLRDSYGSVQTVFSFALFSSLKNTNFLSALCLEGVVADRGXEGNDXMPXGDIQVAGD

SEQ ID NO: 166858 - protein, 139 aa, Heterodera glycines
  misc_feature (64)..(64): Xaa can be any naturally occurring amino acid
  Homolog annotation: Hit_ID=EAA69730.1; Match level="QueryCoverage =100%, HitCoverage=69%, E-value=4e-56, Identity=77%"; Hit description= RL16_NEUCR 60S ribosomal protein L16 [Gibberella zeae PH-1] ref|XP _382275.1| RL16_NEUCR 60S ribosomal pro
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_93281; Strand=+; Position=42-457
MSSFDKVVVIDGKGHLLGRLASIVAKQALNGQKIVIVRCEELNIAGPFFRNKLRYHAHLPSVAXVNPARGAFHFRAPSRIFYKALRGMIPHKTARGAAALARVKVFEGVPAPWDRVKRMVVPAALRVLRLKPGRKFTRV

SEQ ID NO: 166859 - protein, 89 aa, Heterodera glycines
  misc_feature (36)..(36): Xaa can be any naturally occurring amino acid
  Coding regions on vcDNA: vcDNA=SeqID_93282; Strand=+; Position=2-271
PYTTRRMPEISPGQTLNIHGNVNANAHRYKANLLSXCNQMEAHMGSATLHVTGPIFLGKGALNSFAAGEWGKEERRSRAVAAGQPFNPR

SEQ ID NO: 166860 - protein, 139 aa, Heterodera glycines
  misc_feature (72)..(72): Xaa can be any naturally occurring amino acid
  Homolog annotation: Hit_ID=NP_742065.1; Match level="QueryCoverage =100%, HitCoverage=46%, E-value=3e-12, Identity=34%"; Hit description= Surfeit 1 [Rattus norvegicus] gb|AAF19608.1| Surfeit 1 [Rattus norvegicus] sp|Q9QXU2|SUR1_RAT Surfeit lo
  Gene Ontology: Mol. function=cytochrome c oxidase activity; Cellular component=mitochondrial electron transport chain; Biological process= electron transport
  Coding regions on vcDNA: vcDNA=SeqID_93283; Strand=+; Position=53-469
VHVRGYYLFDRQFVIRWRCRLDPANTGTSNSEKYGAYVITPMRLEGTNVTIMVNRGWVPNENVESELKKGLXMRESKLKDLNAVVRTAEKGSPFVEDDPEEGISAFEDLEKVARQSDARPIIGGMPITNPTDKESPIEG

SEQ ID NO: 166861 - protein, 38 aa, Heterodera glycines
  Coding regions on vcDNA: vcDNA=SeqID_93284; Strand=-; Position=0-113
FILISLLFNINYYFKNKICIWMTDRMTLAVPLRSCRPG

SEQ ID NO: 166862 - protein, 115 aa, Heterodera glycines
  misc_feature (72)..(72): Xaa can be any naturally occurring amino acid
  misc_feature (92)..(92): Xaa can be any naturally occurring amino acid
  misc_feature (98)..(98): Xaa can be any naturally occurring amino acid
  Homolog annotation: Hit_ID=NP_998184.1; Match level="QueryCoverage =93%, HitCoverage=49%, E-value=2e-34, Identity=66%"; Hit description =zgc:73214 [Danio rerio] gb|AAH71458.1| Zgc:73214 [Danio rerio] gb|AAH59560.1| Zgc:73214 protein [Danio re
  Gene Ontology: Mol. function=cyclosporin A binding; Cellular component=cytoplasm; Biological process=signal transduction
  Coding regions on vcDNA: vcDNA=SeqID_93285; Strand=+; Position=1-345
RLVASKKGRIVIGLFGEVVPKTAKNFLELAKGTHGYGYKDSKFHRVIRNFMIQGGDFMRGDGTGGKTIFEGXSSHDHNFKLHHYGAGWLNMXNTVPDXNGSQFLINHTNTARLDA

SEQ ID NO: 166863 - protein, 194 aa, Heterodera glycines
  Homolog annotation: Hit_ID=CAB88203.1; Match level="QueryCoverage =100%, HitCoverage=63%, E-value=5e-48, Identity=53%"; Hit description= putative cuticular collagen [Globodera pallida]
  Coding regions on vcDNA: vcDNA=SeqID_93286; Strand=+; Position=3-584
LAIIATVVTLPSLYSEMSQMNSKVRDGVEAFRVNTDSAWTDLMDVQVVVTPPSKPRDNPFNSIFRAFFQLPGHCQCAGLQLPSCPPGPAGPSGPPGQAGQPGGGGRGGEGWGRRGRRRSSVAAPEGGRAKETMLALHGAPEGQRERRTEEEEPRPGRGTADPGRRKHGGSVATEGGRPEERGAGRACGEAGREG

SEQ ID NO: 166864 - protein, 109 aa, Heterodera glycines
  Coding regions on vcDNA: vcDNA=SeqID_93287; Strand=+; Position=263-592
LRHVAKSVWAQQFRHVLRPGRRPSADGVHKHGGVPKNCTLEHVLREGTLPGTPIGPCAHSTSHGNGWGQTHFRVRRCWNVRQRGRGTPPGPFPEPELSPNGGPNADRAI

SEQ ID NO: 166865 - protein, 59 aa, Heterodera glycines
  Coding regions on vcDNA: vcDNA=SeqID_93288; Strand=-; Position=1-177
FFFFLHNFAFYLQFLFNGIKSLLSNHFIKMHQCLCQQILRGCCGSVWRRSQIIARIVSN

SEQ ID NO: 166866 - protein, 120 aa, Heterodera glycines
  misc_feature (82)..(82): Xaa can be any naturally occurring amino acid
  misc_feature (111)..(111): Xaa can be any naturally occurring amino acid
  Homolog annotation: Hit_ID=NP_958918.1; Match level="QueryCoverage =92%, HitCoverage=27%, E-value=1e-46, Identity=82%"; Hit description =eukaryotic translation initiation factor 4A, isoform 1B [Danio rerio] gb|AAH49427.1| Eukaryotic translati
  Gene Ontology: Mol. function=helicase activity; Cellular component =eukaryotic translation initiation factor 4 complex; Biological process=regulation of translational initiation
  Coding regions on vcDNA: vcDNA=SeqID_93289; Strand=+; Position=1-361
QYNDIQATEIESNWDEVVDSFDDMNLRQELLRGIYAYGFERPSAIQARAIMPVIKGHDVIAQAQSGTGKTATFAISILQKIXLQLKQTQALILAPTRELAQQIQKVVLALXDVMGIDCHA

SEQ ID NO: 166867 - protein, 80 aa, Heterodera glycines
  Coding regions on vcDNA: vcDNA=SeqID_93290; Strand=-; Position=2-241
LSGQRKFTQPPSSNGCAEEIFGELPSLAMHLPLPPAGKKMQRERPIKREGTKPKVNCWESMVKDGGFFDLGLADLHHLYF

SEQ ID NO: 166868 - protein, 120 aa, Heterodera glycines
  Coding regions on vcDNA: vcDNA=SeqID_93291; Strand=-; Position=2-361
NSKCLISNVILLQRIYNPSTQIDHYYCHRISLSRFRLFDIPQKKMLLFRLPQLFLQRVVLLRVFLQQLPFATFCRFVEGTRWLKCLKNNDCSNNHPSEENCTFSQNECDTVGTTILLNGL

SEQ ID NO: 166869 - protein, 155 aa, Heterodera glycines
  Homolog annotation: Hit_ID=EAL49477.1; Match level="QueryCoverage =92%, HitCoverage=18%, E-value=1e-10, Identity=29%"; Hit description =hypothetical protein 42.t00003 [Entamoeba histolytica HM-1:IMSS]
  Coding regions on vcDNA: vcDNA=SeqID_93292; Strand=+; Position=19-483
MSRNFAALLRVTCDRKMARRANKQLKRVCKKAHAQHKNIETVIQQQFDDQAKLEKRREKRRRQRKRKRMEQQEKEGDYKKEGNGREEEEQTEDEADPFDDENYTVKQFEEEAERMRKKRMGTELDEDEREITHLEAKLRKKGRKKGKKELEEDGD

SEQ ID NO: 166870 - protein, 71 aa, Heterodera glycines
  misc_feature (60)..(60): Xaa can be any naturally occurring amino acid
  Coding regions on vcDNA: vcDNA=SeqID_93293; Strand=+; Position=1-213
RSCVRLTKDELRYAVYRLIGSNERLRADTERMERTNALLFQIYARLSAGPPNLEPQNLLXFGANQPNLPVA

SEQ ID NO: 166871 - protein, 141 aa, Heterodera glycines
  Coding regions on vcDNA: vcDNA=SeqID_93294; Strand=+; Position=2-427
AVQQMEELRTKNTKATRAHFADTNALRSKIQELEHSLKIAMNELSARSTQANVQQQNDMERSFRSGMNRTQSMSVTFVSRPGSAMSHQETLSNLDSAGMNDDERLKELRERNRRYPPHMRSYYLPESAHLKNSETDLNVMP

SEQ ID NO: 166872 - protein, 69 aa, Heterodera glycines
  Coding regions on vcDNA: vcDNA=SeqID_93295; Strand=-; Position=2-208
KYKFVSLCFFRVKNNFIFKSKQFQLKSFITTFRKSSTFARLNPFALSANLNKKPIRSLFWTSSDTKLTV

SEQ ID NO: 166873 - protein, 59 aa, Heterodera glycines
  Coding regions on vcDNA: vcDNA=SeqID_93296; Strand=-; Position=0-176
ESSAGADELANCAVNRKTSRTVKRMAEEEQKERKIGIFLHWHPLRGAGANRCFVSFRFV

SEQ ID NO: 166874 - protein, 134 aa, Heterodera glycines
  Homolog annotation: Hit_ID=NP_872154.1; Match level="QueryCoverage =100%, HitCoverage=72%, E-value=2e-41, Identity=64%"; Hit description= lactate/malate dehydrogenase (5G996) [Caenorhabditis elegans] gb|AAO12428.1| Hypothetical protein F46E10
  Gene Ontology: Mol. function=malic enzyme activity; Cellular component=cytosol
  Coding regions on vcDNA: vcDNA=SeqID_93297; Strand=+; Position=1-402
NVIIWGNHSSTLFPDIRHAKIAKGGSETLAYDAVKDTAWIQDQFIKTVQKRGAVIIEKRKLSSAMSASKAACDHMRDWFFVTPSDGRWVSMAVFFYGSHGIPEGLVFSFPRTIDAQKKWRVGEGLYLDDFAKGR

SEQ ID NO: 166875 - protein, 34 aa, Heterodera glycines
  Coding regions on vcDNA: vcDNA=SeqID_93298; Strand=-; Position=2-103
TLKFRLFFDHSGSGLMPAARINCSGTRFNSSRDS

SEQ ID NO: 166876 - protein, 96 aa, Heterodera glycines
  Homolog annotation: Hit_ID=AAQ06662.1; Match level="QueryCoverage =93%, HitCoverage=13%, E-value=2e-34, Identity=74%"; Hit description =acetylcholinesterase [Meloidogyne incognita]
  Gene Ontology: Mol. function=acetylcholinesterase activity; Cellular component=cell; Biological process=synaptic transmission, cholinergic
  Coding regions on vcDNA: vcDNA=SeqID_93299; Strand=+; Position=106-393
MLIFLIGKKSRYVFGMPFRHPQAYDQKELDMVQAFSAKIMDFWGRFARTGEPIEFWPKYNRITRKSLVLSDEIARGNSHRIYVDVHGKLCRLLEEA

SEQ ID NO: 166877 - protein, 115 aa, Heterodera glycines
  Coding regions on vcDNA: vcDNA=SeqID_93300; Strand=+; Position=1-348
VVHWKNGHSSSSEDGKTQESSESCKFRKAITAFMPSKSAPTNLDRQTAAAEGAWAYHILCAMRKALNRPIVSQICCQKFFLIQKLRQITDQNKINAQQLLQEYLLRILSPLRCTK

SEQ ID NO: 166878 - protein, 146 aa, Heterodera glycines
  Homolog annotation: Hit_ID=NP_989598.1; Match level="QueryCoverage =97%, HitCoverage=93%, E-value=2e-23, Identity=39%"; Hit description =lipopolysaccharide-induced TNF factor [Gallus gallus] gb|AAU95774.1| TNF-alpha factor [Gallus gallus] dbj
  Gene Ontology: Mol. function=protein binding
  Coding regions on vcDNA: vcDNA=SeqID_93301; Strand=+; Position=47-487
MSQQPNAPPPYDDAQKYPAYPNPNVPTEQGAAYQPNMNNPQHAPPQPSPGAAPAGNTTTTYVYMADGGQPHWGPRPQNVFCSNCRQQVLTKVKYSAGLLTWLLFGGCLLFGCWLGCCLLPFCMDDCQDCEHYCTNCKAYMGQYKRL

SEQ ID NO: 166879 - protein, 207 aa, Heterodera glycines
  Homolog annotation: Hit_ID=CAE60517.1; Match level="QueryCoverage =86%, HitCoverage=36%, E-value=1e-33, Identity=40%"; Hit description =Hypothetical protein CBG04136 [Caenorhabditis briggsae]
  Gene Ontology: Mol. function=protein degradation tagging activity; Biological process=endocytosis
  Coding regions on vcDNA: vcDNA=SeqID_93302; Strand=+; Position=21-644
MIGGEDLFTNSDEELDEQKSPETKECEQSRLVISPASDSFSTAAEFSNNEPSHNQFPEAPLTPSSSQSPHQHLDKLSSILIDGSIQIFIRAYEKRGEGINAYIVYKIETMASKIPGYIKNRFEVWRRFSDFLGLRAKLAEKYQQLGVIVPYAPEKSITSLTKTKLNAGEEHSDLANKRSRLLERFLRRLAAHPRLGSDCEVRDFLLL

SEQ ID NO: 166880 - protein, 94 aa, Heterodera glycines
  Homolog annotation: Hit_ID=NP_498388.1; Match level="QueryCoverage =100%, HitCoverage=29%, E-value=6e-11, Identity=37%"; Hit description= putative protein, with a coiled coil-4 domain, of bilaterial origin (3H435) [Caenorhabditis elegans] gb|
  Coding regions on vcDNA: vcDNA=SeqID_93303; Strand=+; Position=2-283
YLSKHASEFMDGPLIHKAYIIPFTFDIKQASFGAIKKGNYVGMALPIRKYINWKSVFLFLPWVVQIKLLEEVQTNGGDWEHALKNLVPERGLEN

SEQ ID NO: 166881 - protein, 89 aa, Heterodera glycines
  misc_feature (58)..(58): Xaa can be any naturally occurring amino acid
  Homolog annotation: Hit_ID=CAE66541.1; Match level="QueryCoverage =100%, HitCoverage=9%, E-value=1e-33, Identity=84%"; Hit description =Hypothetical protein CBG11848 [Caenorhabditis briggsae]
  Gene Ontology: Mol. function=protein binding; Cellular component =synaptic vesicle; Biological process=synaptic vesicle docking
  Coding regions on vcDNA: vcDNA=SeqID_93304; Strand=+; Position=1-268
QMSSDGRPSKSSRMAQAQEAVARVKAPDGELQPSTEIDLFISTEKIMVLNTDLQRISXIYVRQDILMDHSLRSISYIADIGDLVVLMAR

SEQ ID NO: 166882 - protein, 54 aa, Heterodera glycines
  Coding regions on vcDNA: vcDNA=SeqID_93305; Strand=+; Position=75-236
MPQVINLKNLPPDELSIYNKLYPCKVALLTLKKGQSFSLPELADISDKVSSLAE

SEQ ID NO: 166883 - protein, 83 aa, Heterodera glycines
  Coding regions on vcDNA: vcDNA=SeqID_93306; Strand=+; Position=231-482
GRRQYYIDSSKTRKRSPRTRVGFCQESVIELAERRLAPSTNRRIAWLRTEILTEWRSNALLLLAVRVLTLWSNLCSVAMFSML

SEQ ID NO: 166884 - protein, 126 aa, Heterodera glycines
  Coding regions on vcDNA: vcDNA=SeqID_93307; Strand=-; Position=2-379
PSGGMAMSNALTSLSRDRFCSSNSLKNDSSNYFSFLTCSCSSWAKNSSYSLQMMPFSSVSTIRICSNRRSNHCRAWAIPSRISGCSPFSNECLSNSNGKRKICARLLIITVSFCKLNADPLPRAEE

SEQ ID NO: 166885 - protein, 66 aa, Heterodera glycines
  Coding regions on vcDNA: vcDNA=SeqID_93308; Strand=-; Position=1-198
PPPIPPPYGEPYIPRLARRAAGSLSTLSSCAVISAEKAHKTTKRKAMIKRRGDIINRRCSSNLLLV

SEQ ID NO: 166886 - protein, 107 aa, Heterodera glycines
  Homolog annotation: Hit_ID=Q27666; Match level="QueryCoverage=100%, HitCoverage=67%, E-value=6e-27, Identity=53%"; Hit description =Superoxide dismutase [Cu-Zn] emb|CAA93447.1| cytoplasmic superoxide dismutase [Haemonchus contortus]
  Gene Ontology: Mol. function=copper, zinc superoxide dismutase activity; Cellular component=cytoplasm; Biological process =neurogenesis
  Coding regions on vcDNA: vcDNA=SeqID_93309; Strand=+; Position=2-322
TQDNEGSPVTVQGEISGLEPGLHGFHVHAYGDLSNRCTSPGPHFNPTNFFLGGPQDQILHVGDLRNVHAGSDGIAKLTFSDHLITAVRAEHLVRHPLVLAQSQEHLG

SEQ ID NO: 166887 - protein, 100 aa, Heterodera glycines
  Homolog annotation: Hit_ID=NP_493463.1; Match level="QueryCoverage =97%, HitCoverage=13%, E-value=2e-09, Identity=33%"; Hit description =DNaJ domain (prokaryotic heat shock protein) (86.5 kD) (dnj-29) [Caenorhabditis elegans] emb|CAA21710.2|
  Coding regions on vcDNA: vcDNA=SeqID_93310; Strand=+; Position=3-305
NSNNSRIAEADNGSSFDMDTDGARQWDENEDDDMDDDELIRRQDMLLDTEPVNHHEVHCPYFPGDKFEWWYLFLLERKTRRLVTMVQPCKTLDQEKTHLR

SEQ ID NO: 166888 - protein, 94 aa, Heterodera glycines
  Homolog annotation: Hit_ID=CAE67518.1; Match level="QueryCoverage =89%, HitCoverage=38%, E-value=1e-28, Identity=66%"; Hit description =Hypothetical protein CBG13037 [Caenorhabditis briggsae]
  Coding regions on vcDNA: vcDNA=SeqID_93311; Strand=+; Position=78-362
MTTGGANEPRFHVLAQLEHLQSKYTGTGHADSSRWDWITNQHRDTFASIIGHPDHLSMMAICENETRARTKYNMLCRMVQPCGPPPEKSALDDL

SEQ ID NO: 166889 - protein, 180 aa, Heterodera glycines
  Homolog annotation: Hit_ID=NP_499328.1; Match level="QueryCoverage =96%, HitCoverage=80%, E-value=5e-68, Identity=69%"; Hit description =RAB family member (rab-30) [Caenorhabditis elegans] emb|CAA21489.1| Hypothetical protein Y45F3A.2 [Caenor
  Gene Ontology: Mol. function=RAB small monomeric GTPase activity; Cellular component=endoplasmic reticulum membrane; Biological process=ER to Golgi transport
  Coding regions on vcDNA: vcDNA=SeqID_93312; Strand=+; Position=7-546
MDDYAYLFKVVLVGNAGVGKTCLVKKFTQGIFPPGQNATIGVDFMVKNVKVDGEKVKLQIWDTAGQERFRSITQSYYRSAHAIVLVYDLSSQPTFDCISEWLLEIEQYANKRALRMLVGNKLDREEEREIPTDVAQSFASANAFHFFVETSAANDANVNILFQEVAEQLVSNEKKQNANG

SEQ ID NO: 166890 - protein, 109 aa, Heterodera glycines
  Coding regions on vcDNA: vcDNA=SeqID_93313; Strand=-; Position=1-327
KRKQSKQQKNVLSFNLAHFRFVVFLLLVFASSLFAFCFLRPPPSLPHHFFLQLLLRLFAKVGAHQLAQSHSGVGAGRQIETDFQCPPPFAVLLLLLSVMALLLKWRNEF

SEQ ID NO: 166891 - protein, 128 aa, Heterodera glycines
  Coding regions on vcDNA: vcDNA=SeqID_93314; Strand=+; Position=3-386
PCHLCSLLVAISLFWFLSLLAISPPLTMALSLFPRQNVPKMLHSPFLQQHDNNNNNNVRGPLGYSDQLELLAHSGRMAKKCRHDCSISDPTAEKCWNETLAFYEQTLFGVLRRVILVETNRILWMTGQ

SEQ ID NO: 166892 - protein, 193 aa, Heterodera glycines
  Coding regions on vcDNA: vcDNA=SeqID_93315; Strand=+; Position=3-581
QLNTLSQQKQVTLNVQVPKTPTRLFSLHTLPMTFVGTENVQNARPQQRSAFLHFGEQCKAVQNQQLLSMAMAFDKHSDTEQSLLQLPFHVRGILHRPRRMDKLKEWVKVLLSTENHFQLSLVSTSSLSPHEIAFSIGWDLSRPQPTISEALSHIGFKEWPKAFTSTASDIERKDNENEETEEDDGQWGTEATA

SEQ ID NO: 166893 - protein, 107 aa, Heterodera glycines
  misc_feature (17)..(17): Xaa can be any naturally occurring amino acid
  Coding regions on vcDNA: vcDNA=SeqID_93316; Strand=+; Position=1-321
KSQNLCGGTALKMAADXKKTSKSWAQNSTNCSCSLLPDGGGGATAIHGQGAATIRGVLHRALFFFVFVQRRSIRRRRRLRAARRPVQSDAAAILCAATVVLPTNLCP

SEQ ID NO: 166894 - protein, 139 aa, Heterodera glycines
  Homolog annotation: Hit_ID=AAO73004.1; Match level="QueryCoverage =74%, HitCoverage=29%, E-value=2e-10, Identity=37%"; Hit description =cathepsin B [Fasciola gigantica]
  Coding regions on vcDNA: vcDNA=SeqID_93317; Strand=+; Position=33-449
MNSAGFVLLLWNIVNLLIVCEGNVLKEKVDKSFASADLLVAHVNGQQSSWKAKLNAKFAKMTPEEQQQLMGSRRPFLEPITKSTKQQNGKPRLNKADIPLNFDARQHFYKCADIIGKIQDQSACGSCWAVSVPSAITDR

SEQ ID NO: 166895 - protein, 212 aa, Heterodera glycines
  Homolog annotation: Hit_ID=CAE72607.1; Match level="QueryCoverage =55%, HitCoverage=29%, E-value=4e-29, Identity=51%"; Hit description =Hypothetical protein CBG19798 [Caenorhabditis briggsae]
  Coding regions on vcDNA: vcDNA=SeqID_93318; Strand=+; Position=20-655
MSTISSDQLDKLENVFEIRKHLNASEQGRLGKAIGLTEEQVNEWFEQRRNRWREEFSCDYQEQSPQNVNKTEAAEQKVVAQKQQMLSADQFAVQSECATVWEPLNLRQEWTISNFAKALELATPGICMRGKKLWDTSMPYICWQLCLYPGGKREANSGNVSLFLKMSTTHPAHELTTVRAEYHFFFVDEQGTVKFSNTNTADFNVKPSKSSW

SEQ ID NO: 166896 - protein, 158 aa, Heterodera glycines
  Coding regions on vcDNA: vcDNA=SeqID_93319; Strand=+; Position=1-474
DLHNQQWKEQQEDYPLHLIVSRMMFVYGDSDEPLNICQEFMLDLLCKQLKMLLDKAHKLSIERHSPSVGFPEFMFAFRRHPLLIRKLIGYMRLVDLMPAMFREEEQKIDDSEDILPLSSSSSLNIQNSLDDLMKLKNTSKVIVAVRLIDVMDHLLADI

SEQ ID NO: 166897 - protein, 30 aa, Heterodera glycines
  Coding regions on vcDNA: vcDNA=SeqID_93320; Strand=-; Position=0-89
FFFFFFYNSLFLIVSLCTQFLGMTSDECSS

SEQ ID NO: 166898 - protein, 119 aa, Heterodera glycines
  misc_feature (117)..(117): Xaa can be any naturally occurring amino acid
  Homolog annotation: Hit_ID=CAG87702.1; Match level="QueryCoverage =92%, HitCoverage=33%, E-value=8e-50, Identity=82%"; Hit description =unnamed protein product [Debaryomyces hansenii CBS767] ref|XP _459484.1| unnamed protein product [Debaryomy
  Gene Ontology: Mol. function=protein phosphatase type 1 intrinsic catalyst activity; Cellular component=cytoplasm; Biological process =cell cycle
  Coding regions on vcDNA: vcDNA=SeqID_93321; Strand=+; Position=206-562
MTNMSDNAPEPNVDSIIERLLEVRSSRPGKQVAIPEHEVRWLCMKSRDIFVSQPILLELEAPLKICGDIHGQYYDLLRLFEYGGFPPEANYLFLGDYVDRGKQSLETICLLLAYKIXVP

SEQ ID NO: 166899 - protein, 108 aa, Heterodera glycines
  Homolog annotation: Hit_ID=CAE71449.1; Match level="QueryCoverage =73%, HitCoverage=20%, E-value=6e-29, Identity=72%"; Hit description =Hypothetical protein CBG18361 [Caenorhabditis briggsae]
  Gene Ontology: Biological process=tyrosine catabolism
  Coding regions on vcDNA: vcDNA=SeqID_93322; Strand=+; Position=1-327
GTVSAAPSSSARILCFDHIRFWVGNAKQAAHWYCVNFGFIPFAYRGLETGSRKTVAYAVKQDKIFFVFESALLPNNGEMSAHLAKHGDGVKVSSPPFSPSSAFPLPFH

SEQ ID NO: 166900 - protein, 141 aa, Heterodera glycines
  misc_feature (74)..(74): Xaa can be any naturally occurring amino acid
  Homolog annotation: Hit_ID=NP_506895.1; Match level="QueryCoverage =96%, HitCoverage=33%, E-value=1e-35, Identity=51%"; Hit description =kelch domain containing 3 (48.2 kD) (5Q134) [Caenorhabditis elegans] emb|CAB04012.1| Hypothetical protein
  Gene Ontology: Cellular component=cytoplasm; Biological process =cytoskeleton organization and biogenesis
  Coding regions on vcDNA: vcDNA=SeqID_93323; Strand=+; Position=1-424
VVPTVGHCPPSRDGHSAVVNGDFMFIFGGFEEREHRFSQETYAFHFPTRVWKKLKTEGESPQYRDFHAACVLGXKMYVFGGRSDEMGQLHTSHDVYCDKLHYLDLKTFQWHRPEVKEPTTAPCGRRSLTMWTYRDAIYIFG

SEQ ID NO: 166901 - protein, 175 aa, Heterodera glycines
  Homolog annotation: Hit_ID=XP_317352.1; Match level="QueryCoverage =99%, HitCoverage=22%, E-value=3e-58, Identity=61%"; Hit description =ENSANGP00000010476 [Anopheles gambiae]
  Gene Ontology: Biological process=induction of apoptosis by intracellular signals
  Coding regions on vcDNA: vcDNA=SeqID_93324; Strand=+; Position=2-526
NVDDSYIINPWELLRKAIQEIQRKNNSGLSFEELYRNAYTMVLHKHGDKLYEGLKEVVREHLQTKVREIVVEAINGRFLEVLNRVWADHTTSMVMIRDILMYLDRVYVAQAAVEPVHPLGLRIFREEIVDYPAINEHLKATLLGMISLERQKEIIEWIDLKNVCQMLIALGLDNR

SEQ ID NO: 166902 - protein, 30 aa, Heterodera glycines; identical to SEQ ID NO: 153355
  Coding regions on vcDNA: vcDNA=SeqID_93325; Strand=-; Position=3-92

SEQ ID NO: 166903 - protein, 157 aa, Heterodera glycines
  Coding regions on vcDNA: vcDNA=SeqID_93326; Strand=+; Position=1-471
KKDEIEVEMKKKRTVRPSQTATRRRQLDEPTRRRTSASPSKIRASNANIERAKKAAAAAESRFSTPAKMTPAEKSQLQREQQQQKRNKEAEKQMEAKLAIVQQHLQRQIEREKNLAVRNTLWNREAKMEQRIIQRFRAYRAMVDKEFRAAVHQGATI

SEQ ID NO: 166904 - protein, 114 aa, Heterodera glycines
  Coding regions on vcDNA: vcDNA=SeqID_93327; Strand=-; Position=81-425
SVERKLVLCRLFAFHRFYYATFGHWLSIPCSSTIFGKRTAAAQIGKTFHQIGRVAESAAKETVRTPAEIAPFRWRILFQFSARSFVCLRLCGDYCFCVVQSSDCFSEVICCAAA

SEQ ID NO: 166905 - protein, 140 aa, Heterodera glycines
  Coding regions on vcDNA: vcDNA=SeqID_93328; Strand=+; Position=15-437
IDANLLTAFFHMSHHQQHFPPAMFKSDRRLLSAPYQSRNAERMQRRIGHGMGEHSRKFTSNGNSFCTFEGLMEVAVEIEVKETTENEGTDEANGTANSKPKMAQEKPKRQQGGGGRPFVGAISLCRRIWPPPKAFRRFSD

SEQ ID NO: 166906 - protein, 80 aa, Heterodera glycines
  misc_feature (22)..(22): Xaa can be any naturally occurring amino acid
  Homolog annotation: Hit_ID=NP_510476.1; Match level="QueryCoverage =98%, HitCoverage=19%, E-value=9e-20, Identity=54%"; Hit description =rhodopsin-like GPCR superfamily (XP541) [Caenorhabditis elegans] pir||T20902 hypothetical protein Y70D2A.
  Coding regions on vcDNA: vcDNA=SeqID_93329; Strand=+; Position=2-241
KETGENRVYTVLFAITVIFFLXTIPSPPGTIFISDRHSQSLPFQIFRSASNLLEITKFALNFYLYCLINPDIRRVCLRVL

SEQ ID NO: 166907 - protein, 134 aa, Heterodera glycines
  Coding regions on vcDNA: vcDNA=SeqID_93330; Strand=+; Position=2-406
RIMANRRVEEQRQTLTKEPKKKVFERDFLRMATLTNDVMFLRRTLERDDLSELLLCLFGSFTCEKAFETAEHLEAFVAKHCPSIRIETVGLGADVKKFFHWDPAGDQPQKNGLDRMANGTAINETFEEENESEN

SEQ ID NO: 166908 - protein, 179 aa, Heterodera glycines
  Homolog annotation: Hit_ID=CAF89712.1; Match level="QueryCoverage =97%, HitCoverage=93%, E-value=5e-57, Identity=60%"; Hit description =unnamed protein product [Tetraodon nigroviridis]
  Gene Ontology: Cellular component=cell; Biological process=asymmetric protein localization involved in cell fate commitment
  Coding regions on vcDNA: vcDNA=SeqID_93331; Strand=+; Position=80-616
MAAIRKTLNFVSGNKQKLLELRLLLGDEFEIAPLDIDLPELQGDPADITKAKCAKAVDATGGTLKVIVEDTALCFNALDGLPGPYVKWFLAKLKPEGLHRLLAGYNDKSAYSLCTVAYSEGKDKPIHLFTGTTNGQIVEPRGPREFGWDPCFQPDGFPKTFAEMTKEEKNQISHRAIAL

SEQ ID NO: 166909 - protein, 122 aa, Heterodera glycines
  misc_feature (63)..(63): Xaa can be any naturally occurring amino acid
  Homolog annotation: Hit_ID=AAH82716.1; Match level="QueryCoverage =97%, HitCoverage=21%, E-value=8e-19, Identity=41%"; Hit description =Unknown (protein for MGC:88873) [Xenopus tropicalis]
  Gene Ontology: Cellular component=chromatin; Biological process =mitosis
  Coding regions on vcDNA: vcDNA=SeqID_93332; Strand=+; Position=43-408
MGVSFESRPLSVGDYLWVLQRTNWEGKRQELVLDYVVERKTLDDLRRSIKETRYLEQKQRLKXCGLRNVVFVLEGGTTANDRQLEQAMVSSGVESGFLVHRTPNVQGTAKFLQNLTRWLRER

SEQ ID NO: 166910 - protein, 189 aa, Heterodera glycines
  Coding regions on vcDNA: vcDNA=SeqID_93333; Strand=+; Position=9-575
MPVKILIFSILFCVCLQTVELGFNGQLNQDSQNNGQLTSTVQEAQGGTFGNQNQATNNGQFKNGQLINGQSTITSSNNVQLISPVSQVQQGTGSLKNVGEGTGLSVNRQQLISTGAQVQQGAGFPNYSQFNAGQGSLNNAGQATKSSINGQLINPAGQVQQRIGSSNDYQPNNGQLINNSDQGKINGQV

SEQ ID NO: 166911 - protein, 81 aa, Heterodera glycines
  Coding regions on vcDNA: vcDNA=SeqID_93334; Strand=+; Position=27-272
ALPLPTKHSPNDGDCVRFPNSARQWRSNACAGLRTESTGVRAGRTTLSRTFAQSEHQRMGRHFDGGPSKSVLAPMTERRDK

SEQ ID NO: 166912 - protein, 207 aa, Heterodera glycines
  misc_feature (199)..(199): Xaa can be any naturally occurring amino acid
  Homolog annotation: Hit_ID=XP_321452.1; Match level="QueryCoverage =99%, HitCoverage=69%, E-value=1e-25, Identity=36%"; Hit description =ENSANGP00000022095 [Anopheles gambiae]
  Coding regions on vcDNA: vcDNA=SeqID_93335; Strand=+; Position=33-652
MKYTHAITIRMPSSLKFDDKKAKSKIDFPLALRQHQDLTETLTEAGIEVIELATAETEPTIPSLFADDLAIVINGTALLTRPKSNNNKKTPVVSRTNEFVSVLNSLTWQVVEAPLQIHGRSVVLEGSDVVFTEKEIFVGIRKNGTNTEGALIVAKTFADYSVIPISIAGTLPLKAHISVATNEILSVGRDKDSQAILSXIERDATFR

SEQ ID NO: 166913 - protein, 105 aa, Heterodera glycines
  Homolog annotation: Hit_ID=NP_497829.1; Match level="QueryCoverage =100%, HitCoverage=41%, E-value=3e-20, Identity=47%"; Hit description= protein likely ortholog of mouse Ly1 antibody reactive clone (28.5 kD) (3F252) [Caenorhabditis elegans]
  Coding regions on vcDNA: vcDNA=SeqID_93336; Strand=+; Position=20-334
SCMDWLVAIDTWEYRGHTKCITEDQKYLCARHVPKVNKGELKQDAWVSQVRAAIRQVDQPRLKNLLRSVQCHTNLPRKEAQYVVFLQNSMRIRDRALWGDAWNGV

SEQ ID NO: 166914 - protein, 179 aa, Heterodera glycines
  misc_feature (156)..(156): Xaa can be any naturally occurring amino acid
  Homolog annotation: Hit_ID=EAK80931.1; Match level="QueryCoverage =100%, HitCoverage=98%, E-value=3e-89, Identity=89%"; Hit description= ARF_CRYNE ADP-RIBOSYLATION FACTOR [Ustilago maydis 521] ref|XP _398002.1| ARF_CRYNE ADP-RIBOSYLATION FACTO
  Gene Ontology: Mol. function=ARF small monomeric GTPase activity; Cellular component=cytosol; Biological process=G-protein coupled receptor protein signaling pathway
  Coding regions on vcDNA: vcDNA=SeqID_93337; Strand=+; Position=91-627
MGLSISKLLSSLFGKQEMRILMVGLDAAGKTTILYKLKLGEIVTTIPTIGFNVETVEYKNISFTVWDVGGQDKIRPLWRHYFQNTQGIIFVVDSNDRERVNEARDELQRMLNEDELRNAILLVFANKQDLPNAMQAAEITEKLGLQSIRQREWYIXATCATSGDGLYEGLEWLSNTLKK

SEQ ID NO: 166915 - protein, 156 aa, Heterodera glycines
  Homolog annotation: Hit_ID=CAE59594.1; Match level="QueryCoverage =100%, HitCoverage=21%, E-value=2e-39, Identity=53%"; Hit description= Hypothetical protein CBG03001 [Caenorhabditis briggsae]
  Gene Ontology: Mol. function=GMP synthase (glutamine hydrolyzing) activity; Biological process=purine base biosynthesis
  Coding regions on vcDNA: vcDNA=SeqID_93338; Strand=+; Position=2-469
RVAILDFGAQYGKLIDRRVRECNVCSDLLPFSTTMNELVHNGYSAVIFIGGPNSVYVDNAPVYDPELLGGRLPLLGICYGFQLINKHFGGSVSLQPRREDGRTQIQVSPKSDLFHSLKPDQFVLLTHGDGVTPGNVSQKWVSTNWLHRGICGGHRK

SEQ ID NO: 166916 - protein, 173 aa, Heterodera glycines
  Homolog annotation: Hit_ID=NP_386546.1; Match level="QueryCoverage =80%, HitCoverage=27%, E-value=3e-34, Identity=56%"; Hit description =PROBABLE MANNITOL 2-DEHYDROGENASE PROTEIN [Sinorhizobium meliloti 1021] emb|CAC47019.1| PROBABLE MANNITOL
  Coding regions on vcDNA: vcDNA=SeqID_93339; Strand=+; Position=27-545
MPAQNFVTNQQRKNDYAADHQTMLNTLNPPPKTIKLSARTLDAIALAHQEVNVPKYSRASLSAGIVHFGVGNFHRAHQAVYLNELFNMGQDLDWAIIGVGMTSSASANSKKKCMLEHDFLTTVVEQDGMAQSAHVTGCMIDYVPAGNPELVVAKLPHPALRIVSMTITESGLF

SEQ ID NO: 166917 - protein, 182 aa, Heterodera glycines
  misc_feature (159)..(159): Xaa can be any naturally occurring amino acid
  Homolog annotation: Hit_ID=NP_505977.1; Match level="QueryCoverage =94%, HitCoverage=14%, E-value=2e-74, Identity=77%"; Hit description =pyruvate carboxylase, Biotin-requiring, cadmium-responsive gene (129.3 kD) (pyc-1) [Caenorhabditis elegan
  Gene Ontology: Mol. function=pyruvate carboxylase activity; Cellular component=cytosol; Biological process=TCA intermediate metabolism
  Coding regions on vcDNA: vcDNA=SeqID_93340; Strand=+; Position=1-545
AFGDGSLFVEKFVERPRHIEVQIIGDHYGNLVHLYERDCSVQRRHQKVVELAPAPVLDPAIRQRMLDDALKLTRHVGYQNVGTVEFLLDTKGNHYFMEVNARLQVEHTVTEEITGVDLVQSQIRIAEGKSLEDINLRQDSIHVNGAAIQCRVTTEDPGXGGFHPDSGRIRAFPRVPRGGAVA

SEQ ID NO: 166918 - protein, 44 aa, Heterodera glycines
  Coding regions on vcDNA: vcDNA=SeqID_93341; Strand=-; Position=3-134
FFFFFFFRQYLSHIFSTKLKKQHKYLMNRGKMSLTMEKESNSKL

SEQ ID NO: 166919 - protein, 46 aa, Heterodera glycines
  Coding regions on vcDNA: vcDNA=SeqID_93342; Strand=-; Position=0-137
FFFFFGMGKRSNIHIDNKDKRIWLLKFKRRECLVDKEAEWDPIEVG

SEQ ID NO: 166920 - protein, 157 aa, Heterodera glycines
  Coding regions on vcDNA: vcDNA=SeqID_93343; Strand=+; Position=3-473
FSLMDVNEFGLAASSSLLTCEEIAEVFLHLTVRPRPQCRFSARGFRANSRSKHIVQRFSALSSKRCTRRENKICFTADRDVLISGVAIYGANQSGSRMITDDSTAKTNWEHKIAIKLELVADLYGSPLEQLASNELLMSGKFGDPTPLVAQFAEPVP

SEQ ID NO: 166921 - protein, 170 aa, Heterodera glycines
  Homolog annotation: Hit_ID=NP_492339.1; Match level="QueryCoverage =100%, HitCoverage=88%, E-value=1e-49, Identity=55%"; Hit description= CalPoNin (21.1 kD) (cpn-1) [Caenorhabditis elegans] emb|CAB02104.1| Hypothetical protein F43G9.9 [Caenor
  Gene Ontology: Mol. function=troponin C binding; Cellular component =cytoskeleton; Biological process=growth
  Coding regions on vcDNA: vcDNA=SeqID_93344; Strand=+; Position=2-511
ERATKTGLAAEAQQKIHSKFDLELSKQIFGWISQVTGESFTVSGEVEEYLTTLKDGTGLCQLENDLSPNSIKKINTTNYPFKQMENISFFLGFAEKYVNKSELFQTVDLFEGQDPNSVLICLVALAQKSDKSFGKGGLGPIEWEGSNNEWTWEALRARYSIHLLANGLNK

SEQ ID NO: 166922 - protein, 84 aa, Heterodera glycines
  Coding regions on vcDNA: vcDNA=SeqID_93345; Strand=-; Position=1-252
LLFDQLHNCRSVVTSFCFTVSVVCLFSSVCSDEFLIQFGISFAPHFFANAFRRSHDVLLFPLLQHRRCYCHSTVRRVRPTFDQK

SEQ ID NO: 166923 - protein, 94 aa, Heterodera glycines
  misc_feature (83)..(83): Xaa can be any naturally occurring amino acid
  Homolog annotation: Hit_ID=CAE60607.1; Match level="QueryCoverage =96%, HitCoverage=12%, E-value=2e-13, Identity=36%"; Hit description =Hypothetical protein CBG04247 [Caenorhabditis briggsae]
  Coding regions on vcDNA: vcDNA=SeqID_93346; Strand=+; Position=1-282
LCCLTLHTLVKIRASRIFSVSQTNLYWQKSGSYLAAHTERYHKMVKNKEGEVKYTGNNSYLEIFDCTDKEYAVQSIQLPEPFXNLAWEPKGNKF

SEQ ID NO: 166924 - protein, 104 aa, Heterodera glycines
  Homolog annotation: Hit_ID=AAH02251.1; Match level="QueryCoverage =72%, HitCoverage=33%, E-value=2e-10, Identity=41%"; Hit description =Psph protein [Mus musculus] gb|AAH83937.1| Unknown (protein for MGC:97922) [Xenopus laevis] ref|NP_598661.
  Coding regions on vcDNA: vcDNA=SeqID_93347; Strand=+; Position=19-330
MCRPPIENISAGRRYSKVIWRSLKRQRPSAVCFDMDSTLIKEETLDAYSSFFGLDLGGSAITEKAMGGQIGFRKALALRLEMLKATKAHSDHFLNNFPPHLAIG

SEQ ID NO: 166925 - protein, 97 aa, Heterodera glycines
  Homolog annotation: Hit_ID=AAN10061.1; Match level="QueryCoverage =76%, HitCoverage=10%, E-value=3e-09, Identity=40%"; Hit description =Kunitz-like protease inhibitor precursor [Ancylostoma caninum]
  Coding regions on vcDNA: vcDNA=SeqID_93348; Strand=+; Position=6-299
MQLSELSVAFVALFLTSALIEITEANAPKQNSGTDTNAEKEENVCLLKKHEGSGNGHIRRWWHDKADGECKAFFYKGRGGNGNRFVSKALCERRCNK

SEQ ID NO: 166926 - protein, 153 aa, Heterodera glycines
  Homolog annotation: Hit_ID=AAH27747.1; Match level="QueryCoverage =84%, HitCoverage=32%, E-value=6e-29, Identity=46%"; Hit description =RAD23b homolog [Mus musculus] ref|NP_033037.1| RAD23b homolog [Mus musculus] emb|CAA63146.1| MHR23B [Mus m
  Gene Ontology: Mol. function=single-stranded DNA binding; Cellular component=nucleus; Biological process=nucleotide-excision repair
  Coding regions on vcDNA: vcDNA=SeqID_93349; Strand=+; Position=42-500
MESLENPQGLSFLAQSPQFQQLRDIVRTDPSMLPQIIQQIAAANPQLMEAIRNNQGAFLQMLNEGQPLGGGTDAGAGGEAAAGVQQEAAQRRVSIPVNAQDRLAITRLVSMGFPEALVVEAYFACDKNEDLAVNYILERMDESQNERAGAGQQ

SEQ ID NO: 166927 - protein, 51 aa, Heterodera glycines
  Coding regions on vcDNA: vcDNA=SeqID_93350; Strand=-; Position=3-155
FKRSHKLRAGQFRREEIIVSKRSIFINELMKNSLNSFYQFFNKIHDKQIWI

SEQ ID NO: 166928 - protein, 90 aa, Heterodera glycines
  Homolog annotation: Hit_ID=CAE75355.1; Match level="QueryCoverage =92%, HitCoverage=56%, E-value=9e-14, Identity=40%"; Hit description =Hypothetical protein CBG23335 [Caenorhabditis briggsae]
  Coding regions on vcDNA: vcDNA=SeqID_93351; Strand=+; Position=3-275
CDLFAVNVNICSGSCWSLSFVDPRQSKGAESEANANGNEPAVAVFAQCCRMVEAQMLNVSIPCEDGSKTVQIPSATNCSCFDCSRKRRRR

SEQ ID NO: 166929 - protein, 130 aa, Heterodera glycines
  Coding regions on vcDNA: vcDNA=SeqID_93352; Strand=-; Position=127-519
RSSPRSQKKCCCPPMPSPSHFSVPPSHSVPSSHFSVPPSHSVPSSHFSVPPSHSVPSSHFSVPPHIRSQPQAASSTICNRRRRPECAQFQAQNGCSIHRRSSCCRFLVHNRTHIQPACSGQRSSLRRSCC

SEQ ID NO: 166930 - protein, 110 aa, Heterodera glycines
  Coding regions on vcDNA: vcDNA=SeqID_93353; Strand=+; Position=2-334
RNVLSFDDYSQYRIITVLLHRPQGINEGAVGLLLRTMAERSKPANAPFSILVHQVTGGSIASKNGHLMQGDRVFFIQHQSTVNMSVAEARSLVKSPSPVIHLVVGRGRFL

SEQ ID NO: 166931 - protein, 19 aa, Heterodera glycines
  Coding regions on vcDNA: vcDNA=SeqID_93354; Strand=+; Position=2-58
TFSFSSLALPNTHTIFEML

SEQ ID NO: 166932 - protein, 99 aa, Heterodera glycines
  misc_feature (26)..(26): Xaa can be any naturally occurring amino acid
  misc_feature (73)..(73): Xaa can be any naturally occurring amino acid
  Homolog annotation: Hit_ID=NP_492064.2; Match level="QueryCoverage =100%, HitCoverage=47%, E-value=3e-26, Identity=59%"; Hit description= inositol monophosphatase (23.3 kD) (1H878) [Caenorhabditis elegans] emb|CAA95791.2| Hypothetical protein
  Gene Ontology: Mol. function=myo-inositol-1(or 4)-monophosphatase activity; Biological process=signal transduction
  Coding regions on vcDNA: vcDNA=SeqID_93355; Strand=+; Position=2-297
TTHIVDMLTISELSERYPDHKFIGEXNVLAGNTYELTDAPTWIIDPIDGTTNFAHRIPFLGICVGLAINKSLXSWDRFRPITDELYTAIGGKRPFKNGF

SEQ ID NO: 166933 - protein, 66 aa, Heterodera glycines
  Homolog annotation: Hit_ID=NP_508379.1; Match level="QueryCoverage =81%, HitCoverage=8%, E-value=4e-12, Identity=65%"; Hit description =lysophosphatidic acid acyltransferase (69.9 kD) (XC686) [Caenorhabditis elegans] gb|AAF39831.1| Acyltransf
  Coding regions on vcDNA: vcDNA=SeqID_93356; Strand=+; Position=146-343
MSLLLLSATAEHLLVLSAFFFPPALLIVLLVVVLATFGKSLGLRERYVSILIRIFEWGAGEIQSRR

SEQ ID NO: 166934 - protein, 103 aa, Heterodera glycines
  Homolog annotation: Hit_ID=NP_608461.1; Match level="QueryCoverage =72%, HitCoverage=21%, E-value=6e-11, Identity=45%"; Hit description =CG14614-PA [Drosophila melanogaster] gb|AAF50953.2| CG14614-PA [Drosophila melanogaster] gb|EAL32348.1| G
  Coding regions on vcDNA: vcDNA=SeqID_93357; Strand=+; Position=77-388
MTSTLRGFCLSPADQQTNLFSFCSEMATNASQKRKEIYRYKASFNVYAMGWSTKLFFFLKFRLAIGSFIDEYHHKVSIGHLHQDQGQFGRLGTFDHANTSTKR

SEQ ID NO: 166935 - protein, 58 aa, Heterodera glycines
  misc_feature (37)..(38): Xaa can be any naturally occurring amino acid
  misc_feature (41)..(43): Xaa can be any naturally occurring amino acid
  misc_feature (45)..(45): Xaa can be any naturally occurring amino acid
  misc_feature (48)..(53): Xaa can be any naturally occurring amino acid
  Coding regions on vcDNA: vcDNA=SeqID_93358; Strand=+; Position=181-354
FKFCLVFSYFPFFSLFSFFFFFFFSPPPPPPPSFPPXXPPXXXPXPPXXXXXXPPPPP

SEQ ID NO: 166936 - protein, 105 aa, Heterodera glycines
  misc_feature (48)..(48): Xaa can be any naturally occurring amino acid
  misc_feature (50)..(50): Xaa can be any naturally occurring amino acid
  misc_feature (76)..(76): Xaa can be any naturally occurring amino acid
  Homolog annotation: Hit_ID=CAB88203.1; Match level="QueryCoverage =98%, HitCoverage=34%, E-value=2e-30, Identity=67%"; Hit description =putative cuticular collagen [Globodera pallida]
  Coding regions on vcDNA: vcDNA=SeqID_93359; Strand=+; Position=2-317
IVLGIASVRSLLAIIATVVTLPSLYSEMSQMNSKVRDGVEAFRVNTDXAXTDLMDAQVVLTTPSNPRDNPLDSFFXAKRQLSAHCQRVFPPPSTIIPHGPSLPTP

SEQ ID NO: 166937 - protein, 170 aa, Heterodera glycines
  misc_feature (144)..(144): Xaa can be any naturally occurring amino acid
  Homolog annotation: Hit_ID=NP_502064.1; Match level="QueryCoverage =91%, HitCoverage=22%, E-value=2e-20, Identity=34%"; Hit description =autophagy (72.4 kD) (4L844) [Caenorhabditis elegans] emb|CAA92753.1| Hypothetical protein M7.5 [Caenorhab
  Gene Ontology: Mol. function=protein binding; Cellular component =cytoplasm; Biological process=membrane fusion
  Coding regions on vcDNA: vcDNA=SeqID_93360; Strand=+; Position=3-512
MASTHEKRTDSRLVFVPFVTFADPLFWNEINRLKVDHWKLDESLKPIYATTTFQGAQPSDGLLSFDQFSIAAESGQTLPLQSVQPFVSPFHGTFLLLNTKKAFSDGFDRKKFLEQSADSLWKVIESKKWLTEAQLLNSFLLTAXADVKNFTYCFWNCVPARLLPDKLREN

SEQ ID NO: 166938 - protein, 178 aa, Heterodera glycines
  Coding regions on vcDNA: vcDNA=SeqID_93361; Strand=+; Position=20-553
NKNSQLVLKWNYKRSAMSDNEDELTGIQRRRRLTEGTDEKSRFRPPLTPSNSLLLRSPPVIMITSPSLPNSREEHLAEQQVPSSNGNGTSSSASSSAGTTRVNHPPQPFPVPLQRRRSSCSSSVSSPLGSAAFHPRYSTPRLSITSLGSVAKTFRNIAAFIVPEEEGERERARDRLRK

SEQ ID NO: 166939 - protein, 137 aa, Heterodera glycines
  Homolog annotation: Hit_ID=CAE62020.1; Match level="QueryCoverage =57%, HitCoverage=29%, E-value=5e-15, Identity=45%"; Hit description =Hypothetical protein CBG06029 [Caenorhabditis briggsae]
  Coding regions on vcDNA: vcDNA=SeqID_93362; Strand=+; Position=1-411
AKCLLHGPSVVRLLPHSLKISRSFAVPWRQFFDKLKADRINAQVKHKPLDDDHKRYADDEWHWMPTGESDIQNQATVTFLSRILKKEKLVAIKTISKFGFRTHENAYLLGPIAVFPRTVLSWRVPMPADITPESLEL

SEQ ID NO: 166940 - protein, 110 aa, Heterodera glycines
  Homolog annotation: Hit_ID=CAB88203.1; Match level="QueryCoverage =99%, HitCoverage=38%, E-value=7e-44, Identity=78%"; Hit description =putative cuticular collagen [Globodera pallida]
  Coding regions on vcDNA: vcDNA=SeqID_93363; Strand=+; Position=6-338
MQETHIVLGIASVCSLLAIIATVVTLPSLYSEMSQMNSKVRDGVEAFRVNTDSAWTDLMDVQVVVTPPSKPRDNPFNSIFFFKRHLPGHCQCAVFQQPTSAPGAAPKQPE

SEQ ID NO: 166941 - protein, 93 aa, Heterodera glycines
  misc_feature (63)..(63): Xaa can be any naturally occurring amino acid
  Homolog annotation: Hit_ID=NP_493960.1; Match level="QueryCoverage =94%, HitCoverage=12%, E-value=1e-12, Identity=37%"; Hit description =putative protein family member, with at least 7 transmembrane domains, of ancient origin (2B679) [Caenorh
  Coding regions on vcDNA: vcDNA=SeqID_93364; Strand=+; Position=1-278
SLEQSETMAFVLKRLIGYLAIWLICFINLFSLQKIAARFQVILTVLKLLVIALIILTGLYQNXIIFRGRTENFRDTFVFTKTEACEIVLALFA

SEQ ID NO: 166942 - protein, 73 aa, Heterodera glycines
  Homolog annotation: Hit_ID=CAA65474.1; Match level="QueryCoverage =97%, HitCoverage=23%, E-value=2e-11, Identity=47%"; Hit description =collagen [Globodera pallida]
  Coding regions on vcDNA: vcDNA=SeqID_93365; Strand=+; Position=2-223
PSLYSEMSQMNSKARDRLEGFRDHSDYDWTDLMDGQPGPTPPANPHDSPARCFFFAKRQLTARRHCLLAHPAR

SEQ ID NO: 166943 - protein, 120 aa, Heterodera glycines
  Coding regions on vcDNA: vcDNA=SeqID_93366; Strand=+; Position=5-364
AAISESPLNNCPVKVLPSFTSTFLPDLSNAQVLKPKPTNVDRLPLSNEEFITPTQPKKQQSRPFSPANGVSKLILPRSRVASIRRESDCNSEKGFGEAEAAHQKMVKSAQQVAMGFEDFC

SEQ ID NO: 166944 - protein, 175 aa, Heterodera glycines
  Coding regions on vcDNA: vcDNA=SeqID_93367; Strand=+; Position=2-526
KTKSEKDRHEHRTTEEQLRTRLLNSDGQCTELRHKLRAVEQQNDNLERRERIHTQQLIDLSERYDHCLERCAMLEAGMAVPQALPLAVNGGGINGVMVQQIDCADNQPMDFASSSVNNIVDNPSSTTDTSPEGPAMRERVRQTLNGRPTQRLIEQMLRKVEAAEAHLNISSFSSS

SEQ ID NO: 166945 - protein, 156 aa, Heterodera glycines
  misc_feature (131)..(131): Xaa can be any naturally occurring amino acid
  Coding regions on vcDNA: vcDNA=SeqID_93368; Strand=+; Position=55-522
MTTLDAKMSSSSSVLQDLLRDHSSEIGNWSEIVNNHQDESSKPEPFTNIDHNGPFYIFVPNLTLDYAVDSVNMEVYKMFGGHKNLFAVYAYRLAKKVSQSFMLMARDFESCVQVLKMEEKIVNSSSKEVVXLEYVLPSVAPPKTFHYTTEQVDNQL

SEQ ID NO: 166946 - protein, 159 aa, Heterodera glycines
  Coding regions on vcDNA: vcDNA=SeqID_93369; Strand=+; Position=3-479
RSEMAAVDQHQQQLVERIKQLDTLSTTADEQFDNSLNVPIGDLCRLLLAALAGDELAAGEAKKICPPSSPFANAIGSLAVGCLRDGIGPDGLAMEIQQLNSASTGKGNEMRNAFLEAYRSNFDQLKMALAKSTGTFASGGSAYPKVVGMDWSILSVIES

SEQ ID NO: 166947 - protein, 68 aa, Heterodera glycines
  Homolog annotation: Hit_ID=NP_499752.1; Match level="QueryCoverage =97%, HitCoverage=14%, E-value=1e-15, Identity=56%"; Hit description =acetyl-CoA acetyltransferase (3O435) [Caenorhabditis elegans] emb|CAB04455.1| Hypothetical protein F53A2.
  Gene Ontology: Mol. function=3-oxoacyl-[acyl-carrier protein] reductase activity; Cellular component=mitochondrion
  Coding regions on vcDNA: vcDNA=SeqID_93370; Strand=+; Position=2-205
VADLGEIEDDAALKSSSIAAEHIDHGIFGNVIQSSKDAAYLARHIGLRVGVPDHVPAATANKICGSGF

SEQ ID NO: 166948 - protein, 143 aa, Heterodera glycines
  Homolog annotation: Hit_ID=CAE58355.1; Match level="QueryCoverage =95%, HitCoverage=62%, E-value=1e-19, Identity=37%"; Hit description =Hypothetical protein CBG01476 [Caenorhabditis briggsae]
  Gene Ontology: Cellular component=nucleus
  Coding regions on vcDNA: vcDNA=SeqID_93371; Strand=+; Position=2-430
QGFFGFSKQKAPPPILVEAITIIVARGNSVKKKIKNWEGDWENLRVPLKKMKEGPAKNLAPKRVFKFMKQKGFFENQGNHLPAHSLIMEQTIFEFGGMKNPQGPAPKRKEVLTSMTREHKSADFARTDPLEDEMKKLLQMISQ

SEQ ID NO: 166949 - protein, 159 aa, Heterodera glycines
  misc_feature (82)..(82): Xaa can be any naturally occurring amino acid
  Homolog annotation: Hit_ID=NP_508280.1; Match level="QueryCoverage =100%, HitCoverage=14%, E-value=1e-66, Identity=81%"; Hit description= atp citrate lyase (XC101) [Caenorhabditis elegans] gb|AAB00585.1| Hypothetical protein D1005.1 [Caenorha
  Gene Ontology: Mol. function=ATP citrate synthase activity; Cellular component=mitochondrion; Biological process=ATP catabolism
  Coding regions on vcDNA: vcDNA=SeqID_93372; Strand=+; Position=3-479
LISSLVSGLLTIGDRFGGALDGAAKSFSEAMDTGLSAMQFVNEQKRLGKLIPGIGHRVKSINNPDKRVEILKEIAKNKTFFXQETPLFDYALKVEQITTSKKPNLILNVDGAIATIFVDILRHSGMFTPQEARETIEIGSLNGLFVLGRSVGFIGHYLD

SEQ ID NO: 166950 - protein, 81 aa, Heterodera glycines
  Coding regions on vcDNA: vcDNA=SeqID_93373; Strand=+; Position=2-247
PCRTPFQRVQNYAEEQAELNDGVARLTNGGPILGGVVVDLVFSDLRRWRSVAIDRKGQQMGLKGQNILFFGRNFYIFIKLI

SEQ ID NO: 166951 - protein, 179 aa, Heterodera glycines
  misc_feature (77)..(77): Xaa can be any naturally occurring amino acid
  misc_feature (103)..(103): Xaa can be any naturally occurring amino acid
  Homolog annotation: Hit_ID=CAB88203.1; Match level="QueryCoverage =83%, HitCoverage=50%, E-value=9e-51, Identity=67%"; Hit description =putative cuticular collagen [Globodera pallida]
  Coding regions on vcDNA: vcDNA=SeqID_93374; Strand=+; Position=15-554
MQETHIVLGIASVCSLLAIIATVVTLPSLYSEMSQMNSKVRDGVEAFRVNTDSAWTDLMDVQVVVTPPSKPRDNPFXPFFRAKRQLPGHCHCAGLQQASCPPXPPGPSVLPGLSSTPRNPPTLIRRPAPPRHPPPASPFPVVPPGLSPPRTRHPHPICNDPPPTDDLRGSPVLCQAAPP

SEQ ID NO: 166952 - protein, 93 aa, Heterodera glycines
  Homolog annotation: Hit_ID=NP_493230.1; Match level="QueryCoverage =100%, HitCoverage=50%, E-value=2e-14, Identity=43%"; Hit description= DNA segment Chr 11 Wayne State University 68 expressed (21.5 kD) (1N326) [Caenorhabditis elegans] emb|CA
  Coding regions on vcDNA: vcDNA=SeqID_93375; Strand=+; Position=2-280
WYFHFPPFFSMPTTASSTLDKQLKACGRLLLDYCQANLIYTTDLDEISKSDLFNNRRLNRHLDLSCFPGVFYFLELHKHVECNDKDKTRCDIY

SEQ ID NO: 166953 - protein, 73 aa, Heterodera glycines
  Coding regions on vcDNA: vcDNA=SeqID_93376; Strand=-; Position=1-219
FFEIDCFANGKIQFSIFWVRFSHVVWIENLNPIGVRVRDECQASQVVRRFEGQIQTDFDHARNRLMNDICLQN

SEQ ID NO: 166954 - protein, 92 aa, Heterodera glycines
  Coding regions on vcDNA: vcDNA=SeqID_93377; Strand=+; Position=3-278
VNLKSMFIAVHAGAGFFAESAEKNCSEALKHAVDINNRPTDNGKQSEIGLGGDGITYSGAAGDCPLVAAVMFLERCPALNCGLGSNLTVAGS

SEQ ID NO: 166955 - protein, 21 aa, Heterodera glycines
  Coding regions on vcDNA: vcDNA=SeqID_93378; Strand=-; Position=3-65
VILNIEDIHYKLINAIIMVHF

SEQ ID NO: 166956 - protein, 50 aa, Heterodera glycines
  Coding regions on vcDNA: vcDNA=SeqID_93379; Strand=+; Position=139-288
FIHSLLLLITWAGNFVEKPIVFVIHKNRTNANSIPLTITRESNYMHMHIF

SEQ ID NO: 166957 - protein, 45 aa, Heterodera glycines
  Coding regions on vcDNA: vcDNA=SeqID_93380; Strand=-; Position=114-251
KKKPLAALTSVDRMSPPPAPPPKAPLPPPPPPRNPPINSPAISAN

SEQ ID NO: 166958 - protein, 154 aa, Heterodera glycines
  Homolog annotation: Hit_ID=NP_871817.1; Match level="QueryCoverage =97%, HitCoverage=38%, E-value=5e-40, Identity=53%"; Hit description =oxysterol-binding protein (1G409) [Caenorhabditis elegans] gb|AAN84853.1| Oxysterol binding protein (osbp
  Gene Ontology: Mol. function=oxysterol binding; Cellular component =cytosol; Biological process=Golgi to plasma membrane transport
  Coding regions on vcDNA: vcDNA=SeqID_93381; Strand=+; Position=12-473
MQAPDWGNYDTNGTDYDYIYNNSDERDNWNSEQAGVFRHLVTQLGTTQTLQNLALPTFVLERRSLLEMYADFFAHPDELIAGAYENTAEKRFLAVLKYYLNSFYPARKTDAAKKPYNPILGEVFRCRWTLPDVPLSASRTAGGPFPGSATNQMT

SEQ ID NO: 166959 - protein, 78 aa, Heterodera glycines
  Homolog annotation: Hit_ID=NP_505117.1; Match level="QueryCoverage =52%, HitCoverage=30%, E-value=4e-09, Identity=63%"; Hit description =putative nuclear protein (5I694) [Caenorhabditis elegans] pir||B89124 protein K07C11.8 [imported] - Caeno
  Coding regions on vcDNA: vcDNA=SeqID_93382; Strand=+; Position=3-236
SKCQSILCPFLAVMNELLAIVLIVLLCCAMFFAWLFALATCPDRLVNLISGTKSSSSPISRASEDNGTRKGSSRWRFG

SEQ ID NO: 166960 - protein, 85 aa, Heterodera glycines; identical to SEQ ID NO: 138989
  Coding regions on vcDNA: vcDNA=SeqID_93383; Strand=+; Position=1-255

SEQ ID NO: 166961 - protein, 156 aa, Heterodera glycines
  Homolog annotation: Hit_ID=EAL17549.1; Match level="QueryCoverage =71%, HitCoverage=10%, E-value=2e-12, Identity=39%"; Hit description =hypothetical protein CNBM1150 [Cryptococcus neoformans var. neoformans B-3501A]
  Coding regions on vcDNA: vcDNA=SeqID_93384; Strand=+; Position=3-470
VLSYEPELAVLAASAYLSDVIYAIRASEAALMKKRKGPAVTSKAATILVATTYPAWQEELLDVIRQVYKGTGNDWKGKDLAALKAAGLLKNKKAMPFVNEIKKQLAIVGEEAFNRTLAFDEEQVVRENLLVIQRRVGFDLIRGRVDDRARGGVMRR

SEQ ID NO: 166962 - protein, 217 aa, Heterodera glycines
  Homolog annotation: Hit_ID=NP_502262.1; Match level="QueryCoverage =100%, HitCoverage=38%, E-value=4e-39, Identity=39%"; Hit description= solute family 5 member (64.3 kD) (4M703) [Caenorhabditis elegans] emb|CAA98070.1| Hypothetical protein Z
  Gene Ontology: Mol. function=iodide transporter activity; Cellular component=integral to membrane; Biological process=transport
  Coding regions on vcDNA: vcDNA=SeqID_93385; Strand=+; Position=1-651
IWTDTLQAGFIYGGLAVIIVRGTAQAGGLTNVLAINQRTGRLWSAFRVHPSLLQYNNLWVAMFGGILQWTCIYGLNQMAMQRYCSMPSLRHARVVLSLTMPANLLIQLMIGYIGLLMAAYFDQCNPLALGEVETVDQVTILMASRIFEGVPGLPGLFLATIFSATLSTASSGINSLTAILWEDFLKVPLKDLSDAHKSCAMKGISVFFGALATVMAF

SEQ ID NO: 166963 - protein, 140 aa, Heterodera glycines
  Coding regions on vcDNA: vcDNA=SeqID_93386; Strand=+; Position=112-534
RRPTTANKAVPRRRALRRHRVSTAASLPPAHLRPLLLKKQWRQSERSDGRHSHRKFSWSATRRAEPAAMRTKRRRAAATEEDGETEAETDETDAEERRKGKEMQSQPMTIFYVYEELIMHFLIVQNVCDLLSSIVDFFKV

SEQ ID NO: 166964 - protein, 175 aa, Heterodera glycines
  misc_feature (124)..(124): Xaa can be any naturally occurring amino acid
  Homolog annotation: Hit_ID=CAE59244.1; Match level="QueryCoverage =100%, HitCoverage=17%, E-value=5e-78, Identity=75%"; Hit description= Hypothetical protein CBG02570 [Caenorhabditis briggsae]
  Gene Ontology: Mol. function=electron transporter activity; Cellular component=mitochondrion; Biological process=glycine catabolism
  Coding regions on vcDNA: vcDNA=SeqID_93387; Strand=+; Position=3-525
QRKICLIPISAHGTNPATAHMSNFRVVPVESDKHGNINYKDLSAKCEKHGAELACAMITYPSTHGVFESNILDVCQKVHEFGGQIYLDGANFNAQVGLCRPGDYGSDVSHFNLHKTFCIPHGGXGGPGMGPIGVKAHLAPFLPGHPIVPIKGNRSGAVAASPWGSSSILSITWTY

SEQ ID NO: 166965 - protein, 143 aa, Heterodera glycines
  Homolog annotation: Hit_ID=CAE72928.1; Match level="QueryCoverage =98%, HitCoverage=28%, E-value=1e-42, Identity=50%"; Hit description =Hypothetical protein CBG20248 [Caenorhabditis briggsae]
  Gene Ontology: Mol. function=zinc ion binding; Cellular component =ubiquitin ligase complex; Biological process=ubiquitin-dependent protein catabolism
  Coding regions on vcDNA: vcDNA=SeqID_93388; Strand=+; Position=233-661
VRLLWHHLFCRQCWSNYLSCKILGEGRPYVTCPELRCTIVADDEFVLKNVDNKQALRSYHKLVLNSFVECNTLIKWCPAPECGRAVKVPHSEPRKILCKCGCLFCFSCSQQWHEPINCDLLKKWQKKCIDDSETSNWLSANTK

SEQ ID NO: 166966 - protein, 175 aa, Heterodera glycines
  Coding regions on vcDNA: vcDNA=SeqID_93389; Strand=+; Position=1-528
QKSQITFAPVSSYTLRKQKRPISRSTEEPPPVLTKGSETEFDNCEEPPPPLLEAETATDGDGSEHDFVQNGSIKSVRDLSVIMTSAAEIGRAAEDSAAGCDPPAEPFILESRHLPSWFRNCPGCHPDQNSELLFRGRIAGGPQSGPIVSIECAFCGSRFITAIVTGNGDRRGLKV

SEQ ID NO: 166967 - protein, 193 aa, Heterodera glycines
  Coding regions on vcDNA: vcDNA=SeqID_93390; Strand=+; Position=3-584
SCRGHHVQPPAHQRFGAVLSPTPPPSAYPSAGVVISSKVPPFFRSVPPASPFVCPAPPSVVLSQPPPMGSPLPQRAQLSRAQLLSRHSRDVEARKFAVKLYHLQRTIKALVYKNGALADELARLNQRINTVTTERKMLAKRLQHHERNRIRRIQSQYRKAIAAANNKQQSNAVEALLDEFGGEGRNVAQPKKS

SEQ ID NO: 166968 - protein, 123 aa, Heterodera glycines
  Coding regions on vcDNA: vcDNA=SeqID_93391; Strand=-; Position=34-405
SHHHRFVLHDHGHAQKLRSAASPSNPLVPAAICSNCLTLLSKAHRCRGRNGVKRHKQQITTMAHTTTRASKTETPMMIHNLTLRPAISFVEVFSSVGFLSLTRGAPWQQLKTIRVMNNRRRAF

SEQ ID NO: 166969 - protein, 135 aa, Heterodera glycines
  misc_feature (50)..(50): Xaa can be any naturally occurring amino acid
  Homolog annotation: Hit_ID=AAN05593.1; Match level="QueryCoverage =92%, HitCoverage=49%, E-value=6e-43, Identity=62%"; Hit description =ribosomal protein S4 [Argopecten irradians]
  Gene Ontology: Mol. function=structural constituent of ribosome; Cellular component=eukaryotic 48S initiation complex; Biological process=protein biosynthesis
  Coding regions on vcDNA: vcDNA=SeqID_93392; Strand=+; Position=3-409
TFRLLYDVKGRFVIHRIQSREGQYKLCKVKKQAVGDKQVAYDARTIRYPXPHIKADDTVVIDIGTGKVTDYVKFDAGNICMICGGHNIGRVGIVGHRERHPGSFDIVHIKDSAGHGHSFATRCGIISPICSTIFR

SEQ ID NO: 166970 - protein, 143 aa, Heterodera glycines
  Homolog annotation: Hit_ID=AAL78214.1; Match level="QueryCoverage =93%, HitCoverage=68%, E-value=8e-34, Identity=49%"; Hit description =putative esophageal gland cell protein Hgg-20 [Heterodera glycines]
  Coding regions on vcDNA: vcDNA=SeqID_93393; Strand=+; Position=172-600
MDQIGGTFSDQIWLDTLAWIGRGEVGWHLALVNARFAALVNMQLQQRRWCLEEFHISERKPKRTGAEVLSLANNGSYFSLPLATSPLPDSVVGFNGTFNIWYLDAEVINFLQRFRRLFNTYISLKFTIPITEFRAWQAVARHI

SEQ ID NO: 166971 - protein, 47 aa, Heterodera glycines
  Coding regions on vcDNA: vcDNA=SeqID_93394; Strand=-; Position=49-192
KKMEFLTLIKTEKESAIQAYKPMSQLNSVSQKKEKDRQTQQLLVIRK

SEQ ID NO: 166972 - protein, 159 aa, Heterodera glycines
  Coding regions on vcDNA: vcDNA=SeqID_93395; Strand=-; Position=0-476
QLVANFAAVFAAPSHFAVVPKMCREKQREKATEKVPRYYLNLMALSSALDTVGFGSSAAVVAKHWPNFGPTRQKKVEGGKRCPWTYRLLREKCRLCVALTDSDGQTTGTRRRRENPPGEGAQRHPKTAPFYDGGQRPRGHSDALLKLSSGERRTSMKNG

SEQ ID NO: 166973 - protein, 190 aa, Heterodera glycines
  Homolog annotation: Hit_ID=EAL32167.1; Match level="QueryCoverage =91%, HitCoverage=44%, E-value=9e-53, Identity=59%"; Hit description =GA22116-PA [Drosophila pseudoobscura]
  Coding regions on vcDNA: vcDNA=SeqID_93396; Strand=+; Position=76-645
HSSRNVFAYFVSSDTSQPAIFFRDPHVEDDLRYNGPLDNLDSVKKWLTDKCVPLVREITFDNAEELTEEGIPFLILFRIPGDLQAERTFTDIVTTELEDQKNAVNFLMADGKKFAHPLHHLGKSERDLPLIAIDSFRHMYLFPDMKQFGVKGHLRQFVLDMHSGKLHREFHQWPDPTEQPAPTTTQPPAS

SEQ ID NO: 166974 - protein, 152 aa, Heterodera glycines
  Coding regions on vcDNA: vcDNA=SeqID_93397; Strand=+; Position=1-456
AVEKEEEEYGSKQLIPCAPYARLLLFGTPSAIQSAQLAQLRALVPGAQLAVANCRPGLDTDEAVEEEIVALGASHLVFVHGADGETRDAWEAGGPANLRENVRVNLFSPWLLSNICDRFGIVFIEFDGEGKNCCNSNGKVPTNADALQMSRY

SEQ ID NO: 166975 - protein, 200 aa, Heterodera glycines
  Homolog annotation: Hit_ID=AAL78214.1; Match level="QueryCoverage =73%, HitCoverage=80%, E-value=9e-11, Identity=27%"; Hit description =putative esophageal gland cell protein Hgg-20 [Heterodera glycines]
  Coding regions on vcDNA: vcDNA=SeqID_93398; Strand=+; Position=16-615
MAPVKKRKKLSSTDQRPISATVTNQQKPLGSFVTFGKRRSLRVAMKTKSRRWLCNDIWMDILPLFRRPQLGRKLALLSPRFNALVDKHFDSKNELTILKQIRIARNGTKLLSVVTKSNPLPNKIRFDNLRIEYIDHSVIEFLRSNKQIFAKGTNMDLYLDFDDVYDNNGIVQPIWSVFAREFWPIFAPNIRHLTVPIGHQ

SEQ ID NO: 166976 - protein, 155 aa, Heterodera glycines
  Homolog annotation: Hit_ID=XP_310712.1; Match level="QueryCoverage =80%, HitCoverage=22%, E-value=3e-11, Identity=29%"; Hit description =ENSANGP00000021988 [Anopheles gambiae] gb|EAA06287.1| ENSANGP00000021988 [Anopheles gambiae str. PEST]
  Coding regions on vcDNA: vcDNA=SeqID_93399; Strand=+; Position=181-645
PTFCTHPKFFLWDFISDHSIHSLSFFPLFQDILLSLEALLRLCQTPVVAAGILHYLKTLLLREDLLAEPSSLHFALIDQIARVHPNLHSRVFNLLCDLYDHQSNRNEVAEVVMERQRHVVERFVHLLCCGMAISVVEKIIAMFKAGHIDISLVRY

SEQ ID NO: 166977 - protein, 166 aa, Heterodera glycines
  Coding regions on vcDNA: vcDNA=SeqID_93400; Strand=+; Position=1-501
ILSGLVYDGDSLLRIGNGICASTFPIERKPSGGHAADNSTVSAFVTVAFHRDDDIKRSSAECPLLWFGHRLATIAQGHAQFHSLWHFPLFSAHPNPSESLRETLDTINRLGQNEPQKSDKTKPRSDQQLLSIEEVLQKVDAKKLREMREKFIKMPMEEKESGKPSK

SEQ ID NO: 166978 - protein, 120 aa, Heterodera glycines
  Coding regions on vcDNA: vcDNA=SeqID_93401; Strand=+; Position=1-363
IYFKIQNKMVIDGLRDCLLQVLRDYALRVGLLEHSNSVASSDTFALFQRRLRPEPFVAGTHGMVTELRCEICFDPLVSPSASAPVGDVRLLVNGSAVHEKCHGQKQMPNAKALYEERRNE

SEQ ID NO: 166979 - protein, 183 aa, Heterodera glycines
  Coding regions on vcDNA: vcDNA=SeqID_93402; Strand=-; Position=2-550
KNQIMTNLIICRRLLPLLLLLSLLNMVMVRLQELAVLLAQHTERVHVRVRQPRHRVNVTRALSTDCAHAELPWLQLWKALLGWRWFGHKCDEMLSVPCPQLAHTRPVQRESLCRFLMALPPLQFHVLKTLQRRNVQLGRMFCFLQPFTLRLRITCIFGHRFPIDAGNGPIFVVLQPIAFGSIA

SEQ ID NO: 166980 - protein, 203 aa, Heterodera glycines
  Homolog annotation: Hit_ID=CAE56905.1; Match level="QueryCoverage =100%, HitCoverage=51%, E-value=6e-76, Identity=65%"; Hit description= Hypothetical protein CBG24746 [Caenorhabditis briggsae]
  Gene Ontology: Biological process=cysteine metabolism
  Coding regions on vcDNA: vcDNA=SeqID_93403; Strand=+; Position=3-611
FQRPLELGADVVMHSLTKYINGHTDVLMGAMVTNNDQLDQHLKSQQITAGAAPSPFDVYLVIRGIKTLHLRMRQHMENALAVARWLEKDPRVEKVLYPELESHPQHKIHKKQSSGMSGMVSFYMRADADRARKFLANLKLFTLAESLGGFESLAELPAVMTHASVPEQMRNLIGISDNLIRLSVGCEDKTDLINDLDMALNLA

SEQ ID NO: 166981 - protein, 79 aa, Heterodera glycines
  misc_feature (58)..(58): Xaa can be any naturally occurring amino acid
  Homolog annotation: Hit_ID=AAC48358.1; Match level="QueryCoverage =100%, HitCoverage=61%, E-value=5e-21, Identity=53%"; Hit description= cuticle preprocollagen [Meloidogyne incognita]
  Gene Ontology: Mol. function=extracellular matrix structural constituent; Cellular component=collagen type IX; Biological process= cuticle biosynthesis (sensu Nematoda)
  Coding regions on vcDNA: vcDNA=SeqID_93404; Strand=+; Position=2-237
PACPPGEVGAPGIPGHPGAPGQPGTDGQSCPKGPPGGPGQPGNGGTPGHAGQPGQSGXPSDSNGMCPLYCARDRGWLFE

SEQ ID NO: 166982 - protein, 216 aa, Heterodera glycines
  Coding regions on vcDNA: vcDNA=SeqID_93405; Strand=+; Position=3-650
PLFAACQINFAIDDTLTIFNSTLEPILRNIWPMIATNVCAIQLSAEVFRRLRHFEPSILNDCPSLRVFNAYYFGFFTQFPCDDSAAASDGQTVAKWLFTPRPDDVPKVFKCWLQWDDGHLASSIEDFKREFTNASSPVNFIAVIRFPPTFADSVLLFDLTNGFTHEQLTLTWMNDIGRFLLIRRPIVRDTNKWAKWEKEAIGWQFYDQWNRIDIRS

SEQ ID NO: 166983 - protein, 86 aa, Heterodera glycines
  misc_feature (66)..(66): Xaa can be any naturally occurring amino acid
  Homolog annotation: Hit_ID=CAB88203.1; Match level="QueryCoverage =97%, HitCoverage=28%, E-value=9e-09, Identity=41%"; Hit description =putative cuticular collagen [Globodera pallida]
  Coding regions on vcDNA: vcDNA=SeqID_93406; Strand=+; Position=2-262
THSALESASVRSVVYIIHTGHSVISVHSDKTHENNKARHRLEVFRVHTHSVYSDYIDAQGVETPAXNPRDNPLIYIFCAKPTVPRL

SEQ ID NO: 166984 - protein, 181 aa, Heterodera glycines
  Homolog annotation: Hit_ID=NP_505526.1; Match level="QueryCoverage =100%, HitCoverage=29%, E-value=4e-57, Identity=60%"; Hit description= zinc finger protein 277 (71.1 kD) (5K268) [Caenorhabditis elegans] emb|CAA94823.1| Hypothetical protein
  Coding regions on vcDNA: vcDNA=SeqID_93407; Strand=+; Position=2-544
NSVSNGEYADCDEMELDEPFSESEGEDFPQAKGVEKPCLVIPRGRIRSLSGTIPPVGFAPHWGGPTMCLSCFQFFQLPEMICEFSTHLLTEHQIFIDGMDIIVDLKRYIEYWRQQFAKRNIAEIFPKICPKPEDDVFGKVGFYFLMDESVKEDYGLRQRLAMRRLEEALACQQREREDSVF

SEQ ID NO: 166985 - protein, 156 aa, Heterodera glycines
  Coding regions on vcDNA: vcDNA=SeqID_93408; Strand=+; Position=32-499
MDAVFLEKLSEGGLLNGEQLNELDTDEVRKLVEIQFRKDGATLRGVEHLIIRVEAKVSRNELRLLFVFYLELLRQCVVQNSEMDDFCSDQTTRQFLLQFQFILTEERADDRQQNWVQLLLGEMICKMFVEMGRTAAASSASPFCYEIAKQHISALL

SEQ ID NO: 166986 - protein, 205 aa, Heterodera glycines
  Homolog annotation: Hit_ID=NP_490989.1; Match level="QueryCoverage =98%, HitCoverage=28%, E-value=5e-23, Identity=31%"; Hit description =probable atp-dependent RNA helicase Ddx10 (82.6 kD) (1D65) [Caenorhabditis elegans] gb|AAF60456.1| Hypoth
  Gene Ontology: Mol. function=ATP dependent RNA helicase activity; Cellular component=nucleolus; Biological process=nucleobase, nucleoside, nucleotide and nucleic acid metabolism
  Coding regions on vcDNA: vcDNA=SeqID_93409; Strand=+; Position=1-615
DYIHRVGRTARMNRKGEAMLMLTPSQEPFVALLRQRNVPVTKVTVDSNKVFDVRNKITNLMVPFPSVKQFAQQSLIAYAKALYFSELKEVFDVQSIDFDALSRSYGLVVTPRIRFLRKKGIMTRKYVEFEKGTSPEMATKTEEILLGNPSGSGGKNPFDIQCQNEMEEEEPFLKVSRRDVFNSITEVDMKEEILSRISSKKPISK

SEQ ID NO: 166987 - protein, 97 aa, Heterodera glycines
  misc_feature (52)..(52): Xaa can be any naturally occurring amino acid
  Homolog annotation: Hit_ID=NP_507514.1; Match level="QueryCoverage =89%, HitCoverage=18%, E-value=4e-09, Identity=39%"; Hit description =ubiquitin specific protease 8 (5S413) [Caenorhabditis elegans] emb|CAC14405.1| Hypothetical protein Y59A8
  Gene Ontology: Biological process=positive regulation of body size
  Coding regions on vcDNA: vcDNA=SeqID_93410; Strand=-; Position=2-293
AAVTFDVNELDLSPYVHEKSPLFNAAFSLYAITVMTKIILLITLICLKTPLXHSGRLNSGHYTSAVVNLISTDREWLSFDDESCMPCVAPSPTVRIS

SEQ ID NO: 166988 - protein, 108 aa, Heterodera glycines
  Homolog annotation: Hit_ID=AAO33477.1; Match level="QueryCoverage =73%, HitCoverage=32%, E-value=3e-18, Identity=56%"; Hit description =gland-specific protein g4g05 [Heterodera glycines]
  Coding regions on vcDNA: vcDNA=SeqID_93411; Strand=+; Position=157-483
IEKQQTQQNPKAETASTKLPLDYDLQRVAAKAAGNVYAWLPADKQPKKLADIKPAAPAAPLPPADYDVERVAEKAAESVYSWLPKELQPEMMTEDERVEFTAEVFQDI

SEQ ID NO: 166989 - protein, 138 aa, Heterodera glycines
  Homolog annotation: Hit_ID=NP_505381.1; Match level="QueryCoverage =79%, HitCoverage=33%, E-value=7e-31, Identity=60%"; Hit description =rhodopsin-like GPCR superfamily (5J675) [Caenorhabditis elegans] pir||B89153 protein C24B5.1 [imported] -
  Coding regions on vcDNA: vcDNA=SeqID_93412; Strand=+; Position=162-578
MGSSKENDGLSVAGRAKAANRLEVTDAATRQKLKRHNLRYTDLQLTRSLLVVTTVFIVLNLPNYVYRISIQFFVISEQINLSFAAHVLLYTHHAILFYIYIFNSPQMRKRLIPTALKLLECYCLKPRHLNDFSDNLFQ

SEQ ID NO: 166990 - protein, 197 aa, Heterodera glycines
  Homolog annotation: Hit_ID=AAS54408.1; Match level="QueryCoverage =87%, HitCoverage=33%, E-value=6e-31, Identity=42%"; Hit description =AGL082Wp [Ashbya gossypii ATCC 10895] ref|NP_986584.1| AGL082Wp [Eremothecium gossypii]
  Gene Ontology: Mol. function=UTP-glucose-1-phosphate uridylyltransferase activity; Biological process=embryogenesis and morphogenesis
  Coding regions on vcDNA: vcDNA=SeqID_93413; Strand=+; Position=56-646
MENESQGAHLMDQLDSVIPSLVNPSECQSEKDLALFRQLFRQFLEDPHKVNWQEIQPMAKEKQMPYEHLPKVEGSEERRAILERIAVIKLNGGLGTTMGCSGPKSLVQLRDGLTFLDFALQQHRILLNCADLRSPVPLLLMNSFNTDAQTKAFLWAQNANSVAAVKCFCQSKCPRIFADSLRPVPNSWDDRAEEGWY

SEQ ID NO: 166991 - protein, 188 aa, Heterodera glycines
  Homolog annotation: Hit_ID=NP_508777.1; Match level="QueryCoverage =100%, HitCoverage=44%, E-value=1e-39, Identity=44%"; Hit description= target of (48.5 kD) (XF138) [Caenorhabditis elegans] gb|AAK39154.1| Hypothetical protein C07A12.7a [Caen
  Gene Ontology: Cellular component=endosome; Biological process =endosome transport
  Coding regions on vcDNA: vcDNA=SeqID_93414; Strand=+; Position=3-566
IVQERVLGIIQSWADAFRDDPALSGVVELYDEFRAKGVEFPATNIDAMAPIVTPKQTVFPLADDQSQQQNGKSVVQTFPKPDRPPFVPPQQFVGSVGPEQMAKLRSELDIVQVNLTVLRELVAQMKPTNDGGVTEAPEDFHFVRGLHSTCKEMQKRIVELIPSVSNEEVTLELLSVNDELNTTFEKYD

SEQ ID NO: 166992 - protein, 143 aa, Heterodera glycines
  misc_feature (23)..(23): Xaa can be any naturally occurring amino acid
  misc_feature (61)..(65): Xaa can be any naturally occurring amino acid
  misc_feature (94)..(94): Xaa can be any naturally occurring amino acid
  misc_feature (98)..(98): Xaa can be any naturally occurring amino acid
  Coding regions on vcDNA: vcDNA=SeqID_93415; Strand=-; Position=2-430
PNKKKRKGGGGGGGAKEKKKKKXWGGGGGGEINNLFFFFFFFTPPHQNIFFFLPPPPFFFXXXXXGGGGRKKKKRGGFFFFLKKKKKNFFFFLXYQPXWSCFCSSVNSKLNPIENDDENNFEELENGRLNMHFDQWTNGCIIS

SEQ ID NO: 166993 - protein, 110 aa, Heterodera glycines
  Homolog annotation: Hit_ID=AAQ82688.1; Match level="QueryCoverage =77%, HitCoverage=9%, E-value=6e-10, Identity=52%"; Hit description =Epa4p [Candida glabrata]
  Coding regions on vcDNA: vcDNA=SeqID_93416; Strand=+; Position=298-627
SPRLLNYIKFLAKKRHNFCHISFVQSSYSSCSTCGGSSYSSYPSSSYSSYPASSSSYSSYPASSSSYSSYPASSSSYSSYPSYSSSSSCSTCGLSGYSNSWNNGGSSSNT

SEQ ID NO: 166994 - protein, 213 aa, Heterodera glycines
  Homolog annotation: Hit_ID=CAE71877.1; Match level="QueryCoverage =100%, HitCoverage=43%, E-value=1e-71, Identity=58%"; Hit description= Hypothetical protein CBG18932 [Caenorhabditis briggsae]
  Gene Ontology: Mol. function=aldehyde dehydrogenase activity; Cellular component=cytoplasm; Biological process=acetaldehyde metabolism
  Coding regions on vcDNA: vcDNA=SeqID_93417; Strand=+; Position=1-639
AWGKWLNCGQTCLAPDYVMVTNEMKPRLVEELKAVLVEYYGTNPETSKDYSRVINEAHFDRICALLKNSVGIEICKMGQPNREDLFIPPTILEVQTDDALMQSEIFGPILPFLIVRSFDEAIDIIKRGEKPLAAYLFTRDERKVNRWVAETHSGSVCVNDVMLQITVDTLPFGGVGESGRGSYRGKFGFDEFTHQKAVLKRCFFGDGIAAGRY

SEQ ID NO: 166995 - protein, 145 aa, Heterodera glycines
  Homolog annotation: Hit_ID=AAD11968.1; Match level="QueryCoverage =95%, HitCoverage=62%, E-value=1e-20, Identity=33%"; Hit description =P22U [Dirofilaria immitis]
  Coding regions on vcDNA: vcDNA=SeqID_93418; Strand=+; Position=2-436
SHLSSLGGNFRQVKACFTPKENLLSSAMRCTKRQHDNACSHSSADLFGPKRYCQTLENQAMVEIDRMIVRMGLDKSGSMKKLVSASKKLYGCLKQCMANKAGNCEKQLKCGLLMPSDSAMVQNTTSCALNNGFNTATAQQNGHLC

SEQ ID NO: 166996 - protein, 69 aa, Heterodera glycines
  Coding regions on vcDNA: vcDNA=SeqID_93419; Strand=-; Position=1-207
TDCEENWSNLWNGFNKTVKIRFDELFATTLRRYKKFFNLPNRSGANSKAQLLEGINDHFESIPVDLAET

SEQ ID NO: 166997 - protein, 205 aa, Heterodera glycines
  Homolog annotation: Hit_ID=NP_495841.1; Match level="QueryCoverage =88%, HitCoverage=26%, E-value=7e-12, Identity=27%"; Hit description =initiation factor eIF-2Be (75.5 kD) (2I953) [Caenorhabditis elegans] emb|CAA91063.1| Hypothetical protein
  Coding regions on vcDNA: vcDNA=SeqID_93420; Strand=+; Position=3-617
AFSVSPSKSLSNLLLDDSPSDESADERDDQTDFCGQRQQIGDTHSHSSFVAEVVDSLQGALEDGFLRENEKAKLSGDLLNKIKLEVNASKLAYNIPAEEVPGLLFTAFLSLPGVVDKFSEFTKMYNHWRGLWKMFYRTTFAQSQMLFAIEEKASDSDRFRRVLPKVLYFLSQEVKAMDDALIVDWYSNLEEKSQLKKEEKLAELV

SEQ ID NO: 166998 - protein, 83 aa, Heterodera glycines
  misc_feature (19)..(19): Xaa can be any naturally occurring amino acid
  misc_feature (44)..(44): Xaa can be any naturally occurring amino acid
  Homolog annotation: Hit_ID=CAA65506.1; Match level="QueryCoverage =98%, HitCoverage=52%, E-value=2e-12, Identity=43%"; Hit description =cuticular collagen [Teladorsagia circumcincta]
  Gene Ontology: Mol. function=structural constituent of bone; Cellular component=Golgi apparatus; Biological process=epidermal differentiation
  Coding regions on vcDNA: vcDNA=SeqID_93421; Strand=-; Position=35-287
FGPVGPPRSPGQNPRVGPXFVDPRGPPGPRGYPGVRVHPELPGXFVQPGGPGHPGDAEKPATPGTPGEIGGPGFAGEIENMGT

SEQ ID NO: 166999 - protein, 165 aa, Heterodera glycines
  Coding regions on vcDNA: vcDNA=SeqID_93422; Strand=+; Position=63-557
MDIFPHFDRPQLGLKMALLSPRFNALVDKHFDGISQLTIWNAITIHRIGTKAKLVVEENNAKFPLPDHPLRNKIRFNYLQIEYIDYSVITFLRANQKIFDKGTDLNLFMPYYDHDDKNVQPIWDDFARAIWPIFAPNIRHLSFSDAHAFGNLRRHISPTILTDLN

SEQ ID NO: 167000 - protein, 159 aa, Heterodera glycines
  Homolog annotation: Hit_ID=NP_491174.2; Match level="QueryCoverage =74%, HitCoverage=25%, E-value=1e-40, Identity=62%"; Hit description =carboxypeptidase a2 family member (1E92) [Caenorhabditis elegans] gb|AAF60674.3| Hypothetical protein Y47
  Gene Ontology: Mol. function=lysine carboxypeptidase activity; Cellular component=extracellular space; Biological process=histone acetylation
  Coding regions on vcDNA: vcDNA=SeqID_93423; Strand=+; Position=2-481
ILGTDLRGRVPAMITMHAYSQLWIYPFSHRRGVYPADVEELKAVARRAVTALAEKFGTNYQYGTGPETIYAYTGGSADWAKETAKVKYTYTLELRPSYWSWNGFVLDRAQLIPTARETFDGVFGGDGTSRKGNDRANGAQSERRGSVRPPFHFVCPSFC

SEQ ID NO: 167001 - protein, 112 aa, Heterodera glycines
  Homolog annotation: Hit_ID=NP_499993.1; Match level="QueryCoverage =75%, HitCoverage=29%, E-value=8e-13, Identity=40%"; Hit description =Enoyl-Coa hydratase (4B551) [Caenorhabditis elegans] gb|AAK29838.1| Enoyl-coa hydratase protein 5 [Caenor
  Coding regions on vcDNA: vcDNA=SeqID_93424; Strand=+; Position=277-612
MGSITQLSSVEQHKCALLHTNGGPAVAPAAPLTLEPLAGPDTGILVARISVPSTRNAFSRALAQAFRDMVDQLRYGLETRALILTSSVPQAFCSGVDLKERRKMTSNEVTTF

SEQ ID NO: 167002 - protein, 162 aa, Heterodera glycines
  misc_feature (152)..(156): Xaa can be any naturally occurring amino acid
  Homolog annotation: Hit_ID=CAB88203.1; Match level="QueryCoverage =100%, HitCoverage=54%, E-value=2e-44, Identity=57%"; Hit description= putative cuticular collagen [Globodera pallida]
  Coding regions on vcDNA: vcDNA=SeqID_93425; Strand=+; Position=2-487
QETHIVLGIASVCSLLAIIATVVTLPSLYSEMSQMNSKVRDGVEAFRVNTDSGWTDWMEVQGVVNPPFKPPGNPFQSIFSWQRKWAGNCQGLGLPKPNCPFGPPGPSGTLGNPGNPGGRENPENLEKLGKPLFLGPAKKTPPPSFLGPPPPXXXXXPSVGPP

SEQ ID NO: 167003 - protein, 81 aa, Heterodera glycines
  Coding regions on vcDNA: vcDNA=SeqID_93426; Strand=+; Position=1-246
VQPPFTETVRRDGAELIVFLESVLLQTIGFDLQVELPHPLVLHHMNCYAGGNSAISRCAYWFASEMIRLKSIRIFVSPPPS

SEQ ID NO: 167004 - protein, 96 aa, Heterodera glycines
  Homolog annotation: Hit_ID=CAE69711.1; Match level="QueryCoverage =81%, HitCoverage=65%, E-value=7e-14, Identity=53%"; Hit description =Hypothetical protein CBG15980 [Caenorhabditis briggsae]
  Gene Ontology: Biological process=anti-apoptosis
  Coding regions on vcDNA: vcDNA=SeqID_93427; Strand=-; Position=204-494
SASTGAVPTAQKGDGVVAIDSKIEQAMDLVKSHLIYAVRDEIELLRARIVHLEATVIRLEAENAILREHIPRDVLDRICLPHHFPSGAASVASIAQ

SEQ ID NO: 167005 - protein, 178 aa, Heterodera glycines
  Homolog annotation: Hit_ID=NP_496915.1; Match level="QueryCoverage =100%, HitCoverage=22%, E-value=5e-36, Identity=44%"; Hit description= repetitive proline-rich cell wall protein 1 like family member (2O209) [Caenorhabditis elegans] emb|CAB0
  Coding regions on vcDNA: vcDNA=SeqID_93428; Strand=+; Position=2-535
GQPLYFTRENVTERYGEYETRKIDLWEKFMSTFSEKQKFELNRTGFVPMRPEQMRMIYGAQSPFNDTEALHRLSSLNETQIHEGMERDIHNIARLKQWRLQYHPRAEFHSRRRRAVVLSPIVSSPFVLAAPGLSQAVILSPVVLSPVILTPAVFGPFILSPWVFVPVVLSPRVLSPFV

SEQ ID NO: 167006 - protein, 192 aa, Heterodera glycines
  Coding regions on vcDNA: vcDNA=SeqID_93429; Strand=+; Position=40-615
NFKMSSAGSTNGLKMNDQQQQQESVPDSEVIRQLRAKIAELEAANLRMSSSTASFDVFSSPNGDDENDSFEGQNEQNGGEHNDKRIEQLEKMMLQMEINHQQLLTEHNSLREKMAQMEKEQRKMAGRQQNDNTELCAAFEALKQKQTSDSEQMNTVREEILVKIDELVELSINNLAFRHKFAAMENIVGILK

SEQ ID NO: 167007 - protein, 55 aa, Heterodera glycines
  Coding regions on vcDNA: vcDNA=SeqID_93430; Strand=-; Position=0-164
QLTQPTCHTVSALLSVITDPTMFDDFGQCVGRNPFECAISSMSLAVNCRVPLACS

SEQ ID NO: 167008 - protein, 152 aa, Heterodera glycines
  misc_feature (38)..(38): Xaa can be any naturally occurring amino acid
  Coding regions on vcDNA: vcDNA=SeqID_93431; Strand=+; Position=3-461
TNKLFIMKRPSSVVAFGSHLFVGFILLSLFIGTLGTEXKETKPAAAHSPADAKHPPPVAAHAAAGRGHAFDPKPASPSPLGLLVLVPRLIRPMGGPPTGAEPKMGGGSRFKKYRRGPHKVFLGVVGKKKISSRPPEKIAPREKFLRGLPWKK

SEQ ID NO: 167009 - protein, 216 aa, Heterodera glycines
  Homolog annotation: Hit_ID=NP_510079.1; Match level="QueryCoverage =58%, HitCoverage=54%, E-value=4e-13, Identity=37%"; Hit description =hemoglobin C1 polymer like (XM994) [Caenorhabditis elegans] emb|CAA92164.1| Hypothetical protein F19H6.2
  Coding regions on vcDNA: vcDNA=SeqID_93432; Strand=+; Position=6-653
MGNKQMANANTATRAFSTQSPPTAKKVANHRLNRRRSDFQQNSKRSAEQTKGDRHNNNIGTPSNGSGDLPMNSAAERARQRRRCSSAALVAARNGAIQRPKRMTPRQCHLVIKSWSKKSPKNRMAKDIFEAIFVEAEELKATFGIEKGSNGKRLRMEPNFVAHTNMFADTLDFVIRNLDDLSLVTENAEQLGRRHAAFPVEGGFKTEYWNMFTECI

SEQ ID NO: 167010 - protein, 93 aa, Heterodera glycines
  Coding regions on vcDNA: vcDNA=SeqID_93433; Strand=+; Position=6-287
MLSSSACCTLLAALISAAFFAMANAQTVKQCLCSEIQPCSEKYMNTWKTCMQQCKGHFSSVGGDVEKLGHCLDSNQALLQSTIRCTQSHGDES

SEQ ID NO: 167011 - protein, 93 aa, Heterodera glycines
  misc_feature (27)..(27): Xaa can be any naturally occurring amino acid
  misc_feature (63)..(63): Xaa can be any naturally occurring amino acid
  Homolog annotation: Hit_ID=BAB84191.1; Match level="QueryCoverage =100%, HitCoverage=14%, E-value=1e-17, Identity=52%"; Hit description= flavoprotein subunit of succinate dehydrogenase [Ascaris suum]
  Gene Ontology: Mol. function=succinate dehydrogenase (ubiquinone) activity; Cellular component=mitochondrial inner membrane; Biological process=tricarboxylic acid cycle
  Coding regions on vcDNA: vcDNA=SeqID_93434; Strand=+; Position=2-280
AGETSIANLDDLRNASGDVSTADLQLXITLRTMQKHAPCCSKRPPLLQEGIEKGRSLFGLQKXLRVSDRRLIKNSYLVETLELHNLLINALQT

SEQ ID NO: 167012 - protein, 74 aa, Heterodera glycines
  Coding regions on vcDNA: vcDNA=SeqID_93435; Strand=-; Position=84-308
FLFFYFFCVHLILIKCFSKSCELNIHFLISFNNSRPSVILFGRDLSLNTQWPNWPDDVWSWPQVMPCHFVFDVM

SEQ ID NO: 167013 - protein, 178 aa, Heterodera glycines
  Homolog annotation: Hit_ID=AAV34698.1; Match level="QueryCoverage =94%, HitCoverage=60%, E-value=1e-18, Identity=35%"; Hit description =IC5 [Globodera pallida]
  Coding regions on vcDNA: vcDNA=SeqID_93436; Strand=+; Position=1-534
DLEITDDKCLAVHYKENEYGRRSVFARHSLFPESALSGIFYFEVLVKSMKHIAFIGLSEKQHQISFDETIHCGTAIYEYASGGYLWISGSSRKSNAKYSFGVGDIVGCGVNLAIRQIFITKNGHLLASSKLFVPPPPASSSSSSSVFDLPLVPFVSLFSFDDRIEANFGPNFKFDFSI

SEQ ID NO: 167014 - protein, 206 aa, Heterodera glycines
  Homolog annotation: Hit_ID=AAO25690.1; Match level="QueryCoverage =55%, HitCoverage=60%, E-value=7e-12, Identity=41%"; Hit description =ankyrin repeat protein E3_19 [synthetic construct]
  Coding regions on vcDNA: vcDNA=SeqID_93437; Strand=+; Position=33-650
MNFLSKPAVSNSNSKVHMQTMTWKEFKADALKSDNELEREEVEPLFDPIYEKDTKRMKALIGTLSEEKRHRFLRTRYAPEGTNKTLTPLMLAAVLGTGEMVEILLESGADPNQMCVRKLKDARGSPIMTIVTPLWVGAKDGHFEVCQALVKHGANIDVGVPKFGLSPLMSACDSNARLDTVDLLIKSGANVNHSDPNGDTALMGAT

SEQ ID NO: 167015 - protein, 66 aa, Heterodera glycines
  misc_feature (10)..(10): Xaa can be any naturally occurring amino acid
  Coding regions on vcDNA: vcDNA=SeqID_93438; Strand=-; Position=2-199
GDGVGVRLGXGEEQFQRRKHSLLFGGRPKLIRRNFGPAKALCPQRVNRFGLLRFRFAIVWCEFRGV

SEQ ID NO: 167016 - protein, 159 aa, Heterodera glycines
  Homolog annotation: Hit_ID=NP_509635.1; Match level="QueryCoverage =100%, HitCoverage=3%, E-value=1e-51, Identity=59%"; Hit description =high Incidence of Males due to increased X chromosome loss HIM-4, hemicentin, cell adhesion and meiotic c
  Coding regions on vcDNA: vcDNA=SeqID_93439; Strand=+; Position=3-479
QVFHLEKSHVNTVLEYVRHAVSQRKVHFLYEVREHGQTHTTSVPVDAFVSELTFSLAGERDDGAFLSISMVDPRNRTIEKSDYEHEQGIIDLTNVKLIRINDPLPGLWRVRTSSRLKHTLRVVGHGTIDFKYGFSSRPVPSVDLAHPRPIAGQITFLVV

SEQ ID NO: 167017 - protein, 119 aa, Heterodera glycines
  Coding regions on vcDNA: vcDNA=SeqID_93440; Strand=+; Position=34-393
MAPVKKKKKFSSANHRLISATEQQKPLGSFVTFGNRRSLRVAMKTKSRRWICNDIWMDILPLFRRRQLGLKMCLLSPRFTALVDKHFNGQSELTIWKPIRIDEKGTKASPFTKNLFPKK

SEQ ID NO: 167018 - protein, 162 aa, Heterodera glycines
  Coding regions on vcDNA: vcDNA=SeqID_93441; Strand=+; Position=3-488
EMPSNSTPFDEGKQQMAEKNKSIPSSSSISKFAPFSSSAAAEIPPEIAALSQLSISDSPKEPSVVVAANWTLWRYECRDLPEHRCQAKPCQFCEQVSKLKGVAKGKLSESTDRWDSYLKREKSYDDEHILIKVMEGFSPSKLAKDVFFNKKLGVALFRGDIE

SEQ ID NO: 167019 - protein, 193 aa, Heterodera glycines
  Homolog annotation: Hit_ID=NP_510790.1; Match level="QueryCoverage =100%, HitCoverage=94%, E-value=8e-81, Identity=78%"; Hit description= RAB family member (23.4 kD) (rab-6.2) [Caenorhabditis elegans] gb|AAC69020.1| Rab family protein 6.2 [Ca
  Gene Ontology: Mol. function=ATP binding; Cellular component=Golgi apparatus; Biological process=embryogenesis and morphogenesis
  Coding regions on vcDNA: vcDNA=SeqID_93442; Strand=+; Position=2-580
LLFLGEQSVGKTSLITRCMYDSFDNTYHATSGINFLSMTMYLEDRTVRLQLWDTAGQERFHSLIPSYIKDSTVADAAYDITNANSFHLTAGWIDDVRTERGSDVIIMLVGNKTDLADKRQVSTEEGEQKAKELNVMFIETSAKAGYNVKQLFRPIANALPGIEVEKAAVAQQLADIGPIKPPPIVTEKGSCWC

SEQ ID NO: 167020 - protein, 188 aa, Heterodera glycines
  Homolog annotation: Hit_ID=NP_506417.1; Match level="QueryCoverage =82%, HitCoverage=29%, E-value=1e-46, Identity=57%"; Hit description =WD-repeat protein (5O282) [Caenorhabditis elegans] emb|CAB02116.2| Hypothetical protein F53C11.7 [Caenorh
  Coding regions on vcDNA: vcDNA=SeqID_93443; Strand=+; Position=62-625
MTSTLRGFCLSPADQQTNLFSFCSEMATNASQKRKEIYRYKASFNVYAMGWSTKLDNHLKFLLAIGSFIEEYNNKVSIVQLHEDQGEFGHLGTFDHPFVPFNFLLFLPFSYPSTKVLWIPDPKSAFPDLLATTGDYLRIWRIGGHNGASLEVRLDNNRSSEYCAPLTSADWNEVDVSLIGTSSIGPNC

SEQ ID NO: 167021 - protein, 124 aa, Heterodera glycines
  Coding regions on vcDNA: vcDNA=SeqID_93444; Strand=+; Position=46-420
ERKRIGRPLGRGEAIGRRREIGRHRENESVNGIRQPKGQRQTERVFSFSTVDLIRTEAKMVTIGHNLLSHIPYNDHMAYKWDLQTLQGTRATGMKKNYLYSIKPSLTAAAGGPNVGESSFTAKE

SEQ ID NO: 167022 - protein, 159 aa, Heterodera glycines
  Homolog annotation: Hit_ID=NP_057032.2; Match level="QueryCoverage =78%, HitCoverage=31%, E-value=6e-38, Identity=59%"; Hit description =solute carrier family 35, member B3 [Homo sapiens] emb|CAC19504.1| OTTHUMP00000039206 [Homo sapiens] gb|A
  Coding regions on vcDNA: vcDNA=SeqID_93445; Strand=+; Position=3-482
KAMREYNASNDEMVLFSYSIGFAYILVGLCLSGQIGEAFLFFAQRPLQTYGYSVLIGIVGYFGVNVVLTMVRTSGALVTVTVTTMRKAVTIVFSFYFFAKPFTLGYLWGGLVVLLAIYLNVYTKNKKQFDAKLAEWWSNLAESNNGQKFAAERKLLLPV

SEQ ID NO: 167023 - protein, 94 aa, Heterodera glycines
  Coding regions on vcDNA: vcDNA=SeqID_93446; Strand=+; Position=265-546
ICFRLSGSRTCNSFDPLMAVACGAALASLVFTLKSNPDEIALRARLAQLRQQMVLIPASIHSTRADERLEQYTVLLNGNRLELVDFLLFSVLVE

SEQ ID NO: 167024 - protein, 71 aa, Heterodera glycines
  Coding regions on vcDNA: vcDNA=SeqID_93447; Strand=-; Position=315-530
SLSSSSSTSSVALSSSSSSSSSSSSSCSILAKSSSSSSGTCSSRDGIKVVEDGTISKFSAESFLELAHELL

SEQ ID NO: 167025 - protein, 190 aa, Heterodera glycines
  misc_feature (33)..(33): Xaa can be any naturally occurring amino acid
  misc_feature (178)..(178): Xaa can be any naturally occurring amino acid
  Homolog annotation: Hit_ID=EAK83732.1; Match level="QueryCoverage =100%, HitCoverage=39%, E-value=9e-60, Identity=64%"; Hit description= hypothetical protein UM02562.1 [Ustilago maydis 521] ref|XP_400177.1| hypothetical protein UM02562.1 [Ust
  Gene Ontology: Mol. function=proteasome endopeptidase activity; Cellular component=26S proteasome; Biological process=proteolysis and peptidolysis
  Coding regions on vcDNA: vcDNA=SeqID_93448; Strand=+; Position=65-632
MGNSQSGLPGFPPGQGGKKKPDDKEKKKWEPPXVATRVGKKKKKKGPDSINKLPPVFPTTRCRLKLLKLERIKDYLNIEEEFITNQEALKPVQEKEKLQAQLESGETAEPDERSKVDDLRGSPMAVGTLDEIIDDDHAIVSSTSGPEYYVSILSFVDKDLLEPGCTVLTHHKNNSIVXVLGDDADPTVSL

SEQ ID NO: 167026 - protein, 129 aa, Heterodera glycines
  Homolog annotation: Hit_ID=NP_068749.2; Match level="QueryCoverage =93%, HitCoverage=16%, E-value=2e-10, Identity=31%"; Hit description =Rad50-interacting protein 1 [Homo sapiens] gb|AAG42101.1| RAD50 -interacting protein 1 [Homo sapiens]
  Coding regions on vcDNA: vcDNA=SeqID_93449; Strand=+; Position=3-389
AVKSDSLARFLQLELCSALSTIFSRIHFPFEEPVDLNSLHFPLHQSAQIIKCLQLVTSETVATTSRSFYYQPKWPIELVLDEFRKRFDYHFYGDRPTNNATKPEWFFTQLSYCAENHIEYFEQHIQPIA

SEQ ID NO: 167027 - protein, 185 aa, Heterodera glycines
  Homolog annotation: Hit_ID=XP_308085.1; Match level="QueryCoverage =97%, HitCoverage=54%, E-value=6e-67, Identity=68%"; Hit description =ENSANGP00000019781 [Anopheles gambiae] ref|XP_307706.1| ENSANGP00000023501 [Anopheles gambiae]
  Gene Ontology: Mol. function=electron transporter activity; Cellular component=cytoplasm; Biological process=glucose metabolism
  Coding regions on vcDNA: vcDNA=SeqID_93450; Strand=+; Position=51-605
MVKFAPTVKLNNGQAFPVIGLGTWKSKPGEVEQAVKDAIDAGYRHIDGAFIYGNEVEVGNGIRAKIAEGVIKREDIFVTSKLWNTFHRPDLVVGAVKKSLQNFGLDYLDLYLIHWPVGYQEEGELFPRGADGKVFWSDVDYVDTWKELEKCVQLRLLKGIGLSNFNSEQVTRVLDRCHIKPGVNQ

SEQ ID NO: 167028 - protein, 164 aa, Heterodera glycines
  Coding regions on vcDNA: vcDNA=SeqID_93451; Strand=+; Position=3-494
EEELMSRLNLEEKNRALSHELREFGQRHHALQVRSDFEQQAAAREITVLRKAVGDVHDIQDQNDSLLHQNDSLLKTNEKLNKEIVMLKKWLRVLFWLLAVLLPPIAVFIRGIMSGLRCSAIGLRCIKCCLLCFCGWFPGIWYALNIVREQETNESNFSNHFFLT

SEQ ID NO: 167029 - protein, 154 aa, Heterodera glycines
  Homolog annotation: Hit_ID=NP_506041.1; Match level="QueryCoverage =71%, HitCoverage=18%, E-value=6e-25, Identity=48%"; Hit description =SPINL protein family member (58.1 kD) (5M597) [Caenorhabditis elegans] emb|CAB07311.1| Hypothetical prote
  Gene Ontology: Biological process=courtship behavior
  Coding regions on vcDNA: vcDNA=SeqID_93452; Strand=+; Position=1-462
GIGEASYAVIAPTIIADLFVGQMRSRILMFFYFAIPVGSGLGYVIGSSATSLAKSALGSVDCPFCWQWGIRVTPLLGFFCIITLLLFVKEPVRGQSEQSVAQLMPTNYETGTISPSSRRTVASAEAPNENIWKEYYHRIRTHTKSYCADIGHLI

SEQ ID NO: 167030 - protein, 103 aa, Heterodera glycines
  misc_feature (84)..(84): Xaa can be any naturally occurring amino acid
  Homolog annotation: Hit_ID=NP_497685.2; Match level="QueryCoverage =100%, HitCoverage=19%, E-value=3e-14, Identity=33%"; Hit description= putative protein family member, with at least 9 transmembrane domains, of ancient origin (58.0 kD) (3E37
  Coding regions on vcDNA: vcDNA=SeqID_93453; Strand=+; Position=2-310
WCDGLKQVDPRLYYALMITVIGSTFPLINVSMNTIFSAAVGPRLQAKQQSILMVSGGMGQMQDPLLIGHLVTFYRPKIIWILEXEPNTFTGTMWVVFYKRLVP

SEQ ID NO: 167031 - protein, 41 aa, Heterodera glycines
  Coding regions on vcDNA: vcDNA=SeqID_93454; Strand=+; Position=191-316
QTASNGFVGAQATWTYRKTPARIDPVGVLLGHPRCCCCCFC

SEQ ID NO: 167032 - protein, 166 aa, Heterodera glycines
  Coding regions on vcDNA: vcDNA=SeqID_93455; Strand=+; Position=3-500
GITLTMLHSIGHKEEDLNAFGTSVWPLLVAMNASDGIGKMHFEFPITFQLLRRSIGPFFAKHGACFPNLRMISFDFGILFEIPPAVDASALSSSSDDNDDGQVLCKWLHTPRADGQPKVLKMNFDYNFPIEKLKTLFLSATIAVSFIIWFHFFEHDADSNGDQFEL

SEQ ID NO: 167033 - protein, 31 aa, Heterodera glycines; identical to SEQ ID NO: 131563
  Coding regions on vcDNA: vcDNA=SeqID_93456; Strand=-; Position=18-113

SEQ ID NO: 167034 - protein, 70 aa, Heterodera glycines
  Homolog annotation: Hit_ID=NP_999495.1; Match level="QueryCoverage =98%, HitCoverage=12%, E-value=3e-14, Identity=60%"; Hit description =muscle phosphohexose isomerase [Sus scrofa] pir||NUPG glucose-6 -phosphate isomerase (EC 5.3.1.9) - pig em
  Gene Ontology: Mol. function=glucose-6-phosphate isomerase activity; Cellular component=cytosol; Biological process=neurogenesis
  Coding regions on vcDNA: vcDNA=SeqID_93457; Strand=+; Position=2-211
NLPTISIELTPLTPSTLGSLIAMYDYKIFVQRVLWGINSFYQWGVELGNHLASIILDDLQGGPIHEDDSG

SEQ ID NO: 167035 - protein, 180 aa, Heterodera glycines
  Homolog annotation: Hit_ID=EAK83802.1; Match level="QueryCoverage =90%, HitCoverage=83%, E-value=1e-48, Identity=55%"; Hit description =hypothetical protein UM02632.1 [Ustilago maydis 521] ref|XP _400247.1| hypothetical protein UM02632.1 [Usti
  Gene Ontology: Cellular component=microtubule cytoskeleton; Biological process=embryogenesis and morphogenesis
  Coding regions on vcDNA: vcDNA=SeqID_93458; Strand=+; Position=89-628
MMSSSSADPSTVPAIPPVDDDSLTEHEREERDRQARLKEEAEQAALPYKWRQTLQDVTVTIDLPKGTKARDLTVVMEKKKLKAGLKGKEPIMVGELHSAIKLDDSTWVIESGELIIQLEKVNKMEWWKNVLTHHPAIDTTKIQPENSRLDELDGETRGLVEKMMYDQRQKGMGKPPSDEQ

SEQ ID NO: 167036 - protein, 166 aa, Heterodera glycines
  Homolog annotation: Hit_ID=CAE60124.1; Match level="QueryCoverage =82%, HitCoverage=24%, E-value=2e-45, Identity=62%"; Hit description =Hypothetical protein CBG03667 [Caenorhabditis briggsae]
  Gene Ontology: Mol. function=ATP dependent RNA helicase activity; Cellular component=nucleolus; Biological process=ribosome biogenesis
  Coding regions on vcDNA: vcDNA=SeqID_93459; Strand=+; Position=3-500
LVEENLESTSNANSLIEPIIASPNAQGTVPLPFQFFESFSTFSWREIGISPWLIKQLNEFNLRRPTPVQANCIPKILEGSDVLGCAKTGTGKTLAFALPILQQLAVDPYGIFALILTPTRELALQIGDQFSAFGRQLKLQCSVIIGGRHQMAQAQELSRRPHIVIA

SEQ ID NO: 167037 - protein, 159 aa, Heterodera glycines
  Coding regions on vcDNA: vcDNA=SeqID_93460; Strand=+; Position=1-477
LHQNGHVRSNNQTKTGGPKNVPAKHCQGHSPSPKCFRANDKSLLNRFIFARFACDDPSVIPPFFASSQFGIDRAGGPIVLPDQVGLLIARLHGVVSTAVDVDVSIPFEPKGGKAHHQRFLHEADLSQLNEALERLRQFVEMDPNWMEQRFISSKEEGEE

SEQ ID NO: 167038 - protein, 175 aa, Heterodera glycines
  misc_feature (150)..(150): Xaa can be any naturally occurring amino acid
  Homolog annotation: Hit_ID=CAE56933.1; Match level="QueryCoverage =97%, HitCoverage=64%, E-value=8e-33, Identity=42%"; Hit description =Hypothetical protein CBG24778 [Caenorhabditis briggsae]
  Gene Ontology: Mol. function=endopeptidase activity; Cellular component=26S proteasome; Biological process=proteolysis and peptidolysis
  Coding regions on vcDNA: vcDNA=SeqID_93461; Strand=+; Position=2-529
VLVGDDFVVVAIDARLTGDAEIEILSRWRQNTRILSHKIIMTSCGFYGDVLQLRCILKLPIDLFQLIYQMPMSLDQCGDMFSRTLYSRRFFPYFTGTIICGITSDGRGDLYSYDPVGCIETQLFEASGNGGSTLSTFFQNQWAYSTVAPXERKNMPKPTLERALSVIPDAFPGLS

SEQ ID NO: 167039 - protein, 64 aa, Heterodera glycines; identical to SEQ ID NO: 139860
  Coding regions on vcDNA: vcDNA=SeqID_93462; Strand=+; Position=1-195

SEQ ID NO: 167040 - protein, 132 aa, Heterodera glycines
  Coding regions on vcDNA: vcDNA=SeqID_93463; Strand=+; Position=157-552
NPAIDLLLAGRQHLRGGRFIRDLIDIGKFAFDTGCKLFHTAICDLGKKRKREAVYGKNEPAPNPAAVNEFKVLQSTPIDELVEKVKKQLREVAEKPGFKDLSPVDQEDTLLDAISADDQFMKDLVRESIDDS

SEQ ID NO: 167041 - protein, 46 aa, Heterodera glycines
  Homolog annotation: Hit_ID=CAB88203.1; Match level="QueryCoverage =100%, HitCoverage=15%, E-value=7e-12, Identity=78%"; Hit description= putative cuticular collagen [Globodera pallida]
  Coding regions on vcDNA: vcDNA=SeqID_93464; Strand=+; Position=2-139
QETHIVLLIASVCSLLDIIATAVTLPSLYSEMSQMNSKVHYGVEAF

SEQ ID NO: 167042 - protein, 102 aa, Heterodera glycines
  Homolog annotation: Hit_ID=NP_504650.1; Match level="QueryCoverage =98%, HitCoverage=21%, E-value=4e-17, Identity=48%"; Hit description =epoxide hydrolase (51.5 kD) (5G981) [Caenorhabditis elegans] gb|AAB04970.1| Hypothetical protein W01A11.1
  Gene Ontology: Mol. function=epoxide hydrolase activity
  Coding regions on vcDNA: vcDNA=SeqID_93465; Strand=-; Position=83-449
LLTIVSIYWFNGNILSSQRYYKEHFASDSNTEKLYRKYVAVPTAYAAFPYDLGGVLPREMVSRQYNLTQMTLFEDGGHFAAFECPKELGEDIIRFAQGLSLD

SEQ ID NO: 167043 - protein, 76 aa, Heterodera glycines
  Coding regions on vcDNA: vcDNA=SeqID_93466; Strand=-; Position=82-312
MNTFVTGTGILRLIGCGVFPLRCLCCCCCCVVCALSCEVTKLFSPLFGIGSSHKLTSANFPSFSLSHISVLFGFNR

SEQ ID NO: 167044 - protein, 144 aa, Heterodera glycines
  Homolog annotation: Hit_ID=EAA65869.1; Match level="QueryCoverage =99%, HitCoverage=24%, E-value=1e-14, Identity=34%"; Hit description =hypothetical protein AN1276.2 [Aspergillus nidulans FGSC A4] ref|XP _405413.1| hypothetical protein AN1276.
  Gene Ontology: Mol. function=glucose binding; Cellular component =plasma membrane; Biological process=signal transduction
  Coding regions on vcDNA: vcDNA=SeqID_93467; Strand=+; Position=113-544
MVSAQTYSYFVAFAAALGGFLFGYEIGIINSVLEMNPFRLYFGMSTVVDGALAKTAEATFYTSSIVTAFVFGCIPGALIITLGGDILGRKRAIFIGAFLFTLGGLLQALVPAGSSIGSRVTFISAGRFFGGVGIGMLSGSVPLY

SEQ ID NO: 167045 - protein, 91 aa, Heterodera glycines
  Homolog annotation: Hit_ID=CAE64058.1; Match level="QueryCoverage =100%, HitCoverage=26%, E-value=5e-31, Identity=68%"; Hit description= Hypothetical protein CBG08658 [Caenorhabditis briggsae]
  Gene Ontology: Mol. function=general RNA polymerase II transcription factor activity; Cellular component=transcription factor TFIIA complex; Biological process=regulation of protein activity, epigenetic
  Coding regions on vcDNA: vcDNA=SeqID_93468; Strand=+; Position=2-277
EEEDPTMVAAKYGLGERNDDEAVEEEPLNSGDDQSDDEDLDTLFDAENVVVCQFEKVHRARNKWRFTLKDGVMHIRGKDYCFQKCTGEAEW

SEQ ID NO: 167046 - protein, 177 aa, Heterodera glycines
  Homolog annotation: Hit_ID=NP_872037.1; Match level="QueryCoverage =94%, HitCoverage=35%, E-value=8e-25, Identity=39%"; Hit description =putative protein family member, with 3 coiled coil-4 domains, of eukaryotic origin (2G181) [Caenorhabditi
  Gene Ontology: Mol. function=Rab interactor activity
  Coding regions on vcDNA: vcDNA=SeqID_93469; Strand=+; Position=99-629
MRPMDYLEAEPSPSLSNGTLPSSSSSVASRLYLNGRLNSRRNSFSSEPELMQFNDHDSISTDFGNATNQMSILAQKLTELQEEKMMISEEKSRLRTDNAVLQERVHLLEEHLHATEQRWAEKCEEEKAKSRELAHRMERERQLEAEREALKHQMLSKEVKQLEVEKERMGGEMRKAR

SEQ ID NO: 167047 - protein, 97 aa, Heterodera glycines
  Coding regions on vcDNA: vcDNA=SeqID_93470; Strand=+; Position=54-347
MSKGNKNVKAVAVLGLDDTDTDATIDLEYHDRLVEASKDFKSENQYKELLRLRFKLVATGVLKLERSLDGLQIPPPILEKIGELFDCLDWALSADDE

SEQ ID NO: 167048 - protein, 171 aa, Heterodera glycines
  Homolog annotation: Hit_ID=CAE64788.1; Match level="QueryCoverage =84%, HitCoverage=94%, E-value=3e-28, Identity=46%"; Hit description =Hypothetical protein CBG09581 [Caenorhabditis briggsae]
  Gene Ontology: Mol. function=thiol-disulfide exchange intermediate activity; Cellular component=mitochondrion
  Coding regions on vcDNA: vcDNA=SeqID_93471; Strand=+; Position=14-526
MIFRQFLRRFLVANHRFVPLESFWVGRLNSVLHSTVCGVGPSNFSTGFANHLVQHRFFSSQSDGLNVFELGSEDDFDNRVLQAQQPVMVQFYADWCGPCQNLAPRIEAKVNGQNGEVLLARINVDSSLGFLTAQFDVTSVPTVVCFHNGEGIHRFEGDVDDSYLDEIIAHL

SEQ ID NO: 167049 - protein, 45 aa, Heterodera glycines
  Coding regions on vcDNA: vcDNA=SeqID_93472; Strand=+; Position=58-192
IRDLILNDEDTGIFNLIHTIYTSTALPFLTFSLLIRIICYARDLP

SEQ ID NO: 167050 - protein, 188 aa, Heterodera glycines
  Homolog annotation: Hit_ID=NP_497714.2; Match level="QueryCoverage =87%, HitCoverage=49%, E-value=5e-58, Identity=60%"; Hit description =protein phosphatase I87 (37.4 kD) (3E557) [Caenorhabditis elegans] emb|CAA87100.2| Hypothetical protein C
  Gene Ontology: Mol. function=protein serine/threonine phosphatase activity; Cellular component=cytoplasm; Biological process=cell organization and biogenesis
  Coding regions on vcDNA: vcDNA=SeqID_93473; Strand=+; Position=18-581
MSPSADNSSDDEQIACDPEITFRGRSVRPLKWLSEVSSCRYLPEGEMVTVCQILISRLAYMPNTVSVQSPATICGDIHGQFYDLMKLFQIGGDILETNYVFLGDYVDRGYYSLETISYLMLLLLKYPDRITLLRGNHETRRVSHQYGFYDECQQKYGNSVVWSWCCRVFDVLAIAAVVDNQIFCVHGG

SEQ ID NO: 167051 - protein, 98 aa, Heterodera glycines
  Homolog annotation: Hit_ID=CAF98370.1; Match level="QueryCoverage =69%, HitCoverage=20%, E-value=7e-11, Identity=47%"; Hit description =unnamed protein product [Tetraodon nigroviridis]
  Gene Ontology: Cellular component=nucleus; Biological process =regulation of cell growth
  Coding regions on vcDNA: vcDNA=SeqID_93474; Strand=+; Position=3-299
GAGSELETSKPSTGASLAEKRLCFSKQFGLPHLLRMFVRFTDMLAYTEWSERSLEAIIRHAQDFVMFLSKNHADFYDVEKDYMLAPAEYHKRVWGNHS

SEQ ID NO: 167052 - protein, 165 aa, Heterodera glycines
  Homolog annotation: Hit_ID=CAE72827.1; Match level="QueryCoverage =74%, HitCoverage=29%, E-value=6e-29, Identity=56%"; Hit description =Hypothetical protein CBG20109 [Caenorhabditis briggsae]
  Gene Ontology: Mol. function=translation release factor activity; Cellular component=mitochondrion; Biological process=translational termination
  Coding regions on vcDNA: vcDNA=SeqID_93475; Strand=+; Position=37-531
MLFSPTFLRFVNLTNLPTTSSLKCHQILRHFLALKSTTTIASASKVPPLDVLDSIDIESLRRCQLEFNSGAGGTEASLFTAELFNMYAKFAARNGWKWTPHEVSKCNKTNSVGINSAIVLVEGDWCYAKMRFESGVHRVQRVPVTESKGRMHTSTASLAVLPEPE

SEQ ID NO: 167053 - protein, 168 aa, Heterodera glycines
  Homolog annotation: Hit_ID=CAE60645.1; Match level="QueryCoverage =98%, HitCoverage=19%, E-value=3e-34, Identity=45%"; Hit description =Hypothetical protein CBG04291 [Caenorhabditis briggsae]
  Coding regions on vcDNA: vcDNA=SeqID_93476; Strand=+; Position=1-504
NLQGQRSYVVVENVQSDEEHEANSLNCTLKVSGFLRGAPLSVNKLVHLPGWGDFQLARIDRTLEPCPMKTPNDKNPPTGDVKFAVLAKADPAKRTPLDSEIVPDPMEAEQTWPNENEIEENKFVVPKVSRKVPKGTSEYQASWLIDSDGTDENDEDQSEEADEEERED

SEQ ID NO: 167054 - protein, 66 aa, Heterodera glycines
  Coding regions on vcDNA: vcDNA=SeqID_93477; Strand=-; Position=3-200
KMIIKYVLFIHSLMRPSVDCAATVVADPSCPPPHPPLLVRHLWENSVLCSCELLSLCRPHSRQSHT

SEQ ID NO: 167055 - protein, 169 aa, Heterodera glycines
  Homolog annotation: Hit_ID=NP_502745.1; Match level="QueryCoverage =69%, HitCoverage=42%, E-value=1e-26, Identity=44%"; Hit description =Hly-III related proteins (4P142) [Caenorhabditis elegans] emb|CAB60449.1| Hypothetical protein Y67A10A.8
  Coding regions on vcDNA: vcDNA=SeqID_93478; Strand=+; Position=1-510
VLIAIYVPFCRFSIQSKCRFGVPDVLYLSMALIALYPTWHWTQLHGGLSNDHVRQWLPCLFALFALLGFAFAFYVSQIPERILPGKFDVIGCSHQWWHLLILAALTYSHWTGIQLLITYHRTALIRQQPLHTDQMLLQSAASPFVPALSSSGRLGTNLLNHTATSTNGG

SEQ ID NO: 167056 - protein, 44 aa, Heterodera glycines
  Homolog annotation: Hit_ID=CAB88203.1; Match level="QueryCoverage =95%, HitCoverage=14%, E-value=2e-09, Identity=73%"; Hit description =putative cuticular collagen [Globodera pallida]
  Coding regions on vcDNA: vcDNA=SeqID_93479; Strand=+; Position=2-133
LDLRIASECSLMAIIATVITLPSLYSEMSQMNIKVRDRADAFHV

SEQ ID NO: 167057 - protein, 171 aa, Heterodera glycines
  Coding regions on vcDNA: vcDNA=SeqID_93480; Strand=-; Position=2-514
EHIGEYLPQLVPDKNMARLRREHRVGAIVRQRQRLFFRLPPFFRTGKSLESRLALLLRSAAVGHFGECQPGKSGDRCAVNERLDPFEVGQPSAGDHSKFCADGHYRIGLKSELTFVKNLDVLVEELSLSKGRLGAKGSKLTDETTEDDGGLIGLRNGGKIRLLENVHGLNN

SEQ ID NO: 167058 - protein, 182 aa, Heterodera glycines
  Homolog annotation: Hit_ID=CAE74062.1; Match level="QueryCoverage =74%, HitCoverage=69%, E-value=1e-25, Identity=43%"; Hit description =Hypothetical protein CBG21714 [Caenorhabditis briggsae]
  Coding regions on vcDNA: vcDNA=SeqID_93481; Strand=+; Position=70-615
MISCRRSVSKCLLPQITNRLTSNFGHLQPCCSSQKVPMCASASNRSSVRLSAIFPRMLSSSVGDKSHERPQMYQLEHIQKRLEYTVPLMFNARLDYTFYTKDVFVDNQILGSQLRSLEGFMHHISLITVAAQFCCTHIETQILNISPILEDGTVRLRWRICYLGLLSMLNFRNFNRQYRLKN

SEQ ID NO: 167059 - protein, 166 aa, Heterodera glycines
  Coding regions on vcDNA: vcDNA=SeqID_93482; Strand=+; Position=3-500
KRKVSGVFFKEVPAIMAFPANKLLVWQQNDIAQTSCSSKPNTDHFLQFALEVSPINGNKTKRVFYLKRPYDDPFSGFKSRLRHKISEFLGVQDELAVQPIYSGDQSPAEAIEDVSLFDLFFNATDPCSLSALRIGTTDYEIVRDSAWLDNVEISLLPLVGCPVLPS

SEQ ID NO: 167060 - protein, 83 aa, Heterodera glycines
  Coding regions on vcDNA: vcDNA=SeqID_93483; Strand=-; Position=161-412
FFFFFFFFFRAAFISIKLFFNYSIRSHLKQILLGNGRSGNGNGTHLSSICTDSFGSGPLSLRISIVLQIVNSLLPSKCLSPTH

SEQ ID NO: 167061 - protein, 210 aa, Heterodera glycines
  Homolog annotation: Hit_ID=NP_956953.1; Match level="QueryCoverage =100%, HitCoverage=28%, E-value=1e-57, Identity=54%"; Hit description= mutL homolog 1, colon cancer, nonpolyposis type 2 [Danio rerio] gb|AAH57507.1| Hypothetical protein MGC6
  Gene Ontology: Mol. function=ATPase activity; Cellular component =nucleus; Biological process=mismatch repair
  Coding regions on vcDNA: vcDNA=SeqID_93484; Strand=+; Position=1-630
LDPTVVNRIAAGEVIHRPSHALKELLENCLDANASAITITLKDGGLTLLEIADNGHGIHPHDLPIVCLRFTTSKLRSFDDLRTVATFGFRGEALASLSHVARVAIVSRTADSDCAYASEYIDGKPLNDAITPCAHPTVGTTISIHDLFYNLQARRRAMRSYNEEHANVVDTLVRYAVHYPSVAMTLRKHGAGVPDVSTSGGSTTDRIDVI

SEQ ID NO: 167062 - protein, 150 aa, Heterodera glycines
  Coding regions on vcDNA: vcDNA=SeqID_93485; Strand=+; Position=2-451
AVLSNLSLCCSSSLLQIQRHFVTASILRKCPSSTKQFANAHRCISRTRTLFMFIHDNEMEQWAEKMIDHKLKENGLDSADVCFSDLVHWWYSNVYESTLNVHGLRLLVKIALDKEQSRQFVRKRSAIAELWDYVKDTMPASDFLPFLVMG

SEQ ID NO: 167063 - protein, 119 aa, Heterodera glycines
  Coding regions on vcDNA: vcDNA=SeqID_93486; Strand=-; Position=2-358
NNPVNINQSMHFCAGGKLTNCLWVLKALPRFVAELTRHPIVHWRLMRTPNAHLSTVRASGRVDVAHVHGQPINVHKVIRDYVQTLGSLHNVGTTCFCAERANDWGEKGEDGQSFGHWNI

SEQ ID NO: 167064 - protein, 34 aa, Heterodera glycines
  Coding regions on vcDNA: vcDNA=SeqID_93487; Strand=+; Position=136-237
AFANCFFKNLICLFFCNVDKFGLLLKKKKKKKKK

SEQ ID NO: 167065 - protein, 62 aa, Heterodera glycines
  Coding regions on vcDNA: vcDNA=SeqID_93488; Strand=+; Position=84-272
ANFVTGSTQIAKNFSRRRLSAPPDLHFPLFLQVFCLKTAKIWSFLVKKCSCYPAVEKKLLVK

SEQ ID NO: 167066 - protein, 44 aa, Heterodera glycines
  Coding regions on vcDNA: vcDNA=SeqID_93489; Strand=-; Position=72-206
IKIFSIKIQPMEQQQEQQNQSANDHDHYVTVRCFLDSLICNLFF

SEQ ID NO: 167067 - protein, 94 aa, Heterodera glycines
  Coding regions on vcDNA: vcDNA=SeqID_93490; Strand=+; Position=5-289
DELLELLPALLSMDLVDRACRLQNEMLTFLEFVAEVHAQLWPSHLEAFHLTGPLALHFDSNSCEPMPRKIHLTDELMPPKLRSKGTEWKLEIVK

SEQ ID NO: 167068 - protein, 177 aa, Heterodera glycines
  Homolog annotation: Hit_ID=CAE68739.1; Match level="QueryCoverage =93%, HitCoverage=32%, E-value=7e-24, Identity=34%"; Hit description =Hypothetical protein CBG14669 [Caenorhabditis briggsae]
  Coding regions on vcDNA: vcDNA=SeqID_93491; Strand=+; Position=78-608
MDIGKKQPKEMKNGNLLTTVYPKDVPFSWISRPTFDVAAMPQILANPQNRLTAAAFADIVRSIQRDSRFVSYALFYSRMVPVWLVFSIVILLAVLASSPMGGLPVMVFAFVWLFMLVLGLLFCALLQKFIVLALRVLVKEINAISQTFRLLVGIQNRGIVFIFYDFDGCREDIARQI

SEQ ID NO: 167069 - protein, 119 aa, Heterodera glycines
  misc_feature (67)..(67): Xaa can be any naturally occurring amino acid
  Homolog annotation: Hit_ID=NP_011835.1; Match level="QueryCoverage =98%, HitCoverage=20%, E-value=2e-09, Identity=36%"; Hit description =Wsc4p [Saccharomyces cerevisiae] sp|P38739|WSC4_YEAST Cell wall integrity and stress response component 4
  Gene Ontology: Mol. function=transmembrane receptor activity; Cellular component=membrane fraction; Biological process=Rho protein signal transduction
  Coding regions on vcDNA: vcDNA=SeqID_93492; Strand=+; Position=1-360
PPPTSTTGPKSPTPSRARSSLSAARSSLPTTRRPRATMLSNGLSTASSRTATTTSSSSRSLSSRNPXSGSTSTRARTRSAPKSKSATKPSKPSTRPLPPCSASATSPAKALSSKVMPAT

SEQ ID NO: 167070 - protein, 84 aa, Heterodera glycines
  Coding regions on vcDNA: vcDNA=SeqID_93493; Strand=-; Position=3-254
INFITNIHPFTILALLIMIIDHIGQSVCHFLSCHWPVICICCPFNFPILHSVKRHTSPLKTFAKCCWGQKGKDEQKEKEKSHFK

SEQ ID NO: 167071 - protein, 58 aa, Heterodera glycines
  Coding regions on vcDNA: vcDNA=SeqID_93494; Strand=-; Position=6-182
IFYRFLNVWIFFWLTKTSSNLVLSILFQIAPNFFYSLTRPKQTYFQKISHEISFLNFL

SEQ ID NO: 167072 - protein, 159 aa, Heterodera glycines
  Homolog annotation: Hit_ID=NP_498420.1; Match level="QueryCoverage =98%, HitCoverage=35%, E-value=3e-20, Identity=32%"; Hit description =mannosyltransferase (3H551) [Caenorhabditis elegans] gb|AAC77507.1| Hypothetical protein T26A5.4 [Caenorh
  Gene Ontology: Biological process=protein modification
  Coding regions on vcDNA: vcDNA=SeqID_93495; Strand=+; Position=1-477
HEGDIGRSPRMGYHAYSLARQGAYVNLVGYMDNQPHGDVFGEQINFVALPKPPISSSSDNPFRRFLIRLVKMVWLLFAIPYAFFVLCRGHRHRQLIMVQNPPGIPAMIVCYLLAKIRFATFVVDWHNYSSSMLDNSWISYLVGLIEGFFGRRASFNFCV

SEQ ID NO: 167073 - protein, 96 aa, Heterodera glycines
  misc_feature (21)..(21): Xaa can be any naturally occurring amino acid
  Homolog annotation: Hit_ID=CAE61653.1; Match level="QueryCoverage =89%, HitCoverage=46%, E-value=5e-16, Identity=52%"; Hit description =Hypothetical protein CBG05587 [Caenorhabditis briggsae]
  Coding regions on vcDNA: vcDNA=SeqID_93496; Strand=+; Position=2-293
KVIEIRRTRRIIQRLTARLRXRNFKAIQKARDVRKRAIAAKEARGEPTPPEPAAVPPPVYRQSPPTGNSPPPTYEDSLLHQFFMECVSVNENGPTI

SEQ ID NO: 167074 - protein, 147 aa, Heterodera glycines
  Coding regions on vcDNA: vcDNA=SeqID_93497; Strand=+; Position=1-441
PSPPFAHSLTMLYPSVLSPSSFAMFVYLFLFFSCSCSISLSAIYPPQNGISEEKRGFSLVRNPYSWMARLQQNLSVPVGLDDVSSKNDEQLLTNLLLEEPLSKRSFPAAPRRPQNPYSWMSFADADQSNMDWLITRLRPFSDLVSKR

SEQ ID NO: 167075 - protein, 173 aa, Heterodera glycines
  Homolog annotation: Hit_ID=XP_415263.1; Match level="QueryCoverage =91%, HitCoverage=57%, E-value=1e-42, Identity=54%"; Hit description =PREDICTED: similar to expressed sequence AA407659 [Gallus gallus]
  Gene Ontology: Mol. function=structural molecule activity; Cellular component=microtubule; Biological process=synaptic transmission
  Coding regions on vcDNA: vcDNA=SeqID_93498; Strand=+; Position=45-563
MADLDQNNARNESEGRSESTNEIRAPITEAEIRAKEVVMPDDVLGLNCITENFLCRPEDNVYDIEFVRFKVRDIDSETVLFEINKPDAAANDDCSEAGGNSDEAEEEGNAEEGDKPFTPRFIRYYFKPSFLRLRHIGATMEFVVGNKPINNFRMIERHYFRDRLLKSFDFDFG

SEQ ID NO: 167076 - protein, 175 aa, Heterodera glycines
  Coding regions on vcDNA: vcDNA=SeqID_93499; Strand=+; Position=1-525
ICGDAVGTEIQMGDQMAMVPTQSTPMEQPNCHQQHDDVPKNGEHLTMNREFYRPTTPSSTSVPKKRTFAEISGFDSLTDSAHATAKVSRIALISYPAAPPAVLKSYTDDRRYTMCHLQQNERQNPLEIEAQNCLLDLRQELAFVDSLDPSLGQCLTNSRRLLISESMKLEEWHNP

SEQ ID NO: 167077 - protein, 39 aa, Heterodera glycines
  Coding regions on vcDNA: vcDNA=SeqID_93500; Strand=-; Position=8-127
DQSIRRIRHLKKHRRNIGRHFFFIHKIEHRLRFVPSAEF

SEQ ID NO: 167078 - protein, 54 aa, Heterodera glycines
  Coding regions on vcDNA: vcDNA=SeqID_93501; Strand=-; Position=155-319
PLWPLPPLCSLSSPCSFFLSISSFHSPFFSRNSIPPQSFSFSIALKFSKRQNSR

SEQ ID NO: 167079 - protein, 66 aa, Heterodera glycines; identical to SEQ ID NO: 155643
  Coding regions on vcDNA: vcDNA=SeqID_93502; Strand=-; Position=0-197

SEQ ID NO: 167080 - protein, 36 aa, Heterodera glycines
  Coding regions on vcDNA: vcDNA=SeqID_93503; Strand=-; Position=2-109
FLFFFLLILLSVVFFVMTEHYLVDISQERLSPNKFF

SEQ ID NO: 167081 - protein, 149 aa, Heterodera glycines
  Coding regions on vcDNA: vcDNA=SeqID_93504; Strand=+; Position=32-481
MFCSNSLFCFCFFLFFSIHCAFGVKFRINGTLKCRYREGMEKPYRNEAVIQLWEADANLFGFIDKDDLLGETKSSKGDGVFELKETKDEWEMGELEPYLLIRHICWGESPPGENCALLSRMDLQPTPAAKMLPPIILGMDSQLKTIVMC

SEQ ID NO: 167082 - protein, 113 aa, Heterodera glycines
  misc_feature (78)..(78): Xaa can be any naturally occurring amino acid
  Coding regions on vcDNA: vcDNA=SeqID_93505; Strand=-; Position=204-545
MDSSQKQMPTLIPFTCPSKDSSPPKPKWTDNCPPDEHSQFAPSKAQCALPKNVSHPNTFPPLPLILSPIGGHFRCCCXCCCLEFGLTSRNFLFSSDGGRENSLGRGFEAGRFQ

SEQ ID NO: 167083 - protein, 170 aa, Heterodera glycines
  Homolog annotation: Hit_ID=CAE69446.1; Match level="QueryCoverage =98%, HitCoverage=29%, E-value=1e-56, Identity=63%"; Hit description =Hypothetical protein CBG15634 [Caenorhabditis briggsae]
  Gene Ontology: Mol. function=cGMP-dependent protein kinase activity; Biological process=larval locomotory behavior
  Coding regions on vcDNA: vcDNA=SeqID_93506; Strand=+; Position=145-654
MLGNLELAELKTVSTLGVGGFGRVNLVKHIDTERVYALKVLNKRHVKEMNQVEHVLNERSILLSCHCDFIVRLHKTFRDSERLYMLMEYCPGGEVWTMLRNWGRFDEATARFYCAAALEAFDYLHRRMIIYRDLKPENMLLDIDGNPKLVDFGFAKKLPTEGSRAWTFCG

SEQ ID NO: 167084 - protein, 203 aa, Heterodera glycines
  Homolog annotation: Hit_ID=CAE66537.1; Match level="QueryCoverage =86%, HitCoverage=35%, E-value=1e-16, Identity=30%"; Hit description =Hypothetical protein CBG11841 [Caenorhabditis briggsae]
  Coding regions on vcDNA: vcDNA=SeqID_93507; Strand=+; Position=4-612
MDKFPQLSRVPAPPGVNSDQAAISLMAMAEIFRTANKYKMAIKCVMTSLRVPCSSELFALCSFELGKLLWLYTNNLELAQFHLCQAHKLMRQLGPGLEQPRLKTATLLAEVFLARRLFSDCVQLLRSELPDSQKCHSVHTKMLFLFAEAYLRLGDFNGALDIVRAGVQFSRGPGWGGVIAECYFRLVKSLVLSIQMTDQHELG

SEQ ID NO: 167085 - protein, 206 aa, Heterodera glycines
  Homolog annotation: Hit_ID=CAE57215.1; Match level="QueryCoverage =100%, HitCoverage=25%, E-value=9e-86, Identity=73%"; Hit description= Hypothetical protein CBG00074 [Caenorhabditis briggsae]
  Gene Ontology: Mol. function=glutamate-5-semialdehyde dehydrogenase activity; Cellular component=cytoplasm; Biological process=proline biosynthesis
  Coding regions on vcDNA: vcDNA=SeqID_93508; Strand=+; Position=1-618
ICHVYIDRKCDEKMAIDIVRDSKCDYPAACNAAETILIHRDHLSTPFFESLCGMLKAEGVKLHAGPKLQSLLKFGPPAADSLKYEYGRLECTLEMVDNVAEAVKHVIRYGSGHTDCIVTSDDAAAEQFLARVDSACVFRNASTRFADGYRFGLGAEVGISTGRIHARRPVGMEGLLTTKWLLRGAGHTAQQFKVGGPLIYLHEPLN

SEQ ID NO: 167086 - protein, 105 aa, Heterodera glycines
  Homolog annotation: Hit_ID=NP_080583.2; Match level="QueryCoverage =88%, HitCoverage=60%, E-value=3e-21, Identity=52%"; Hit description =divalent cation tolerant protein CUTA [Mus musculus] gb|AAH24422.1| Divalent cation tolerant protein CUTA
  Coding regions on vcDNA: vcDNA=SeqID_93509; Strand=+; Position=99-413
MAGRAVASLSRFSVVYVTVPSAEIGKRIAHELVRSRLAACVNIVPQITSFFFWKGKEEEDSESLLIITTGRERLEQLREAVITLHPYEVAECAAFPIEYGSPPVL

SEQ ID NO: 167087 - protein, 198 aa, Heterodera glycines
  Coding regions on vcDNA: vcDNA=SeqID_93510; Strand=+; Position=32-625
MSLSNVHTNLVQNGKETNDPFAFSAADHPQNVGNNESSSSIEQKRHFRKRVGQLELELADSQQMCEAVKHENKLLRMELNHQKLLTEHYALQAKVAAMEKGPRKGREMELLHDQVAHLKEEQEKIYVKSSELEQFKATTGQVDELRKDQKNLLERISTESEQQQNNFETLKGKLYGKIAETDRNVEELKKQFGNVSQC

SEQ ID NO: 167088 - protein, 188 aa, Heterodera glycines
  Homolog annotation: Hit_ID=NP_496814.1; Match level="QueryCoverage =93%, HitCoverage=62%, E-value=5e-40, Identity=43%"; Hit description =member of the AAA family of ATPases, cell survival CED-4-interacting protein, Member of AAA family bindin
  Gene Ontology: Mol. function=helicase activity; Biological process =growth
  Coding regions on vcDNA: vcDNA=SeqID_93511; Strand=+; Position=23-586
MKRKRSNTSRNLQVQSNGVPTKIPSEQTAIAAAAKQFKTDQSNLRLSDLGGCEAQFLEAIQLMTHLKHPKLCEQIGFTPPKGLLLHGPPGCGKSAFAMALAGELQLPILSVSSTELVAGVSGESERKIRTLFAEAKMAAPALLLIDDIDVIAAKRENAQREMERRIVTQLIASIDGLKSENDNESCTV

SEQ ID NO: 167089 - protein, 70 aa, Heterodera glycines
  Homolog annotation: Hit_ID=AAH67992.1; Match level="QueryCoverage =94%, HitCoverage=33%, E-value=3e-14, Identity=60%"; Hit description =Hypothetical protein MGC69411 [Xenopus tropicalis] ref|NP _001001214.1| hypothetical protein MGC69411 [Xeno
  Gene Ontology: Mol. function=signal transducer activity; Cellular component=shmoo tip; Biological process=cell-matrix adhesion
  Coding regions on vcDNA: vcDNA=SeqID_93512; Strand=+; Position=2-211
GACAQTCLLIEISKEHFPEGYVPTGLSTIIAEYIQEYVKRVELALGDTAGHEDYHRLLPLLFPDTEPSQM

SEQ ID NO: 167090 - protein, 176 aa, Heterodera glycines
  Homolog annotation: Hit_ID=NP_495017.1; Match level="QueryCoverage =100%, HitCoverage=31%, E-value=1e-15, Identity=31%"; Hit description= ring finger protein eeed8.9 (73.1 kD) (2F684) [Caenorhabditis elegans] gb|AAK93845.1| Hypothetical prote
  Coding regions on vcDNA: vcDNA=SeqID_93513; Strand=+; Position=75-602
MSVRRINKILFRFLKELILPPRIQALTKIYPAQKVSSYLPKAAKPGKSPMRKILTGSFRALRNRNQLLRPFVSLHSYHIRLKELERARGFLSVRVSEKRDVLERVKHLFGTNVRYNRSLAVTELPDHLDGYEIGAFIAKGCNGAVHELKLRVADGHSRRIAPMTSQKEFPLALKIM

SEQ ID NO: 167091 - protein, 204 aa, Heterodera glycines
  Homolog annotation: Hit_ID=CAE73351.1; Match level="QueryCoverage =76%, HitCoverage=72%, E-value=1e-34, Identity=47%"; Hit description =Hypothetical protein CBG20783 [Caenorhabditis briggsae]
  Coding regions on vcDNA: vcDNA=SeqID_93514; Strand=+; Position=21-632
MIRGFFKQYDKNLVAKFNSLKNKAWRVAMPGSNIRKLDTKSISGWSIVVDIAFNALMKGQVVAVPTDTLYGLVALAEHSDKLYKIKRRSVQKPLGLFLDRPESIKKYCDQTVPDEFLHLIYPGPVTLLFNRTDAVPSDFNPGCSTVGVRVPQAKFVRDLCRRMPFRLLAQTSANVSGGPNPLCIRDFEEIWDDIDLIVDAGEII

SEQ ID NO: 167092 - protein, 126 aa, Heterodera glycines
  misc_feature (1)..(7): Xaa can be any naturally occurring amino acid
  Coding regions on vcDNA: vcDNA=SeqID_93515; Strand=-; Position=13-393
XXXXXXXQIYVFIQSFVVFQESHKNSLISAIFIKCFAIYFLSIFDCSFAFFYFSTFSAFFAIQFRFRPSHQKCQPTIGFTACCCCTALIWSLAINSAEGSNDDTIKSSRSANCSICYVMVDNIIVK

SEQ ID NO: 167093 - protein, 162 aa, Heterodera glycines
  misc_feature (145)..(145): Xaa can be any naturally occurring amino acid
  Homolog annotation: Hit_ID=CAE66431.1; Match level="QueryCoverage =100%, HitCoverage=29%, E-value=1e-43, Identity=58%"; Hit description= Hypothetical protein CBG11701 [Caenorhabditis briggsae]
  Coding regions on vcDNA: vcDNA=SeqID_93516; Strand=+; Position=2-487
EVEVSEKKDRVTDPLCLTRAAVEEGIVPWGGDALLDALYNLDSLKPDNDDHQSVIGILQNAIHQPISTIIANARLEPSAIVEKALANAETNYRYDAMNDQFVNMLEAGIIYPDKRRARRRCTTRPALVSLMATTECVVTEIPKEXPTMPSGGGMGGMGGGMG

SEQ ID NO: 167094 - protein, 188 aa, Heterodera glycines
  Homolog annotation: Hit_ID=CAE67303.1; Match level="QueryCoverage =100%, HitCoverage=43%, E-value=6e-77, Identity=71%"; Hit description= Hypothetical protein CBG12756 [Caenorhabditis briggsae]
  Gene Ontology: Mol. function=adenosylhomocysteinase activity; Cellular component=cytoplasm; Biological process=selenocysteine metabolism
  Coding regions on vcDNA: vcDNA=SeqID_93517; Strand=+; Position=1-567
NALQAAMEGYQVSTLDEVADIAQLVVTTTGCKNIVRGEHIERLPEDAIVCNVGHFDCEINVTYMNENCVSMEQVKPQVDRYLMRSGRHVILLAEGRLVNLGCATGHSSFVMSASFTNQVIAQLELYTKYGTPDAYKTGLYLLPKQLDEEVARLHLDKLGAKLTKLSKDQAEYLGIPQEGPFKPGHYRY

SEQ ID NO: 167095 - protein, 98 aa, Heterodera glycines
  Homolog annotation: Hit_ID=AAR12009.1; Match level="QueryCoverage =86%, HitCoverage=25%, E-value=4e-28, Identity=64%"; Hit description =cathepsin B-like proteinase [Triatoma infestans]
  Gene Ontology: Mol. function=peroxidase activity; Cellular component =extracellular space; Biological process=embryogenesis and morphogenesis
  Coding regions on vcDNA: vcDNA=SeqID_93518; Strand=+; Position=1-297
QAEIMRAGPVTAAFRVYEDFGHYASGVYQHVAGKYRGGHAVRVIGWGYDTDSKLPYWLVANSWNTAWGDGGFFKIRMGTDECGFETSGICFADPDQSN

SEQ ID NO: 167096 - protein, 95 aa, Heterodera glycines
  Coding regions on vcDNA: vcDNA=SeqID_93519; Strand=+; Position=255-542
EMGNEKWVRLLAQKPPLFAFPDISFGSQIQHDGIDSFLLFIAKNEDDEQAKLCLELPLYPETSDDLALGRFWLIQLSRAHFRWMDFGSLLLSTLI

SEQ ID NO: 167097 - protein, 54 aa, Heterodera glycines; identical to SEQ ID NO: 126699
  Coding regions on vcDNA: vcDNA=SeqID_93520; Strand=-; Position=241-405

SEQ ID NO: 167098 - protein, 178 aa, Heterodera glycines
  Coding regions on vcDNA: vcDNA=SeqID_93521; Strand=+; Position=1-534
CSLTCAKGFSCEEGWSKIGINCFKVFTFYGSYGAENFANSKEAKSRCEALGANLASLHSSFENQFVQELVRKSYTQCQKDNVPWCCDSYTYDGYWIGMSLTRASNGTILSAKWSDGTNTHYGNPLKFADRTPWYTPEHRPKQDSPESNCVFMLLTNSGIGWADYDCAMAKIGGYVCKK

SEQ ID NO: 167099 - protein, 89 aa, Heterodera glycines
  Homolog annotation: Hit_ID=CAB88203.1; Match level="QueryCoverage =100%, HitCoverage=29%, E-value=5e-31, Identity=71%"; Hit description= putative cuticular collagen [Globodera pallida]
  Coding regions on vcDNA: vcDNA=SeqID_93522; Strand=+; Position=2-268
RETHLVLGIASVCSVLVMIATVVTLPSLYSDMSPMNSNVRDGVDGFRGNTDSAWTDLMDVQVVVTPPMKPRDNPLHSIFCAIRGLPGRC

SEQ ID NO: 167100 - protein, 155 aa, Heterodera glycines
  misc_feature (107)..(107): Xaa can be any naturally occurring amino acid
  Homolog annotation: Hit_ID=NP_509045.1; Match level="QueryCoverage =54%, HitCoverage=22%, E-value=2e-29, Identity=64%"; Hit description =heat shock protein (43.2 kD) (hsp-43) [Caenorhabditis elegans] gb|AAA80366.1| Heat shock protein protein
  Coding regions on vcDNA: vcDNA=SeqID_93523; Strand=+; Position=233-697
MGKRTSGNVGRRRKKNSEKKGRWRRSGWEAEEERRKFFSDEFYGAFPHLRGTESVNAERWRTRRKPFEEECSSHLDRFDRNWRDDPFWRDLYPRWAETIFTDGIDVXTNIINDSNRFAVEMDTYQFRPVELRVNTMGDTLLIEGRAEDVRDREHY

SEQ ID NO: 167101 - protein, 94 aa, Heterodera glycines
  Homolog annotation: Hit_ID=NP_494884.1; Match level="QueryCoverage =91%, HitCoverage=41%, E-value=5e-09, Identity=38%"; Hit description =glutathione S-Transferase (gst-8) [Caenorhabditis elegans] gb|AAB37847.1| Glutathione s-transferase prote
  Gene Ontology: Mol. function=glutathione transferase activity; Biological process=glutathione conjugation reaction
  Coding regions on vcDNA: vcDNA=SeqID_93524; Strand=+; Position=2-286
DIRIKDVEKWDKTYKPEFFYGKAPDMEVDRKALARTTSILHYHDEKLDLAGKDEWQEANANEIIDFLKDATTDLLPDVMVRMGRPEGHLDEMLG

SEQ ID NO: 167102 - protein, 44 aa, Heterodera glycines
  Coding regions on vcDNA: vcDNA=SeqID_93525; Strand=+; Position=71-202
IFKFNFRRNHKTLPLPHNILFCNWKIYFLKYHKKTIRKKKKKKK

SEQ ID NO: 167103 - protein, 176 aa, Heterodera glycines
  Coding regions on vcDNA: vcDNA=SeqID_93526; Strand=+; Position=1-528
LDPNSQMPTETTESNEKKENPEDISSTVFFEHQQELLNETVSSGDEDFRCVSVTSNESEIQEPRLSTPTSQLPTETSDSSGKKENPEDISSTVFFEHQQELLNESVSSGDEDFRCASVTPPESEVQEARLLTPTSQMPTETSNSNGKKENPEDISSTVFFEHQKELLNESVSSGDE

SEQ ID NO: 167104 - protein, 177 aa, Heterodera glycines
  Coding regions on vcDNA: vcDNA=SeqID_93527; Strand=+; Position=86-616
MSSPSPVQRASSPSSAPRTVVLAMDDSTHAWHALEYCLANVVSPARNDRLFIVTVALLSDTWLESIATALRADPGTMGVPFVPSAHSASADRELTDHTQEQLKLALDKANMLLSRAKLAVRANPDTRNMHVETVALHDTDARQVLTDYVNHMSPKADVLVVGSRGLGAIKRAMVGST

SEQ ID NO: 167105 - protein, 84 aa, Heterodera glycines
  Coding regions on vcDNA: vcDNA=SeqID_93528; Strand=-; Position=3-254
VFDINPNNPVRGISRFYRTIEHNVFSPKIHKSEVTVLVGNWLANRQFAPAITENCIHTANSFCVQRLYRCHQLCKGHRALVDDK

SEQ ID NO: 167106 - protein, 125 aa, Heterodera glycines
  Homolog annotation: Hit_ID=NP_497744.1; Match level="QueryCoverage =73%, HitCoverage=25%, E-value=7e-28, Identity=60%"; Hit description =galanin receptor 2 (3E774) [Caenorhabditis elegans] emb|CAA88290.1| Hypothetical protein T27D1.3 [Caenorh
  Coding regions on vcDNA: vcDNA=SeqID_93529; Strand=+; Position=47-424
MAQLPLFNDFSKGNSRANSCVGFAPVSGAHEEALKTRRTVVKMLVACVSVYFICYSPIQAIFLCRGLFNLSIHPPYEFVLLMNAMAILCSACNPLLYTLFSSRFRARIGHLLCLCCDIFYRRHNK

SEQ ID NO: 167107 - protein, 92 aa, Heterodera glycines
  Homolog annotation: Hit_ID=NP_492029.2; Match level="QueryCoverage =78%, HitCoverage=56%, E-value=5e-33, Identity=75%"; Hit description =putative membrane protein (14.7 kD) (1H748) [Caenorhabditis elegans] emb|CAA95834.2| Hypothetical protein
  Coding regions on vcDNA: vcDNA=SeqID_93530; Strand=+; Position=3-281
RLWLLAPTRPQPTDWDNYNWCCTFPYFGSWKPSCCPFAIPTGAVIAVIIACIILVAVLVGLSCWCCYFCPLYKHLYENDDEEAEEEQRQREG

SEQ ID NO: 167108 - protein, 209 aa, Heterodera glycines
  misc_feature (59)..(59): Xaa can be any naturally occurring amino acid
  misc_feature (88)..(88): Xaa can be any naturally occurring amino acid
  misc_feature (116)..(116): Xaa can be any naturally occurring amino acid
  Homolog annotation: Hit_ID=CAA65474.1; Match level="QueryCoverage =99%, HitCoverage=63%, E-value=2e-46, Identity=50%"; Hit description =collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_93531; Strand=+; Position=2-631
VLGIASVCSLLPIKGAVVTLPSLYSEMSQMNSKVRDGIEGFPRQHDSGWTELVDLPMGXTPPPNPLDTPLTPSFRAKVLLPGHWPCAXSQQPNWPPGPPRPSRTPWETPNNPGGQXKPGKPGKPGQNASSLCAPENSPGAPCPGWAPPAAPEGKGTPRATKGAPGKPGNPPLQGGGTWKTLGAPGPPGKTWGNPEAPRKPCATPGKPGR

SEQ ID NO: 167109 - protein, 134 aa, Heterodera glycines
  Coding regions on vcDNA: vcDNA=SeqID_93532; Strand=-; Position=1-402
LQLSFLLFIFRCAHCFDVSLQLCIFLGVVRQRSVANAFVVHGHFDANAMEWHAERLFGTSLFQHLQIVRPIVGHAEIVGEQMCQFLIRFYATVARGGAGVVGLLSLRLCRCARAHQVVQHKLECRKKVALPANG

SEQ ID NO: 167110 - protein, 51 aa, Heterodera glycines; identical to SEQ ID NO: 138508
  Coding regions on vcDNA: vcDNA=SeqID_93533; Strand=+; Position=2-157

SEQ ID NO: 167111 - protein, 166 aa, Heterodera glycines
  Homolog annotation: Hit_ID=CAE64771.1; Match level="QueryCoverage =81%, HitCoverage=52%, E-value=1e-22, Identity=38%"; Hit description =Hypothetical protein CBG09562 [Caenorhabditis briggsae]
  Gene Ontology: Mol. function=pre-mRNA splicing factor activity; Cellular component=nucleus; Biological process=transcription from Pol II promoter
  Coding regions on vcDNA: vcDNA=SeqID_93534; Strand=+; Position=52-549
MKDSAIQQLTDPEIESALQRSKQLAASNGGQKRTFSDDLNFYPAKRKSNGTDMANVGMGAQVAETLVENVDIPESAVGLVIGRGGEQIQLIQQQSSCRVQMSSESNVSGFRQCTLQGARHNIDKAKQLIQEVLERSNRSAPGPQNGANAITIELSIPGPKCGLIIG

SEQ ID NO: 167112 - protein, 116 aa, Heterodera glycines
  Homolog annotation: Hit_ID=CAE68714.1; Match level="QueryCoverage =66%, HitCoverage=23%, E-value=2e-10, Identity=39%"; Hit description =Hypothetical protein CBG14639 [Caenorhabditis briggsae]
  Coding regions on vcDNA: vcDNA=SeqID_93535; Strand=+; Position=2-352
IEPDVGCRLHLSGLNWEWHTLDTLRSHFGQFGTIEQLEMVAYPRGCGSLVFDSLNAAQLCLAAGEKHSVNGHSIEVKMVPAGFSPLFSPARPNSSDSALSAASSAPPPPNAPLNLI

SEQ ID NO: 167113 - protein, 89 aa, Heterodera glycines
  misc_feature (48)..(48): Xaa can be any naturally occurring amino acid
  Homolog annotation: Hit_ID=CAE74349.1; Match level="QueryCoverage =78%, HitCoverage=28%, E-value=3e-13, Identity=44%"; Hit description =Hypothetical protein CBG22067 [Caenorhabditis briggsae]
  Coding regions on vcDNA: vcDNA=SeqID_93536; Strand=+; Position=1-271
ISTVPFGEPPSAFVLLCQTLLGARFVQTAHFCRTCAVPSAKKRCKDYXYCSVECQRFDWGVHKKCCEAIKQRNFDQNCTATNFEELNIS

SEQ ID NO: 167114 - protein, 28 aa, Heterodera glycines
  Coding regions on vcDNA: vcDNA=SeqID_93537; Strand=-; Position=0-83
FFFCFFLCTQPIVRRFRKRERFFGADLG

SEQ ID NO: 167115 - protein, 119 aa, Heterodera glycines
  Coding regions on vcDNA: vcDNA=SeqID_93538; Strand=+; Position=3-359
TNNERTRVSRWQDINPAPALSDIKNNNNHNNNNKSNNLNPNVFPPAPLLRSTAALPSLLNVTPTQSACLLPSSNLQSLLGEVPSLLKNRGHQVFAVPPNIPPLRLFDVHEQKQPLPNGF

SEQ ID NO: 167116 - protein, 153 aa, Heterodera glycines
  Coding regions on vcDNA: vcDNA=SeqID_93539; Strand=+; Position=3-461
ESSFSWKDWVRLRDTWNAVVTSQSQIHRHSEQLDKIVSEESSYRNYASDIQNRQIMIQIVERNVNKARELVRTALYQLNAFNSALSQMSAMFKSQEENDSQTEHGILELNNQNAEMRLELSRLRNELVFRRRHMLKSLYEVFFLPKLKRSSIA

SEQ ID NO: 167117 - protein, 85 aa, Heterodera glycines
  misc_feature (75)..(75): Xaa can be any naturally occurring amino acid
  Homolog annotation: Hit_ID=NP_510484.1; Match level="QueryCoverage =100%, HitCoverage=51%, E-value=1e-22, Identity=60%"; Hit description= putative N-myristoylated protein, with a transmembrane domain, of bilaterial origin (17.6 kD) (XP588) [C
  Coding regions on vcDNA: vcDNA=SeqID_93540; Strand=+; Position=2-256
MKAEHDPIARFPWRALYLSKGLVINGGVVAIFYRILALFTIHPMSMVATLLQLAAGFLTIALEAPFCCAFVDFIXRIAQFSESRA

SEQ ID NO: 167118 - protein, 140 aa, Heterodera glycines
  Coding regions on vcDNA: vcDNA=SeqID_93541; Strand=+; Position=3-425
KLEPSFLFELCVESVLPTKNQQQILSSLSLRQLCLLSCLVKLESSEYKQRIDFTYQEIAKGYIKFTNDYEKSMRVCSFVLYRDLDELAASGALSLAKGSDFGQIQFKKATSNVELDAIIKTIGRGKIPTKVENWILSPEL

SEQ ID NO: 167119 - protein, 211 aa, Heterodera glycines
  Homolog annotation: Hit_ID=XP_392760.1; Match level="QueryCoverage =99%, HitCoverage=44%, E-value=5e-34, Identity=38%"; Hit description =similar to ENSANGP00000011882 [Apis mellifera]
  Gene Ontology: Mol. function=hydrogen-transporting ATP synthase activity, rotational mechanism; Cellular component=mitochondrion; Biological process=growth
  Coding regions on vcDNA: vcDNA=SeqID_93542; Strand=+; Position=2-634
HCSTHALHCPAATMNSLRTGLPKLARGFASAAVQVPIQMHSLEGRYATALFTAASKANSLTAVETDLRTFNSSLRSDAEFRAFIESPVVDTKYKTQAVKAVAAKKNFSATTTNFFTLLAENGRLDMSVAVLESFGQLMSAHRGEIPVVVTSSQPLGPKTLNRVRDALAKGGKFTAKNQTLIVSNKVNPSILGGMIVEVGDQTIDMAVFAKM

SEQ ID NO: 167120 - protein, 164 aa, Heterodera glycines
  Homolog annotation: Hit_ID=EAA68901.1; Match level="QueryCoverage =95%, HitCoverage=97%, E-value=2e-82, Identity=92%"; Hit description =conserved hypothetical protein [Gibberella zeae PH-1] ref|XP _381692.1| conserved hypothetical protein [Gib
  Gene Ontology: Mol. function=RNA binding; Cellular component =cytosolic large ribosomal subunit (sensu Eukarya); Biological process=protein biosynthesis
  Coding regions on vcDNA: vcDNA=SeqID_93543; Strand=+; Position=25-516
VFGRHLRTEANPSPALYRMTIFSPNETVAKSRYWYFLRGLKKVKKATGEIVSIKVLHDKHPLKVKNFGIWIRYDSRSGTHNMYKEYRELSRTDAVDSLYSDMAARHRARFRSIHILRVVELEKTEDVKRPYIRQLTQKGLSFPLPHRITKENTQKVFSAKRPST

SEQ ID NO: 167121 - protein, 153 aa, Heterodera glycines
  Coding regions on vcDNA: vcDNA=SeqID_93544; Strand=+; Position=2-460
EVVVQLAHSLSVFQNETDQIFKKAALWMEKRTRRMKQLDKRMEILERKMEAVEKLPEVPLLNCASNFPEFGTPGGIVVPIFGHSAPFNRRSGVHFMEQKWKKDFNSNLLNEANVRRKDFLAQLFVKEKQRKEKVILDVETLEKLSPSSDNGDS

SEQ ID NO: 167122 - protein, 98 aa, Heterodera glycines
  Coding regions on vcDNA: vcDNA=SeqID_93545; Strand=+; Position=2-295
RGARKTKAFTIPFISTANRIAASQRYIRSLQLAETPRIAFDCRFLTLHTKRGLNLTMLQLQMLLFVYRDRQMPWPIHLCNFPSTSSADDCTGGAEAGA

SEQ ID NO: 167123 - protein, 86 aa, Heterodera glycines
  Coding regions on vcDNA: vcDNA=SeqID_93546; Strand=+; Position=308-565
KDAKIKNRNGGRKNCPAALTPSDQFVLPPLISRFLPSLPLRSFRRPEVLRFRPNRRRRRSVARNSTIGRSSPSPIRSSPRSQSPTA

SEQ ID NO: 167124 - protein, 132 aa, Heterodera glycines
  Coding regions on vcDNA: vcDNA=SeqID_93547; Strand=-; Position=45-443
FQQNVRITEAALNLCQEGVAIAQAQAVHRTTAKRLNVIDGAKASGGTALGSQHVQLMDGIFGIFAQTRLVHVRELAMEIKPFPVPRHTFRQKVAWAISQPSFLGLTLVFKAPFWPFSANSSAKTSSEKQRKK

SEQ ID NO: 167125 - protein, 47 aa, Heterodera glycines
  misc_feature (27)..(27): Xaa can be any naturally occurring amino acid
  Coding regions on vcDNA: vcDNA=SeqID_93548; Strand=-; Position=3-143
KNRMLKCSEQKENIFHRIVSATCCSSXPVIFHKCRMRWLEHLFVLQT

SEQ ID NO: 167126 - protein, 39 aa, Heterodera glycines
  Coding regions on vcDNA: vcDNA=SeqID_93549; Strand=-; Position=1-117
SKSFRLEVLSGSFFAATICTQYSRAQRKKRTRRLSTAHS

SEQ ID NO: 167127 - protein, 166 aa, Heterodera glycines
  misc_feature (125)..(125): Xaa can be any naturally occurring amino acid
  misc_feature (149)..(149): Xaa can be any naturally occurring amino acid
  Homolog annotation: Hit_ID=CAE68714.1; Match level="QueryCoverage =91%, HitCoverage=44%, E-value=1e-34, Identity=49%"; Hit description =Hypothetical protein CBG14639 [Caenorhabditis briggsae]
  Gene Ontology: Mol. function=heterogeneous nuclear ribonucleoprotein; Cellular component=cytoplasm; Biological process=RNA processing
  Coding regions on vcDNA: vcDNA=SeqID_93550; Strand=+; Position=2-497
FVLLHNQRNSQSQSKKLFIGGLGRVNDDALRQYYSQWGHVIDCIVIRDPATRSSRGFGFVTYATTEMADVAMAHRPHEINGKAVDAKRAVPRERMNLILDNDPIPFFMNIEPDVGCRLHLSGLDXRMAHIGHFAFSFWPFGTIEQLEMXGLPRGWGSLCLIHLMLP

SEQ ID NO: 167128 - protein, 157 aa, Heterodera glycines
  Homolog annotation: Hit_ID=NP_730435.1; Match level="QueryCoverage =95%, HitCoverage=17%, E-value=2e-32, Identity=49%"; Hit description =CG8798-PB, isoform B [Drosophila melanogaster] gb|AAN11654.1| CG8798- PB, isoform B [Drosophila melanogast
  Gene Ontology: Mol. function=ATP-dependent peptidase activity; Cellular component=mitochondrion; Biological process=proteolysis and peptidolysis
  Coding regions on vcDNA: vcDNA=SeqID_93551; Strand=+; Position=1-471
LFICTANVTDSPQRGLKDRMEMIEVAGYVAEEKLEIARKYLVPKCREKCALPDEKLVIKDDAIDSLIKSYCRESGVRFLFIAIEKICRKSAYQLVRGEGAGTQVLPIGVENSDHKKNAGGEEVTSDRLHPTTPVGGSMGTGWTETGRSALVARRPLQ

SEQ ID NO: 167129 - protein, 185 aa, Heterodera glycines
  Coding regions on vcDNA: vcDNA=SeqID_93552; Strand=+; Position=1-555
QKHRRMAKKMYEKARDRAERGRVLLSNERGIDTKERSSIILMPIDQPKVLTAETFASGRSRRVKGEAQANGGAHTERKPINGPSAAKRPANLQIATDKHADANANASQNTVVYGPIFPADYWQLPPALLAARLRRFSKADIMRSLRQNARRMGVDGGKLRAVMRHIEIMRREEAQLRNQRHYQLP

SEQ ID NO: 167130 - protein, 82 aa, Heterodera glycines
  Homolog annotation: Hit_ID=XP_306616.1; Match level="QueryCoverage =98%, HitCoverage=14%, E-value=1e-18, Identity=53%"; Hit description =ENSANGP00000000907 [Anopheles gambiae]
  Gene Ontology: Mol. function=glucose-6-phosphate isomerase activity; Cellular component=cytosol; Biological process=neurogenesis
  Coding regions on vcDNA: vcDNA=SeqID_93553; Strand=+; Position=2-247
NSLKKVEPKTVLFILGSDTVPTPHTITNAYSAREWFLHEAVDTAQVAPHFVALSTNGLSADDLSIDRNNMFELSHWIAGRYS

SEQ ID NO: 167131 - protein, 154 aa, Heterodera glycines
  misc_feature (21)..(21): Xaa can be any naturally occurring amino acid
  Homolog annotation: Hit_ID=AAR06638.1; Match level="QueryCoverage =98%, HitCoverage=94%, E-value=2e-47, Identity=57%"; Hit description =superoxide dismutase [Brugia malayi]
  Gene Ontology: Mol. function=copper, zinc superoxide dismutase activity; Cellular component=cytoplasm; Biological process =neurogenesis
  Coding regions on vcDNA: vcDNA=SeqID_93554; Strand=+; Position=2-463
VCVLVGDEDPNVNGNINFIQXKDDSTVTIQGEITGLSPGKHGFHVHAFGDLSSRCMSAGPHFNPTNKTHGGPEDDTHHVGDLGNVLVGHDGVAKLYFTDKVISLVGPHNIIGRALVVHKLEDDLGRGEGLQMPESMETGNAGPRLACGVIGIAQ

SEQ ID NO: 167132 - protein, 84 aa, Heterodera glycines
  Coding regions on vcDNA: vcDNA=SeqID_93555; Strand=-; Position=2-253
RQHLLIVSPSYHFGLCCCCGVVFDVISPGLFKFAAARRVAWNKSSCEMPGILLDAAAEVMGVGGWCTAPAPTNACKFKAEDNCC

SEQ ID NO: 167133 - protein, 81 aa, Heterodera glycines
  Coding regions on vcDNA: vcDNA=SeqID_93556; Strand=+; Position=126-371
MEQQTKFSSIQQPKPLPKLSHHQPNNNTNNNKRPAEYLVNEKYKTILCKSFTINGYCAYGAQCLFAHGEGELRNQKFKKCW

SEQ ID NO: 167134 - protein, 160 aa, Heterodera glycines
  Coding regions on vcDNA: vcDNA=SeqID_93557; Strand=+; Position=75-554
MASNSSDASDSDDDDLFTHETDDGSDAMDSDDEDQSDEDANRRADALTMEQEKQFWSIVPVEQLKTEDGNSQSSDKPSTSYAASQAGLPPSQKKNQASSSSMRHPNVCLDDSSMPCSICLSDMREECDDDVVVQLSLCSHLFHKECIKSAFAVKRQCPLC

SEQ ID NO: 167135 - protein, 195 aa, Heterodera glycines
  Homolog annotation: Hit_ID=CAE67653.1; Match level="QueryCoverage =88%, HitCoverage=31%, E-value=3e-59, Identity=69%"; Hit description =Hypothetical protein CBG13216 [Caenorhabditis briggsae]
  Gene Ontology: Mol. function=ribosomal protein S6 kinase activity; Cellular component=nucleus; Biological process=positive regulation of cell growth
  Coding regions on vcDNA: vcDNA=SeqID_93558; Strand=+; Position=3-587
AGVFSIELTDRARNQIRPSADALSDMEDEDNEYENVEYDEIPTLSPSSSYINGPEGVETIELGDNPELVNPLYTKVGPEDFQLLKVLGKGGYGKVFQVRKVTGKDSGKIFAMKVLKKATVIRNQKDTAHTKAERNILEAVKSPFICDLQYDFQTGGELYLILEYWSGGQLFMPLEREGPFMEDTAVFYLAQIVIA

SEQ ID NO: 167136 - protein, 158 aa, Heterodera glycines
  misc_feature (17)..(17): Xaa can be any naturally occurring amino acid
  Homolog annotation: Hit_ID=NP_598665.1; Match level="QueryCoverage =96%, HitCoverage=6%, E-value=1e-39, Identity=55%"; Hit description =acetyl-Coenzyme A carboxylase beta [Mus musculus] gb|AAS13686.1| acetyl-CoA carboxylase 2 [Mus musculus]
  Gene Ontology: Mol. function=acetyl-CoA carboxylase activity; Cellular component=mitochondrion; Biological process=mitosis
  Coding regions on vcDNA: vcDNA=SeqID_93559; Strand=+; Position=2-476
IILANIRGFSGGQNDMXEMVLKFGANIVDALQTYTQPIVVYLPPFGELRGGAWAVLDTKINPTCITMLADPNCRGGVLEASGIVEIKFREKDLLILLRKCDPKINQLEESLATASDPTAKGQLLDEYKRRIEKLLPICRAAAVKFADLHDTNGENAPE

SEQ ID NO: 167137 - protein, 109 aa, Heterodera glycines
  Homolog annotation: Hit_ID=CAE69012.1; Match level="QueryCoverage =71%, HitCoverage=15%, E-value=1e-15, Identity=56%"; Hit description =Hypothetical protein CBG15006 [Caenorhabditis briggsae]
  Coding regions on vcDNA: vcDNA=SeqID_93560; Strand=+; Position=207-533
MNGGSERVTHPFLPPWDFSQLLQIHVHLNLKMASGAAPCSDQRNSAKAADKAPPPSQGHRSRKWATDGGAAAHCENCVVCGDRACNHHYYGVAACHGCKCFFWRSIKTK

SEQ ID NO: 167138 - protein, 97 aa, Heterodera glycines
  Coding regions on vcDNA: vcDNA=SeqID_93561; Strand=-; Position=2-292
FLLSFVCFCSSKKKYLFSSFVCSPMIWPLPSAANVPFPRSHRSVLSTGSEPSRTFGRYFSATAPNSAKEAKEQISKALEEGKGTQSKAKQMPSPLPA

SEQ ID NO: 167139 - protein, 74 aa, Heterodera glycines
  Coding regions on vcDNA: vcDNA=SeqID_93562; Strand=+; Position=3-227
STTASSPHIHSASNGGNCGKCGSHWLQELQVLGPKFEHSVPQSGLQQQQKRLEEIKLKFLPESPNHSFILNSFK

SEQ ID NO: 167140 - protein, 158 aa, Heterodera glycines
  Homolog annotation: Hit_ID=NP_505662.1; Match level="QueryCoverage =97%, HitCoverage=41%, E-value=2e-35, Identity=46%"; Hit description =hydrolase (5K836) [Caenorhabditis elegans] emb|CAA94898.1| Hypothetical protein K07C5.5 [Caenorhabditis e
  Gene Ontology: Cellular component=extracellular space
  Coding regions on vcDNA: vcDNA=SeqID_93563; Strand=+; Position=74-547
MFVDWWNHRGAYFVAKPHMRPALLDRPEWKHKFIKLKHIQLHFVEMVEGGAHESKPVMFFLHGFPEFWYSWRFQMRHFCAKYRVIAVDLRGYNDSDKPIGIEEYGLELLSADIMELIERLGKQVVLVGHDWGGVIAWNISMERPKLLHRLVVMNGPHP

SEQ ID NO: 167141 - protein, 115 aa, Heterodera glycines
  Coding regions on vcDNA: vcDNA=SeqID_93564; Strand=+; Position=8-355
AVFVRPFIRFVAMFSPFLRRIFFAFLIASFYFGGRTFHAYLSLSASNNPQTTAVKLREFVDGADFMERIQQIIREEVKALLVKAKRVDKREIEEERASPAFSFRLHMNFTKLFGF

SEQ ID NO: 167142 - protein, 144 aa, Heterodera glycines
  Homolog annotation: Hit_ID=NP_506228.1; Match level="QueryCoverage =99%, HitCoverage=8%, E-value=1e-35, Identity=48%"; Hit description =NIDogen, basement membrane protein (174.4 kD) (nid-1) [Caenorhabditis elegans] emb|CAB01972.1| Hypothetica
  Gene Ontology: Mol. function=protein binding; Cellular component =extracellular space; Biological process=cell-matrix adhesion
  Coding regions on vcDNA: vcDNA=SeqID_93565; Strand=+; Position=3-434
SVFISDDVHLPTGMVLLQQRRWLCWVDAGIQQLSCIGLDGTGRRVIYAPLEYPFGLTVNGAEERFYWTDWEDMKIHSVFVFGKGYTQFLPGGGGKGRPYGVLSLPSKCRPHPPLCECMANNGGCAHWWLSGGRRGTTKGGCPDN

SEQ ID NO: 167143 - protein, 161 aa, Heterodera glycines
  Homolog annotation: Hit_ID=CAB88203.1; Match level="QueryCoverage =100%, HitCoverage=94%, E-value=2e-64, Identity=74%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_93566; Strand=+; Position=2-484
GIASVCSLLAIIATVVTLPSLYSEMSQMNSKVRDGVEAFRVNTDSAWTDLMDVQVVVTPPSKPRDNPFNSIFRAKRQLFGHCQCAGLQQPSCPPGPPGPSGPPGQPGQPGGAGQPGQPGAPGQPGQPGNSGQPGQPGAPGQPGKDSGYCPCPPRSSVLAVK

SEQ ID NO: 167144 - protein, 30 aa, Heterodera glycines
  Coding regions on vcDNA: vcDNA=SeqID_93567; Strand=-; Position=1-90
INPMKNNKCIHELFFEKASNNFVYGRRKRN

SEQ ID NO: 167145 - protein, 192 aa, Heterodera glycines
  misc_feature (90)..(90): Xaa can be any naturally occurring amino acid
  Homolog annotation: Hit_ID=CAE57379.1; Match level="QueryCoverage =90%, HitCoverage=72%, E-value=1e-34, Identity=39%"; Hit description =Hypothetical protein CBG00325 [Caenorhabditis briggsae]
  Coding regions on vcDNA: vcDNA=SeqID_93568; Strand=+; Position=49-626
MHSVAFSSLSTEEARLNFEQIFHENGFVRIDGVFSTEELAELRDAVKLIVEGFDPKDHPRTTFFTSDEEKHVSDSYFLDSVDKIRKLSVXTGAVQPRVMQSMFIFKQPKIGGSTNEHVDSTFLHTENGDNLLGVWIAVDPANLDNGCLWFLPGSHKDANYLSATRQYKFPRTETKHHGEKGIPPMGPLLKSW

SEQ ID NO: 167146 - protein, 99 aa, Heterodera glycines
  Homolog annotation: Hit_ID=CAE62791.1; Match level="QueryCoverage =91%, HitCoverage=40%, E-value=1e-23, Identity=51%"; Hit description =Hypothetical protein CBG06965 [Caenorhabditis briggsae]
  Gene Ontology: Mol. function=UDP-N-acetylglucosamine transporter activity; Cellular component=Golgi apparatus; Biological process=UDP- N-acetylglucosamine transport
  Coding regions on vcDNA: vcDNA=SeqID_93569; Strand=+; Position=5-301
MAAVSSAKSSSALKWVSLIVLIGQTTALVLTLRYSQTQKSHPSDGPKYLSSTAVLMAEIVVQNNLLFLALSKLDAATYQVTYQLKILTTGFFSVTMVNK

SEQ ID NO: 167147 - protein, 35 aa, Heterodera glycines
  Coding regions on vcDNA: vcDNA=SeqID_93570; Strand=-; Position=0-104
FFFFFFFLKKKFFFIKSKKNWEKFQFCIFSAFSLS

SEQ ID NO: 167148 - protein, 137 aa, Heterodera glycines
  misc_feature (27)..(27): Xaa can be any naturally occurring amino acid
  Homolog annotation: Hit_ID=NP_504167.1; Match level="QueryCoverage =92%, HitCoverage=47%, E-value=3e-14, Identity=33%"; Hit description =putative nuclear protein, with a coiled coil-4 domain, of eukaryotic origin (5E683) [Caenorhabditis elega
  Coding regions on vcDNA: vcDNA=SeqID_93571; Strand=+; Position=2-412
IVARQLAKPITGYFMGLGKEHPAFRNXVFLPVRKTITYWFHKIANENLDLGSPTSGVYVSEDTALEQASFVIHQVDIFGYSVVVVYAYSYFTHPEEKDLASVDELTELSMDTSQEIMLLNELVTDLQDDMRMPPTDR

SEQ ID NO: 167149 - protein, 165 aa, Heterodera glycines
  Coding regions on vcDNA: vcDNA=SeqID_93572; Strand=-; Position=2-496
LRASLMTASSSSSSSVGRSALPPLCHQQRHTVHLRRAGPLLRFRAQAVLYERGHRLTVAVVGHRRVLRVADLLRQRRDVALLAEEGRAQRGHFVQNAAQGPNVGLGGVRQLSDALRRHVIRRATNGVRSADPVLLPAEAEISQFGLVVLLHQHIGRLQIAMDDIF

SEQ ID NO: 167150 - protein, 90 aa, Heterodera glycines
  Coding regions on vcDNA: vcDNA=SeqID_93573; Strand=+; Position=226-495
RRFSSFVESLASRDFEQLHCLDFAHLGLGSAAFMFMGEWRELHRIALKTYYSLVFMDHDMHILPSADESEADDASSSSGAVDSPTADHSQ

SEQ ID NO: 167151 - protein, 48 aa, Heterodera glycines
  Coding regions on vcDNA: vcDNA=SeqID_93574; Strand=-; Position=10-156
FYISTKLIEKYRIYFNSLLQWITILFSIKNKIYEFIFCNESIYLHTSS

SEQ ID NO: 167152 - protein, 156 aa, Heterodera glycines
  Coding regions on vcDNA: vcDNA=SeqID_93575; Strand=+; Position=3-470
LGPIPSLLKNLRPLTSAFKTEIRIGQVLNNRALLDQYCVLFLVFGFNRLLLVTSGPCLSCVRMNEDWHDYCNAMAKCCDSLRIKPCGLDDSDVTDDSDSELSPTSCLPIYVFNAPPVDQYWSGICENQPTDKCDSYEVNLCFLDAKKRCLPRMPWA

SEQ ID NO: 167153 - protein, 73 aa, Heterodera glycines
  Coding regions on vcDNA: vcDNA=SeqID_93576; Strand=+; Position=2-223
LQILRPLLAVSLLVTCCHGQKERKPKTGTTKTSTTTTTTTTTTTTTLPKMTTPNNTAANGGGGSGNTLLFILF

SEQ ID NO: 167154 - protein, 109 aa, Heterodera glycines
  Homolog annotation: Hit_ID=NP_524226.1; Match level="QueryCoverage =97%, HitCoverage=6%, E-value=3e-09, Identity=34%"; Hit description =CG1059-PA [Drosophila melanogaster] gb|AAF52107.1| CG1059-PA [Drosophila melanogaster]
  Coding regions on vcDNA: vcDNA=SeqID_93577; Strand=-; Position=7-336
VNFCEDCPKSIISIYLPSVIVYFVHCFNLFVKIKKRLESVLSQTFQQMMTNGKKLVLEQVSYCLFPFVGSILFKQFQIITTIASVADAAQDHFAKFYGNLMRPLKYSSF

SEQ ID NO: 167155 - protein, 187 aa, Heterodera glycines
  Coding regions on vcDNA: vcDNA=SeqID_93578; Strand=+; Position=3-563
LSHFKLKMHLESRRNVTFPVWEAPFGPIAFHENDVSSEKLIKTDQTDEAINEKGNSFVHWLFLIFLLLILLAFCLFLISLICRRKIRQRIGRTYYVLQKSEPKNGGPTFEVLKTTGPIKKRRFGSRTDSMEPIQLAQHKRFFPLEGSFSATPPVTPTAPLLFAEQKPILRPILRHLPPPRLPSSSIT

SEQ ID NO: 167156 - protein, 74 aa, Heterodera glycines
  Coding regions on vcDNA: vcDNA=SeqID_93579; Strand=-; Position=0-221
NFNHFTLELHFGKTIPTISHPYVWQSPPPRGWHFVCRLISAAVLVFVVAFVRFFFPWGPIALANRSPWRTEHPT

SEQ ID NO: 167157 - protein, 100 aa, Heterodera glycines
  Homolog annotation: Hit_ID=NP_508767.1; Match level="QueryCoverage =100%, HitCoverage=70%, E-value=4e-46, Identity=89%"; Hit description= AP-2 Small chain, clathrin associated complex (17.1 kD) (aps-2) [Caenorhabditis elegans] gb|AAA96207.1|
  Gene Ontology: Mol. function=transporter activity; Cellular component= cytoplasmic vesicle; Biological process=neurotransmitter secretion
  Coding regions on vcDNA: vcDNA=SeqID_93580; Strand=+; Position=3-302
KQKLIEEVHAVVTVRDAKHTNFVEFRNFKIVYRRYAGLYFCICVDIAVFYLYYLEAIHNFVDVLNEYFHNVCELDLVFNFYKVYSVVHEMFLGGQIREAS

SEQ ID NO: 167158 - protein, 122 aa, Heterodera glycines
  Homolog annotation: Hit_ID=EAA10890.2; Match level="QueryCoverage =94%, HitCoverage=55%, E-value=4e-20, Identity=45%"; Hit description =ENSANGP00000017070 [Anopheles gambiae str. PEST]
  Coding regions on vcDNA: vcDNA=SeqID_93581; Strand=+; Position=2-367
PIPVIELSYPVSVIYCGECSMPVEYCEYSGKFERCQQWLERNLPDLAEKQMKIGAGDGKAADFWNGEETEAKKHQKRGGKGLPKARGGGNGSKEQSATVAQITLNTEVRIKNQVVTVDKGLT

SEQ ID NO: 167159 - protein, 100 aa, Heterodera glycines
  Coding regions on vcDNA: vcDNA=SeqID_93582; Strand=-; Position=49-351
WSSICCCCCCWCCRMSIIWCCSICAAASVPRGGAGGNGCWKRAPPAGGGCVPPPPFIGGCWHCSAATANENWLEWKRLLCSGGCIWTEDGRMTILAENGA

SEQ ID NO: 167160 - protein, 99 aa, Heterodera glycines
  Homolog annotation: Hit_ID=CAE71043.1; Match level="QueryCoverage =74%, HitCoverage=16%, E-value=1e-14, Identity=47%"; Hit description =Hypothetical protein CBG17885 [Caenorhabditis briggsae]
  Gene Ontology: Mol. function=SH3-domain binding; Cellular component =lamellipodium; Biological process=cell surface receptor linked signal transduction
  Coding regions on vcDNA: vcDNA=SeqID_93583; Strand=+; Position=347-643
MFYDGSQWIRPDAINNIQQLPDSHHLSNIQLMRSNVDLVFRIVAIRNRDNKRLVNQHIFHRLKYKEATPSFHQWRNEHKQVIGLNFTNEQDAKMFYEAV

SEQ ID NO: 167161 - protein, 203 aa, Heterodera glycines
  misc_feature (65)..(65): Xaa can be any naturally occurring amino acid
  misc_feature (77)..(77): Xaa can be any naturally occurring amino acid
  misc_feature (91)..(91): Xaa can be any naturally occurring amino acid
  misc_feature (112)..(112): Xaa can be any naturally occurring amino acid
  misc_feature (185)..(185): Xaa can be any naturally occurring amino acid
  Homolog annotation: Hit_ID=NP_872153.1; Match level="QueryCoverage =99%, HitCoverage=73%, E-value=2e-52, Identity=54%"; Hit description =lactate/malate dehydrogenase and Lactate/malate dehydrogenase precursor (29.1 kD) (5G996) [Caenorhabditis
  Gene Ontology: Mol. function=malic enzyme activity; Cellular component=mitochondrion
  Coding regions on vcDNA: vcDNA=SeqID_93584; Strand=+; Position=2-610
QPILVLVTGAGGRIGYSLVLVIVKRDDYGKHQPIVLSLLDIPPLTEVFSGDHYQLFDCALPDLCXDQVLTSEEAAIXDIDFAFLVRAMPRXEGMKRKDLLAANVRIFKSQRXSLDEFSKPTGIVLVEGNQVNTDPLICDKYADSEIPAKNFNAMTRLDHNRAMAQAAQNCADGTTDGMVINRIIXDNHSITHFTDIRHDNIDK

SEQ ID NO: 167162 - protein, 171 aa, Heterodera glycines
  misc_feature (24)..(24): Xaa can be any naturally occurring amino acid
  Homolog annotation: Hit_ID=NP_741215.1; Match level="QueryCoverage =98%, HitCoverage=38%, E-value=6e-27, Identity=39%"; Hit description =secreted NADH-ubiquinone oxireductase precursor (50.9 kD) (3I246) [Caenorhabditis elegans] gb|AAA62532.1|
  Gene Ontology: Biological process=growth
  Coding regions on vcDNA: vcDNA=SeqID_93585; Strand=+; Position=2-515
KQSLLFTRMYPHLIIYLDCPPEKXLENIQKRGNPAEVNAVDLEYLVNIQNSYKDFFREMRDECEILAYDWTTPQVLDVLLEDILEIDFETLDFYSSGKHRTWSLMGTDTNHCFWRHMVTTKDQLKERAMNKLGLLQTEVSELYIYPMDGIHHRNVIMHEVLKDRCTHGYTK

SEQ ID NO: 167163 - protein, 28 aa, Heterodera glycines
  Coding regions on vcDNA: vcDNA=SeqID_93586; Strand=+; Position=1-84
VFLDSNRQNDFDTHSLLIRLYILFQIKE

SEQ ID NO: 167164 - protein, 41 aa, Heterodera glycines
  Homolog annotation: Hit_ID=AAB80640.1; Match level="QueryCoverage =100%, HitCoverage=2%, E-value=7e-15, Identity=100%"; Hit description= Strong similarity to Lycopersicon aldehyde oxidase (gb|U82559). [Arabidopsis thaliana] pir||D86178 hypoth
  Coding regions on vcDNA: vcDNA=SeqID_93587; Strand=+; Position=2-124
EPVGDISKGMAEADRKIRSVEVLKFSFSLLIFDILKKNKKK

SEQ ID NO: 167165 - protein, 105 aa, Heterodera glycines
  misc_feature (8)..(8): Xaa can be any naturally occurring amino acid
  Coding regions on vcDNA: vcDNA=SeqID_93588; Strand=-; Position=65-382
FFFFFFFXSFAFNSEIIIKTVTGQIDVKKVVSHFTVSSQSALNAVSDVFRKAPESDVPVLVKPLVRHRFLPETVAGLDDSNRETQKNDGDGQCEQMSAAGGHPFP

SEQ ID NO: 167166 - protein, 123 aa, Heterodera glycines
  Homolog annotation: Hit_ID=CAE72200.1; Match level="QueryCoverage =86%, HitCoverage=11%, E-value=2e-11, Identity=36%"; Hit description =Hypothetical protein CBG19308 [Caenorhabditis briggsae]
  Coding regions on vcDNA: vcDNA=SeqID_93589; Strand=+; Position=65-433
MPKTPKCTTPSLLGRVVRKLSSARKAHPHRFVFEPKKLLIDTDERWRPVEHIVLVFRHRHRLFRSKMRSLEDSCLVGNRRVLVWPDRVVDDPIEFVTTLYNRRKQCNELDDKEWTLFVEGPMV

SEQ ID NO: 167167 - protein, 186 aa, Heterodera glycines
  Coding regions on vcDNA: vcDNA=SeqID_93590; Strand=+; Position=2-559
SNLMSPTKKFVPKRLPPELLYEISLFVNPRNNLSSICSSSRVLHKFVYLRVAKFYHSSVEQLKTSYANARRSPSWEAVKSVASLARGLRDPCLDQFLAALEDALGTGRPATYTFEKISKERVGISLIQTKGGSETNRTHTVSKTSAGPAARRSSPGDTSRTHTVSKTSAVTTESSTSRFSLPQLFG

SEQ ID NO: 167168 - protein, 122 aa, Heterodera glycines
  Coding regions on vcDNA: vcDNA=SeqID_93591; Strand=+; Position=3-368
LLISLIIVGISHGHPVYEEVPVYPLSNSQGFYDKEKGEVNGSANGTKQAQHNAIPVSGNGTEVNSNSTVDTAFDNNFNGTASGVSKNAIPAPLVSGHGFNGTENKKHIGQSKTGKKTKKSSK

SEQ ID NO: 167169 - protein, 72 aa, Heterodera glycines
  Coding regions on vcDNA: vcDNA=SeqID_93592; Strand=-; Position=49-267
MVENKTPMLVSVSIRTHSDGLCFGPRNVSAAVDVFAGHHHHHRFADECRCSAKRRHSKSVFQRNSATIGGAR

SEQ ID NO: 167170 - protein, 68 aa, Heterodera glycines
  Coding regions on vcDNA: vcDNA=SeqID_93593; Strand=-; Position=2-205
DYQSECRRSCVLNHFKDASAAAASSSSRSVSWKALDEDEAPAGIGRRMPCSKGGICRFSVSGLGIFSW

SEQ ID NO: 167171 - protein, 144 aa, Heterodera glycines
  Coding regions on vcDNA: vcDNA=SeqID_93594; Strand=+; Position=1-432
ACQALNCAFGSEGLCQFKTLFLAAGDVPFVVPPSGEGIVARFSRGMRRAILKSRHFRLPSNEQLEMHLEASLSTFGSRLYICPDEQQKTVARLSMEKTGPNGVETDPLREFGYCELLMGPKVEQRMMERMVVQLDPELRHFSLV

SEQ ID NO: 167172 - protein, 207 aa, Heterodera glycines
  Homolog annotation: Hit_ID=CAE68990.1; Match level="QueryCoverage =90%, HitCoverage=56%, E-value=2e-14, Identity=28%"; Hit description =Hypothetical protein CBG14977 [Caenorhabditis briggsae]
  Coding regions on vcDNA: vcDNA=SeqID_93595; Strand=+; Position=15-635
MLSARTLHFARSRLSSFAPLCRASTSSVRHLCLLGRNLTRYRAKEPLRDQLQNALTKNIEAKAAPRADSIPPRPLRQVIIRGGLFFFVASNVFSMIAAVNDFEMTQKRFQSVIDQAIYEFRRTFSFTPPYKRKTEAAKLIWTIIGANVAIFLLWRVPTLVPLVWQYFSSGVASKSLCMPMLFSVFSHQNLMHLFFNMDVLNSFAIVA

SEQ ID NO: 167173 - protein, 138 aa, Heterodera glycines
  Homolog annotation: Hit_ID=EAK85576.1; Match level="QueryCoverage =99%, HitCoverage=97%, E-value=7e-43, Identity=60%"; Hit description =hypothetical protein UM04314.1 [Ustilago maydis 521] ref|XP _401929.1| hypothetical protein UM04314.1 [Usti
  Gene Ontology: Mol. function=actin filament severing activity; Cellular component=actin cortical patch (sensu Saccharomyces); Biological process=cell organization and biogenesis
  Coding regions on vcDNA: vcDNA=SeqID_93596; Strand=+; Position=75-491
MSTGVAVNDQCLEVFNELKLGKKYSYIIYKLNESMTEIVVEKTADAGAPYSEFVGCLPATDCRYCVFDFKYEHAEGGERNKILFVSWSPDDAKIRAKMTYAGSKDAIRRKLVGVHTEIQATDFSEVAQDTVLEKVSRV

SEQ ID NO: 167174 - protein, 188 aa, Heterodera glycines
  Homolog annotation: Hit_ID=NP_499711.1; Match level="QueryCoverage =85%, HitCoverage=42%, E-value=1e-26, Identity=43%"; Hit description =prion-like Q/N-rich domain protein PQN-83, Prion-like Q/N-rich domain protein (41.5 kD) (pqn-83) [Caenorh
  Gene Ontology: Biological process=regulation of protein activity, epigenetic
  Coding regions on vcDNA: vcDNA=SeqID_93597; Strand=+; Position=16-579
MKFIRKKFIFSFLFCAIQLHYLNAKKFGGGGGFRGGGAARANPAPAGGHFGGGGAPVGGGQPHFVGGGAGGFHGPTGGGFHPPPAGGGFHGPPMSAGSGPGRFGSGTGLGSSSRAGTFTTALAGAAVGTVGGLVAFEAGKAIIHSFDRPFQHDGRNYYLDEKYAKKQHGEIQCKVPWDKLVNQSPAAT

SEQ ID NO: 167175 - protein, 99 aa, Heterodera glycines
  Coding regions on vcDNA: vcDNA=SeqID_93598; Strand=-; Position=3-299
IVKMRWLGQNWPLIKSIFGCFVRICVQNWALPISSSIFGFIFGIGISINKCIKLSDGSFGAIGSHWTVLWSDDGLAVFTKLITVSIRKLLINLSLALNS

SEQ ID NO: 167176 - protein, 94 aa, Heterodera glycines
  misc_feature (7)..(7): Xaa can be any naturally occurring amino acid
  Coding regions on vcDNA: vcDNA=SeqID_93599; Strand=-; Position=69-353
FFFFFFXLALILSSIAFRTMLRYLSKSLSSTRSALVDISSVHFSFYHPSKTSSPTGSLLLSEGEHSTASGSLVNVRMPNIKGEADGAVDHDQCM

SEQ ID NO: 167177 - protein, 121 aa, Heterodera glycines
  Homolog annotation: Hit_ID=NP_500248.1; Match level="QueryCoverage =85%, HitCoverage=34%, E-value=1e-14, Identity=40%"; Hit description =UBX domain containing protein (32.6 kD) (4D486) [Caenorhabditis elegans] gb|AAF60887.2| Hypothetical prot
  Coding regions on vcDNA: vcDNA=SeqID_93600; Strand=+; Position=2-364
LAQITPNVGGAADIVFADAPPKLSADETAKLVEQAHAELKEDDNLPTTRIQIVIPDTERPVDARLNQGHTVNQLRIFIVTADPRLAYRPFRLMTSYPTQPIDDEGLTVIHAGLINATALVK

SEQ ID NO: 167178 - protein, 136 aa, Heterodera glycines
  Homolog annotation: Hit_ID=XP_314661.1; Match level="QueryCoverage =95%, HitCoverage=27%, E-value=2e-46, Identity=66%"; Hit description =ENSANGP00000005009 [Anopheles gambiae]
  Gene Ontology: Mol. function=protein binding; Cellular component =cytoplasm; Biological process=TGFbeta receptor signaling pathway
  Coding regions on vcDNA: vcDNA=SeqID_93601; Strand=+; Position=3-453
FTSLDPSVKKLLGWKMGDEEEKWALKAVESLVKKMQKRKHHGYGTVEDLEYALSHPGSSSNCVTIPRSLDGRLQVSHRKGLPHVIYCRVWRWPNLQSHQIRILSTTDCMFPYDGRSEQICINPYHYHRIEMLGQSK

SEQ ID NO: 167179 - protein, 141 aa, Heterodera glycines
  Coding regions on vcDNA: vcDNA=SeqID_93602; Strand=-; Position=81-506
DVFRVLIRILSSESVCQKSVCFRVQEVAFPRRHFPPLRSLLSSHRFALFSLFFQLQLLPYLPTDLLLLLLLLLVLFSPNFCLFSVFLLFRRHHYDHRSLRCTNRIWHSVLVRRISQIIFDPFRQHSHEQFLSIASNRNLGA

SEQ ID NO: 167180 - protein, 173 aa, Heterodera glycines
  Coding regions on vcDNA: vcDNA=SeqID_93603; Strand=-; Position=3-521
EQPEKQQRQQETQPNSALSQEVEEKTTTTITMARASEAAEEEQQRCQNATATATVEEEATEVPKQQQQQTLLEQKKGKGEDQEEGWKEVRTKRNKRGSNNRNFANSRQWTTNGGELDFQFDSEMESVGNAADGGAEASEDKIWDDLDDAMCNKLIIVTQTPPSSGRKGTDVRK

SEQ ID NO: 167181 - protein, 18 aa, Heterodera glycines
  Coding regions on vcDNA: vcDNA=SeqID_93604; Strand=+; Position=1-54
VQLSLAKMENAEIKSQRK

SEQ ID NO: 167182 - protein, 79 aa, Heterodera glycines; identical to SEQ ID NO: 126123
  Coding regions on vcDNA: vcDNA=SeqID_93605; Strand=+; Position=3-242

SEQ ID NO: 167183 - protein, 134 aa, Heterodera glycines
  misc_feature (94)..(94): Xaa can be any naturally occurring amino acid
  Homolog annotation: Hit_ID=AAL26583.1; Match level="QueryCoverage =100%, HitCoverage=88%, E-value=6e-31, Identity=49%"; Hit description= ribosomal protein S16 [Spodoptera frugiperda] sp|Q95V31|RS16_SPOFR 40S ribosomal protein S16
  Gene Ontology: Cellular component=eukaryotic 48S initiation complex; Biological process=protein biosynthesis
  Coding regions on vcDNA: vcDNA=SeqID_93606; Strand=+; Position=2-403
GQMKTATAVAFSKKGNGLIRVSGRPLRDYSAPNSAHQISSSAILIVGKDSFAGFDILLLVEGGGHIAQIYDDRQPLAKSVAAFYQKNVDQQLYXELNEQFIPYNRHLMEADPQHLDPKKFVGPVTRARYHKSYR

SEQ ID NO: 167184 - protein, 59 aa, Heterodera glycines
  Homolog annotation: Hit_ID=AAO72712.1; Match level="QueryCoverage =81%, HitCoverage=21%, E-value=2e-16, Identity=81%"; Hit description =Mn superoxide dismutase [Melopsittacus undulatus]
  Gene Ontology: Mol. function=manganese superoxide dismutase activity; Cellular component=mitochondrion; Biological process=superoxide metabolism
  Coding regions on vcDNA: vcDNA=SeqID_93607; Strand=+; Position=341-569
IKFSSFRSLTSAQREKHTLPDLPYDYNALEPAISAQIMQLHHQKHHATYVNVLNTAEEK

SEQ ID NO: 167185 - protein, 71 aa, Heterodera glycines
  Homolog annotation: Hit_ID=AAV91445.1; Match level="QueryCoverage =100%, HitCoverage=100%, E-value=2e-10, Identity=51%"; Hit description=hypothetical protein 32 [Lonomia obliqua]
  Coding regions on vcDNA: vcDNA=SeqID_93608; Strand=+; Position=68-283
MGFLTYAVVSVVGGAVAMTGVGLPIAGLLGFSAAGPVAGSLAAGAQAYVGNVAAGSVFAAVQALAMAAPTP

SEQ ID NO: 167186 - protein, 37 aa, Heterodera glycines
  Coding regions on vcDNA: vcDNA=SeqID_93609; Strand=-; Position=1-111
AFLRNHKHVKVNTYKTRQWFRECNKQLTIINDLSLVL

SEQ ID NO: 167187 - protein, 68 aa, Heterodera glycines
  Homolog annotation: Hit_ID=BAB20933.1; Match level="QueryCoverage =98%, HitCoverage=17%, E-value=1e-11, Identity=55%"; Hit description =E2F homolog [Oryza sativa]
  Gene Ontology: Mol. function=transcription co-repressor activity; Cellular component=cytoplasm; Biological process=apoptosis
  Coding regions on vcDNA: vcDNA=SeqID_93610; Strand=+; Position=2-205
SRQDSSLLRMTQRFLELHATGGILNLNDAAQLVGVSKRRVYDITSVLERIEMIEKVGKDTIRWKNYDE

SEQ ID NO: 167188 - protein, 60 aa, Heterodera glycines
  misc_feature (45)..(45): Xaa can be any naturally occurring amino acid
  Coding regions on vcDNA: vcDNA=SeqID_93611; Strand=+; Position=1-184
PPCRTSRTSRPPRPTSMPCPRRTKVLPPAATRTRATAPPPLLPPXRVPPGPPHDRSRPSP

SEQ ID NO: 167189 - protein, 115 aa, Heterodera glycines
  Coding regions on vcDNA: vcDNA=SeqID_93612; Strand=+; Position=19-366
PFIYYICAPNKYLSVLHICCSRTQQSGPKAVRVLSKFIGRLSRRRVLLAVTLCNVWTRAVGLMCRSPFLSLDKPNTATTFGLFHLFTTSSTLSASSLSLLMGRRRRVKRLLAVSL

SEQ ID NO: 167190 - protein, 67 aa, Heterodera glycines
  Coding regions on vcDNA: vcDNA=SeqID_93613; Strand=+; Position=288-488
LDYDDESNNKRISKSIPVIHNNSPLSLGTEHVTGEVTGSCLLFLMKTHTLHYFTALKNTPWRGSLRA

SEQ ID NO: 167191 - protein, 142 aa, Heterodera glycines
  misc_feature (7)..(7): Xaa can be any naturally occurring amino acid
  Coding regions on vcDNA: vcDNA=SeqID_93614; Strand=-; Position=2-427
FFFFFFXYSLAFYPTNAVKKNKQKSAITQVVGSPPKFAPIRKSANASHSIRSTLPGYASPTEALAPIRTARPCSGPMQQRLDDRALHRAQCPLCYPSPPCKSSPRRALPMEQKRYFPAPMPSSFRWGVLLLRVAAGRDNEVF

SEQ ID NO: 167192 - protein, 210 aa, Heterodera glycines
  misc_feature (182)..(182): Xaa can be any naturally occurring amino acid
  Homolog annotation: Hit_ID=NP_508952.2; Match level="QueryCoverage =99%, HitCoverage=74%, E-value=3e-61, Identity=54%"; Hit description =amidinotransferase family member (XG273) [Caenorhabditis elegans] gb|AAB04595.2| Hypothetical protein T22
  Coding regions on vcDNA: vcDNA=SeqID_93615; Strand=+; Position=3-632
LMCRPTHFNVKYEINPWMRPGDPVNVQKATDQWERLKRTLEESGAQVEVMEPVGADNYPDLVFTANAAVVRGKNALLSNFFYPERKGEQHFYDRWFKQNGYETFKDLHVPFEGAGDALWIGKSKLFCGIGPRTDVRALTLISEKLRDYGAPFKVYGFRLIDPRFYHIDTCFCPLNDQIASYXPCACDPVAGDDMSDEVELVPVHEEGAMR

SEQ ID NO: 167193 - protein, 173 aa, Heterodera glycines
  Homolog annotation: Hit_ID=NP_509045.1; Match level="QueryCoverage =89%, HitCoverage=41%, E-value=4e-66, Identity=70%"; Hit description =heat shock protein (43.2 kD) (hsp-43) [Caenorhabditis elegans] gb|AAA80366.1| Heat shock protein protein
  Coding regions on vcDNA: vcDNA=SeqID_93616; Strand=+; Position=143-661
MALVSKWRSDPFGRSDWPSLWRDRFSRDWDDWPRDWPRPGELMERFRSRDFDRDRWWRDWPTDWPRMDAIVPRFSSHLDRFDRNWRDDPFWRDLYPRWAEPIFKDGIDVKTNITNDSNRFAVEMDTYQFRPEELQVKTMDDTLLIEGRHEDVRDRDNYTKMYFVRKYQLPADV

SEQ ID NO: 167194 - protein, 51 aa, Heterodera glycines
  Coding regions on vcDNA: vcDNA=SeqID_93617; Strand=-; Position=1-153
NHKLTIIIFFFSFFKFILTPAGVNVVLFFPSHWSHPLICREIIISHNTYYN

SEQ ID NO: 167195 - protein, 132 aa, Heterodera glycines
  Homolog annotation: Hit_ID=NP_504592.2; Match level="QueryCoverage =100%, HitCoverage=22%, E-value=2e-57, Identity=79%"; Hit description= receptor Mediated Endocytosis RME-1, required for endocytic recycling (65.2 kD) (rme-1) [Caenorhabditis
  Gene Ontology: Mol. function=protein binding; Cellular component =endomembrane system; Biological process=receptor mediated endocytosis
  Coding regions on vcDNA: vcDNA=SeqID_93618; Strand=+; Position=16-495
MFSWLGKNTTNKKDQDVLETVSEGLKKIYKQKLYPLEDFYRFHEFHSPALDDPDFNAKPMILLVGQYSTGKTTFIRYLLEQNFPGIIIGPEPTTDRFIVVMYGEEEAVIPGNALVVDSTKQFRALTKFGNAF

SEQ ID NO: 167196 - protein, 107 aa, Heterodera glycines
  misc_feature (67)..(67): Xaa can be any naturally occurring amino acid
  Homolog annotation: Hit_ID=CAE69858.1; Match level="QueryCoverage =81%, HitCoverage=20%, E-value=2e-10, Identity=37%"; Hit description =Hypothetical protein CBG16187 [Caenorhabditis briggsae]
  Coding regions on vcDNA: vcDNA=SeqID_93619; Strand=+; Position=39-363
MNCVPFFLSFRCTSLSFPFSRRFMTAHQASVALRPFYFAVHPDRFATEPNIRNNNEKALQPFPEANXQQQPVQVDFFVRGKDNKFRSVRLSLSGFDVEQIVRTTLEF

SEQ ID NO: 167197 - protein, 151 aa, Heterodera glycines
  Coding regions on vcDNA: vcDNA=SeqID_93620; Strand=+; Position=2-454
AFFTRHWGERFLPHKTLCSSPTIPKITLEHFRHYLDNTEKKHRQYLRVRKTLHRSHGHLIREQIAPDEIPSIFFSSAFSYRDSATFEAGFLEPRQGEADNIISGAEQIRGAVGIDSLYRPASCGSLSSMQRVQMIIAPADEACHGRMIPRS

SEQ ID NO: 167198 - protein, 103 aa, Heterodera glycines
  Coding regions on vcDNA: vcDNA=SeqID_93621; Strand=+; Position=2-310
HLKQQQPHFAASVWHPSHGQEAGPGSPSVSVFIALAKEGRRRWWHCWRSGCEERRRQRRHEGNGIGTAAADQSVAAHCQIRRLLLNHFVPAVGRRLPFLCWAT

SEQ ID NO: 167199 - protein, 80 aa, Heterodera glycines
  Coding regions on vcDNA: vcDNA=SeqID_93622; Strand=-; Position=1-240
VIENIFRIIRHIRPILLSRFSPLSFDRLHPLLVLVLLPELLMVFLDQKQIIFTHLRPPAAQPRHEKCQSFRQFRFLQPSR

SEQ ID NO: 167200 - protein, 199 aa, Heterodera glycines
  misc_feature (123)..(123): Xaa can be any naturally occurring amino acid
  Homolog annotation: Hit_ID=CAI02740.1; Match level="QueryCoverage =95%, HitCoverage=87%, E-value=4e-30, Identity=33%"; Hit description =hypothetical protein PB300893.00.0 [Plasmodium berghei]
  Gene Ontology: Mol. function=cell adhesion receptor activity; Cellular component=cell wall (sensu Fungi); Biological process =agglutination during conjugation with cellular fusion
  Coding regions on vcDNA: vcDNA=SeqID_93623; Strand=+; Position=3-598
QLYLFNHSCTSFNHSCTFSDHCCTSSNHFCTSSSNLYLFNLCCTSSNHFCTSSSNLYLFNLCCTSSNHFCTSSDHCCTSSNHCCTSSDHFCTSSNHFCTSSNHFCTSSNHFCTSSNHCFTFLXSSCTSSNHSCTSSDHCCTSSDHCCTSSNHFCTSSNHFCTSSNHFCTSSNHSCTSSNHSCTSSNHSCTSSDHFCTSF

SEQ ID NO: 167201 - protein, 193 aa, Heterodera glycines
  Homolog annotation: Hit_ID=AAP92535.1; Match level="QueryCoverage =70%, HitCoverage=52%, E-value=7e-13, Identity=33%"; Hit description =Ab1-042 [Rattus norvegicus]
  Gene Ontology: Biological process=salinity response
  Coding regions on vcDNA: vcDNA=SeqID_93624; Strand=+; Position=46-624
MTLRMALMEEITQRSRKKEKNRDNTEKDGEKCEIGQQKQRVEEKQRIGERRKAEEDEEEQQQKQRNARVTERVERKQANEERKEVAEEQRKRGKRRSGERHARKSLFSSSSEEEGAEEEEEEKEKAFNISTKPSLPVLENRRQKLENGPDSSLGRSLSQRPLSVQSFGSSVGDGTTNISDDRKTTVSGQTPSL

SEQ ID NO: 167202 - protein, 128 aa, Heterodera glycines
  Coding regions on vcDNA: vcDNA=SeqID_93625; Strand=+; Position=2-385
KFELGLSGDQFPSIPPITFLFVPRAIPRRPSVAHFGCPPLGNAFVAVFRLLFRCFSFCCFLRLSFRTCQFFPLPLISAKRRPSASVCSFRTHTGAAWSLGWHWPNGTSASSAPHRRQIRLPIFFVPIA

SEQ ID NO: 167203 - protein, 140 aa, Heterodera glycines
  Homolog annotation: Hit_ID=AAO61963.1; Match level="QueryCoverage =77%, HitCoverage=44%, E-value=5e-13, Identity=36%"; Hit description =DNA polymerase [Aster yellows phytoplasma]
  Coding regions on vcDNA: vcDNA=SeqID_93626; Strand=+; Position=70-492
IKFCIFLGEQLKVYCENDVEILMEAILKFRQLFLDITDGMDVLKDSVTIAGVVMRIFRTKFLKDRHIPIMPEGGYERADNQSKIAVKYFEWLAHREGIRVRHAENGGEIKFGDLKVDCVIGCQKRIIEFQVFKNKSHPLM

SEQ ID NO: 167204 - protein, 96 aa, Heterodera glycines
  Coding regions on vcDNA: vcDNA=SeqID_93627; Strand=+; Position=1-291
PKPKPKTLTKKTNKLKPLALNRPKRCHSFSQMIISFRLIVIYFACFSHSVHFCSSRAIGQRTNKKAFLKFTFWNIIFKVFLSFFSILPSPTVALDT

SEQ ID NO: 167205 - protein, 128 aa, Heterodera glycines
  Homolog annotation: Hit_ID=NP_499618.1; Match level="QueryCoverage =51%, HitCoverage=5%, E-value=7e-12, Identity=45%"; Hit description =E1-E2 ATPase, putative E1-E2 ATPase (3N488) [Caenorhabditis elegans] emb|CAB11550.4| Hypothetical protein
  Coding regions on vcDNA: vcDNA=SeqID_93628; Strand=+; Position=95-481
NPKNFPVNADKSTQISKIFRVSSVGSTRPYPLFPKVFLILSIVLQNVPLTIRTLLAAGIRIWMLTGDKLETAVQIAQSSSLCHKDTELMVLAERRFDTVLAKLQEYTLKVVKGGVSARFGLEAAEQNG

SEQ ID NO: 167206 - protein, 206 aa, Heterodera glycines
  Coding regions on vcDNA: vcDNA=SeqID_93629; Strand=+; Position=2-619
SASTVIQSVLQQVLSEDISLAANNDENDGEEDTKKQNGDVPHEQKELKEDNNSKKAGHGTDTELSSTNVVVHYENLVDSSATAPPRPPQPCHGTSPTHHKFTANITTNTNNINNSKSIVSADNTSPKHAPSSSSQSEVLSILTRKQQQQKTLQLSANKKFHRRSASDRSPAKLDKLPQCKSPRPTHQKSSTWEPHQAQQQHKLLLG

SEQ ID NO: 167207 - protein, 60 aa, Heterodera glycines
  Coding regions on vcDNA: vcDNA=SeqID_93630; Strand=-; Position=266-448
FVGLGRALRARYLKFVDSYGRFAPVTGASRRFFNFCWPWTGASRPFLNSLNSYGRFAPVF

SEQ ID NO: 167208 - protein, 208 aa, Heterodera glycines
  Homolog annotation: Hit_ID=CAE67933.1; Match level="QueryCoverage =100%, HitCoverage=36%, E-value=2e-67, Identity=63%"; Hit description= Hypothetical protein CBG13533 [Caenorhabditis briggsae]
  Coding regions on vcDNA: vcDNA=SeqID_93631; Strand=+; Position=1-624
EGSIVFPRVPLIIVEGPLAVCQLLETPLLNLVNYASLVTTNAARFRLAAGESIGLFEFGLRRAQGPDGALSASKYCFIGGFDSTSNLLAGKLYGIPVSGTMAHSFVTSFEPDEPMKRPNLLLPNDKVVDLFQLSKDKLDFLFKIDSIDWEVARNDLNMGELAAFCAYAIAHPKSLVALVDTYDTLRSGLINFCACALALADLGFRAIG

SEQ ID NO: 167209 - protein, 84 aa, Heterodera glycines
  Coding regions on vcDNA: vcDNA=SeqID_93632; Strand=+; Position=47-301
NVADVAAGVILFFSPKYLFLGPNFPCKIENIDPIECDACYRIFYNQKCFKNHLEKACKFYKRCVDCDKEYYNDHQHICGKYYFQ

SEQ ID NO: 167210 - protein, 105 aa, Heterodera glycines
  Homolog annotation: Hit_ID=CAE69291.1; Match level="QueryCoverage =89%, HitCoverage=22%, E-value=1e-17, Identity=47%"; Hit description =Hypothetical protein CBG15346 [Caenorhabditis briggsae]
  Gene Ontology: Mol. function=acid phosphatase activity; Cellular component=integral to membrane; Biological process=regulation of cell cycle
  Coding regions on vcDNA: vcDNA=SeqID_93633; Strand=+; Position=3-412
LATLKFVHAVWRHGDRSPSKMIPSDQTNTLDKWKAKFGGLGQLTADGAQQHFNLGRLMRHRYDGFLSCKFTPEEFVYRSSDYNRTKMSAIANIQGQLGGKGSKSN

SEQ ID NO: 167211 - protein, 166 aa, Heterodera glycines
  Coding regions on vcDNA: vcDNA=SeqID_93634; Strand=+; Position=1-498
LLFRFCVSSAVDHLSVSPFGTLSHRRNCDIVSYNFSALVRNARPFDSADRTFVADTPLGVVLRRRFDFSSPLTANVSVHLSVLSANNKLLLFSRFSSQMPSPAEGENAQTFQYVNYGNVLIFQLRAKCADGSVGQKCTEICAPPKAGDHYFCAADGMRCVPGWGGT

SEQ ID NO: 167212 - protein, 215 aa, Heterodera glycines
  misc_feature (56)..(56): Xaa can be any naturally occurring amino acid
  Homolog annotation: Hit_ID=CAE65790.1; Match level="QueryCoverage =93%, HitCoverage=44%, E-value=4e-30, Identity=37%"; Hit description =Hypothetical protein CBG10894 [Caenorhabditis briggsae]
  Coding regions on vcDNA: vcDNA=SeqID_93635; Strand=+; Position=4-649
MANFCSVLSNHFGLFLLFLAFGSNGQQREHAAEVRAVKGKLFVHMLHSAYFFPQTXRPTLPHWLHLFPSRHRSIAFLLGTPVSPHSHFPIHIIARRLDTFQSSERSFAIIASDDVQFDGGAQQIAEIKVTNVDAEELIWELIRGHKMAKGLERAIHSTFRGRGVNPFVFNILPGTPNPPTDEVLHQLRHQLKFGAIVQVGTQAHFHSNVLQLARG

SEQ ID NO: 167213 - protein, 199 aa, Heterodera glycines
  Coding regions on vcDNA: vcDNA=SeqID_93636; Strand=+; Position=1-600
GARRKKSGGSHPRKQSMVSFLFAAISSSAPSIQNRRRNRLPPPRQLSVPERGSLVDLNSEDEPFRLVQKAPSVTVSASSSYSNQRTPPTNRMSRECLSGSQTDGMPPSGHSQFVLFGFAFGPRSSSFKSLIPSFPLFLWHFRSFLSVGFLPIIRRLSPSRIFWLKLTQSVSVRLSPAHCFCVVWTRSVSNEATKIYQLN

SEQ ID NO: 167214 - protein, 159 aa, Heterodera glycines
  Coding regions on vcDNA: vcDNA=SeqID_93637; Strand=+; Position=1-477
VGPSAKMVLCPLSLNRQLGCTCTVLSESHSVQILCNGTQPDKVWAVLGGFAPNIDKLAIRRCTTNKKSSILKNMLPLKVRSLEISNCAIAQIQPNAFDSLADSLEELSLESNALTSSESPQIKACQIPQLQQQFGQRTVRFDVFWTQGVEISATSNEQT

SEQ ID NO: 167215 - protein, 72 aa, Heterodera glycines
  Coding regions on vcDNA: vcDNA=SeqID_93638; Strand=+; Position=3-221
KLFFIPKNRHIGRFLNPPCGRKTKKCKTYKFITWSIFNQINNSWYHSIALGVFYQNIILLNFLLKYIKRYGN

SEQ ID NO: 167216 - protein, 90 aa, Heterodera glycines
  Homolog annotation: Hit_ID=NP_499976.1; Match level="QueryCoverage =76%, HitCoverage=4%, E-value=1e-10, Identity=42%"; Hit description =putative protein family member, with at least 15 transmembrane domains (4B476) [Caenorhabditis elegans]
  Coding regions on vcDNA: vcDNA=SeqID_93639; Strand=-; Position=2-327
GVCPPNSFLFVSSLRQTFLQVLAISAVNTFCGLIYIYMQFFRISDLLIYLASFLWVWAHGLPSLIYLTMNKTIRRDIVNFMDPNKSNMGI

SEQ ID NO: 167217 - protein, 146 aa, Heterodera glycines
  Homolog annotation: Hit_ID=NP_741519.1; Match level="QueryCoverage =99%, HitCoverage=33%, E-value=4e-36, Identity=52%"; Hit description =putative N-myristoylated protein of bilaterial origin (50.4 kD) (5E179) [Caenorhabditis elegans] gb|AAL65
  Coding regions on vcDNA: vcDNA=SeqID_93640; Strand=+; Position=2-483
ARLSSFFESIGWKVYTVPETASILLSPGRIRFPDLSRDQAAQFQIDLLKTLIQIENVFFNQAELSEAEKIMIILDRGAMDGSAYIDMESWSNVLSACGVDNHEMRERYHQIYHLVTAADGAQSFYQLANNQARTEAMEEAIEIDKK

SEQ ID NO: 167218 - protein, 175 aa, Heterodera glycines
  Homolog annotation: Hit_ID=CAA55737.1; Match level="QueryCoverage =100%, HitCoverage=42%, E-value=1e-82, Identity=88%"; Hit description= unnamed protein product [Nicotiana tabacum] sp|Q40465|IF4V_TOBAC Eukaryotic initiation factor 4A-11 (eIF4
  Gene Ontology: Mol. function=helicase activity; Cellular component =eukaryotic translation initiation factor 4 complex; Biological process=nucleobase, nucleoside, nucleotide and nucleic acid metabolism
  Coding regions on vcDNA: vcDNA=SeqID_93641; Strand=+; Position=3-527
GTGKTATFCAGILNNIDYNSNECQALVLAPTRELAQQIEKVMRALGDFLQVKCHACVGGTSVREDARILGAGVQVVVGTPGRVFDMLRRRYLRADSIKMFTLDEADEMLSRGFKDQIYDIFQLLPPKLQVGVFSATLPPEALEITRKFMNKPVRILVKRDELTLEGIKQFYVNVD

SEQ ID NO: 167219 - protein, 217 aa, Heterodera glycines
  Coding regions on vcDNA: vcDNA=SeqID_93642; Strand=+; Position=1-651
QEHARKAGSTPKSPRQTTKAPSTTGEGTSTETMPSTSNAEPRQRPSPRPLSTTPIRRHVRTRPTTTDQTTGTDSRAAVQSTQTFLETVETATQTETEQGPIQRLCTELNKAKRRIGTLERQLQRKTEEMKQLRKRPTEHHRHKLKRVSSLDDLSRQSRTTRAKEIARNLSHLFRPDTPIPEIDKVVRQARHQANFISPKKSLGKWTRNGRTRKKERI

SEQ ID NO: 167220 - protein, 89 aa, Heterodera glycines
  Coding regions on vcDNA: vcDNA=SeqID_93643; Strand=-; Position=1-267
IFFFNLRSDFRARVWTPDTCEFLIFIHRFQFKFISLFSYHLLSYFYHDLVRVLDKILARDFVVIFLVTDFHGIRYFPGTKTHWISISLV

SEQ ID NO: 167221 - protein, 182 aa, Heterodera glycines
  Homolog annotation: Hit_ID=NP_001004509.1; Match level="QueryCoverage= 97%, HitCoverage=12%, E-value=3e-09, Identity=27%"; Hit description =si:busm1-180o5.3 [Danio rerio] emb|CAD60788.1| novel protein similar to DNA polymerases [Danio rerio]
  Coding regions on vcDNA: vcDNA=SeqID_93644; Strand=+; Position=1-549
EHTSSNIVLSLWTTSRARLKLLDYMLQCYNTPGTELLYTDTDSVIVRHKRDLVPVHTGEYLGQMSEEYADYDILTFACGGAKQYAMKMVHKQTKAVKFVQKIRGITFDVNNSQELQFEHFVRKVINYGKEDEQENAVVFNYNKIQPTKDNRIITRKQNKKYLPVCQKGIINQTLEVLPFGYE

SEQ ID NO: 167222 - protein, 199 aa, Heterodera glycines
  Coding regions on vcDNA: vcDNA=SeqID_93645; Strand=+; Position=20-616
MAQVDDDYEANKRVADSLREYMGRRLNVANAFETPILEGLMAAVKVEPLQRIGTVLDASARCYAFRVDNTYSACYKVLSAASGGEKIAPFQNDDWQNDRDEVETVNANDEGGDKSGTIASGEDGEGSGEGNKRDKNKLSKPLDSSRKAKLLTRETHQLAEGLWKRFASAQHFGDTEDDLHALFDQLSTDVTGTVMKRRL

SEQ ID NO: 167223 - protein, 65 aa, Heterodera glycines
  Coding regions on vcDNA: vcDNA=SeqID_93646; Strand=+; Position=274-471
TIEFDFFELFFTMRFFYYFLLNSLQRVTGTWCTEHMRTVLNSRPLSSAQFPANEFGTTRAGTFPI

SEQ ID NO: 167224 - protein, 158 aa, Heterodera glycines; identical to SEQ ID NO: 127570
  Homolog annotation: Hit_ID=XP_520831.1; Match level="QueryCoverage =78%, HitCoverage=12%, E-value=4e-11, Identity=34%"; Hit description =PREDICTED: similar to copine VIII [Pan troglodytes]
  Gene Ontology: Mol. function=calcium-dependent phospholipid binding; Biological process=vesicle-mediated transport
  Coding regions on vcDNA: vcDNA=SeqID_93647; Strand=-; Position=91-567

SEQ ID NO: 167225 - protein, 118 aa, Heterodera glycines
  Homolog annotation: Hit_ID=CAE64132.1; Match level="QueryCoverage =88%, HitCoverage=12%, E-value=3e-10, Identity=41%"; Hit description =Hypothetical protein CBG08748 [Caenorhabditis briggsae]
  Coding regions on vcDNA: vcDNA=SeqID_93648; Strand=+; Position=1-357
AHMNLELQQRSVEFSRLLSKDELRNGLLERMPAIEHNALHTAATPIEMDDNHQELIVAQKEHQSQKPKADEIDLLGLGNTDSPALVDILFGGGVPNVQPLSRNIGKDPIDDLFSFESR

SEQ ID NO: 167226 - protein, 214 aa, Heterodera glycines
  Homolog annotation: Hit_ID=NP_510427.1; Match level="QueryCoverage =94%, HitCoverage=25%, E-value=1e-32, Identity=43%"; Hit description =putative protein of eukaryotic origin (XP188) [Caenorhabditis elegans] emb|CAB01868.2| Hypothetical prote
  Coding regions on vcDNA: vcDNA=SeqID_93649; Strand=+; Position=1-642
VRLVSPAFTCNSQPKTASSQSKSYSFADRVIETLSLYVQSVEIFFESDSGTDFDFGGSISLYSLALESISPNWSEEKDVDTNLTRIHDKTIRQVLFFKQLSWRLLKIEASAHPKCGADEQREPLRSKTNSPLRLLTVDGKCRISIKKSSQNCSLLAGKIELILKEIHWLATMLHLRMAIDFHKHLVDLANCQKKADSVTPFLGQRQNPFTDASS

SEQ ID NO: 167227 - protein, 100 aa, Heterodera glycines
  Coding regions on vcDNA: vcDNA=SeqID_93650; Strand=-; Position=0-299
RSATDRTSRRWPDGSMEEAAEPADADSLNDLDLTLDGSAGTECRFGIGRLDGTLPFVSAIVRFFVLSLSPVPSLPALRPRRRLTKSGDASQTRVATRRRL

SEQ ID NO: 167228 - protein, 213 aa, Heterodera glycines
  Homolog annotation: Hit_ID=NP_032645.1; Match level="QueryCoverage =94%, HitCoverage=21%, E-value=7e-28, Identity=36%"; Hit description =Moloney leukemia virus 10 [Mus musculus] pir||A39611 probable GTP -binding protein - mouse emb|CAA36803.1|
  Gene Ontology: Mol. function=ATP binding; Cellular component =intracellular; Biological process=germ-cell development
  Coding regions on vcDNA: vcDNA=SeqID_93651; Strand=+; Position=1-639
KRLDCISYLAKEAKNRFFGIPDRHNLKMFRVIISTLSTSSYLVSAGGLRGFFTHLIVDEASQATEADTWIPIGGLVGPQTSVMFAGDPKQLGPVVRPENLKWFGFDNSLMKRIMYGDVYSQADDRVFVTLKQTYRSHYAILRPCSYLFYDNILQVDDGQGDFHKLTEWEGLPTKGFPVIFHSSRGSKDEQGFNRSHHNLFEAELVRHYVERIL

SEQ ID NO: 167229 - protein, 108 aa, Heterodera glycines
  Homolog annotation: Hit_ID=AAQ12016.1; Match level="QueryCoverage =80%, HitCoverage=30%, E-value=2e-30, Identity=78%"; Hit description =tropomyosin [Heterodera glycines]
  Gene Ontology: Mol. function=structural constituent of cytoskeleton; Cellular component=muscle thin filament tropomyosin; Biological process=pole plasm oskar mRNA localization
  Coding regions on vcDNA: vcDNA=SeqID_93652; Strand=+; Position=2-325
DLTGANNLLDEKEKKVEEAEAEVGSLKRRMVVLEEELDKREEGVKLATEKREEGTANCDESERVGKVKENRSLKEEERGNGIEEKLEGGRIGWGEEGGAKNRKEVGWK

SEQ ID NO: 167230 - protein, 115 aa, Heterodera glycines
  Homolog annotation: Hit_ID=NP_507780.1; Match level="QueryCoverage =99%, HitCoverage=7%, E-value=3e-10, Identity=33%"; Hit description =predicted CDS, DNA polymerase type B, organellar and viral family member (5T899) [Caenorhabditis elegans]
  Coding regions on vcDNA: vcDNA=SeqID_93653; Strand=+; Position=42-389
GCTWHGCKKCYPNDNMLLPSGKTAGQVRERDSKRMEFLREKVNRVDVYWECEIHRMLERSKEMRKAFEDYVDDGPLVIRDAFMGGRTGPLKLLRKAGPGEKISYYDFTSLYPYIK

SEQ ID NO: 167231 - protein, 85 aa, Heterodera glycines
  Coding regions on vcDNA: vcDNA=SeqID_93654; Strand=+; Position=67-324
GQPQLKGSYPKLARPTQLKVVPQASKVKKSGDPPLLRSAREELHRLHPARSARLWLQESARGRHTCGRKVLHSRSLYGPFSCPAY

SEQ ID NO: 167232 - protein, 193 aa, Heterodera glycines
  Homolog annotation: Hit_ID=NP_498151.1; Match level="QueryCoverage =79%, HitCoverage=3%, E-value=3e-24, Identity=38%"; Hit description=g- protein beta WD-40 repeat (3G476) [Caenorhabditis elegans] gb|AAF60491.2| Hypothetical protein Y32H12A.8
  Gene Ontology: Cellular component=peroxisomal membrane; Biological process=protein targeting
  Coding regions on vcDNA: vcDNA=SeqID_93655; Strand=+; Position=1-579
LNPQPQSKNLIATAGRDKYIRIWDWSKSTPHFIYTVETMAIVTRVSWCPNNSWHVACCFASPSGFAYSDNIVYVWDIRRPFIPYASFDTHTKTCTDMSWPRFGSGDQFLSCGKDGKLAVNFADDAHHPILYANSVALDSNSPFDEITVAVPSDLRKSSSVVDPFRRKVPSNLFCAFPSDPFLMTSRAVSYFAE

SEQ ID NO: 167233 - protein, 95 aa, Heterodera glycines
  Coding regions on vcDNA: vcDNA=SeqID_93656; Strand=-; Position=23-310
SFVFLGWPAHQFRLVLCAEFHNFLDHQLQIPQFDDQHAHASFVQVPRLPEHTAHPSCSRSRLSQCLKLSNIFFLLYSQTTIKKLSPFQCNHFFHV

SEQ ID NO: 167234 - protein, 203 aa, Heterodera glycines
  Coding regions on vcDNA: vcDNA=SeqID_93657; Strand=+; Position=3-611
ITRDVERRMSMKAKEAEAKAAKSNSDVNNESADDDDDVFGSHQHRHTGLDHGVRRFARSYGVGAVDFFRGAVRKAKQIPEHLTRNVSMSRSTKKSEIIAGENEDGASSIADSDIDQLSIAAAASEPNAAMPAIATPSTSAGTATRKWRFGSAEPPRGNTPSVSTPPTTSAAATSSTQGQGMNSSAPSSSAPFARTGVCRSKNA

SEQ ID NO: 167235 - protein, 207 aa, Heterodera glycines
  Homolog annotation: Hit_ID=CAE71277.1; Match level="QueryCoverage =95%, HitCoverage=30%, E-value=1e-23, Identity=34%"; Hit description =Hypothetical protein CBG18160 [Caenorhabditis briggsae]
  Coding regions on vcDNA: vcDNA=SeqID_93658; Strand=+; Position=2-622
KVLNEEEEAEGTQPGTEPTNQYIQTTFIHRDANDDDREFAQFTRLMLAYVRPHLLALAHVTVDNENIDCSVDDGHPRCGEYPMEKPFHFLVVEDSRSGAAVYSIERMRNWHAGGSRARTMARIEAALLDALSRHSVHPLTLYASESATNELCFVREVSVTELEQLIRQNHAKRSSAASPSTGPSIFTRSPTELRLLNDRLLARRRVD

SEQ ID NO: 167236 - protein, 81 aa, Heterodera glycines
  Coding regions on vcDNA: vcDNA=SeqID_93659; Strand=+; Position=3-248
SMFVCPSFSPSVQFLFSLSLFLSFVTLLRFFFLFGAKQQMLCLADLLISFCLLIGTQLACRVSVRFIGPIAMAHPKPINSE

SEQ ID NO: 167237 - protein, 122 aa, Heterodera glycines
  Coding regions on vcDNA: vcDNA=SeqID_93660; Strand=+; Position=156-521
GKKKPKSKTKLQNSHLKIREGRKHSIPSDQNGDESYGRHLKIFLQFTTCLTASAAGCRSLYRSCCCSTGSASWISSSAWCRRWCCAASASALFRLLFSRFCGPFGRRAPPGGHLPNWAGPRG

SEQ ID NO: 167238 - protein, 63 aa, Heterodera glycines
  Coding regions on vcDNA: vcDNA=SeqID_93661; Strand=-; Position=9-200
AYSNGGTRIRCSSSRALQTYFCFFSISSLNGVKTTFVNCFAFNKPIIKIIIGTEVQAYADFVS

SEQ ID NO: 167239 - protein, 89 aa, Heterodera glycines
  Coding regions on vcDNA: vcDNA=SeqID_93662; Strand=+; Position=105-374
LIINCRHNRFECSSPSFRWLSPPSPSRGWAGSARVGKWRAPRAAERHRTRRFVCATSARRAQGTSHAPRWSDCQHLLRGGIINMAISEL

SEQ ID NO: 167240 - protein, 144 aa, Heterodera glycines
  Coding regions on vcDNA: vcDNA=SeqID_93663; Strand=+; Position=2-433
PWESNNDQQMCHVWTSLAPADLCARNSWARLRRMREMSLFTKCPDGFTNLQLIELFRLDWRRIRSEEDLLAHSDHLRDGPWGRGCLIGPTNSADCLHCFERLRRAIEQVEAVHWAFANLLNRFDCRLAKFGLASATAALLAQHD

SEQ ID NO: 167241 - protein, 143 aa, Heterodera glycines
  Coding regions on vcDNA: vcDNA=SeqID_93664; Strand=+; Position=160-588
LTSQTDHPSAADQSFLPLPNSSAVVCRGMLFRLTLFVLLPFVPSIADEFRHRKFEKTGREIRMATKVYAWGYQHLQEEIASSSAIDDIRLRSMALRTGRLPNSSGIWKRKSKMGTKNDSNANEQSVDGQHQKETMTAHARLIE

SEQ ID NO: 167242 - protein, 72 aa, Heterodera glycines
  Coding regions on vcDNA: vcDNA=SeqID_93665; Strand=+; Position=27-245
FPAEAKLPGGEKAKGLLKGGKSKGKGGKAGERGERGRQESRECVDAFVLLVTPPPPPPIGFFWNSFPPFFTN

SEQ ID NO: 167243 - protein, 48 aa, Heterodera glycines
  Coding regions on vcDNA: vcDNA=SeqID_93666; Strand=+; Position=1-147
FFLKIAKIYKMPNFLILSCHYGTPTKCPSHEMSKRVKTHEMSKIFQNL

SEQ ID NO: 167244 - protein, 211 aa, Heterodera glycines
  Homolog annotation: Hit_ID=NP_510849.1; Match level="QueryCoverage =100%, HitCoverage=15%, E-value=9e-47, Identity=44%"; Hit description= predicted CDS, zn-finger, CCHC type and RNA-directed DNA polymerase and Integrase, catalytic domain cont
  Coding regions on vcDNA: vcDNA=SeqID_93667; Strand=-; Position=2-634
STQLCPINPHIGLFQCHLMPFGVSSAPSIFQHLMVQMCAGIPGVFACVSDGLIATKSLEQRIAPLYTLFGRIKKYGLRIQLDKCKFLQHKLLFLGHIVSANGIRPDPSRSDAIWKMPAPIHKSTLRSFLGALNYNGRFVKCMRELRAPLDRFLQKDVAWNWTSEQQNAFEKAKEMMTSDLLLTHYDPTRPIVVSADASKDGIGATLSHTFP

SEQ ID NO: 167245 - protein, 61 aa, Heterodera glycines
  Coding regions on vcDNA: vcDNA=SeqID_93668; Strand=+; Position=2-187
FSPNSSPSSSLVGEGRGRIFLCVPSQFHPPPPPSSPFPSRPDIIPSNRYFLSMRTLQSMNE

SEQ ID NO: 167246 - protein, 199 aa, Heterodera glycines
  misc_feature (33)..(33): Xaa can be any naturally occurring amino acid
  Homolog annotation: Hit_ID=CAE58624.1; Match level="QueryCoverage =97%, HitCoverage=28%, E-value=9e-45, Identity=47%"; Hit description =Hypothetical protein CBG01792 [Caenorhabditis briggsae]
  Gene Ontology: Mol. function=metalloendopeptidase activity; Cellular component=mitochondrion; Biological process=mitochondrial processing
  Coding regions on vcDNA: vcDNA=SeqID_93669; Strand=+; Position=2-597
TDCVRCMHTDPKWGKAAEEAMRYFTSLVETLNXNTELYEALRLSLEREQLDAVSERTCRLLLAEFEQSGIQLASVERKQFVKLSDEIFEAGTNFVDGCERPVKLSSDEQNQFGVRTSHLNGPWTQQVDRRLRWFSYRKYFEHDEQQETFLRRLVSARHNLALLTNFQSFAHRGQSNSLLGTYENVYSFLGTVIEKFVPK

SEQ ID NO: 167247 - protein, 81 aa, Heterodera glycines
  Homolog annotation: Hit_ID=CAE72608.1; Match level="QueryCoverage =100%, HitCoverage=14%, E-value=8e-29, Identity=67%"; Hit description= Hypothetical protein CBG19799 [Caenorhabditis briggsae]
  Gene Ontology: Mol. function=nucleocytoplasmic transporter activity; Cellular component=cytosol; Biological process=rRNA processing
  Coding regions on vcDNA: vcDNA=SeqID_93670; Strand=+; Position=2-244
MELIVRLGSYGLIHGDFDEFNIMLNEDESPILIDFPQMVSMDHPNADFYFDRDVQCVRTFFNRRFKFESEDWPRFGDMVRR

SEQ ID NO: 167248 - protein, 73 aa, Heterodera glycines
  Coding regions on vcDNA: vcDNA=SeqID_93671; Strand=+; Position=16-234
MTALCGKTKELPISTILERLLCTPGPQLLKDLTGILLRFRRMEHVILADIEKAFLQLGIRYVDRDACRFIWLN

SEQ ID NO: 167249 - protein, 191 aa, Heterodera glycines
  Coding regions on vcDNA: vcDNA=SeqID_93672; Strand=+; Position=3-575
STAVSQSANTPLTNVPAIPHATAPPQGMPIPKIGVIAAPKLVETSTQQAQNLLSQLGMSTSAQRVFSGQQPMANVHAPISTPTVAMFRPPIPTATVANLLGQQPMPSFGAVPSIPSNLLGTLNSALGVPMAIPPVHFNQHTMPPMVGGFPSSMPPQQPPMMNPVEMILYSKMQLYSRDLASIDNIAALIEY

SEQ ID NO: 167250 - protein, 98 aa, Heterodera glycines
  Coding regions on vcDNA: vcDNA=SeqID_93673; Strand=+; Position=103-399
SRIHKALLEQCGRKYEISVDANFAEQLREKVRSIEAKKSGIYGTEKQMAEAIEKLRLSVVQLKNNGTQKRQECAKLSQAIASVGGEGTANAGTNHANH

SEQ ID NO: 167251 - protein, 98 aa, Heterodera glycines
  Coding regions on vcDNA: vcDNA=SeqID_93674; Strand=+; Position=181-474
LDAWYDTLVYEVALRCWDQETATRGRYHRASLYSRQGTKRCAGGHAQQLQMARAWLCCEQAALRHGLRALNRWSQEVGLRYRGAAIVLQVLPVEHKGS

SEQ ID NO: 167252 - protein, 153 aa, Heterodera glycines
  Homolog annotation: Hit_ID=CAE58696.1; Match level="QueryCoverage =99%, HitCoverage=36%, E-value=4e-43, Identity=56%"; Hit description =Hypothetical protein CBG01876 [Caenorhabditis briggsae]
  Coding regions on vcDNA: vcDNA=SeqID_93675; Strand=+; Position=140-598
MLSWLLNGPLSLLLVLSGIVLNALCVVVFVRFRRNVSGGTTPIIHYYLISLAGWHSALLFNAFLLYCLPTMLWGSVVSSGPYVHLYPPTYALANATHTGTVWIILALTLDRYLALCMPFKHRIFSKRSRVKRLVVGLSIGALFFCLPRFFEVQ

SEQ ID NO: 167253 - protein, 57 aa, Heterodera glycines
  Coding regions on vcDNA: vcDNA=SeqID_93676; Strand=-; Position=2-172
VYTNQIGLISDHSISDFPSFPPPIFGFSNTLSIHKAKYHSHDPHREFAASFFFFVNK

SEQ ID NO: 167254 - protein, 170 aa, Heterodera glycines
  Coding regions on vcDNA: vcDNA=SeqID_93677; Strand=-; Position=14-526
IFFLFIKNHYFILFIFILNSGTNFNRIWRHLTASAAIVSQYQQQQKQKHGTNNNNNSNNNSNNNSIKGSNKRLHRQQRVVVDVHGHGRQQQKQRSLTQQQLYTTTTTFTTENRRRSSRRSSPSCEPSSPAAAAAAPVFPQGSGCRKFSFKIGIFREKKFTMPSNFAKSNL

SEQ ID NO: 167255 - protein, 183 aa, Heterodera glycines
  Homolog annotation: Hit_ID=CAE72000.1; Match level="QueryCoverage =39%, HitCoverage=15%, E-value=4e-14, Identity=46%"; Hit description =Hypothetical protein CBG19077 [Caenorhabditis briggsae]
  Coding regions on vcDNA: vcDNA=SeqID_93678; Strand=+; Position=3-551
EPNGIEFKEEGSESDSCCSSIVQVYNSGSCGSKKWTVEALYESCRMKVRMTGSGLMMDAEIISKRKEPDGTYRFYVHYVDCNLRLDEWVAEDRIDLMSVRIPQRVKKSASQQAIAQSLDQSFDQNFAISDAQSSRSSTPEKVIEMFRTPTRSLTGSRKRKHLGHTIEYVDANSTSSECCPSVT

SEQ ID NO: 167256 - protein, 82 aa, Heterodera glycines
  Coding regions on vcDNA: vcDNA=SeqID_93679; Strand=-; Position=41-289
LYCGVFHLLIQNQFRLRLWRREGVLLNSDPILGRLMESIKRRVCVSFSHFMHWEPFRIKTFRKNPFSSPSRKGICTEIRPWS

SEQ ID NO: 167257 - protein, 116 aa, Heterodera glycines; identical to SEQ ID NO: 155645
  Homolog annotation: Hit_ID=CAE71161.1; Match level="QueryCoverage =96%, HitCoverage=29%, E-value=7e-28, Identity=50%"; Hit description =Hypothetical protein CBG18017 [Caenorhabditis briggsae]
  Coding regions on vcDNA: vcDNA=SeqID_93680; Strand=-; Position=221-571

SEQ ID NO: 167258 - protein, 122 aa, Heterodera glycines
  Coding regions on vcDNA: vcDNA=SeqID_93681; Strand=+; Position=191-556
CFRLFETLSEEAGYQEEDNEQLPTPNNNRVIAVTANSIFTVNKIFENGGVTAIGASPSKKKSMRERMARFSIGGLNIFESESAIAFAMSERRNPKEQAPHGIELKMQEVPVNALGDENDETV

SEQ ID NO: 167259 - protein, 98 aa, Heterodera glycines
  Homolog annotation: Hit_ID=XP_310658.1; Match level="QueryCoverage =96%, HitCoverage=71%, E-value=1e-31, Identity=65%"; Hit description =ENSANGP00000020734 [Anopheles gambiae]
  Gene Ontology: Biological process=sporulation (sensu Saccharomyces)
  Coding regions on vcDNA: vcDNA=SeqID_93682; Strand=+; Position=3-299
TFGEEQRKELLEPLLKEGWETVQERDAIKKSFTFKDFNQAFGFMTRIALKADKMDHHPEWFNVYNKVDITLSSHDVQGISERDVKLASFIENVFKTVK

SEQ ID NO: 167260 - protein, 111 aa, Heterodera glycines
  Coding regions on vcDNA: vcDNA=SeqID_93683; Strand=-; Position=0-332
FQTAQCCAPLNVGLFKLEFRSIGRKGKEERKHTGILKVVLLSCGSSIGGSSCHSSSGSGAISQWQRPSIVHMLNGITLRHHALTNRRSLPVGILSRRLMSETGPKNWLKRP

SEQ ID NO: 167261 - protein, 135 aa, Heterodera glycines
  misc_feature (35)..(35): Xaa can be any naturally occurring amino acid
  misc_feature (81)..(81): Xaa can be any naturally occurring amino acid
  Homolog annotation: Hit_ID=CAE63750.1; Match level="QueryCoverage =100%, HitCoverage=54%, E-value=1e-17, Identity=36%"; Hit description= Hypothetical protein CBG08285 [Caenorhabditis briggsae]
  Gene Ontology: Mol. function=galactosylgalactosylxylosylprotein 3 -beta-glucuronosyltransferase activity; Cellular component=integral to membrane; Biological process=carbohydrate biosynthesis
  Coding regions on vcDNA: vcDNA=SeqID_93684; Strand=+; Position=2-406
LMHIYELQWDDIEDANATSDADQRIHDRSGIPCTXYSTTKKPGFRRRRWRHRSAGLDFVRHHYCLLPHNGVDYYADDDDPXDIHLVERYINKARTIGIWAVGLAGTAIEKAPHVENGTITICDRDYAPKRRVAVD

SEQ ID NO: 167262 - protein, 205 aa, Heterodera glycines
  misc_feature (77)..(77): Xaa can be any naturally occurring amino acid
  Homolog annotation: Hit_ID=NP_495808.2; Match level="QueryCoverage =100%, HitCoverage=45%, E-value=8e-60, Identity=55%"; Hit description= STCH (truncated HSP) (48.9 kD) (stc-1) [Caenorhabditis elegans] emb|CAA90248.2| Hypothetical protein F54
  Gene Ontology: Mol. function=heat shock protein activity; Cellular component=cytoplasm; Biological process=SRP-dependent cotranslational membrane targeting, translocation
  Coding regions on vcDNA: vcDNA=SeqID_93685; Strand=+; Position=135-750
MSSTTFTLISVSSLIVLLVGYYVQRYGMPPPPPKIAGIDLGTTFSSVAIFQPQTGETIVLKDPLGKRSIPSVVGFLXENGEIVVGTRAVEQQEMNPENTIYDAKRFIGRRFSSDDLQFESDRKRYPFTIKLDEDGFVYFEVHQKGVKRKIRPEEIGAIIIKYLRKMAQNHFNVNIPEVVISVPAEFDQMQRNYTTKAVELAGMNV

SEQ ID NO: 167263 - protein, 54 aa, Heterodera glycines
  Coding regions on vcDNA: vcDNA=SeqID_93686; Strand=-; Position=284-448
RGNPFFKCVFFVHLNIALAVYHFTMIQRTLPPTVLRRDPVEAFVGQMPSSYAKL

SEQ ID NO: 167264 - protein, 50 aa, Heterodera glycines
  Coding regions on vcDNA: vcDNA=SeqID_93687; Strand=-; Position=100-252
MCAIAANCGRKQFLRWKSDFFLPKSMSTLVTQETCLYDFLIWIPTNVIQW

SEQ ID NO: 167265 - protein, 123 aa, Heterodera glycines
  Homolog annotation: Hit_ID=BAB84191.1; Match level="QueryCoverage =100%, HitCoverage=19%, E-value=9e-52, Identity=74%"; Hit description= flavoprotein subunit of succinate dehydrogenase [Ascaris suum]
  Gene Ontology: Mol. function=succinate dehydrogenase (ubiquinone) activity; Cellular component=mitochondrion; Biological process =tricarboxylic acid cycle
  Coding regions on vcDNA: vcDNA=SeqID_93688; Strand=+; Position=3-374
LFAQQKRLRVSDRGLIWNSDLIETLELQNLLINALQTIVAAENRRESRGAHAREDFPVRVDEFDYTKPTEGQSKKKLEEHWRKHSIIYQNVENGAVTLEYRPVIDTTLDKSETDWVPPKIRSY

SEQ ID NO: 167266 - protein, 234 aa, Heterodera glycines
  Homolog annotation: Hit_ID=CAE61538.1; Match level="QueryCoverage =69%, HitCoverage=48%, E-value=1e-16, Identity=30%"; Hit description =Hypothetical protein CBG05443 [Caenorhabditis briggsae]
  Coding regions on vcDNA: vcDNA=SeqID_93689; Strand=+; Position=19-720
MFHFIFPFFLFPMPTLLKKALPSSHYPSSPMCRPLACRSASASDPSHLQSDDGIRPVRPPIARDSPRRRLFWSCFVVLCVAISTGYGSQLKFSLLNTASDHFYPPFLLMWLNNCCLIICFPLYLIFERAKSKDRSVREITNESARIVAEKGVKSGLAKEVFFLLLYTVGNYSYALSLGRITSSAALSVRSMDVSVVYLLGHFILHERFVGLKTIAVVLATGGVLLIAQDHQFAA

SEQ ID NO: 167267 - protein, 162 aa, Heterodera glycines
  Coding regions on vcDNA: vcDNA=SeqID_93690; Strand=+; Position=3-488
SSSVSSFPSSSAVFALFAAFCRNFVRFVSRALFQKCQCCAIAKSAPFCSVYFGRLSKRKHWQYVFNRAKFKCAQRKCQLWTNKCFSAISLEHYLLFAQSIQTCASAATKFQQFLMNCELMISAMLRFLNVPMPRKQCQTIDLTDNEIGMSFLPNSILFYFFS

SEQ ID NO: 167268 - protein, 70 aa, Heterodera glycines
  Coding regions on vcDNA: vcDNA=SeqID_93691; Strand=+; Position=25-237
LPIHTKKLHCLCLYRSLLFNCPSQNSSFFNHLCRNSFKTFVLIAFLNRSSKCVPQQNDTFFLYFFNSTLF

SEQ ID NO: 167269 - protein, 106 aa, Heterodera glycines
  misc_feature (76)..(76): Xaa can be any naturally occurring amino acid
  Homolog annotation: Hit_ID=NP_497276.2; Match level="QueryCoverage =97%, HitCoverage=35%, E-value=4e-18, Identity=45%"; Hit description =RNA-binding protein S1 serine-rich domain like (rnp-4) [Caenorhabditis elegans] gb|AAK21429.2| Rnp (rrm r
  Gene Ontology: Mol. function=RNA binding; Cellular component=nucleus; Biological process=RNA splicing
  Coding regions on vcDNA: vcDNA=SeqID_93692; Strand=+; Position=2-319
RTPSPRRRRPSPAIRGPRRRSRSPRHELAAPSPPPAKTERTPEPPPRRLCVLNLSRNITKAHMEEIFALFGALRSXELPMDRVHVHLPPGCGYAEYENAEDARERS

SEQ ID NO: 167270 - protein, 115 aa, Heterodera glycines
  Coding regions on vcDNA: vcDNA=SeqID_93693; Strand=+; Position=143-490
SLRLLIRHRNSLFRFAGDCCRAKANACFSRRNGSWNGSNSVGLEWERSLGRRGTAHFAMARRPNDAEKGGLTPHLLCQFLFSSPLSTDCPCFVRRINEGPRGIHRNALRSAKAPF

SEQ ID NO: 167271 - protein, 47 aa, Heterodera glycines
  Coding regions on vcDNA: vcDNA=SeqID_93694; Strand=-; Position=2-142
FFFFFFYLKLLNFNALDGKKCKNKQQKNEGNKLNLRDASKTNSKRWS

SEQ ID NO: 167272 - protein, 130 aa, Heterodera glycines
  Homolog annotation: Hit_ID=CAE73274.1; Match level="QueryCoverage =95%, HitCoverage=21%, E-value=4e-29, Identity=52%"; Hit description =Hypothetical protein CBG20692 [Caenorhabditis briggsae]
  Coding regions on vcDNA: vcDNA=SeqID_93695; Strand=+; Position=2-391
IGYVIENLSNRKLFFILSLLLLLQSLFFLLGALFAPGPSSSMEFVLSACVDKSSGKSGEWFTLRPDKTQNCVLVPDLKQHSPLSSDARDIVFGAQMPHMRDGVQLRYSPLCQFLIGLLDLEVEFSLETTS

SEQ ID NO: 167273 - protein, 36 aa, Heterodera glycines
  Coding regions on vcDNA: vcDNA=SeqID_93696; Strand=+; Position=2-112
ALFAVRENRYMVLNTDFNKAYKQVVKKDSDEFAFYK

SEQ ID NO: 167274 - protein, 169 aa, Heterodera glycines
  misc_feature (44)..(44): Xaa can be any naturally occurring amino acid
  misc_feature (54)..(54): Xaa can be any naturally occurring amino acid
  misc_feature (66)..(66): Xaa can be any naturally occurring amino acid
  misc_feature (133)..(133): Xaa can be any naturally occurring amino acid
  misc_feature (140)..(140): Xaa can be any naturally occurring amino acid
  Homolog annotation: Hit_ID=NP_492692.1; Match level="QueryCoverage =100%, HitCoverage=81%, E-value=2e-33, Identity=44%"; Hit description= 5-formyltetrahydrofolate cyclo-ligase (1K796) [Caenorhabditis elegans] emb|CAA21728.1| Hypothetical prot
  Gene Ontology: Mol. function=5-formyltetrahydrofolate cyclo-ligase activity; Cellular component=cytosol; Biological process=formate metabolism
  Coding regions on vcDNA: vcDNA=SeqID_93697; Strand=+; Position=2-508
RETATAALKLLDNEWFLNSTRLFIYVSHEHEICTEDIVLTALKXGPEVFIPTFXKGAERMDMLRLXSDKEFDSLEGTLWGIRQHSSSLSPLSFEETSAKAPLDLVEVPGVAFTTSGKRLGLGRGFYDRFLNEXHNNTEQXPRTIALALKERLVDDLPMESKDRMVDEVI

SEQ ID NO: 167275 - protein, 117 aa, Heterodera glycines
  misc_feature (25)..(25): Xaa can be any naturally occurring amino acid
  misc_feature (90)..(90): Xaa can be any naturally occurring amino acid
  Homolog annotation: Hit_ID=CAE60592.1; Match level="QueryCoverage =100%, HitCoverage=54%, E-value=9e-33, Identity=59%"; Hit description= Hypothetical protein CBG04228 [Caenorhabditis briggsae]
  Gene Ontology: Cellular component=cytosolic ribosome (sensu Eukarya); Biological process=protein biosynthesis
  Coding regions on vcDNA: vcDNA=SeqID_93698; Strand=+; Position=2-352
THDQLNHSAGEVLKQSQENIRNFRXTIELQIALKLYDPQKDQRFSGTVRLKHVPRPKTKVCILGYPSHCDEASADGIPCMTVDDLITLYXDNNLIQKLTSRYDAFLASESLITQIPR

SEQ ID NO: 167276 - protein, 141 aa, Heterodera glycines
  Homolog annotation: Hit_ID=NP_497685.2; Match level="QueryCoverage =64%, HitCoverage=16%, E-value=4e-17, Identity=43%"; Hit description =putative protein family member, with at least 9 transmembrane domains, of ancient origin (58.0 kD) (3E377
  Coding regions on vcDNA: vcDNA=SeqID_93699; Strand=+; Position=1-426
IRLAFPNINISLNTLLSKIIGPRRQGIQQGILQMSGAFARALGPITIGNLYTVYGPQGIWIIALSVIFTTLLLWMLFFPLMVPLSLPDENERHHPTEKTTDRPPYREERTPLVEQSDGRGQDAEAAENGNDATVTTTASLR

SEQ ID NO: 167277 - protein, 186 aa, Heterodera glycines
  Homolog annotation: Hit_ID=NP_492143.1; Match level="QueryCoverage =93%, HitCoverage=34%, E-value=2e-33, Identity=48%"; Hit description =quaking, defective in Germ Line Development GLD-1 (50.6 kD) (gld-1) [Caenorhabditis elegans] emb|CAB03417
  Gene Ontology: Mol. function=RNA binding; Cellular component=nucleus; Biological process=embryogenesis and morphogenesis
  Coding regions on vcDNA: vcDNA=SeqID_93700; Strand=+; Position=24-584
AVGTPRLPCKIMVRGRGSLRDAAKEEMNRGKPNWEHLEDDLHILIQCEDNEKRARSKLDKAVDKVKKLLVPSRDGIDELKRKQLMELSIINGTYRANIGPKNSPTVPRLTPLSMLSPVHSPLSPPHRVHSTVSSHNMFFGSPLPSPVKEYGSPRSVPSSKSTSNTGGGHGHSFDFAQLNQMMHHFD

SEQ ID NO: 167278 - protein, 200 aa, Heterodera glycines
  Coding regions on vcDNA: vcDNA=SeqID_93701; Strand=+; Position=11-613
PLKLVDISNESARILRNFSPKLKRIPESPMVLSAISTSKSGSNSQSESFRTGLEEEEEERANGMEEVVNETPHLDMMETSGTGTEVENASNSKGKIEQRKSAIAPICSITLRQRSSAMKFAPSEMKRTHIATPAFFAPALPSVSICEAEGTPSFATASSIPSTPLSIDNVSVTASGRLKRAAAKKVRSYQEPSLSKKMRR

SEQ ID NO: 167279 - protein, 119 aa, Heterodera glycines
  Homolog annotation: Hit_ID=EAA67772.1; Match level="QueryCoverage =94%, HitCoverage=40%, E-value=7e-52, Identity=91%"; Hit description =conserved hypothetical protein [Gibberella zeae PH-1] ref|XP _382718.1| conserved hypothetical protein [Gib
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_93702; Strand=+; Position=345-701
LRTNLINSVPTNDQILVPETLLKKRKSQEKARAERTDAIQKQKAANKEKRGVIFKRAEKYVKEYRDAEREKIRLHRVAKSEDSAYIPAEAKLIFVVRIKGINKMPPKPRKILQLLRLLQ

SEQ ID NO: 167280 - protein, 34 aa, Heterodera glycines
  Homolog annotation: Hit_ID=EAA68630.1; Match level="QueryCoverage =97%, HitCoverage=16%, E-value=3e-11, Identity=84%"; Hit description =hypothetical protein FG01164.1 [Gibberella zeae PH-1] ref|XP _381340.1| hypothetical protein FG01164.1 [Gib
  Coding regions on vcDNA: vcDNA=SeqID_93703; Strand=+; Position=3-107
AVEGKGHNHGEDWGPSAVEMGVKRREWANGTIDG

SEQ ID NO: 167281 - protein, 65 aa, Heterodera glycines
  Coding regions on vcDNA: vcDNA=SeqID_93704; Strand=+; Position=42-239
MPFYDSLFGGSLGDDAPPASGSAKSTSGPLAQTAIGVAPTSIPAPVAVSSKKPVIPGMAITRTTF

SEQ ID NO: 167282 - protein, 237 aa, Heterodera glycines
  Coding regions on vcDNA: vcDNA=SeqID_93705; Strand=+; Position=77-787
KAQNKMSKRTVEQQRQQQNMQKKHNKLEQFRSKLDQIESELMEVSDQLKDQLARNDQFRKGKGEIEKMPIEREGENRLIKERIFVNAAKMEQNHAQLRQNQKEVNYEFAEIIKFFDIWLRESQTHFASSPFTPTTENHSLRRQQNLKASIWAIDLFELRQFRNGNSLAQCMECGKKFMTTEEAAMGWHIVQGHPQYAAQLLQKQLERDAQQRQGTNGTETTAQKRKRKATEEQEKPT

SEQ ID NO: 167283 - protein, 78 aa, Heterodera glycines
  Homolog annotation: Hit_ID=NP_220760.1; Match level="QueryCoverage =100%, HitCoverage=15%, E-value=9e-28, Identity=66%"; Hit description= ADP,ATP CARRIER PROTEIN (tlc2) [Rickettsia prowazekii str. Madrid E] emb|CAA14836.1| ADP,ATP CARRIER PRO
  Coding regions on vcDNA: vcDNA=SeqID_93706; Strand=-; Position=3-236
FFFFFFGLILFPYQAYWHPNKLLIDQYIQLYPQLKWFFMMWSKWTLVCFYVMGELWPMIVFTLLYWQLANQITTIEEA

SEQ ID NO: 167284 - protein, 177 aa, Heterodera glycines
  Coding regions on vcDNA: vcDNA=SeqID_93707; Strand=-; Position=2-532
RRNRLNFRLFIAFPLLSVRPSAGVSNASQFGKTVLEQNLSLFREKNGRNIWQFGDQFIFGAVDGMAKQTKLSKQQINAIKNSKVRRAKIKNFNFAFKARLCAHFEIGQHMDDLLNTTCDNCCGYFPFFVKTQCHGVRFRPFFVLLVFLLVLLFAFCTICQYLLAIVRLIRRRGRRIS

SEQ ID NO: 167285 - protein, 79 aa, Heterodera glycines
  Coding regions on vcDNA: vcDNA=SeqID_93708; Strand=+; Position=15-251
FNKVPKMISLAILVVFALYEAIAVPLYLRLIYVMLKDTHFAGSPLFRIVSMIGILEVCHFLVVLLFYRLPLFAPTAEFF

SEQ ID NO: 167286 - protein, 275 aa, Heterodera glycines
  Homolog annotation: Hit_ID=XP_318162.1; Match level="QueryCoverage =99%, HitCoverage=33%, E-value=9e-76, Identity=50%"; Hit description =ENSANGP00000020700 [Anopheles gambiae]
  Coding regions on vcDNA: vcDNA=SeqID_93709; Strand=-; Position=25-852
WDWGKECQGAFIKIKEILSSDLLLTHYDPKWEIIVAADASEHGIGAVISHRFPNGAIKAIEHASSSLTPAERNYSQIEKEGLALIFAVRKFHKMIYGRKFVLQTDHKPLLAIFGNKKGIRQMSANRLLRWSLMLLAYDFEIEYVNTTEFGQADALSRLIAKSTSPEEDRVIASMEFEKEAENFFINTLETVSLSSKDIISAGNEDETIKKVKKFVKDGWPNDKAIASETEEIKLFFRRKDDLSITKECLMYGERVVIPPKFRAKVLRMLHKGHPG

SEQ ID NO: 167287 - protein, 267 aa, Heterodera glycines
  Homolog annotation: Hit_ID=NP_571683.1; Match level="QueryCoverage =97%, HitCoverage=20%, E-value=2e-09, Identity=23%"; Hit description =apoptotic protease activating factor [Danio rerio] gb|AAF67189.1| Apaf-1 [Danio rerio] sp|Q9I9H8|APAF_BRA
  Coding regions on vcDNA: vcDNA=SeqID_93710; Strand=+; Position=10-852
MVLQFSSEQKRLLGLGRVPSLRRGLLPRTSLSDQLYHCLKTFLTDPDSGWFLVHGLVGTGKSELVTKVLWERPELCFALVDRILWITDRRFHPAELSQLAADTLLLAVSLNSPTNFSQMDDGELSSVAHSLHSLLNDNFAKTLLIVDGVQMADSVKFFDQIKGKMCKILATSTSRTLFNGLENIQTFKIPSDNCSGEELAQMALNYGIKETFSAERINAILCETGGNFALLEKMFVMARGCPAIFDSLLAQLRHSPLSLVSCHSAYY

SEQ ID NO: 167288 - protein, 233 aa, Heterodera glycines
  misc_feature (155)..(155): Xaa can be any naturally occurring amino acid
  misc_feature (174)..(174): Xaa can be any naturally occurring amino acid
  Homolog annotation: Hit_ID=NP_524212.2; Match level="QueryCoverage =87%, HitCoverage=28%, E-value=5e-58, Identity=53%"; Hit description =CG9054-PA [Drosophila melanogaster] gb|AAF51814.1| CG9054-PA [Drosophila melanogaster] gb|AAM50315.1| SD0
  Gene Ontology: Mol. function=ATP dependent helicase activity; Biological process=ribosome biogenesis
  Coding regions on vcDNA: vcDNA=SeqID_93711; Strand=+; Position=38-736
MTAFEELGVLPELATALNDLEWTLPTDIQSEAIPAILGGGDVCMAAETGSGKTGAFCIPILQIVFETMLPSNPKRSGAVEDNGWRMNIFDRDHNLGIDASGFVCESNHPKLWSGSRSVRGVKGSGKYYYEATIESDGLCRMGWSTARANLNLGNXDQGWGFGRHGKKSHAGQFXDYGQSFTLGDTIRLFLELEMGRIPFAKIGLTSQWLLPKATPDSARLFPGRVIRKLVFAF

SEQ ID NO: 167289 - protein, 86 aa, Heterodera glycines
  Coding regions on vcDNA: vcDNA=SeqID_93712; Strand=-; Position=5-265
INKRHYLANNFTKNHPMWQKSISKSVLLSTKRNRTARNFPQVIHQFLANISGVEQKGLISGGPTITREFLERSKFEEMSVADDELQ

SEQ ID NO: 167290 - protein, 97 aa, Heterodera glycines
  Coding regions on vcDNA: vcDNA=SeqID_93713; Strand=-; Position=5-298
FFFFFFFLIHAVFTSKVNAFKQSIMLHRRHYCRLHTKLVWPSSSSSSSSSLAGCCASLLLHAAASCCCSTLSSSRRWALPPPSHSFGKFISAKKITS

SEQ ID NO: 167291 - protein, 118 aa, Heterodera glycines
  Homolog annotation: Hit_ID=CAE72182.1; Match level="QueryCoverage =63%, HitCoverage=13%, E-value=8e-16, Identity=52%"; Hit description =Hypothetical protein CBG19289 [Caenorhabditis briggsae]
  Coding regions on vcDNA: vcDNA=SeqID_93714; Strand=+; Position=134-490
RFRRTDQNYQDTVASMEPPILVPLAKSAAPSRYDLSSLKLIMTGAAPVGTDLLDKVRRRIPSLKQICQGYGMTEHSMCSHLSMIGSDDSNTACQLMPNLDMKGDDIESRMPLRCAQNW

SEQ ID NO: 167292 - protein, 74 aa, Heterodera glycines
  Homolog annotation: Hit_ID=ZP_00275816.1; Match level="QueryCoverage =89%, HitCoverage=66%, E-value=1e-14, Identity=56%"; Hit description =COG2154: Pterin-4a-carbinolamine dehydratase [Ralstonia metallidurans CH34]
  Gene Ontology: Biological process=sporulation (sensu Saccharomyces)
  Coding regions on vcDNA: vcDNA=SeqID_93715; Strand=+; Position=11-232
MEHGMDAIKKRSPFRECNDPLGFMTHVALNADKKYHHPKWLNVYTDVDITLRSRDADGISKRDVGLASFVEDEV

SEQ ID NO: 167293 - protein, 160 aa, Heterodera glycines
  Coding regions on vcDNA: vcDNA=SeqID_93716; Strand=-; Position=1-480
TLLDELAKTLIRKSNGHLGTQIVINVRTVPLVILEILFVILQLVVVLVVIRTVEAVLRCVWHLASAVAAFSHTAHGPSNALTLRRILANWINVTDDSSGGTQIFHLRGGRRKVRRMGNRRNASSGVPSCRTDAFLLVVVLHRMFMLSLASLCMAIALLGF

SEQ ID NO: 167294 - protein, 129 aa, Heterodera glycines
  Coding regions on vcDNA: vcDNA=SeqID_93717; Strand=+; Position=1-390
SLSTPQEWHKTGAFLEGRCFVDTAQRQLIPLRDVNGNANVREVAVILLMDRHFTQRIGPSEKGPDRPTGINQMNIRHLKLAGIHPIVFTERHFRELGDDERSQIKFIREKILSLSEEFHTNEWTEENSS

SEQ ID NO: 167295 - protein, 68 aa, Heterodera glycines
  Coding regions on vcDNA: vcDNA=SeqID_93718; Strand=-; Position=92-298
FFFFFFFNSVYHSAGNKINSIPVKNQRSQILRNYSIPLSQAQNAIIRLAHEAYFSFCRESCRESTVSS

SEQ ID NO: 167296 - protein, 114 aa, Heterodera glycines
  misc_feature (24)..(24): Xaa can be any naturally occurring amino acid
  Homolog annotation: Hit_ID=XP_315562.1; Match level="QueryCoverage =92%, HitCoverage=24%, E-value=1e-17, Identity=48%"; Hit description =ENSANGP00000017773 [Anopheles gambiae]
  Gene Ontology: Mol. function=proteasome endopeptidase activity; Cellular component=proteasome regulatory particle (sensu Eukarya); Biological process=proteolysis and peptidolysis
  Coding regions on vcDNA: vcDNA=SeqID_93719; Strand=+; Position=2-347
NRHKKLKKEKVSVDFPLGGEATAXNNNIIADFVDLLNGAEEGNSHLLVVMGGDTKLDDVLLRSPIFAGSGAALGAGGEFGINEEDDPELAMALRISLEEQRLRQQQQQGGEGTD

SEQ ID NO: 167297 - protein, 184 aa, Heterodera glycines
  Homolog annotation: Hit_ID=CAE64589.1; Match level="QueryCoverage =85%, HitCoverage=31%, E-value=9e-17, Identity=34%"; Hit description =Hypothetical protein CBG09344 [Caenorhabditis briggsae]
  Gene Ontology: Cellular component=mitochondrion
  Coding regions on vcDNA: vcDNA=SeqID_93720; Strand=+; Position=1-555
ILLVERTKTRSDGDRFTDKILRMTSRTADAKLNPFLEFTRRIGNMYTPSVYAQLINVFLNTELSDKSNGKRILIFSYGSGCIAAMYSLRFNLCTEKLMAAYGAIKQSAKKAHARLDQRIRHSPKQFTAALERTEQIVAGGDTYIETPDDGKRSDGIPMFAGTFYLREIDSKHRRFYGQIDDANE

SEQ ID NO: 167298 - protein, 44 aa, Heterodera glycines
  Coding regions on vcDNA: vcDNA=SeqID_93721; Strand=+; Position=1-132
ISLKCHSLIYFVKLLSLYILLFFKHWIINCKNKLIKKQKKKKKK

SEQ ID NO: 167299 - protein, 143 aa, Heterodera glycines
  Coding regions on vcDNA: vcDNA=SeqID_93722; Strand=+; Position=1-432
PLCSPDGGGARIRSAVPSLWSEIDTNEPVEELVSLERKAMRRRSIRSGIASGEISRVSPFLNDIVHVNKLGHEEMMNSSKFSSAASVRSANVPRQRMRSRSAGRQSIARLIPASKPNVHIHKPAIPASRPNVQIHKPAPKEHI

SEQ ID NO: 167300 - protein, 122 aa, Heterodera glycines
  Coding regions on vcDNA: vcDNA=SeqID_93723; Strand=-; Position=0-365
EAMKGFRLKLGKVPSLPRWGHHSNPAQINCSHKHDQRDQNECQLRTASARPAVPRAILLRLMPEVLRLGLMAMELAADRRKALLRIVSRGRGGVGGGEMHTIEVNGVIPPFSNRVIGQLKGT

SEQ ID NO: 167301 - protein, 57 aa, Heterodera glycines
  Coding regions on vcDNA: vcDNA=SeqID_93724; Strand=+; Position=184-354
SLPSSSRFVTHDLERGNQFQRRVDLAFKLQLSNLKLEFGNQIHETFGLVLGKKKKKK

SEQ ID NO: 167302 - protein, 230 aa, Heterodera glycines
  misc_feature (15)..(15): Xaa can be any naturally occurring amino acid
  Homolog annotation: Hit_ID=NP_723791.2; Match level="QueryCoverage =83%, HitCoverage=95%, E-value=1e-63, Identity=49%"; Hit description =CG5547-PC, isoform C [Drosophila melanogaster] gb|AAN10827.2| CG5547- PC, isoform C [Drosophila melanogast
  Gene Ontology: Mol. function=ethanolamine-phosphate cytidylyltransferase activity; Biological process=phospholipid biosynthesis
  Coding regions on vcDNA: vcDNA=SeqID_93725; Strand=+; Position=3-696
PFLPSTQTIMQFSDXRAPTPEDRIVYVCGSFDLFHIGHLCFLEEARRLGDYLIVGIYSDQDVNSYKGQNYPIMTLHERVLSVLAYKPVSEVVIGAPLCVTKELIDRFRINFVVQGIRTEHHTATEEADCYEVPKHLGIFKTVDSGNEMTTERIIERIIKNRLEFEQRNRAKERKEIAAFKALQRMKMTDGNGTNEEEGNAKHLEEENNGKCDEKNGRREYQIVSINTENV

SEQ ID NO: 167303 - protein, 96 aa, Heterodera glycines
  Coding regions on vcDNA: vcDNA=SeqID_93726; Strand=+; Position=47-337
FFPFNNLETFVCLFCVCQGKFPIWYFFLGFFLISIRTNIICLFNSFSYGEVNRLNILNHFGKIHTPAFHFAYSRLLFDYWSLITSSDSNSSKYQNF

SEQ ID NO: 167304 - protein, 181 aa, Heterodera glycines
  Homolog annotation: Hit_ID=CAE75284.1; Match level="QueryCoverage =89%, HitCoverage=69%, E-value=8e-13, Identity=29%"; Hit description =Hypothetical protein CBG23251 [Caenorhabditis briggsae]
  Coding regions on vcDNA: vcDNA=SeqID_93727; Strand=+; Position=3-548
LLFVAHCSDPSKVPFSAMSFGLGRAESVTRLSAFEPRPNPSLVRCSSLIDVNRFSRDFDRFSPRSSRLSQNDSSALWSSRMYRPSFVMDNHWFDKFYYFSPIFKGTQPYKCHVASHRLTYPSSWHQPHDYWRRVQHFWYDSDNDYAPLHRRMFEPFYGESAYTQRFWHRYRSHLLNNDVYE

SEQ ID NO: 167305 - protein, 76 aa, Heterodera glycines
  Homolog annotation: Hit_ID=NP_502080.1; Match level="QueryCoverage =98%, HitCoverage=9%, E-value=2e-30, Identity=85%"; Hit description =endoplasmin (87.1 kD) (4L887) [Caenorhabditis elegans] emb|CAA92973.1| Hypothetical protein T05E11.3 [Caen
  Gene Ontology: Mol. function=heat shock protein activity; Cellular component=endoplasmic reticulum; Biological process=response to stress
  Coding regions on vcDNA: vcDNA=SeqID_93728; Strand=+; Position=2-229
FQLYVRRVFITDDFQDMLPKYLAFIRGLVDSDDLPLNVSREMLQQHKLLKVIKKKLVRKVLDMLKKISPEKFDEFW

SEQ ID NO: 167306 - protein, 189 aa, Heterodera glycines
  Homolog annotation: Hit_ID=NP_506706.1; Match level="QueryCoverage =96%, HitCoverage=22%, E-value=7e-49, Identity=55%"; Hit description =DNA replication licensing factor Mini Chromosome Maintenance (90.7 kD) (mcm-3) [Caenorhabditis elegans] e
  Gene Ontology: Mol. function=DNA binding; Cellular component =chromatin; Biological process=DNA replication initiation
  Coding regions on vcDNA: vcDNA=SeqID_93729; Strand=+; Position=144-710
HDVERDQTVAENVLKLHRYRPQGESVGAVQVFGTAMEVRTTFDAEKGDSHGRMEVYENIREWTAVEEGQKILSTQFMRKYIHTARDVKPKLTDEASTFISERYAELRSTDLIKTDCERTMPFTARQLETMIRLSTAMAKARLSKTVGLEDAKSAYELLDFACFKEKPRERLEYEEKKNRKKMEEGKGNQ

SEQ ID NO: 167307 - protein, 191 aa, Heterodera glycines
  Homolog annotation: Hit_ID=NP_740776.1; Match level="QueryCoverage =100%, HitCoverage=23%, E-value=1e-21, Identity=33%"; Hit description= ubiquitin-protein ligase with C2 and WW domains; suppressor of deltex; atrophin-1 interacting protein Ne
  Gene Ontology: Mol. function=ubiquitin-protein ligase activity; Biological process=regulation of cell growth
  Coding regions on vcDNA: vcDNA=SeqID_93730; Strand=+; Position=28-600
MASIDDSSSEVNGSTNGNASVRSFALQTTVTSAKLNSGGFLSKAPDAYVEIIVDSKEDQAKKTSVKKKTNSPHWDESFTLNVTENSVIEFKIFCKAKVFDDSLLASKSFKMSNWLRKESNNGKFENTPVTVPLICRDAKTERESKSGELKLSLTGNFERSRRRSSGLRANSSTPSTAESAVVESAAGPSTS

SEQ ID NO: 167308 - protein, 201 aa, Heterodera glycines
  Coding regions on vcDNA: vcDNA=SeqID_93731; Strand=+; Position=36-638
FASALYKEKRWIDWSSRPRHRIGFGHGKETKKAENESDEDQIGDTKQKGAEFGLEARKRTGREMALSLRRHLRHNAERWRRARDPAELVREEPLPTLSLFPQLLISRRPFDISRRLKPMHRHPLLSLRRPILSEQQLSKRKLILNIQFASFIPKRFVNGGPSQIFLHFSTKRLWRWKWAERKRTRGRRATVWRWTCSTWKY

SEQ ID NO: 167309 - protein, 84 aa, Heterodera glycines
  Coding regions on vcDNA: vcDNA=SeqID_93732; Strand=-; Position=1-252
QKKRRKEALTELRFLHGPSLPSLTPSPPLSPTLSPSHFCRSICHPRPQFTCTYLSRKIGPKDNASGILGRLFAHFPTQLPSIWT

SEQ ID NO: 167310 - protein, 143 aa, Heterodera glycines
  Coding regions on vcDNA: vcDNA=SeqID_93733; Strand=+; Position=15-446
MGRPSFPLNGISLLFLLPIFAFPSAFGWHFGTLDRFDPNSVDNRRLYVLKKSESPQWEDLGWAWGKRSLPNSEKSAQSSANWDDLGWAWGKRSSAGGGGEAMRRAKAHGTDPILSVVANRVVRSMSKQSPDWHDLGWAWGRRK

SEQ ID NO: 167311 - protein, 51 aa, Heterodera glycines
  Coding regions on vcDNA: vcDNA=SeqID_93734; Strand=-; Position=136-291
NRSLLLKLSDFAQTMPFLVQNLSRRYSVSRYSNLLGAQMAALKWRRSVGWR

SEQ ID NO: 167312 - protein, 70 aa, Heterodera glycines
  Coding regions on vcDNA: vcDNA=SeqID_93735; Strand=+; Position=1-213
HGPYRKGTQNNEHGHLSSPTSAQPTTTVEQLQQQPRGNTGGKGTTFVEEDGQRHGNDEGQTIQCFIFSFF

SEQ ID NO: 167313 - protein, 86 aa, Heterodera glycines
  Coding regions on vcDNA: vcDNA=SeqID_93736; Strand=-; Position=208-468
LLSILSEKKFSGQGVATNANMLFGLAYFLCFSMHRSVFTNAYLLGSTHRKGADLFLFNILILILDYFCAPQLMLWREVETILSSQF

SEQ ID NO: 167314 - protein, 85 aa, Heterodera glycines
  Homolog annotation: Hit_ID=EAL41690.1; Match level="QueryCoverage =98%, HitCoverage=22%, E-value=2e-20, Identity=57%"; Hit description =ENSANGP00000025604 [Anopheles gambiae str. PEST]
  Gene Ontology: Cellular component=nucleus; Biological process=cell fate commitment
  Coding regions on vcDNA: vcDNA=SeqID_93737; Strand=+; Position=124-622
MMEGDAWLMSTVQAEDKLLQAHTNREKVFSILKTLRDRHLDFSGSATTKQLVKVLVLYECEKHYANHEWNDFCLGDRIIGILLQM

SEQ ID NO: 167315 - protein, 170 aa, Heterodera glycines
  Coding regions on vcDNA: vcDNA=SeqID_93738; Strand=+; Position=45-554
ILSAWGSFFAGSWQAAGHCLCKIHQILPTEPIFCATGGWFRWSTTNSPFGMPSFLHSDGTCAQFGCCAIKINTFRCTTAFCPILRATPMPWKLNCCAQNCQGVRPSNAMPSLSRQLAKCEKLRKICHAQQIQTRAPAAPSHTDRAERSKSCGTAEQMSRPFPKLGLSIGR

SEQ ID NO: 167316 - protein, 248 aa, Heterodera glycines
  misc_feature (240)..(240): Xaa can be any naturally occurring amino acid
  Homolog annotation: Hit_ID=CAE57201.1; Match level="QueryCoverage =97%, HitCoverage=27%, E-value=3e-59, Identity=47%"; Hit description =Hypothetical protein CBG00051 [Caenorhabditis briggsae]
  Gene Ontology: Mol. function=ATP binding; Cellular component =endoplasmic reticulum; Biological process=response to stress
  Coding regions on vcDNA: vcDNA=SeqID_93739; Strand=+; Position=29-771
MANGQTATFAMAIDLGSEFMKMALIKPGVPMETVLNRDSQRKTPMALTIRDGERFLGDAALKKLLVRPKNTFIFFLDLVGKQFDDPTVTAFRNEFPYLRLKAHPKRGTVQFETDVGDMSLECALAMLLWNARQDVDAYAEQPVRDVVITVPSYFGQMERAAVETAAKIADLNLLQLLGSGTAAGLNYGVFRHKEITEKPQTLLIYDVGSTKTLVTIGPFLLVNHSHEGGSSYPQVETLGXGYDRALGG

SEQ ID NO: 167317 - protein, 100 aa, Heterodera glycines
  Coding regions on vcDNA: vcDNA=SeqID_93740; Strand=+; Position=60-362
IQSPFMSPEQGRAKLRKLRVFWASNLVLRKKIVLRLRLRVLIVKRASSIPGPIFYESNKLTILGFYTITLFIHVRTNPIFLVSFECKKSKEAKIYKILSV

SEQ ID NO: 167318 - protein, 134 aa, Heterodera glycines
  Homolog annotation: Hit_ID=ZP_00288088.1; Match level="QueryCoverage =92%, HitCoverage=20%, E-value=6e-26, Identity=46%"; Hit description =COG0427: Acetyl-CoA hydrolase [Magnetococcus sp. MC-1]
  Coding regions on vcDNA: vcDNA=SeqID_93741; Strand=+; Position=16-611
NQKPIKYLIVKVPWTDEKLHDRVRSTTIFICSYFRKLVNQGKADYLPVFLSQSARLYDEKVLRVDTALLNVSPPDKHGYCSLGVSVDMSSAAARNAKRVIASINKTHPRTFGDAEIHISQIDALVHPETPIYEL

SEQ ID NO: 167319 - protein, 184 aa, Heterodera glycines
  Coding regions on vcDNA: vcDNA=SeqID_93742; Strand=+; Position=1-552
PSYILRVKKELTLCVLLLERAWNDADQTHGQFVLRRLEGHAEIFEEEYEGGVPEELRDFFRSPMFLLSERAASTEEPLASEAARPSENERQRKAAVIACHYQVQIFFNDLIVCASDPVPLHWPSFCVPFARIFDLRVFERPEKIRIRLMERLSRMAKWQEIGEVFLPLLADHKTGTSADDNRKE

SEQ ID NO: 167320 - protein, 178 aa, Heterodera glycines
  Homolog annotation: Hit_ID=NP_501210.2; Match level="QueryCoverage =90%, HitCoverage=28%, E-value=2e-47, Identity=61%"; Hit description =glutamate transporter family member (4I271) [Caenorhabditis elegans] gb|AAB00621.2| Glutamate transporter
  Gene Ontology: Mol. function=glutamate transporter activity; Cellular component=integral to membrane; Biological process=dicarboxylic acid transport
  Coding regions on vcDNA: vcDNA=SeqID_93743; Strand=+; Position=9-542
MERRRSGKVLRRSLFLGRAHLLLSLTISSVFVGLFLGFALRIFQLSPETVRLVNFPGEIFMQVLKMMILPLIFSSLVSALAQMDARESGQMSLLTVGYYVITTLFATVTGVLLVMAIHPGDPSIKQDLAYLEVQHTPISPLDTFLDVVRNMFPENVVQATLQRAQTKYFAPRRNAQQK

SEQ ID NO: 167321 - protein, 157 aa, Heterodera glycines
  Homolog annotation: Hit_ID=NP_499884.1; Match level="QueryCoverage =100%, HitCoverage=16%, E-value=4e-35, Identity=52%"; Hit description= aminoadipate-semialdehyde synthase (103.8 kD) (4B3) [Caenorhabditis elegans] gb|AAB94142.1| Hypothetical
  Coding regions on vcDNA: vcDNA=SeqID_93744; Strand=+; Position=3-473
SGCLICSVDNIIAGLPVEATEQFGSLLLPYMMDLLICNTDQPFASLQCRDEIKRAIITSDGQLTPGYKYIDELRLEQRRSAHKSRVVAVSSKRVLLLGAGMVSDPLAKYYFSRSNVQLTVASDSSKDRQRLASLGSNNESGVGDGTREPEVIIRSFR

SEQ ID NO: 167322 - protein, 176 aa, Heterodera glycines
  Coding regions on vcDNA: vcDNA=SeqID_93745; Strand=+; Position=3-530
ISYKSPQFTAVNASTILTRNGISLIETQPQIKLYLFHDLFHLDQDPYKNIIHAEFLGELHSTDDFVWELRKKRQKYALFRPRLFVTFDSTTNRWVPTHFDDQESVPLPSTSQATETVVFRPQNKNSLSDGILGKPRLNYGADFGDGPKNFQPSNRENEKQKSFVAPVENRARTWAP

SEQ ID NO: 167323 - protein, 169 aa, Heterodera glycines
  Coding regions on vcDNA: vcDNA=SeqID_93746; Strand=+; Position=13-519
LSHTLFLVFDGIPYTGQKVLDGCIYAYNAFVSSMHWLFTKLANTVFFVWESVVNLCCSVVDQTGRTISFVRDSAVNVTRFTMEKIGSAIFFMWNNAAHLFQSGFEKIGNAIFFVWHNAAHLFRSGFEKIGSAIFFVCDNVAHLFQSGFAKIGNAFIFVRDNFTNLFWKT

SEQ ID NO: 167324 - protein, 256 aa, Heterodera glycines
  Homolog annotation: Hit_ID=CAE60247.1; Match level="QueryCoverage =99%, HitCoverage=27%, E-value=1e-42, Identity=39%"; Hit description =Hypothetical protein CBG03821 [Caenorhabditis briggsae]
  Gene Ontology: Mol. function=translation initiation factor activity; Cellular component=eukaryotic 48S initiation complex; Biological process=regulation of translational initiation
  Coding regions on vcDNA: vcDNA=SeqID_93747; Strand=+; Position=61-828
MGAESESEGEESEWGTESDESSSASDLEPLEGKEMEELRRYFLKKDKTDRGKTKEKKEKAAQREKIALEKKKLEEADGQNEESWQKITYKHDVAKPLFDGQAEVTGDLVVKKLLELGANRGRRATNRKVYVRYLQELYKAADEHNLGVGLLAKVLTAIIAALFELNTRISDAMEFNSWMKTVETVDGLFSLLSEHPNVIISISTNEDEENILDQSKPFCFHGSVILMGKRLDDELTKIYQSTDCHRSEYLEKLRGE

SEQ ID NO: 167325 - protein, 191 aa, Heterodera glycines
  misc_feature (16)..(16): Xaa can be any naturally occurring amino acid
  Homolog annotation: Hit_ID=AAC98928.1; Match level="QueryCoverage =88%, HitCoverage=30%, E-value=2e-21, Identity=40%"; Hit description =ankyrin homolog [Litomosoides sigmodontis]
  Coding regions on vcDNA: vcDNA=SeqID_93748; Strand=+; Position=2-575
RRHRAAVMKEPRSRAXGVPPQHPICTLSLTLPDYIGPLPCISAQADMQRGDKQQPPDGGAPRVPSVSERYAEALHANLAEAYPNVPLELVAKRIGGDWARLARVLGLHPDDIRQIRKEFNAGGGQEPMAALKIWLWLKAIQQQKQQQEEANVSDDLEKALRQIGRDDIVHRMYGLDITGATAADIDDAWRT

SEQ ID NO: 167326 - protein, 112 aa, Heterodera glycines
  Coding regions on vcDNA: vcDNA=SeqID_93749; Strand=-; Position=9-347
VSNPSSNCGQVSPTRCCFGSIFALRRHQKTVLSPQMKRVRPPRRRPFPRRPALGCAPPPPPSSSPPCEAPTRPPPLQFLPVHFPHSACDERRRNWKLYNVPNDLIIYLTKYI

SEQ ID NO: 167327 - protein, 156 aa, Heterodera glycines
  misc_feature (18)..(18): Xaa can be any naturally occurring amino acid
  misc_feature (94)..(94): Xaa can be any naturally occurring amino acid
  misc_feature (100)..(100): Xaa can be any naturally occurring amino acid
  Homolog annotation: Hit_ID=AAK26375.1; Match level="QueryCoverage =100%, HitCoverage=35%, E-value=8e-70, Identity=81%"; Hit description= class V aminotransferase [Heterodera glycines]
  Gene Ontology: Mol. function=alanine-glyoxylate aminotransferase activity; Cellular component=extracellular space
  Coding regions on vcDNA: vcDNA=SeqID_93750; Strand=+; Position=2-469
PPHRLLRPPHINEKKLLXPAPNNMPPLVYEGLAQPMLGHMHTEIFEIMDDAKAGIKYIFQTDNALTFAVSGTGHAGMECAILNLLEPGQTILVXENRVRXLRTKNVADRLGIKVHRLDIPDGEVINLHDFAEADDNYRPQVAFACHGERSNGVVHP

SEQ ID NO: 167328 - protein, 165 aa, Heterodera glycines
  Coding regions on vcDNA: vcDNA=SeqID_93751; Strand=+; Position=3-497
DPVNLDELVEFDLAICYRNVLDLSTEDGHCSVLFTHPLVYGDRYGVAKLAVAVITHWLDHSPVASKLNFVGIACQSGDILQCYMDLMAELAQHGWADFVAAHSSALFSCLVDSFDTGNKFEPSGASKGAAASLEDPALRVHLVGDDPRRPRRGQPKQLVSYELGM

SEQ ID NO: 167329 - protein, 156 aa, Heterodera glycines
  misc_feature (57)..(57): Xaa can be any naturally occurring amino acid
  misc_feature (89)..(89): Xaa can be any naturally occurring amino acid
  Homolog annotation: Hit_ID=AAD13153.1; Match level="QueryCoverage =100%, HitCoverage=41%, E-value=1e-58, Identity=73%"; Hit description= actin [Setaria digitata]
  Gene Ontology: Biological process=reproduction
  Coding regions on vcDNA: vcDNA=SeqID_93752; Strand=+; Position=2-469
VAALELDNGSGMCKADVAGDDAPPPRVPSIVGGPRHHGDMVRMGLRDSYAGDEAQSXRGILTLKYPIEHGIGTDCDCMDKIWLHTFYNXLRVTAEDHQELLTEDPLNPKANADKMTQIMFETFTTPAMYVSIHIVLALYAVGRSSGIGVDFGDGET

SEQ ID NO: 167330 - protein, 167 aa, Heterodera glycines
  Homolog annotation: Hit_ID=NP_732783.2; Match level="QueryCoverage =87%, HitCoverage=19%, E-value=5e-09, Identity=29%"; Hit description =CG4917-PB, isoform B [Drosophila melanogaster] gb|AAF56041.3| CG4917- PB, isoform B [Drosophila melanogast
  Coding regions on vcDNA: vcDNA=SeqID_93753; Strand=+; Position=115-615
MVISFLYQNPSSYDAAEEITNMTWAQFDHHCVRNGDNQVNAQRECSQLKGTAINWKGTVQSVRIIDIDNPFETLLDYLPDSVAQALRCFYDTTEEEGGQKRDGLRYNRCSLTHHNHYTYLLEVSGPYGEKFQISVNKGQLLLAAAHSFGDTLSLLGEGDIVRFVAFF

SEQ ID NO: 167331 - protein, 91 aa, Heterodera glycines
  misc_feature (19)..(19): Xaa can be any naturally occurring amino acid
  Homolog annotation: Hit_ID=CAE74673.1; Match level="QueryCoverage =100%, HitCoverage=15%, E-value=8e-13, Identity=46%"; Hit description= Hypothetical protein CBG22475 [Caenorhabditis briggsae]
  Coding regions on vcDNA: vcDNA=SeqID_93754; Strand=-; Position=2-273
PPLFFFFPPPPGVFFFRGXTPSPFGEGGKLKPSPFPYFFFPPPPPFFSLSPGPRGRYFRPFPRPLFPAGVFFIFFFPPPPYFGTPPPPEAG

SEQ ID NO: 167332 - protein, 164 aa, Heterodera glycines
  misc_feature (17)..(17): Xaa can be any naturally occurring amino acid
  Homolog annotation: Hit_ID=NP_493614.1; Match level="QueryCoverage =73%, HitCoverage=7%, E-value=2e-29, Identity=54%"; Hit description =alpha-2-macroglobulin, N-terminal and alpha-2-macroglobulin family member (1P593) [Caenorhabditis elegans]
  Coding regions on vcDNA: vcDNA=SeqID_93755; Strand=+; Position=3-493
VSFSVTLSTDRNSAEPXKAVRFRVRAAPDSFVGLLAVDQSVLLLKSGNDISKELVEQDVEEYDTTSDSGAHVWTGMRRRMIGGGRKRRSSWYPWWGVGGKDASTVFENAGLVGLTDFFLYKEPEPIRDWRFRPMYMHMRTDFAGGEERKLKEQPRSAGPAHAAS

SEQ ID NO: 167333 - protein, 140 aa, Heterodera glycines
  Coding regions on vcDNA: vcDNA=SeqID_93756; Strand=+; Position=2-421
DSLTETTIQADIYSFAFNALEMATTGALQSGCFNGAPPSSMASSASVAPPSAASFASLPLHATAVPLPSSDRDRGAVTENEPPNGTGCSLASAASTGTLQATVSNWPTATVSAVTSLPQSAVCSHVVTQEMVHKALNSLD

SEQ ID NO: 167334 - protein, 113 aa, Heterodera glycines
  misc_feature (30)..(30): Xaa can be any naturally occurring amino acid
  misc_feature (87)..(87): Xaa can be any naturally occurring amino acid
  Homolog annotation: Hit_ID=CAE69155.1; Match level="QueryCoverage =92%, HitCoverage=10%, E-value=6e-18, Identity=47%"; Hit description =Hypothetical protein CBG15186 [Caenorhabditis briggsae]
  Coding regions on vcDNA: vcDNA=SeqID_93757; Strand=+; Position=2-340
ELDPYDDLDHFYCGMEDANSRNLDLVKEWXQTVLNVNMEKLFVIMLMALIFTARKDLKGALQLVINALSDFPTHYGLLELMLKVEVXYGRVEEVLQTYHNLVYFWRITHAPAE

SEQ ID NO: 167335 - protein, 149 aa, Heterodera glycines
  Homolog annotation: Hit_ID=NP_496203.2; Match level="QueryCoverage =95%, HitCoverage=26%, E-value=1e-16, Identity=37%"; Hit description =leucine-rich repeat containing protein (2K499) [Caenorhabditis elegans] emb|CAA88748.2| Hypothetical prot
  Coding regions on vcDNA: vcDNA=SeqID_93758; Strand=+; Position=41-487
QSSLGYNADLSLLPCYCKQRLMELFASHEQLHSEQCFGLMLRPMAGRNLTRLCFYLNDHLNDSSLEALVTFILNHPIISIVKCPRVTDTGIGTVTLRQNKLGCLELIGIPLLSSYATQAANSNRLTKRHLSGCPQIASEGNFYLAVNNP

SEQ ID NO: 167336 - protein, 213 aa, Heterodera glycines
  Coding regions on vcDNA: vcDNA=SeqID_93759; Strand=-; Position=1-639
RDQSVFDHYASDSNLAYHPRHLCPLTRSDSGGLSSEFGFGTSPDPIDIQPPELILDDNIRSRDSAFLSDSSPEQSSALARMSDERNYGPTAQMMNDSGIFLDFLPGSLSIDFPLLVSTEKLRTQNEEGKCSTDEGRAITVELQFKTPKAFTEEELRTIDVKRKEEDESREDEPFEVAEWKPLEEIEAEKAQIEEKNEEEVTRTQLGRNKAKRD

SEQ ID NO: 167337 - protein, 201 aa, Heterodera glycines
  Coding regions on vcDNA: vcDNA=SeqID_93760; Strand=+; Position=2-604
AFLDANFKNCTNFPESPADSQRVAFGFVREGICNSQLAAPSLCSFDGFDCRPNSSRKVSTTSLESGGSASSGGGIATLSRRALITTSRDETLGLSGKTGGVAGGAKNILISRQNLVNSSAASAAVARGIARRHGRLIEQQAEANNLVVAKSLSPRVQQQPLATVQSFSPTNVCRPPWTPQTEKRRLIGVKDFVSQNTFSKE

SEQ ID NO: 167338 - protein, 54 aa, Heterodera glycines; identical to SEQ ID NO: 157777
  Coding regions on vcDNA: vcDNA=SeqID_93761; Strand=+; Position=297-461

SEQ ID NO: 167339 - protein, 114 aa, Heterodera glycines
  Coding regions on vcDNA: vcDNA=SeqID_93762; Strand=-; Position=1-342
CANNRDGAHLTLLPLVWPTSRPHQLRSHLPGPASYLYIKIRGGLTTKRPGRKRISRVEHRDRYHSKELGLLYLSIQVEKLVICGKFREKRVRTKKTGLFTTGQKWVVKCVFSPY

SEQ ID NO: 167340 - protein, 197 aa, Heterodera glycines
  misc_feature (113)..(113): Xaa can be any naturally occurring amino acid
  Homolog annotation: Hit_ID=NP_508033.2; Match level="QueryCoverage =99%, HitCoverage=5%, E-value=3e-35, Identity=44%"; Hit description =putative protein, with at least 9 transmembrane domains, 2 coiled coil-4 domains, of bilaterial origin (5V
  Coding regions on vcDNA: vcDNA=SeqID_93763; Strand=+; Position=15-604
KERPSTRRRANWAVRSFWLVGLHQTLLNSPYIAHLHSPKTITLLCLRLTLGDPFGILDDQTVPPFTLSAQHSACAPAGAYLSSVHAPQTVLSAHSPPASFCNVVLRLTSFLMXYLGQLVFSLEMICGVESIGPLAERPEAILCQFLIPMFLRAAISGKEAPQFRPKDLNFCLSLLQNAISPPSLAKQSVAPAMSGSS

SEQ ID NO: 167341 - protein, 157 aa, Heterodera glycines
  Coding regions on vcDNA: vcDNA=SeqID_93764; Strand=+; Position=2-472
SREKIAKNVQKPYDFLHKFLSTTISVLLLILMDLLNSLGSSSAAAPLSSSSSIFTNPNSTLVVVVKQYQQQQQLNNHHHNHRNNHAAAAAAAVLLPFNNNNNLTDEITELAHATVRGDGDRHSDHFADGTIILFHGAAEWCPNVSNAVVWPSCITLG

SEQ ID NO: 167342 - protein, 233 aa, Heterodera glycines
  misc_feature (1)..(1): Xaa can be any naturally occurring amino acid
  misc_feature (15)..(15): Xaa can be any naturally occurring amino acid
  Homolog annotation: Hit_ID=NP_510634.1; Match level="QueryCoverage =99%, HitCoverage=70%, E-value=7e-57, Identity=44%"; Hit description =misexpression suppressor of KSR (35.6 kD) (XQ738) [Caenorhabditis elegans] emb|CAA92227.1| Hypothetical p
  Gene Ontology: Cellular component=cytoplasm; Biological process=cell differentiation
  Coding regions on vcDNA: vcDNA=SeqID_93765; Strand=+; Position=2-699
XNSFFLSVHDVGSTXPPFREFVNSTAMSSVQQHSVFLHVCVPGQNDGAPKLEGDFPSMDQMGESLVHVLNTLDVRNCIGIGEGAGADILCRFAMAWPNRVLGLILIHCLATPHGIIDSFKEMLLNLRLEDGNMNSAAWDYLFLHKFGMHEKMMKEAFIAELSSVINTHNLSRFLYAYNRRTNICEIIGKKLANTDVLLITGSRAPHNKNGRHMFENMRRDKSTLLVIDEVIDL

SEQ ID NO: 167343 - protein, 98 aa, Heterodera glycines
  Coding regions on vcDNA: vcDNA=SeqID_93766; Strand=-; Position=3-296
LGLLVSDSKKFSSLQLFNNGLQSFVLFRQFFILFLWHLVYFSPLVDTLKQKVVKQSTARERIRNGIFGTDEGHKFEQKFGRQAGGGHWQQRKRRQGPI

SEQ ID NO: 167344 - protein, 122 aa, Heterodera glycines
  Coding regions on vcDNA: vcDNA=SeqID_93767; Strand=+; Position=43-408
LTSETVLLSPAMAPKCLPLELLFEIVPFVHAEEAVPNVLLSCRLLHNLLLPCVVKWKKRMAEEKKEEDLTKQFAAMSKALTKRMEAVEEELKKSTEETKKSTFRMEAVEEELKKSTKRIEAV

SEQ ID NO: 167345 - protein, 132 aa, Heterodera glycines
  misc_feature (24)..(24): Xaa can be any naturally occurring amino acid
  Homolog annotation: Hit_ID=NP_498959.1; Match level="QueryCoverage =98%, HitCoverage=6%, E-value=2e-13, Identity=34%"; Hit description =zn-finger, CCHC type and RNA-directed DNA polymerase  and Integrase, catalytic domain containing protein (
  Coding regions on vcDNA: vcDNA=SeqID_93768; Strand=+; Position=3-399
KTLVTDCGTQFMSSTFYIIGKNLXFEHQTTVPYHQSANGQVERYNRTIVDMLVTSTEGKNWAAALPLICFAYNSSINYQIGNSPFYVMHGFDPRLPSEVTLGKVEDNFSDMAIYVHELTKRMEEVKTTVKEN

SEQ ID NO: 167346 - protein, 64 aa, Heterodera glycines
  Coding regions on vcDNA: vcDNA=SeqID_93769; Strand=-; Position=154-348
FGVRLEVRSTFKVDEDDPLFGLLIWPVRDVAFTWNVKAKAHFAKLLAAFVSLLFVVLKSILFSI

SEQ ID NO: 167347 - protein, 216 aa, Heterodera glycines
  Homolog annotation: Hit_ID=AAO89277.1; Match level="QueryCoverage =80%, HitCoverage=33%, E-value=4e-16, Identity=33%"; Hit description =HCV NS5A-binding protein 37 [Mus musculus]
  Coding regions on vcDNA: vcDNA=SeqID_93770; Strand=+; Position=1-648
LCPKSYHVNCFRLYSNSRHQLQDNLAVGTAFSSSKRQLVSQQIAPGSQRLLIIQSLEAETEYELTIEAENSVGKGDRVIIRQKTLVEPPEPPQIFLAQATANSLKLKWSDGGENNSSIGANGHGNYYYYLERENENGTYSPVYEGELRTARLKGLREQSVHHFRIRASVSKGLLLGPWSHRFSFQTTKLPPPAPKQAPIVAEQMQDHFQFEWNSVR

SEQ ID NO: 167348 - protein, 243 aa, Heterodera glycines
  Homolog annotation: Hit_ID=XP_393446.1; Match level="QueryCoverage =98%, HitCoverage=47%, E-value=2e-91, Identity=67%"; Hit description =similar to ENSANGP00000015224 [Apis mellifera]
  Coding regions on vcDNA: vcDNA=SeqID_93771; Strand=+; Position=18-746
MSSIEIEAADVVQLVQQYLKENNLVRTLQTLQDETNITLNTVDSIDQFCQDITSGHWDTVLKCIQPLKLPAKKLIDLYEQIIVELFELRELGSARLILRQTDPMALLKQADPERYTQIENLLAKTYFDPREVYPEGGSKEKRRAAVAQSLSAEVHVVPPSRLLSLLAQALKWQQHQGLLPPGNQIDLFPGKAGIPKQEDEASPNTLEGNNQFGAKSHSRIGPFHPGGQYLVTGTVDGFIRSWK

SEQ ID NO: 167349 - protein, 116 aa, Heterodera glycines
  Coding regions on vcDNA: vcDNA=SeqID_93772; Strand=+; Position=49-396
ENNGMVVQQQKITKNFAPTTKLNDQQKVLTQKDDQRPPTLWTMSSLKQKFLKNKPIILTAFQQQQKSEQNPPVNPNYIQQNQYQSTKLFDQNQSQTTSPTLIQPIQYQPAVQKQLQ

SEQ ID NO: 167350 - protein, 61 aa, Heterodera glycines
  Coding regions on vcDNA: vcDNA=SeqID_93773; Strand=-; Position=295-480
NLSREFLRTLIYKQFVHFCEIYTQFKNVDGCFLAKNSFILSLFLCLCFLNNSMEKLKISMG

SEQ ID NO: 167351 - protein, 93 aa, Heterodera glycines
  Coding regions on vcDNA: vcDNA=SeqID_93774; Strand=+; Position=32-310
GRCLCPNTHRGTQCQFFIRDPNCRDVADFPTELTADWQPQVLRPKVKCTGKPPCTCHWRIKPVDGQKVAVKMLRLEAAAFECERPCGKLNVEF

SEQ ID NO: 167352 - protein, 99 aa, Heterodera glycines
  Coding regions on vcDNA: vcDNA=SeqID_93775; Strand=-; Position=217-516
IFPKNFCMTKTNAGPLCGQVVVNSELFPLCHTRFGSSCGDHPLISVITVLLCYMMSKTTCLFFCLPFLFLLSHFSHQIFSKFVLKYSFTHIFNSLISIW

SEQ ID NO: 167353 - protein, 160 aa, Heterodera glycines
  Homolog annotation: Hit_ID=NP_507780.1; Match level="QueryCoverage =93%, HitCoverage=10%, E-value=3e-10, Identity=29%"; Hit description =predicted CDS, DNA polymerase type B, organellar and viral family member (5T899) [Caenorhabditis elegans]
  Coding regions on vcDNA: vcDNA=SeqID_93776; Strand=+; Position=2-484
KNRFDTPGCEILYFDTACIIYVHPEDNDPLPTGKGHLGELTDEKPDHNILEFISAGCKNYGLKLERKDNGQIEYDLKIRGITLDEQTVQTIHYDSVKDQIMRYGSDDPADPIIVTYPHFIRPNLIQGKVYTQSLTKHYQPVFTKGIINDSFQVLEFGYRK

SEQ ID NO: 167354 - protein, 156 aa, Heterodera glycines
  Coding regions on vcDNA: vcDNA=SeqID_93777; Strand=+; Position=2-469
ILKISCCVHFTDCLSFKMSDAETSIAELPVPKLNGSNSATSGSDGEVPSSSASKVMPPNTHSQPPQQHHHVTPSQPMPVPISYAASAADFSTMVGTPEFIQDLLYTPTGSANGGFSAPAAVFGSTPTNNYGFGSFGSVYPPPSLAANRPLSHHQHN

SEQ ID NO: 167355 - protein, 114 aa, Heterodera glycines
  Homolog annotation: Hit_ID=NP_496066.2; Match level="QueryCoverage =94%, HitCoverage=24%, E-value=2e-36, Identity=60%"; Hit description =nuclear Hormone Receptor (nhr-19) [Caenorhabditis elegans] emb|CAD27185.1| Hypothetical protein E02H1.7 [
  Coding regions on vcDNA: vcDNA=SeqID_93778; Strand=-; Position=275-680
QTLPIFCSLPVNDQMILLKRFAMPCNVLEYGYFTAQIGLDDVWLISNGTCMPRSVNTLVTEDRKWRQENLYRQMTDRCIDEVSTPLRKLQLKPEELVTLKILLLCSCGNHDQNG

SEQ ID NO: 167356 - protein, 109 aa, Heterodera glycines
  Coding regions on vcDNA: vcDNA=SeqID_93779; Strand=-; Position=156-485
HFSPYPLDTTSSISPAVLRESFDLLKQQENVHDVMADRILRHGNVEVAVVQTALASLKRTISSSSSLSSSSSPLPDNSPSKKRKLLSTSVPNGLSEVDRGTVMLIYYYL

SEQ ID NO: 167357 - protein, 112 aa, Heterodera glycines
  Coding regions on vcDNA: vcDNA=SeqID_93780; Strand=-; Position=231-569
LNIILFAKTRSQWVQMSAIREGEKAASDVGMRALIKNCRDRSSICWKNSRQSISIAFVLALSSFLGIHCGSSTHGWNKTYNRTIIYKILFIIFFHSFCNTKPTLCWSSPLAF

SEQ ID NO: 167358 - protein, 209 aa, Heterodera glycines
  misc_feature (175)..(175): Xaa can be any naturally occurring amino acid
  Homolog annotation: Hit_ID=CAC33829.1; Match level="QueryCoverage =90%, HitCoverage=57%, E-value=4e-58, Identity=61%"; Hit description =annexin 2 [Globodera pallida]
  Gene Ontology: Mol. function=phospholipase inhibitor activity; Cellular component=plasma membrane; Biological process=skeletal development
  Coding regions on vcDNA: vcDNA=SeqID_93781; Strand=+; Position=2-628
TPTIVNNVSLDPQVSANFLHTAIEEKREDEIIHLLCTISNQQRQELAREFEQVFGEDVSAKLKKALSGDFEELILALLEPPAVDDAQNMHRAMSGLGTRESVLIEILVTHRKRQIDEMMRVDQQLYGHSLEKDIGEDTRGPFQRMRGALWNDSRDERWSSDPIKANMTARALVKXNQVESGGNESLFNQWWGTKFHSVAFDFEEIPRAA

SEQ ID NO: 167359 - protein, 138 aa, Heterodera glycines
  Homolog annotation: Hit_ID=NP_496529.1; Match level="QueryCoverage =63%, HitCoverage=20%, E-value=1e-12, Identity=38%"; Hit description =membrane glycoprotein HP59 family member (53.7 kD) (2M135) [Caenorhabditis elegans] emb|CAA93878.1| Hypot
  Coding regions on vcDNA: vcDNA=SeqID_93782; Strand=+; Position=285-698
MTISTNVSQFALPKCPQLVRLSDDRPIPRLRRRFLPFFLSDHFRFIVLALAMLCMTSISANSLLFNFTDICMDGDANFTANQNGLLIAGTAIGGILAIGPVPHAIALFGLRYVFALFGLLSGLVTLLMPVLFYIQGGF

SEQ ID NO: 167360 - protein, 116 aa, Heterodera glycines
  Coding regions on vcDNA: vcDNA=SeqID_93783; Strand=+; Position=2-352
FPFITLLRSLLLLFLFLIFLLPRFFRFRFAPSSPLFCLFYLPLLSPLLFRVPSSAPLFPLFRVPSFLLPLPPLHLPPPRSLPIPPSLRSPSSSSPPRPSPSLALWPLLPLPLAFSI

SEQ ID NO: 167361 - protein, 91 aa, Heterodera glycines; identical to SEQ ID NO: 141019
  Coding regions on vcDNA: vcDNA=SeqID_93784; Strand=+; Position=456-731

SEQ ID NO: 167362 - protein, 122 aa, Heterodera glycines
  misc_feature (39)..(39): Xaa can be any naturally occurring amino acid
  Homolog annotation: Hit_ID=AAQ12016.1; Match level="QueryCoverage =100%, HitCoverage=42%, E-value=4e-34, Identity=63%"; Hit description= tropomyosin [Heterodera glycines]
  Gene Ontology: Mol. function=structural constituent of muscle; Cellular component=muscle thin filament tropomyosin; Biological process=pole plasm oskar mRNA localization
  Coding regions on vcDNA: vcDNA=SeqID_93785; Strand=+; Position=2-367
DAVFTKMQVMMIDNDNDIYPWDTSEELCGPTLERVERVXEELRDSPNIVMATDNNLDDAHEDLTAANNLLEEKDKTVLDADAELAALNRPMVLVQEEMHKLAERLKLATENMEEATDHCHES

SEQ ID NO: 167363 - protein, 94 aa, Heterodera glycines
  Coding regions on vcDNA: vcDNA=SeqID_93786; Strand=-; Position=49-333
LGRTAQINMRKSFLQHIPELSSHIAMSVPARNYPKMCSLAQGSSGTLSHNGKGVAMHRCPSDDCAGKDPPQRGSQKGNLRSVRWTPSEEKAVFE

SEQ ID NO: 167364 - protein, 71 aa, Heterodera glycines
  Coding regions on vcDNA: vcDNA=SeqID_93787; Strand=-; Position=27-242
AHGHGSDQRNQQHHQEAERRHFCFLRDLLVFVFGDPFYGMIFFVGSAHFYSKKKKKKFQPVREMVLRRLIN

SEQ ID NO: 167365 - protein, 228 aa, Heterodera glycines
  Homolog annotation: Hit_ID=NP_506712.2; Match level="QueryCoverage =60%, HitCoverage=34%, E-value=1e-20, Identity=42%"; Hit description =UNCoordinated locomotion UNC-76, axonal outgrowth protein, minor form (42.3 kD) (unc-76) [Caenorhabditis
  Gene Ontology: Mol. function=structural molecule activity; Cellular component=axon; Biological process=regulation of axon extension
  Coding regions on vcDNA: vcDNA=SeqID_93788; Strand=+; Position=16-702
MQSAAVHFSATVDGEIPDAPLAQVDELEMVEGSFAAFSSSLTDISAGDCEKSQSDEGPGEDLSNCSVNLSSSLQDLVESFDDKVAVVLKDFEKDAEKIAPIKIRSQEEIMSESQFWWTLTGNYGNLPPIDFDNSQIRRKQLEALNFNSPKVISPVFTLINCFLFFFVLSRERRPIEVSSPTATRRRTPNESTFTDSQLRKHTTKTANPFPLTPTKSSRKLMRFYRPAI

SEQ ID NO: 167366 - protein, 241 aa, Heterodera glycines
  Homolog annotation: Hit_ID=CAE59920.1; Match level="QueryCoverage =56%, HitCoverage=92%, E-value=9e-39, Identity=48%"; Hit description =Hypothetical protein CBG03406 [Caenorhabditis briggsae]
  Coding regions on vcDNA: vcDNA=SeqID_93789; Strand=+; Position=1-723
LNLSPQFRHQIPLLFFLLLTFFASANGTSKCVWVRGALQCHRDPSKHQNVEVRVIDRDGWGPLKVLDPDDMMGVSFTEQDGTFQLDGCGNDMNFLPGVPNLPDPFVRILHFCNSEEGETIELPEFRIFVPDTYDLGILVLDQKTLPNSTVNFPVPENPRRRLQQAKRPTEVGTLDESNGKKGAEDGFVTVDAPKSHNAKGLDDLLPPGKTVTKTNGDLLWETQSVEMEEVPAEYDTSIRQS

SEQ ID NO: 167367 - protein, 202 aa, Heterodera glycines
  Coding regions on vcDNA: vcDNA=SeqID_93790; Strand=+; Position=1-606
SFWLISIFCTTNFKLRADIDRHPRQHRRAVRLLLRRLQAVTISNSSKRRGEATERWDGIWATNSAEAVPMKGTAAEEEEHFRRVVCFPQNVFVSLILHFFVPMPCNCQPIPPPPPFDVPPPPDPSFVFHLLSDDPPEAFEKLHLLHSCPLQKQLFFFRYPFGRFLPFATVAAFLLLTSFSVTAFVFWRKRRRTRRMEEREEE

SEQ ID NO: 167368 - protein, 115 aa, Heterodera glycines
  Coding regions on vcDNA: vcDNA=SeqID_93791; Strand=+; Position=355-699
TKTRSQPDTTNELDLIQERIKKTVELIPPINNYMEQYQANDKQMMKYPDQSALPDHEGSEPPLHGNATGEYTLPFMPDYYDELETVREYVDEETLLPPTMGEICWNVDLDALAKD

SEQ ID NO: 167369 - protein, 47 aa, Heterodera glycines
  Coding regions on vcDNA: vcDNA=SeqID_93792; Strand=-; Position=613-756
MEKEDEDDYIVVVKRCQIGATVRWEDKKTNNFSNINFWPLNGKYCIG

SEQ ID NO: 167370 - protein, 52 aa, Heterodera glycines
  Coding regions on vcDNA: vcDNA=SeqID_93793; Strand=-; Position=305-463
SSSRALQAYCCFFSISSLNGVITTFVICFAFNKPIIKIIIGTQIQSYSDFFS

SEQ ID NO: 167371 - protein, 199 aa, Heterodera glycines
  Homolog annotation: Hit_ID=XP_343061.1; Match level="QueryCoverage =37%, HitCoverage=2%, E-value=2e-11, Identity=47%"; Hit description =similar to E3 ligase for inhibin receptor [Rattus norvegicus]
  Coding regions on vcDNA: vcDNA=SeqID_93794; Strand=+; Position=160-756
MFSDATTALQSQIESFSSVASAFRRQFSTSSTSANQSIIPNTGASRADAFAAIRAAIERSENIIPSLPIDVIIGSSPVNEGRNHRWRQALLDEFNAFIPPSMGSQSDGRQRSNEEGNCGRAARTMANKTAIQPGGWNDDFVLRRQFGALIPAFDPRPGRTNVNQTQDVKLPDSIQFCTYRRKGSLIREEPKGGGTSSTA

SEQ ID NO: 167372 - protein, 189 aa, Heterodera glycines
  Coding regions on vcDNA: vcDNA=SeqID_93795; Strand=-; Position=2-568
ACQKSFRSHDAEAIAAFKGAARALLTRHRRIWFDKMCLLVQRQFRLFAKFTTAQRTQKIVAHQCPKKRRGSTDREATNHLQQKHCSLLPSMSSLCRAPPVRHSQPSPAEEKRMPKSEVQMPKYVGDVPRGRTLAVAVVVRIGPQHSRVRCPCSAAAQCWHCRRRCRRDMRHQWAFPADDDGRVRRPTVR

SEQ ID NO: 167373 - protein, 175 aa, Heterodera glycines
  misc_feature (13)..(13): Xaa can be any naturally occurring amino acid
  Homolog annotation: Hit_ID=CAE67763.1; Match level="QueryCoverage =80%, HitCoverage=16%, E-value=2e-33, Identity=50%"; Hit description =Hypothetical protein CBG13338 [Caenorhabditis briggsae]
  Coding regions on vcDNA: vcDNA=SeqID_93796; Strand=+; Position=1-524
LAYCMPSSMPDTXGSPSLPLVAVKTQKPMGQIKVDYLLATSVDWEEEEEEKHATRMETTFVKHWKKRRTLEVGHRGSGESFTKFATARENTIFSLNNAAQRGADFVEFDVQLSRDRSVVVFHDFHVLVSVATRNAQLLGHPSAEETKNATAKPGSKSETKLSERTEAATDGGELH

SEQ ID NO: 167374 - protein, 259 aa, Heterodera glycines
  Homolog annotation: Hit_ID=CAE63538.1; Match level="QueryCoverage =98%, HitCoverage=75%, E-value=2e-74, Identity=52%"; Hit description =Hypothetical protein CBG08019 [Caenorhabditis briggsae]
  Gene Ontology: Cellular component=cytoplasm; Biological process=cell differentiation
  Coding regions on vcDNA: vcDNA=SeqID_93797; Strand=+; Position=35-811
MNIPTSIEMGVFPFVQQTDLCDSEEIVETSAFGSVKVNIFGNSERYPIVTFHDIGLNAIANFENFFQFQTFSKLTEQFCVYNINAPGQELDARKLPENFHYPTMDGLANIVGDVVSHFGFKSFIGIGVGAGANVLLRFAMSHQNLLDALLLINATSQKAGWVEWAYQRWNVNSLRSERMTRFTVDYLMWHHFGKYFEECNPDIVQQYRDYFYSHPNPSNLALYIETFLNRNELSLRDPKSTSDFLLKVPVLQIVGINSA

SEQ ID NO: 167375 - protein, 66 aa, Heterodera glycines
  misc_feature (33)..(33): Xaa can be any naturally occurring amino acid
  Homolog annotation: Hit_ID=NP_491061.1; Match level="QueryCoverage =100%, HitCoverage=30%, E-value=6e-13, Identity=57%"; Hit description= ribosomal Protein, Large subunit (24.1 kD) (rpl-1) [Caenorhabditis elegans] gb|AAF36008.1| Ribosomal pro
  Gene Ontology: Cellular component=cytosolic ribosome (sensu Eukarya); Biological process=protein biosynthesis
  Coding regions on vcDNA: vcDNA=SeqID_93798; Strand=+; Position=2-199
VAEVLKQSQEKKRNFRETIEFAIALKNYDPTEXQRFSGTVRLKHIPSSENKGWLLGDPKLWDEGNA

SEQ ID NO: 167376 - protein, 174 aa, Heterodera glycines
  Coding regions on vcDNA: vcDNA=SeqID_93799; Strand=+; Position=1-525
INGYASNKLSVRFVFSSLGRRTNGPTTWRTNQCQPLYFTYLCINEYLTQINVLFPRFTFSMYCFASSFSIPLNFAHRFLICAHASSSSSAVLGAFFFSSRQTWSPLSMRSAPAYNSTMAPPSLVIALISLSNKSLGNRAGKNCFAKTRKDNSFNTSKMFREPISDKLCHIFGLN

SEQ ID NO: 167377 - protein, 195 aa, Heterodera glycines
  Coding regions on vcDNA: vcDNA=SeqID_93800; Strand=-; Position=2-586
MNTPTAASSRTPTNVLATPFIPSSQMSMTDVRTPTTTLHGVIPSHHPPPIGGHSAAPIMTAERMALPPGIFSEGRGAFCPAPGNELGVRTEDQILQSKVENILREWISICYTPMAQKDPQHALAYIVQMVLLHVFEKDTIFWENIFLKNSSNCKLVNFLKFFGARDELLPYFRHLFFVWIVDFSKLFRCTTMKGS

SEQ ID NO: 167378 - protein, 140 aa, Heterodera glycines
  Homolog annotation: Hit_ID=CAE67531.1; Match level="QueryCoverage =87%, HitCoverage=9%, E-value=1e-12, Identity=33%"; Hit description =Hypothetical protein CBG13053 [Caenorhabditis briggsae]
  Coding regions on vcDNA: vcDNA=SeqID_93801; Strand=+; Position=3-425
FTYFQFSSEWALRLSADINMLPGKFPSALQPRFFDLCEQLTKQIVPTLEPFLRELIAVDQRSIALRVHIDGEVISYETEKWVALPEQHFGWTVTLDEQLIPFLYGLCSWLPSVFFVELHTFIVSTRPLPALTVPDSPGDS

SEQ ID NO: 167379 - protein, 181 aa, Heterodera glycines
  Coding regions on vcDNA: vcDNA=SeqID_93802; Strand=+; Position=2-544
PTLANDLRGLLAFVHPYAHLYETLNVEFLSARVFERIDAEWLSFLCRLDSAQLNMVPVEFEQYPDCPASLKHFFASARRFSLLDKYSTPFVDQQQHNNKYSSPEQLRKVKRKKAHELGAFGELLRAECAPLGIDRVVDIGCGLGHLGRVLRLNNESLQLQQTSNDNNSSLQLDYVGIEANP

SEQ ID NO: 167380 - protein, 95 aa, Heterodera glycines
  Coding regions on vcDNA: vcDNA=SeqID_93803; Strand=-; Position=2-289
MMLNRQILFTATAWFCWSLTQCMRVVPARGSFRQQSDRAVVQLVGDKPNGSQKMLSSTERAPRNSSGRILGCVFRLPKRERSGERCHSEDARGNG

SEQ ID NO: 167381 - protein, 144 aa, Heterodera glycines
  Homolog annotation: Hit_ID=NP_496366.1; Match level="QueryCoverage =72%, HitCoverage=57%, E-value=5e-12, Identity=43%"; Hit description =C.Elegans Y-box (21.3 kD) (cey-1) [Caenorhabditis elegans] emb|CAB04257.1| Hypothetical protein F33A8.3 [
  Gene Ontology: Mol. function=DNA binding; Cellular component=nucleus; Biological process=transcription from Pol II promoter
  Coding regions on vcDNA: vcDNA=SeqID_93804; Strand=+; Position=267-698
LKNCYTSFHGARGPEAANVTGPDGVPVQGSKYAADLSQRRRFAGPRRNYFFRGNRNRRPRHSEEAAGGEVPVGEKKEGAENNGKEAKKEEVAKDANGGRGGGQRRGRGVRFRGRRNNRRNVAGSTSGGTENEGEQKKEQTQPEE

SEQ ID NO: 167382 - protein, 88 aa, Heterodera glycines
  misc_feature (24)..(24): Xaa can be any naturally occurring amino acid
  misc_feature (26)..(26): Xaa can be any naturally occurring amino acid
  misc_feature (37)..(37): Xaa can be any naturally occurring amino acid
  misc_feature (63)..(63): Xaa can be any naturally occurring amino acid
  Homolog annotation: Hit_ID=CAG06679.1; Match level="QueryCoverage =98%, HitCoverage=14%, E-value=6e-13, Identity=48%"; Hit description =unnamed protein product [Tetraodon nigroviridis]
  Gene Ontology: Mol. function=DNA binding; Cellular component=nucleus; Biological process=regulation of transcription, DNA-dependent
  Coding regions on vcDNA: vcDNA=SeqID_93805; Strand=-; Position=57-320
KEREGETEAERRRCRWQERERERXRXRRLKGRRRREXRERKERLKGRGRRERERMERRLKGRXEERERERKERLKGRGRRERERVRDP

SEQ ID NO: 167383 - protein, 252 aa, Heterodera glycines
  misc_feature (23)..(23): Xaa can be any naturally occurring amino acid
  misc_feature (28)..(28): Xaa can be any naturally occurring amino acid
  misc_feature (135)..(135): Xaa can be any naturally occurring amino acid
  Homolog annotation: Hit_ID=XP_550305.1; Match level="QueryCoverage =85%, HitCoverage=14%, E-value=9e-29, Identity=36%"; Hit description =helicase-like protein [Oryza sativa (japonica cultivar-group)] dbj|BAD68127.1| helicase-like protein [Ory
  Coding regions on vcDNA: vcDNA=SeqID_93806; Strand=-; Position=3-758
KSREELINFVYPNFQQLLGNERXLLSRXILAANIHTCDEINEMMMANVPGQVREYLSTDKPLDDRPLDIDEIESEVAALNRRTDSGMPPHCLQLKVGSVLVLLINKSDREVLINGTRIVLEELGDDRLVGRVINXSNAIGGQVRFFLERSHNIFEDKTPGGLKYARLQFPIKPAFAMTIQKGQGQTIRTVGIDLEREVFTHGQLYTAFSRATDGNNVRVHAPKREIDAQGQAKVLYIVAKKMLILRKRAIQA

SEQ ID NO: 167384 - protein, 143 aa, Heterodera glycines
  Homolog annotation: Hit_ID=T06789; Match level="QueryCoverage=93%, HitCoverage=50%, E-value=8e-40, Identity=63%"; Hit description =hydroxyproline-rich glycoprotein 1 - garden pea (fragment) gb|AAB97098.1| hydroxyproline rich glycoprotein PsH
  Gene Ontology: Mol. function=structural constituent of ribosome; Cellular component=cytosolic large ribosomal subunit (sensu Eukarya); Biological process=positive regulation of growth rate
  Coding regions on vcDNA: vcDNA=SeqID_93807; Strand=+; Position=3-434
QLFAGKMPFKRYVEIARVALINYGPEFGKLVVITDVIDQNRALVDFPEQERRVVNFKRLAITDFKVDIKRHAVKKDLKKALADADVVAKFAASSWGQKLAKQAAKAATTDFDRYKATVAKAKKARAVRKVLNGLKKTAAPKKK

SEQ ID NO: 167385 - protein, 201 aa, Heterodera glycines
  Coding regions on vcDNA: vcDNA=SeqID_93808; Strand=+; Position=32-634
KVRKRVLAFFDDGSQKTYIEEELARSLKLTVIGRQKLELSGLGGVNLGKFESPVVEFGLKARDFNMLMIGRAIKKVLKEIPVLDYQEINNHELKKNKISVPYLLDEPKITIGSDFYNYFDIRPIKHLNSGFWISNSKIGKILSGDGKVTWANFYDKKVNTKDEYNVSAINSSAIQCETEITDQMELDKNKELIKLVRQHDS

SEQ ID NO: 167386 - protein, 102 aa, Heterodera glycines
  Coding regions on vcDNA: vcDNA=SeqID_93809; Strand=-; Position=114-422
AHNFCPIAGKSVGKLSKKAMQKRGKSKNGKPNHRNHRQNEAMECHFRWKVMDKSDNFRINIKYSVQIILFIFRPIIWEKCWQMNGIDTIFVHQKIKIIIQKR

SEQ ID NO: 167387 - protein, 164 aa, Heterodera glycines
  Homolog annotation: Hit_ID=XP_395536.1; Match level="QueryCoverage =88%, HitCoverage=47%, E-value=1e-33, Identity=49%"; Hit description =similar to CG1227-PA [Apis mellifera]
  Gene Ontology: Mol. function=protein serine/threonine kinase activity; Biological process=protein amino acid phosphorylation
  Coding regions on vcDNA: vcDNA=SeqID_93810; Strand=+; Position=92-751
NAKIICRDLKPANLMFSDPQTLQLIDFGSATECPLRILDARDSRRILDEAAELCTMPYRAPELFTCEIGAMIGESVDIWSLGCVLFALCYFRSPFDGVHERGDSVALAVQSAKINFDTAVPVDRHIAELIQSMVLIRPSERPHISQIKKRVDQMQTLDEVKDNE

SEQ ID NO: 167388 - protein, 265 aa, Heterodera glycines
  Homolog annotation: Hit_ID=AAN87269.1; Match level="QueryCoverage =99%, HitCoverage=10%, E-value=2e-40, Identity=37%"; Hit description =ORF [Drosophila melanogaster]
  Coding regions on vcDNA: vcDNA=SeqID_93811; Strand=-; Position=21-818
KVLGLIWDIDKDDIVFEFPSVDSLKIVNRRLVLSFLASLFDPLGLMGPCIQPLKLFFQSLWEEKKGWDDALSEEDSTRWNAFQESWKDKRIRVPRRTMIQGECSLQLHAFVDASIHTFATAIYLRVESSNKIQNWLIFSKNRLKPKSASKALTIPRMELMAILIGIRGLKFIQTQLRRAIEHSYLWSDSQIALNWVASKEAQPKFIERRIKEIRTITKCSFHFVRTAENPADLATRGATPEELSTHSSWWGGPNWLRKGPKSLAS

SEQ ID NO: 167389 - protein, 98 aa, Heterodera glycines
  Coding regions on vcDNA: vcDNA=SeqID_93812; Strand=-; Position=161-457
IYAFSFKKFKFLAALGTIISAINSEQAMRLPLEFGTDSPAPSTLKLNKKIHLQHGRTKSFGHHIFQFRRHSQIEGYAGKLKDLKILMIQLSMSRNEFY

SEQ ID NO: 167390 - protein, 261 aa, Heterodera glycines
  misc_feature (7)..(7): Xaa can be any naturally occurring amino acid
  Homolog annotation: Hit_ID=CAE59655.1; Match level="QueryCoverage =100%, HitCoverage=32%, E-value=1e-113, Identity=73%"; Hit description=Hypothetical protein CBG03070 [Caenorhabditis briggsae]
  Gene Ontology: Mol. function=ATPase activity; Cellular component =cytosol; Biological process=microtubule cytoskeleton organization and biogenesis
  Coding regions on vcDNA: vcDNA=SeqID_93813; Strand=+; Position=30-811
MASVPTXLDEKTKRNEELATAILKKMPKPNRLIVDQSPKDDNSSVLMAQTKMDDLGLFRGDSILLKGKKRRETTSIVIASDTCPPEKILMNRVVRQNLRVKLGDVVSVSSASNTPNGLRIHVLPIDDTVEGLTGNLFEVFLKPYFLEAYRPVYKGDTFTVNAAMRTVEFKVIETDPAPACIVVPTTIIHCEGEPIKREDEENNLNDVGYDDIGGMRKQLAQIKEMVELPLRHPMLFKSIGIKPPRGMLLFGPPGTGKTLVA

SEQ ID NO: 167391 - protein, 100 aa, Heterodera glycines
  Coding regions on vcDNA: vcDNA=SeqID_93814; Strand=+; Position=3-302
VTHYIRPFEVLDLSANSQIPPALCGQSDILFGNIRELLDFHRSLLLPALQRSSNSSMGFLLCSMPSGSFAFAYRAYGATTDQGSVEEENSIDTPIFPECH

SEQ ID NO: 167392 - protein, 150 aa, Heterodera glycines
  misc_feature (85)..(85): Xaa can be any naturally occurring amino acid
  Homolog annotation: Hit_ID=CAE58603.1; Match level="QueryCoverage =96%, HitCoverage=36%, E-value=6e-45, Identity=60%"; Hit description =Hypothetical protein CBG01770 [Caenorhabditis briggsae]
  Gene Ontology: Mol. function=kinase activity; Cellular component =plasma membrane; Biological process=zygotic determination of dorsal/ventral axis
  Coding regions on vcDNA: vcDNA=SeqID_93815; Strand=+; Position=15-463
VWKHTPVAIKRILGKCGSDERQQRERIRQSLQELKTLAKFRHDNVLSLYGYSLDGPEPCLVYQFMSNGTLEDRLLCRVTYNGNHXNGTEPLGWAKKLSICGGVCRGLHFLHTINQMPIIHGDVKSANILLDKHFEPKLGDFGLSRYGQVE

SEQ ID NO: 167393 - protein, 206 aa, Heterodera glycines
  misc_feature (193)..(193): Xaa can be any naturally occurring amino acid
  Homolog annotation: Hit_ID=NP_501120.1; Match level="QueryCoverage =100%, HitCoverage=6%, E-value=3e-47, Identity=49%"; Hit description =hect domain containing protein 1 (4H900) [Caenorhabditis elegans] gb|AAB00699.1| Hypothetical protein C34
  Gene Ontology: Biological process=embryogenesis and morphogenesis
  Coding regions on vcDNA: vcDNA=SeqID_93816; Strand=-; Position=8-815
AECALRCFAAMTDRFVRRQMDPMALASPSRLVAHLFDLIGSSSTAHENAPTELSSNGENCRIRKRSSAFISMVFSLFVNLCKSSFALTEEILSSSKLVPALKMVLNGKDERCINDSLRFIDLLIVLLCEGRSAISKNRVLLNDSVAPPAFDKTHRNLIDAIRLRDTDALIDAVENGTVDPNFVDDVGQTLLNXSSAFGTSDMVIYL

SEQ ID NO: 167394 - protein, 232 aa, Heterodera glycines
  Coding regions on vcDNA: vcDNA=SeqID_93817; Strand=+; Position=51-746
MSSTISENQQQSWGSFVKTSFGTRRHCWVCNDVWMDILPLFDHAQLGLKLALISPRFDVLVDAHFNGKSELTIWRQITIQRFKGPKAKLSEWIDDKWVAFPLPDRPLPNKIRFRNLRIENPDHSVLAFLRANQQIFEKATNLCLSVSSCFHDCLFSFVDNNVQPIWDVFACEIWPIFAPNIRRFNFRDGDHLDNLRRRISPTILTDLNNLSAITSGRLFPDGIADDGPNATA

SEQ ID NO: 167395 - protein, 104 aa, Heterodera glycines
  Coding regions on vcDNA: vcDNA=SeqID_93818; Strand=+; Position=29-343
KRSNFTALWSKKNPNKLNIFKRKNKQQINRSANRREGPPLPFTPGAPLYKPGNSFPGSSVATISYIIFNSPSIDLVPLLQPRESSTRGLRPGMDKRGSVGPAQL

SEQ ID NO: 167396 - protein, 140 aa, Heterodera glycines
  Coding regions on vcDNA: vcDNA=SeqID_93819; Strand=+; Position=2-424
TCHCHFAHGGQHFSQYSLKLPTWLESRYKRVHFADLLRLLIDYDDLSDAFRLLHSHIDSARQRLREFVARWIRTNPKATFIPDEELAPLLPYTHINELLRLAEKRTDRQQLPIKETVDKLRQFADFQKSVTKNPMPFLAK

SEQ ID NO: 167397 - protein, 230 aa, Heterodera glycines
  misc_feature (39)..(39): Xaa can be any naturally occurring amino acid
  misc_feature (112)..(112): Xaa can be any naturally occurring amino acid
  Homolog annotation: Hit_ID=NP_001004509.1; Match level="QueryCoverage= 99%, HitCoverage=14%, E-value=2e-22, Identity=32%"; Hit description =si:busm1-180o5.3 [Danio rerio] emb|CAD60788.1| novel protein similar to DNA polymerases [Danio rerio]
  Coding regions on vcDNA: vcDNA=SeqID_93820; Strand=-; Position=22-713
MAIKYLEWRSKRDGIEIRHAGNGREVKVGKYKLDGFLLXNVGGRDKCIEVMGCYIHGCMNCYDPAAELIGGRTAQELNDETQERLAELRKTLDVEEVWVSLFDIYIFIVNFXGCQIEKELKKDEEMRDFFDDRGNEKGPIDPRMAYAGGRTGPMKLYAKSDEKKKISVYDIVSLYPSVNYGTAYPIGLPEIIIPKTDEINVNWMRPEDLKYKGLYKVRVTPRKGLRIPVL

SEQ ID NO: 167398 - protein, 270 aa, Heterodera glycines
  Homolog annotation: Hit_ID=NP_499836.1; Match level="QueryCoverage =64%, HitCoverage=24%, E-value=2e-46, Identity=50%"; Hit description =tyrosinase family member (77.8 kD) (3O835) [Caenorhabditis elegans] emb|CAB04594.1| Hypothetical protein
  Coding regions on vcDNA: vcDNA=SeqID_93821; Strand=+; Position=8-817
MFSLCCWLRFSLLPPLVFGPALASGGGPNSSQRHPSHHQQQQQQLLHSEPLQLLHSSAEAHPTVVNMSSTNGRRAADAATLGKSGPEGPPPGKWLGCEDAPDEWRRRTCIKLRQIDRKARQALTRRVKQMVSPPSMPGSPAWLKPLPVPVNHRGQIASHPFECMTLRCLCPFFKGKMRRDGLCYLPSGKPLSMAYRKEYRMLSDEERRRFHVAMNELKRQGIYRFFGTQHRRVATGGAHSGPAFLPWHREFVKRLEIALRLLDPSLAVPY

SEQ ID NO: 167399 - protein, 55 aa, Heterodera glycines
  Coding regions on vcDNA: vcDNA=SeqID_93822; Strand=+; Position=90-254
LTIACPYISGRFGRLCLLGRFFGRHFVVVSRTARLGHRRRYGLGHRNGLKKKKKK

SEQ ID NO: 167400 - protein, 163 aa, Heterodera glycines
  Coding regions on vcDNA: vcDNA=SeqID_93823; Strand=+; Position=1-489
LTLLQPRTVPSPSASLSPTDQKGWGTLKNSSDPSTINVPIKTSVCTETVKTANVCGREIGTVGHRHQLQQSQSKWRQAAELNVGDSSNLASPPLTSVELGTAQRRVGTALRPLEVSRPCRSVASNTSPPSPCRTPPVARPLAQRSIAAFYPFKRRALIDYQSP

SEQ ID NO: 167401 - protein, 213 aa, Heterodera glycines
  Homolog annotation: Hit_ID=CAE56783.1; Match level="QueryCoverage =84%, HitCoverage=22%, E-value=6e-17, Identity=22%"; Hit description =Hypothetical protein CBG24593 [Caenorhabditis briggsae]
  Coding regions on vcDNA: vcDNA=SeqID_93824; Strand=-; Position=3-641
PTQCPTPLFNQAQGSRKQTIWLYKPNAFQYEVEAWACRKVRKNIQKHTSLTNIPIIEKLDSELLSMDREECQQMINHQKCSFGTLKQEGELFHTDNKIDMSPRVWLFGSFSWMKASSENCYLFKTRIINKFGSPSIQTSIGDSDHCSFEKGQCFLEDKTLLLWNSSISKKCEYLPLGPFKGQMLGTIFIADNEKVLLTFEEKPKIVKEGVQIN

SEQ ID NO: 167402 - protein, 51 aa, Heterodera glycines; identical to SEQ ID NO: 132561
  Coding regions on vcDNA: vcDNA=SeqID_93825; Strand=-; Position=80-235

SEQ ID NO: 167403 - protein, 257 aa, Heterodera glycines
  Homolog annotation: Hit_ID=NP_495155.1; Match level="QueryCoverage =94%, HitCoverage=31%, E-value=2e-32, Identity=34%"; Hit description =endocytosis protein EPS15 Homolog (81.8 kD) (ehs-1) [Caenorhabditis elegans] gb|AAC71084.1| Eps15 (endocy
  Gene Ontology: Mol. function=protein binding; Cellular component =synaptic junction; Biological process=synaptic vesicle endocytosis
  Coding regions on vcDNA: vcDNA=SeqID_93826; Strand=+; Position=3-773
KAKRQSPFDRNVVEWKIEELGQYESEFERLDSDRDGFVEGGDVRDVFLRSGLHQNVLARIWAHIDVSKTGKLDLEQYAKCVELIRECQAEQNNATISAEFQSEEAIVGAGTPSSPSLPGHPSNLTRRDSQISNATNNSSTGGAKGALSEATQRVMELNTEIEQIQQRRRQAEQDLFQAEADMKVKNSEIRNLEIELLTLNATVKQLKNQRVEANKRLNDLDTKIVRLEGTAVENKKRMEEDQERLTKTQMDIQKAKD

SEQ ID NO: 167404 - protein, 87 aa, Heterodera glycines
  Coding regions on vcDNA: vcDNA=SeqID_93827; Strand=-; Position=2-262
NFRADHYGFFSQILNSCTNTDAARFLKRVKSAAGIEYLGYPFYLVDSLQSQTNQIVKALQSDFGSSRLMLNGSAFSVCGGKKAPKGL

SEQ ID NO: 167405 - protein, 42 aa, Heterodera glycines; identical to SEQ ID NO: 147096
  Coding regions on vcDNA: vcDNA=SeqID_93828; Strand=-; Position=99-227

SEQ ID NO: 167406 - protein, 182 aa, Heterodera glycines
  Coding regions on vcDNA: vcDNA=SeqID_93829; Strand=+; Position=2-550
PAIRKSAICESDQLSTGASESRLEVAKNFLRRFYNHSTLRLTGRRRRRGNGTKRGDADKGTAEPPLMYSSALGPFFEMRNPQPAEMPFLPYNIHYTIESTDEASGASDDDADGTAAAVRRPLRAVSPQSVWSCSPTCSSATITSPNRAEMTTTTSTRSQNSSSCMAITANVTAKREMISNRK

SEQ ID NO: 167407 - protein, 254 aa, Heterodera glycines
  Coding regions on vcDNA: vcDNA=SeqID_93830; Strand=+; Position=12-773
KFDNRNQQSQYRPNKPPNDRRWNNRPVCNYCKKVGHVANACRTRLADFQNNQRPQSFNQRAKSDRWSTTPFASGANAVHQDQTLSLLHEIARTMNKLTVNTDQPGRRDDVNTIVTSTEQCHVKKVHIKDKSDISKSEPLQVSSWEKATLGPKIHPFIFIVAIFCTCGPVFSNTAMIPQGPMLCQTETQPTLWKLPEIPECPIPKVTVGHVPISQIRELYIPNAIEHNTKAWACRKIIKRARKFTSLSGVPITEA

SEQ ID NO: 167408 - protein, 84 aa, Heterodera glycines
  Homolog annotation: Hit_ID=NP_501213.1; Match level="QueryCoverage =100%, HitCoverage=11%, E-value=3e-31, Identity=73%"; Hit description= phospholipase C delta (4I274) [Caenorhabditis elegans] gb|AAB00624.1| Phospholipase c protein 4 [Caenorh
  Gene Ontology: Mol. function=phospholipase C activity; Cellular component=inaD signaling complex; Biological process=acrosome reaction
  Coding regions on vcDNA: vcDNA=SeqID_93831; Strand=+; Position=2-253
RLLQCRWGNILMEGHETVFQQMDQPLQCYFINSSHNTYLTGLQVHGNATVEGYMSALLRGSLLVELDGFDGEHGEPQITHKRTF

SEQ ID NO: 167409 - protein, 266 aa, Heterodera glycines
  misc_feature (17)..(17): Xaa can be any naturally occurring amino acid
  misc_feature (21)..(21): Xaa can be any naturally occurring amino acid
  Homolog annotation: Hit_ID=AAO72713.1; Match level="QueryCoverage =100%, HitCoverage=50%, E-value=1e-119, Identity=75%"; Hit description=catalase [Melopsittacus undulatus]
  Gene Ontology: Mol. function=catalase activity; Cellular component =peroxisomal matrix; Biological process=determination of adult life span
  Coding regions on vcDNA: vcDNA=SeqID_93832; Strand=+; Position=2-800
DAVDVHEMAHFDRERIXERVXHAKGGGAHGYFEVTNKDIANYSKAAMFSEVGKRTPLFIRFSSVGGEAGSADTARDPRGFAIKFYTEEGNWDLVGNNTPIFFIRDPFLFPNFIHTQIRNPVTHLKDPEMMWDFWTLRPEALHQVMFLFSDRGTPDGFRHMNGYGSHTFKLVDNAGSAVYCKFHIKTRQGIKNLTAEKALQLAAEDPDYAIRDLYNAIASGDFPQWDFFIQVMTFEEASRFRWNPFDLTKVWPHRDFPLLPVGRIVL

SEQ ID NO: 167410 - protein, 87 aa, Heterodera glycines
  Coding regions on vcDNA: vcDNA=SeqID_93833; Strand=-; Position=5-268
GTRTEFQTKFLFFNRTLGLLHHFPKFIQDPETRAVGKAVKRILVFEKVRKKYKYRLYCSGSICVSAFHSFDHSLFSIEFTFSSIFNT

SEQ ID NO: 167411 - protein, 183 aa, Heterodera glycines
  Coding regions on vcDNA: vcDNA=SeqID_93834; Strand=+; Position=49-597
SVRVRRHKMRLLPGPSSSSEEVDDSSTEGPPCHCPSSLHSPRVPSRRPLSRAVLWCRPRRRCFCLAICLTVVALVANFTLFFIILDILLALLRRKCADNGYGQQKTMGQSSQIGQNIVKQTLANANNGTENANDSRTNNTSELASVNRQFAIPSTPSSYLSPIGAIPSASSPIGAIPSASSPI

SEQ ID NO: 167412 - protein, 133 aa, Heterodera glycines
  Coding regions on vcDNA: vcDNA=SeqID_93835; Strand=+; Position=190-588
PLMTCFWKIFVEKIFSLKNHVHPPLVPNLKITFIFIKILKKVIKMPNKIYIIEQKTADFCSILFFQTIFSEPSYEFFSENSNFSRNSAILMKRYKCDLKRYNSDKRSIKVIRRGKKVIRRGTMVIRRGTKVIR

SEQ ID NO: 167413 - protein, 237 aa, Heterodera glycines
  Homolog annotation: Hit_ID=CAE68007.1; Match level="QueryCoverage =53%, HitCoverage=7%, E-value=5e-20, Identity=44%"; Hit description =Hypothetical protein CBG13620 [Caenorhabditis briggsae]
  Gene Ontology: Mol. function=general RNA polymerase II transcription factor activity; Cellular component=transcription factor TFIID complex; Biological process=negative regulation of FGF receptor signaling pathway
  Coding regions on vcDNA: vcDNA=SeqID_93836; Strand=+; Position=21-731
MIRGEVTKGYSTVSVAAKEAVAAAAANDRQQTAQTQAAAPDGPQDAFTLPNPQISASTSAIAQRKLRIYRTIKNRDGTESNRIETVSHPQLIEAYVRIRTTRDDNFIKVYAQMDDQYKEEKRKERRRQQQEGGRRPRKGGAAGEPKSVAQRQDNIAAAASFVKSVLEQQQQLQQQQQQKHQQPQSLPAAQLPHQVQAVQQQNPQQKDTPAALSVRAQLPIKPGPKPKKPQMEKKQRK

SEQ ID NO: 167414 - protein, 162 aa, Heterodera glycines
  Homolog annotation: Hit_ID=NP_491780.1; Match level="QueryCoverage =82%, HitCoverage=34%, E-value=3e-23, Identity=35%"; Hit description =of inner mitochondrial membrane 44 (49.4 kD) (1G754) [Caenorhabditis elegans] gb|AAB53011.1| Hypothetical
  Gene Ontology: Cellular component=mitochondrial matrix; Biological process=mitochondrial translocation
  Coding regions on vcDNA: vcDNA=SeqID_93837; Strand=+; Position=1-486
QAIEECEIPPNLVPFSYLRLSLHAIQRKEKTFVASFLNNIKDELKRNKELQDNKKLLEERLKQLNDSEVRRKYDKISKESAESTDIIKHHLKEFTDHMNAIVSNVKDSKLGKDAIHQLKVATETAERVAQQVGEMQAYKQVSYMAKEIDRLADVRMYKRPDE

SEQ ID NO: 167415 - protein, 79 aa, Heterodera glycines
  Coding regions on vcDNA: vcDNA=SeqID_93838; Strand=-; Position=228-467
GKVNVKYIIGQIQNMMLKHRISGSFLRIEFSYKKKQLDFLPFLFDFLVKKIIETEQLFFSSYFLPMFEGFYFLVYKILN

SEQ ID NO: 167416 - protein, 111 aa, Heterodera glycines
  Coding regions on vcDNA: vcDNA=SeqID_93839; Strand=-; Position=1-333
ATAVSEDPPPPPPLVPAGDAEEGFCAAAVAISAPCLLTPPPASAVPLCNCFFFFGSAPLSPSSSSAPIHPLFRLFGGRCSGAVGTTASAAGEATAADAAFNDAFLLRINGR

SEQ ID NO: 167417 - protein, 151 aa, Heterodera glycines
  misc_feature (7)..(7): Xaa can be any naturally occurring amino acid
  misc_feature (9)..(10): Xaa can be any naturally occurring amino acid
  Homolog annotation: Hit_ID=XP_215517.2; Match level="QueryCoverage =90%, HitCoverage=20%, E-value=1e-24, Identity=38%"; Hit description =similar to CG1317-PB [Rattus norvegicus]
  Coding regions on vcDNA: vcDNA=SeqID_93840; Strand=+; Position=5-460
NATGLLXRXXAAAFPLLAVIPFMLGLYFQMLVISPLRVAIFQSPLFFPWKEWAMGVVHFKIVCASVLMGPDWWLKTAFEQVQQRTCAGLSLFVFIIYADGIWNIRLRDLYTNLVFPIVNTLTFLIAFPYVLSNFLLFFVGKRFKFFSFPKF

SEQ ID NO: 167418 - protein, 220 aa, Heterodera glycines
  misc_feature (12)..(12): Xaa can be any naturally occurring amino acid
  Homolog annotation: Hit_ID=CAB88204.1; Match level="QueryCoverage =99%, HitCoverage=90%, E-value=1e-85, Identity=61%"; Hit description =putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_93841; Strand=+; Position=9-667
MGVASLCSIAAXLATLIVVPQLYQQINEVNSRVFDGVQAFRVNTDSAWTELMDVQISVTPPARPRENPFNSIFLRQKRGNGGLPPQCVCQLQQPQCPPGTPGPPGPPGPAGLPGGPGQPGGPGQPGQQPPPCPQASAGCPSCPAGPPGQPGGQGPPGPPGGDGQPGQPGQGGGQGPPGPPGPPGPGGNPGQPGGPGQPGQPGAPGTKSSSVPGPPGPPGQ

SEQ ID NO: 167419 - protein, 84 aa, Heterodera glycines
  Coding regions on vcDNA: vcDNA=SeqID_93842; Strand=-; Position=228-482
QLMSLFGFFFKQFSVIAHQLLGVQQRRHLHPMQLFTGSLNLFLFFFSISSLNGVITIFHNSFAFNRHILKILISMVVQAYYYFF

SEQ ID NO: 167420 - protein, 127 aa, Heterodera glycines; identical to SEQ ID NO: 125714
  Coding regions on vcDNA: vcDNA=SeqID_93843; Strand=-; Position=251-634

SEQ ID NO: 167421 - protein, 221 aa, Heterodera glycines
  Homolog annotation: Hit_ID=XP_397140.1; Match level="QueryCoverage =65%, HitCoverage=24%, E-value=7e-18, Identity=29%"; Hit description =similar to CG9448-PA [Apis mellifera]
  Coding regions on vcDNA: vcDNA=SeqID_93844; Strand=+; Position=66-731
MGECSSNNDVPNASKKWPCAYCTYLNWEASLKCVICCQPRNRPMIIEELGAIEEFGSKLVLSDRFVKESAPRWSCPTCTYLNCQRTKRCAICGSTERPARFEEETSPTENHPNRKDKTMATILSKDLLNKWSCSVCTFDNWPTAPKCTICGRLRSGGSANESEVRQIQQQKQQKAQQLNIGRTGRQRSFALSANGRKQQQHKDDADDEQHHHHKHSDQDDE

SEQ ID NO: 167422 - protein, 136 aa, Heterodera glycines
  Coding regions on vcDNA: vcDNA=SeqID_93845; Strand=+; Position=294-704
VQVQIKLKKFPFDLKLKKNFSAIWADSDLIGDTLSAVPVTKIFLNTQKNAINFQRTRPAMKTHMPAQFIAQFPWCDLFIFCWLSNLKFGFVQLTTHDGTFFCIGAAIRLKIIFFLHILKLMPWFFFSKFWGKNRGA

SEQ ID NO: 167423 - protein, 180 aa, Heterodera glycines
  Homolog annotation: Hit_ID=AAG00551.1; Match level="QueryCoverage =61%, HitCoverage=43%, E-value=2e-12, Identity=42%"; Hit description =retinitis pigmentosa GTPase regulator [Homo sapiens]
  Coding regions on vcDNA: vcDNA=SeqID_93846; Strand=+; Position=3-545
KKVGQIPFDIGELAAQVDNVQDDHALLQNQVANLNNQVVNLNNQVVNLNNHVGALLNLATQQQGQISQLQEALQQLVGPAIGQAAAGSQQQEEKSGKEKPKEGEDEDEAGGEITVAEDKEEAEGEKNVPEDEEEAEGEKTVAEGEGEDEEEAGGEKTVAEGEDEGTSDGEPKTKHPRLQF

SEQ ID NO: 167424 - protein, 109 aa, Heterodera glycines
  Coding regions on vcDNA: vcDNA=SeqID_93847; Strand=-; Position=110-439
IVLDKQQKVETTRHFQNASLGHVFELFNAMTSDSLQFVFISVLRCGLLRQRETICHLEKLCLVQRSFGHHFSPGTFKVRQNALRPRPRCAVRLDLIASSDCGRTWHCAS

SEQ ID NO: 167425 - protein, 126 aa, Heterodera glycines
  Coding regions on vcDNA: vcDNA=SeqID_93848; Strand=+; Position=231-611
FSDFEMPNSINRLFRRLRESHGDGGKKPKKASVVSGCCSRRTSSTISQPSNRKVGLTGITLPFLIFHNFLPRRCPSPSNANAISMVRFCPRRSFFAFSTALTVLSNFFRCDLPTKIVLTLSAQKSA

SEQ ID NO: 167426 - protein, 198 aa, Heterodera glycines
  Homolog annotation: Hit_ID=CAE73955.1; Match level="QueryCoverage =60%, HitCoverage=18%, E-value=1e-49, Identity=78%"; Hit description =Hypothetical protein CBG21580 [Caenorhabditis briggsae]
  Gene Ontology: Mol. function=cysteine-type endopeptidase activity; Cellular component=intracellular; Biological process=proteolysis and peptidolysis
  Coding regions on vcDNA: vcDNA=SeqID_93849; Strand=+; Position=1-594
KLCEGNEWEKGVRFSEFLHLSRISKHFLSFIFSLPHCFFLSFFPISHFVLLRFVSACSTLTHNGALLQKVIPEADRQEWAPSNTYRGIFQFCFWRFGRWVDVIIDDLLPTKNGQLLFARSKTPNEFWSALLEKAFAKLYGCYETLVGGQLADALIELSGGVAETLNVRKFLHIHKQQIQQQQQPMFSASFNACGITVL

SEQ ID NO: 167427 - protein, 96 aa, Heterodera glycines
  Coding regions on vcDNA: vcDNA=SeqID_93850; Strand=+; Position=118-408
PSQIGISSSFSSDTPIRPITVRLCCLILRHVLLSLGSDQNFHSAVELAVRRSQHKLLNVLRGALQTEKFFLEMFEDEHWHFQVAKINLCILPKLHF

SEQ ID NO: 167428 - protein, 148 aa, Heterodera glycines
  Coding regions on vcDNA: vcDNA=SeqID_93851; Strand=+; Position=44-487
VPCSRCRPTPTTKSLPKCAVSLLSVQRAVRRWHRKLWCLSPKSAKWRSPLSAAQSSAAPPPFSNCAYASNANGGRDGERQWGEERTEEKGTEEKAKGGGGRRIRGSGGGAAVAGRGGGGRGGRPRHDGTYHGTVPAGDRSAPIHQSLR

SEQ ID NO: 167429 - protein, 142 aa, Heterodera glycines
  Coding regions on vcDNA: vcDNA=SeqID_93852; Strand=+; Position=46-471
LTLPRSQSEYSPMSKQSDIHQLIDSQMKFAKNTIDALNKLQDSFTLDQKPILSHLISTLSTQFDLLNSSIVHLRSADPTQKDVPISAEELERQRSVVIIGLPEHNDISPSKRGEMDRSKINCLFDSLGIECGTISYRMGRPY

SEQ ID NO: 167430 - protein, 154 aa, Heterodera glycines
  Homolog annotation: Hit_ID=NP_740829.1; Match level="QueryCoverage =59%, HitCoverage=26%, E-value=2e-13, Identity=41%"; Hit description =poly U binding factor 68kD like (rnp-6) [Caenorhabditis elegans] gb|AAM81102.1| Rnp (rrm rna binding doma
  Coding regions on vcDNA: vcDNA=SeqID_93853; Strand=+; Position=7-471
MDVYASYVPQQNGMKQQPQQNAHYATSTPPSVDSPSAAPTTKFVAMPLLQQTARVFVGPGQQKEAQLIGLGLRKLRTYEKEDLERAKRYAMDQSVKYVMLKQREAHQQQVMCDRTMSPTKTDNEWAFVGIVFWELSRSTVVTWHYPSDRCPNGK

SEQ ID NO: 167431 - protein, 142 aa, Heterodera glycines
  Coding regions on vcDNA: vcDNA=SeqID_93854; Strand=-; Position=3-428
SIPSNSNPFSVVVFIVVGVLLTAFLCCRQLVTPLPPDNRCSFPTNSRPISGKKNSQKSWDKLKVPFQWNCKLLIVISQVFFAVPFCPPERCFSVKCEKRSDPRAIPRHWHNSDERKRNAEVSVQNGENEPYFWPMFWDKTSF

SEQ ID NO: 167432 - protein, 101 aa, Heterodera glycines
  Homolog annotation: Hit_ID=CAG06679.1; Match level="QueryCoverage =90%, HitCoverage=9%, E-value=2e-09, Identity=42%"; Hit description =unnamed protein product [Tetraodon nigroviridis]
  Coding regions on vcDNA: vcDNA=SeqID_93855; Strand=-; Position=262-789
GGSLTSSVERRREWTKGGGRERERRKKGRDNTERERERDIATVIKRRERERMRGELVRERGESEREKERLSDSDKVERAREKARDRATALWVRASVRQNCS

SEQ ID NO: 167433 - protein, 116 aa, Heterodera glycines
  Coding regions on vcDNA: vcDNA=SeqID_93856; Strand=+; Position=89-439
GLHKPKMKSGHFRSVSCGPFLPNPFAMPFNTLRFFFAREIKKATAQHQQSKSVQKFHCNQTKIISGHHRNGDTMSDYTKLAAGITENDERLWKINDKKTKEQFKNILCCVWAMGFY

SEQ ID NO: 167434 - protein, 251 aa, Heterodera glycines
  misc_feature (18)..(18): Xaa can be any naturally occurring amino acid
  Homolog annotation: Hit_ID=CAE72291.1; Match level="QueryCoverage =100%, HitCoverage=15%, E-value=1e-101, Identity=68%"; Hit description=Hypothetical protein CBG19421 [Caenorhabditis briggsae]
  Gene Ontology: Mol. function=protein binding; Cellular component =endocytic vesicle; Biological process=synaptic vesicle endocytosis
  Coding regions on vcDNA: vcDNA=SeqID_93857; Strand=+; Position=1-752
RERSKTYKQDEVQIHCPXEYEASVDKEGNVSNQRARVRLFCLAFLSGTSFLEIGLNDRRREGKEVVRRKDILPMYTERWIRFEAPELHETVDKVVWEEDQVLRINPPDGCFFEVMRFRVRPPRNRDRPLNVRCLMRMAGSHIELRIDAMAVAHQQRARGTAASTRAVPCEDIVVRFPLPEAWIYLFREQRPWGVGSVHSKQRKPGKVKNLRDKLMGTVQHNEPSLIEVGIGEAKYEHLYRSLVWRIPRLPE

SEQ ID NO: 167435 - protein, 225 aa, Heterodera glycines
  Homolog annotation: Hit_ID=CAE73243.1; Match level="QueryCoverage =87%, HitCoverage=15%, E-value=9e-35, Identity=36%"; Hit description =Hypothetical protein CBG20655 [Caenorhabditis briggsae]
  Coding regions on vcDNA: vcDNA=SeqID_93858; Strand=+; Position=12-686
SGAYGCERNAGTLRVMGTVAQFRDRDNCPVAESIDRLFVVALRSVGMESLLSAVPLNVDVDAPVLPRDFRRSWLPPILARHAQGDSLDFFARSLFPLAERLHQRLHQLPELPQKLYTTLEHQIWAILPRLMANAPRDFHVAMPTLAPIMGAALNDRPDLRLTILRALREALKFETQNDGICMMERYARNFLPILFGIYTASAANTDKAAQKGDENGDIGKGRRAD

SEQ ID NO: 167436 - protein, 76 aa, Heterodera glycines
  Coding regions on vcDNA: vcDNA=SeqID_93859; Strand=-; Position=2-229
ELKFNYFINEFIKKNIFILQSPEHHKLCNWGYMLHNERSMRLSSKTDIWAFGIIAYETAEFGLNFGPKLEGGEEGK

SEQ ID NO: 167437 - protein, 161 aa, Heterodera glycines
  Homolog annotation: Hit_ID=NP_003581.1; Match level="QueryCoverage =95%, HitCoverage=18%, E-value=5e-35, Identity=50%"; Hit description =cullin 3 [Homo sapiens] gb|AAH39598.1| Cullin 3 [Homo sapiens] gb|AAC36304.1| cullin 3 [Homo sapiens] sp|
  Gene Ontology: Biological process=induction of apoptosis by intracellular signals
  Coding regions on vcDNA: vcDNA=SeqID_93860; Strand=+; Position=3-485
ILQAERYLDKITETTFKDVLNEELITKNMTTIVEMDNSGLFYMLLNDRIDDLRCLYELLKRVESGPKTMTNTMSRFLRAKGTAVVNDNTQQQPQGETVEPIGGVSNPIIFIQSLFVLKEQFDRFLLEAFNNDREFKQCIQSDFEHFLNISPKAPEYLSLYI

SEQ ID NO: 167438 - protein, 246 aa, Heterodera glycines
  Homolog annotation: Hit_ID=CAE67891.1; Match level="QueryCoverage =87%, HitCoverage=42%, E-value=6e-38, Identity=40%"; Hit description =Hypothetical protein CBG13487 [Caenorhabditis briggsae]
  Gene Ontology: Mol. function=N-acetylglucosamine kinase activity; Cellular component=soluble fraction; Biological process=N -acetylglucosamine metabolism
  Coding regions on vcDNA: vcDNA=SeqID_93861; Strand=+; Position=3-740
FPFQEDEGTNKRLMAYMKAQHGDLAHNFLLTSDSIAAAATSSDKGGIVLIAGTGSACRLLKENGEVFGVGGWGHLIGDGGGGFWITMRAIKRIFDVEDGLLWSSDTDNEKTLAFVDSFKKTLLEHFAVDSKLGLLDILYSPKFNKSRIAAFCKELAEVATGGDAFAVELFSDAGKALAQHLVAISRHCDDKMLRELPVLLVGSVFKSWHFMRLGFERCIKESNGAVTDLNRRINRVMLFQLECSAS

SEQ ID NO: 167439 - protein, 50 aa, Heterodera glycines
  Coding regions on vcDNA: vcDNA=SeqID_93862; Strand=-; Position=555-707
LLFKYAKNFRLNFFFINWSEANQILREHQKDKEKHCNDANSSNSEFKIFY

SEQ ID NO: 167440 - protein, 161 aa, Heterodera glycines
  Coding regions on vcDNA: vcDNA=SeqID_93863; Strand=+; Position=3-485
RASKSKSSTETPLSQTFGKSDDKTTAENSGNRAKSNSESRVKTTASQPIYLFGVEECILEARRVLKNVGENEKNAAGGGHKELKHQRLECPRHGIVRWDRNNRQTEEYVASAPSSSSLVVPDLSKMGPDLLFVDLEHEWAVPSVSIQRGKLVGRGAFGFVF

SEQ ID NO: 167441 - protein, 70 aa, Heterodera glycines
  Coding regions on vcDNA: vcDNA=SeqID_93864; Strand=+; Position=360-572
FISLQYIFWIVGGSGILCAFLLILIVTIFFAYCRQRDKNRKNQANMEHLRRNRDQRYTDFPARRYLKKLY

SEQ ID NO: 167442 - protein, 85 aa, Heterodera glycines
  Coding regions on vcDNA: vcDNA=SeqID_93865; Strand=+; Position=405-662
KKNFFKVITYQSLIPFLLPSSFCCCGSGVNCSRRIISSVSSSSHNHRSPRNSIPFRGRGRGRVRNRCQHELIRQLLFLQPALSEE

SEQ ID NO: 167443 - protein, 129 aa, Heterodera glycines
  Coding regions on vcDNA: vcDNA=SeqID_93866; Strand=+; Position=268-654
VVPFLIDFSSILFIFAFFSNSRLFPAIDGPPSADSHPPSVGTANGMATGRPGSVQQQFGTAASQVDTEEPEYKMLLKKLCKYHADVKRLLGRFELDTLPGVEMKIKASLVNVIQVMEGTRKGGCVFEGA

SEQ ID NO: 167444 - protein, 155 aa, Heterodera glycines
  Coding regions on vcDNA: vcDNA=SeqID_93867; Strand=-; Position=23-490
MEVAAVSNGNSANQLNFVLPPSSRCCLSLFFFRPLFPSLPVFSVFFSASAGAVFNLSFSFASGFPSRWYSCSSLSSFIVPIAPVSVPFICFTKVVSVRSSDALPPFRFWCLRLTPSALVGIGSDEIFITTTFCAASPTVCCCCCCLLRVRSMPMF

SEQ ID NO: 167445 - protein, 268 aa, Heterodera glycines
  Homolog annotation: Hit_ID=CAE67223.1; Match level="QueryCoverage =100%, HitCoverage=53%, E-value=1e-41, Identity=33%"; Hit description= Hypothetical protein CBG12661 [Caenorhabditis briggsae]
  Coding regions on vcDNA: vcDNA=SeqID_93868; Strand=+; Position=12-815
IDSLFADAYAFIAQGLCYDEVDDRDNACLMYERGLELGDKALQLDTERLSGLRNGLERVRGMVADRIDSIRSKAPHVDNRQAVENIRHSLVTVSDAIAGSTTDAELFYWLPDGVQLVVIEGDQTNAPTPPSSLAIFKLTKPEEAQKTEKASGATIEAKDAATLPLASSSPAAFIQVGPWAYPLEPGKTAILKNELGVYVMPNPSPDHPNMFVGIILPRGLAPGLESEFVYALKQFAVLNSSDIVDRMSEEQRERTSERIAQFLIRAGQ

SEQ ID NO: 167446 - protein, 133 aa, Heterodera glycines
  Homolog annotation: Hit_ID=NP_507525.1; Match level="QueryCoverage =100%, HitCoverage=13%, E-value=9e-49, Identity=69%"; Hit description= pre-mRNA splicing factor (109.2 kD) (5S521) [Caenorhabditis elegans] emb|CAC14407.3| Hypothetical protei
  Gene Ontology: Mol. function=pre-mRNA splicing factor activity; Cellular component=nucleus; Biological process=RNA processing
  Coding regions on vcDNA: vcDNA=SeqID_93869; Strand=+; Position=3-401
NPEKPQGWIASARLEEASGKLQAARNLVMEGLEKIEKSEDLWLEAIRLHPPNVGKNIVANAVRALPHSVKIWLKAADLEADLKGRKIVLLKALENNPSSVRLWKAAVDLQGPEDARSLLTRAVECCPLSTELW

SEQ ID NO: 167447 - protein, 252 aa, Heterodera glycines
  Homolog annotation: Hit_ID=CAE64947.1; Match level="QueryCoverage =98%, HitCoverage=25%, E-value=2e-41, Identity=40%"; Hit description =Hypothetical protein CBG09778 [Caenorhabditis briggsae]
  Coding regions on vcDNA: vcDNA=SeqID_93870; Strand=+; Position=2-757
WSVPLRKFVHLLFTSDLMIVIGFRDRVDLLSSLIVMAILAVGCLFALLFTLFQLHSETLHLAKLGSNVLSSNPDWLRDALNYTGGHLTEEDIDAYMEQAYQQGRTWLASNIRQLADPKDAARADRLEDQAKLLVDNLYHLWEERRIEDETYKDSLTTFGSTGESTAGNKRKRELSSSQSSNGNADGEGEKENDAGGEENDEEKRAWLYGLVRNANLAMWKTELTSMVSQNIEMVWTIAHSLWHFLLMNISLL

SEQ ID NO: 167448 - protein, 45 aa, Heterodera glycines
  Coding regions on vcDNA: vcDNA=SeqID_93871; Strand=-; Position=60-197
GRPAKCVKAKMTSAEANKTIYKWRAKTAPFSQRFNLKIGGKMIFD

SEQ ID NO: 167449 - protein, 162 aa, Heterodera glycines
  Coding regions on vcDNA: vcDNA=SeqID_93872; Strand=-; Position=186-674
FIANFHRTTVPLAVLTSSSLQHIVDIYPYSGNWSRGRVVVCLVGLVADQKFESTCLRLIYCEFSPDYRTPRSGDVIIFAAYSGHLSLFWQLVSWQSGSVFGLVADQKFESTCLRLIYCEFSPDYRTPRSGDVIIFAAYSGHLSLFWQLVSWQSGSVFGLVAE

SEQ ID NO: 167450 - protein, 157 aa, Heterodera glycines
  Homolog annotation: Hit_ID=NP_505680.2; Match level="QueryCoverage =100%, HitCoverage=30%, E-value=8e-25, Identity=39%"; Hit description= amino acid/polyamine transporter, family II (57.3 kD) (5K912) [Caenorhabditis elegans] emb|CAD54163.1| H
  Coding regions on vcDNA: vcDNA=SeqID_93873; Strand=-; Position=2-472
QERGEVVSVPHDFGWKRVVLRSSVMAAIGLTSESVPSFGPALDFFGGSTVALTSVVFPSVFYLYLAAGECKSQESEHFGNNEPAPFIEMVERANWKTLLLCGAIIVLSTFAGIIAPIFALKALTTTPFVTPCYVPFLFPDDEKGSALSSTNCCGPFQ

SEQ ID NO: 167451 - protein, 45 aa, Heterodera glycines
  Coding regions on vcDNA: vcDNA=SeqID_93874; Strand=+; Position=155-289
KPPKIIFKNRHFLIFWTKINKNIHVAQRTRTNTLCPLTILQKPLS

SEQ ID NO: 167452 - protein, 43 aa, Heterodera glycines
  Coding regions on vcDNA: vcDNA=SeqID_93875; Strand=+; Position=176-307
SVSEKKVKPKLFGLFKKELKIFKNFIHLPFDRKSIREPYLTFN

SEQ ID NO: 167453 - protein, 87 aa, Heterodera glycines
  Coding regions on vcDNA: vcDNA=SeqID_93876; Strand=-; Position=384-647
ATSKGCTPPIGMGPRAATSKGCTPPIGMGSCGIFKGMRPSHRHGFVRGGNIKGLRPSHRHGFVRETPVRNRALLVLYTTPNLNHRLS

SEQ ID NO: 167454 - protein, 231 aa, Heterodera glycines
  misc_feature (3)..(3): Xaa can be any naturally occurring amino acid
  misc_feature (6)..(7): Xaa can be any naturally occurring amino acid
  misc_feature (10)..(10): Xaa can be any naturally occurring amino acid
  misc_feature (13)..(14): Xaa can be any naturally occurring amino acid
  misc_feature (16)..(17): Xaa can be any naturally occurring amino acid
  misc_feature (20)..(21): Xaa can be any naturally occurring amino acid
  misc_feature (27)..(28): Xaa can be any naturally occurring amino acid
  misc_feature (31)..(31): Xaa can be any naturally occurring amino acid
  misc_feature (36)..(38): Xaa can be any naturally occurring amino acid
  misc_feature (43)..(43): Xaa can be any naturally occurring amino acid
  misc_feature (45)..(46): Xaa can be any naturally occurring amino acid
  misc_feature (48)..(48): Xaa can be any naturally occurring amino acid
  misc_feature (50)..(50): Xaa can be any naturally occurring amino acid
  misc_feature (54)..(55): Xaa can be any naturally occurring amino acid
  misc_feature (60)..(60): Xaa can be any naturally occurring amino acid
  misc_feature (63)..(63): Xaa can be any naturally occurring amino acid
  misc_feature (65)..(65): Xaa can be any naturally occurring amino acid
  misc_feature (70)..(70): Xaa can be any naturally occurring amino acid
  misc_feature (72)..(74): Xaa can be any naturally occurring amino acid
  misc_feature (80)..(80): Xaa can be any naturally occurring amino acid
  misc_feature (82)..(82): Xaa can be any naturally occurring amino acid
  misc_feature (87)..(88): Xaa can be any naturally occurring amino acid
  misc_feature (90)..(90): Xaa can be any naturally occurring amino acid
  misc_feature (97)..(100): Xaa can be any naturally occurring amino acid
  misc_feature (103)..(103): Xaa can be any naturally occurring amino acid
  misc_feature (106)..(108): Xaa can be any naturally occurring amino acid
  misc_feature (110)..(112): Xaa can be any naturally occurring amino acid
  misc_feature (115)..(115): Xaa can be any naturally occurring amino acid
  misc_feature (117)..(117): Xaa can be any naturally occurring amino acid
  misc_feature (128)..(128): Xaa can be any naturally occurring amino acid
  misc_feature (137)..(137): Xaa can be any naturally occurring amino acid
  misc_feature (139)..(139): Xaa can be any naturally occurring amino acid
  misc_feature (141)..(141): Xaa can be any naturally occurring amino acid
  misc_feature (144)..(144): Xaa can be any naturally occurring amino acid
  misc_feature (150)..(150): Xaa can be any naturally occurring amino acid
  misc_feature (153)..(153): Xaa can be any naturally occurring amino acid
  misc_feature (156)..(156): Xaa can be any naturally occurring amino acid
  misc_feature (159)..(161): Xaa can be any naturally occurring amino acid
  misc_feature (166)..(166): Xaa can be any naturally occurring amino acid
  misc_feature (168)..(168): Xaa can be any naturally occurring amino acid
  misc_feature (172)..(172): Xaa can be any naturally occurring amino acid
  misc_feature (178)..(179): Xaa can be any naturally occurring amino acid
  misc_feature (181)..(181): Xaa can be any naturally occurring amino acid
  misc_feature (183)..(183): Xaa can be any naturally occurring amino acid
  misc_feature (186)..(187): Xaa can be any naturally occurring amino acid
  misc_feature (189)..(189): Xaa can be any naturally occurring amino acid
  misc_feature (191)..(191): Xaa can be any naturally occurring amino acid
  misc_feature (202)..(203): Xaa can be any naturally occurring amino acid
  misc_feature (207)..(207): Xaa can be any naturally occurring amino acid
  misc_feature (215)..(215): Xaa can be any naturally occurring amino acid
  misc_feature (223)..(225): Xaa can be any naturally occurring amino acid
  misc_feature (228)..(228): Xaa can be any naturally occurring amino acid
  Homolog annotation: Hit_ID=NP_998658.1; Match level="QueryCoverage =90%, HitCoverage=51%, E-value=2e-33, Identity=38%"; Hit description =DnaJ subfamily A member 2 [Danio rerio] gb|AAH68384.1| DnaJ subfamily A member 2 [Danio rerio] gb|AAH4804
  Gene Ontology: Mol. function=heat shock protein activity; Cellular component=cytosol; Biological process=G1 phase of mitotic cell cycle
  Coding regions on vcDNA: vcDNA=SeqID_93877; Strand=+; Position=1-693
GNXEDXXEMXNGXXMXXFMXXGGGLFXXMFXGGREXXXKGEKXVXXLXVXLEEXXKGKNXKLXLXKKVVXKXXXGIGGKXGXVWKCXXCXGSGKVFXXXXIGXGMXXXMXXXCDXWXGEGEMVDEKEXCKKCVGRKXVXEXKIXEVKIIXGMXDNXKIXXXGEGEXEXGIEXGEVVLXXKXKXKEXXEXKXEDFFMKKKVSXXEGVXGFIKTIKXFEGRKITXXXMAXDII

SEQ ID NO: 167455 - protein, 128 aa, Heterodera glycines
  Homolog annotation: Hit_ID=CAE67485.1; Match level="QueryCoverage =89%, HitCoverage=34%, E-value=6e-43, Identity=74%"; Hit description =Hypothetical protein CBG12990 [Caenorhabditis briggsae]
  Gene Ontology: Mol. function=structural constituent of cuticle; Cellular component=extracellular; Biological process=positive regulation of body size
  Coding regions on vcDNA: vcDNA=SeqID_93878; Strand=+; Position=103-486
MDSQQCPMKETDEHRQMRRIAFVAVVVSTVAVIASVVTLPMLYNYVQSFQSHLMVETDYCKARARDMWLEMTALQIGKGHVNRIKRGWLFGQWVPESGADAYAAGGGPSGGAPSGGAPSSASAPVGAV

SEQ ID NO: 167456 - protein, 185 aa, Heterodera glycines
  misc_feature (2)..(2): Xaa can be any naturally occurring amino acid
  misc_feature (4)..(5): Xaa can be any naturally occurring amino acid
  misc_feature (8)..(9): Xaa can be any naturally occurring amino acid
  misc_feature (12)..(12): Xaa can be any naturally occurring amino acid
  misc_feature (14)..(14): Xaa can be any naturally occurring amino acid
  misc_feature (16)..(16): Xaa can be any naturally occurring amino acid
  misc_feature (18)..(20): Xaa can be any naturally occurring amino acid
  misc_feature (23)..(23): Xaa can be any naturally occurring amino acid
  misc_feature (25)..(26): Xaa can be any naturally occurring amino acid
  misc_feature (28)..(30): Xaa can be any naturally occurring amino acid
  misc_feature (32)..(33): Xaa can be any naturally occurring amino acid
  misc_feature (36)..(36): Xaa can be any naturally occurring amino acid
  misc_feature (40)..(40): Xaa can be any naturally occurring amino acid
  misc_feature (43)..(44): Xaa can be any naturally occurring amino acid
  misc_feature (47)..(47): Xaa can be any naturally occurring amino acid
  misc_feature (50)..(51): Xaa can be any naturally occurring amino acid
  misc_feature (56)..(58): Xaa can be any naturally occurring amino acid
  misc_feature (60)..(60): Xaa can be any naturally occurring amino acid
  misc_feature (62)..(63): Xaa can be any naturally occurring amino acid
  misc_feature (65)..(66): Xaa can be any naturally occurring amino acid
  misc_feature (68)..(68): Xaa can be any naturally occurring amino acid
  misc_feature (71)..(72): Xaa can be any naturally occurring amino acid
  misc_feature (74)..(74): Xaa can be any naturally occurring amino acid
  misc_feature (77)..(78): Xaa can be any naturally occurring amino acid
  misc_feature (81)..(83): Xaa can be any naturally occurring amino acid
  misc_feature (86)..(87): Xaa can be any naturally occurring amino acid
  misc_feature (91)..(91): Xaa can be any naturally occurring amino acid
  misc_feature (93)..(94): Xaa can be any naturally occurring amino acid
  misc_feature (96)..(99): Xaa can be any naturally occurring amino acid
  misc_feature (101)..(101): Xaa can be any naturally occurring amino acid
  misc_feature (103)..(103): Xaa can be any naturally occurring amino acid
  misc_feature (105)..(105): Xaa can be any naturally occurring amino acid
  misc_feature (107)..(108): Xaa can be any naturally occurring amino acid
  misc_feature (110)..(113): Xaa can be any naturally occurring amino acid
  misc_feature (115)..(115): Xaa can be any naturally occurring amino acid
  misc_feature (118)..(118): Xaa can be any naturally occurring amino acid
  misc_feature (123)..(123): Xaa can be any naturally occurring amino acid
  misc_feature (127)..(132): Xaa can be any naturally occurring amino acid
  misc_feature (135)..(138): Xaa can be any naturally occurring amino acid
  misc_feature (140)..(144): Xaa can be any naturally occurring amino acid
  misc_feature (146)..(146): Xaa can be any naturally occurring amino acid
  misc_feature (153)..(153): Xaa can be any naturally occurring amino acid
  misc_feature (156)..(156): Xaa can be any naturally occurring amino acid
  misc_feature (158)..(158): Xaa can be any naturally occurring amino acid
  misc_feature (160)..(160): Xaa can be any naturally occurring amino acid
  misc_feature (162)..(162): Xaa can be any naturally occurring amino acid
  misc_feature (164)..(164): Xaa can be any naturally occurring amino acid
  misc_feature (167)..(167): Xaa can be any naturally occurring amino acid
  misc_feature (169)..(169): Xaa can be any naturally occurring amino acid
  misc_feature (172)..(173): Xaa can be any naturally occurring amino acid
  misc_feature (178)..(178): Xaa can be any naturally occurring amino acid
  Homolog annotation: Hit_ID=NP_493380.1; Match level="QueryCoverage =96%, HitCoverage=32%, E-value=3e-19, Identity=31%"; Hit description =isomerase (61.1 kD) (1O173) [Caenorhabditis elegans] emb|CAB60430.1| Hypothetical protein Y87G2A.8a [Caen
  Gene Ontology: Mol. function=glucose-6-phosphate isomerase activity; Cellular component=cytosol; Biological process=neurogenesis
  Coding regions on vcDNA: vcDNA=SeqID_93879; Strand=+; Position=2-556
EXWXXKMXXGEXIXFXEXXXVVXVXXRXXXMXXIFXNNNXVMXXVMXVVXXMKMFXXXLXSXXWXXWXGEXXKXVVXXGIXXXDLXXLMVXEXXKXXXXGXNXDXVXXIXXXXLXQVXKKVEXKIVXXXXXXKKXXXXEXXXXXEXGREWFLXEGXEXGXVXKXFVXVXTNXXKVEDXGIEKKNM

SEQ ID NO: 167457 - protein, 112 aa, Heterodera glycines
  Coding regions on vcDNA: vcDNA=SeqID_93880; Strand=-; Position=272-610
RRKAEMPMRMCWSAIKLNDQRGFSSFRFLFVSPLTPFVLRFTAPLPPHLAPLDVLVPPPISVPTWPSLTRANGAIPRLENVLLFEENTPSAILPKWHLLIQKTIYKGIGTNN

SEQ ID NO: 167458 - protein, 127 aa, Heterodera glycines
  Coding regions on vcDNA: vcDNA=SeqID_93881; Strand=+; Position=3-383
LPLYDPSSISLFSANALSVDDQSSSTIAEERPLSSESQLAAKKSIGTDQTEHGETDGRFSTYHRRKNMEVVHRRNLIERLDKLKASHEAFFTVPQLKAVSNNQLSLFLRRLLKSADIKQHISTELLE

SEQ ID NO: 167459 - protein, 195 aa, Heterodera glycines
  Coding regions on vcDNA: vcDNA=SeqID_93882; Strand=+; Position=15-602
MGPISRNNLTIVEAKSEIFDALDKVGRRKFVRRGFVSASLRNETNFVVRCAVENCFLLSDYEGLDVMVTRFDAERDEKRAEKANEWLKKCQENGTKNKTAERTMRQFIDQNYNIGKVSELLDNFEKQHFNLTNDALYRNIAILRDYGSIDRCGITVSSNDRPSDNHTANAAAMVDYYFAGSFWRACESYAIYFYT

SEQ ID NO: 167460 - protein, 112 aa, Heterodera glycines
  misc_feature (40)..(40): Xaa can be any naturally occurring amino acid
  Homolog annotation: Hit_ID=NP_496824.1; Match level="QueryCoverage =100%, HitCoverage=93%, E-value=7e-46, Identity=76%"; Hit description= NIMA-interacting 4 (13.3 kD) (2N693) [Caenorhabditis elegans] emb|CAB55116.1| Hypothetical protein Y48C3
  Gene Ontology: Cellular component=mitochondrial matrix; Biological process=protein folding
  Coding regions on vcDNA: vcDNA=SeqID_93883; Strand=+; Position=66-401
GGATDSGKKEQSKGAGTSVKVRHILCEKQSKVLEAIERLXAGEKFSEVAAKYSEDKARNGGDLGWMVRGSMVGPFREAAFALAKSSVDKPIYTDPPVKTKFGYHVIMVEGKK

SEQ ID NO: 167461 - protein, 44 aa, Heterodera glycines
  Homolog annotation: Hit_ID=NP_505678.1; Match level="QueryCoverage =93%, HitCoverage=12%, E-value=4e-12, Identity=73%"; Hit description =COLlagen structural gene (30.1 kD) (col-12) [Caenorhabditis elegans] emb|CAA98257.1| Hypothetical protein
  Gene Ontology: Mol. function=structural constituent of cuticle; Cellular component=extracellular; Biological process=cuticle biosynthesis (sensu Nematoda)
  Coding regions on vcDNA: vcDNA=SeqID_93884; Strand=+; Position=2-136
SSSDAGQPGEPGNPRGAGEPGQPGEKGEHGHCDHCPPPRTAPGY

SEQ ID NO: 167462 - protein, 42 aa, Heterodera glycines
  Coding regions on vcDNA: vcDNA=SeqID_93885; Strand=+; Position=49-177
KRKKAPAEEGKTAHELMIYVEIFSCLFGDFKFISFIYQCSEN

SEQ ID NO: 167463 - protein, 157 aa, Heterodera glycines
  Coding regions on vcDNA: vcDNA=SeqID_93886; Strand=+; Position=3-473
PSSPTNHLVALVTPPTSGFRQILQTKNIEFTLPFKTTEFVELGREDCPKDFLTNIGDESIGMDHDEWLRDLGISPRSKFKLKQSPSELDVSSASLLSNESKNDSSGLTNCKSSEDNSRGLSAVSSVESSKSAVLIRGAKNVEAFCRLLIGQPTLCST

SEQ ID NO: 167464 - protein, 125 aa, Heterodera glycines
  Homolog annotation: Hit_ID=AAR28027.1; Match level="QueryCoverage =89%, HitCoverage=55%, E-value=2e-09, Identity=36%"; Hit description =TBP1 [Arabidopsis thaliana] gb|AAK15570.1| putative TATA sequence -binding transcription initiation factor
  Coding regions on vcDNA: vcDNA=SeqID_93887; Strand=-; Position=36-413
QFLAIAQRGSNTEYNPRRFHAIIMRIRTTMGKTVAALVFQSARVVLTGVPHPSSVNKMAARVFRRIQHTQSITLCIHQLRVVNIVGVQTFPKRISVERLQNTLGGIYDPTIFPALRCKLSNGVKA

SEQ ID NO: 167465 - protein, 64 aa, Heterodera glycines
  Coding regions on vcDNA: vcDNA=SeqID_93888; Strand=+; Position=1-192
IHRFSLEARAHQLLAIARLHCYEFSNFYANCVPNLLSEFGRENGLGEQSRTKLEKALAHSLFKD

SEQ ID NO: 167466 - protein, 80 aa, Heterodera glycines
  Coding regions on vcDNA: vcDNA=SeqID_93889; Strand=-; Position=130-372
GTMNKSLLDKICFSKFFNQKKESKYLLLLNDYSSVIWCLIASNLSKSATSLLISFVVRPKNGIFPLPFLLGALAFHLLPF

SEQ ID NO: 167467 - protein, 47 aa, Heterodera glycines
  Coding regions on vcDNA: vcDNA=SeqID_93890; Strand=+; Position=65-205
SFPISPSICLFHAFVHVLNTDDAFHSLRIKFLINQILDLKKKKKKKK

SEQ ID NO: 167468 - protein, 77 aa, Heterodera glycines
  misc_feature (4)..(4): Xaa can be any naturally occurring amino acid
  misc_feature (13)..(13): Xaa can be any naturally occurring amino acid
  misc_feature (16)..(16): Xaa can be any naturally occurring amino acid
  misc_feature (18)..(21): Xaa can be any naturally occurring amino acid
  misc_feature (23)..(23): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(29): Xaa can be any naturally occurring amino acid
  misc_feature (35)..(35): Xaa can be any naturally occurring amino acid
  misc_feature (37)..(39): Xaa can be any naturally occurring amino acid
  misc_feature (48)..(48): Xaa can be any naturally occurring amino acid
  misc_feature (55)..(55): Xaa can be any naturally occurring amino acid
  misc_feature (59)..(60): Xaa can be any naturally occurring amino acid
  misc_feature (63)..(66): Xaa can be any naturally occurring amino acid
  misc_feature (69)..(70): Xaa can be any naturally occurring amino acid
  Homolog annotation: Hit_ID=CAD22154.1; Match level="QueryCoverage =100%, HitCoverage=50%, E-value=7e-17, Identity=50%"; Hit description= pherophorin-dz1 protein [Volvox carteri f. nagariensis]
  Gene Ontology: Mol. function=small GTPase regulatory/interacting protein activity; Cellular component=actin cytoskeleton; Biological process=response to pathogenic bacteria
  Coding regions on vcDNA: vcDNA=SeqID_93891; Strand=-; Position=1-231
PPAXPWPAPLPPXSLXPXXXXPXAXPXPXFAPPPXPXXXPPPPPLPPXRPSPPPXPPPXXSPXXXXPPXXPPPPPPP

SEQ ID NO: 167469 - protein, 253 aa, Heterodera glycines
  Coding regions on vcDNA: vcDNA=SeqID_93892; Strand=+; Position=3-761
PFSILRSPPQRHNRLYTDRMESIWRSADGKTIKFYGNVFASLDNWLLYGLNSMVATLLAKDVFELQRIVARLPFEQHRSLSASPTALIAQLTTNAAEFTQSGPNRELLFALAKLGQQLLLLRNLQMFVKAEKHSQLGTLQTAERTLRRLTNGENISTDENNPTMDLMVLNTDNALLDFVSKHQSLKSPTAQMFFLSVILYFSFVAKDLTTTTASQKGEKIDGVAVMEGAKLMLQHSLLWTHLSSDSTHLFVNA

SEQ ID NO: 167470 - protein, 179 aa, Heterodera glycines
  Coding regions on vcDNA: vcDNA=SeqID_93893; Strand=+; Position=105-644
MAFEYMQAFIVKAPAFFEFPFSIDVVDSLIKNFICYFRDKLVEMCNLCEEELYSLLMMQHDKTAHQQMADDGASLPWQTHHSHHHHYSPSSLSKKAVPNFANLHFKTFLELIATLYERETDQIVRCSREFTDPNCEGLYDFVFRNRAISAPSLKIAYLSMLTSLCKSAESADAFFNFFK

SEQ ID NO: 167471 - protein, 90 aa, Heterodera glycines
  misc_feature (16)..(16): Xaa can be any naturally occurring amino acid
  Homolog annotation: Hit_ID=NP_493694.2; Match level="QueryCoverage =90%, HitCoverage=26%, E-value=2e-27, Identity=74%"; Hit description =carrier (33.3 kD) (2A577) [Caenorhabditis elegans] gb|AAB37890.2| Hypothetical protein B0432.4 [Caenorhab
  Gene Ontology: Cellular component=mitochondrial membrane; Biological process=gametogenesis
  Coding regions on vcDNA: vcDNA=SeqID_93894; Strand=+; Position=2-273
FFISGLATTIASMPAXYIVKTRIQNMSVVDGRPEFSGVVDVVRRVLANEGIFALWKGFLPYYMRLGPHTVLTFILLEQMNALYKRLKYGA

SEQ ID NO: 167472 - protein, 42 aa, Heterodera glycines
  Homolog annotation: Hit_ID=NP_499454.1; Match level="QueryCoverage =100%, HitCoverage=20%, E-value=5e-13, Identity=83%"; Hit description= RAB family member (23.4 kD) (rab-35) [Caenorhabditis elegans] emb|CAB57899.1| Hypothetical protein Y47D3
  Gene Ontology: Mol. function=RAB small monomeric GTPase activity; Cellular component=Golgi apparatus; Biological process=signal transduction
  Coding regions on vcDNA: vcDNA=SeqID_93895; Strand=+; Position=2-127
DYDHLFKLLIIGDSGVGKSSLLLRYSDDTFISRYITTIGADF

SEQ ID NO: 167473 - protein, 123 aa, Heterodera glycines
  misc_feature (8)..(8): Xaa can be any naturally occurring amino acid
  misc_feature (71)..(71): Xaa can be any naturally occurring amino acid
  Coding regions on vcDNA: vcDNA=SeqID_93896; Strand=+; Position=3-371
DIDLGQPXPAPSAHEPDPTADPDPDPDPSIDEEAMVQADHALALQLAQEDQVEVDENDAVSFFSIAGPHTXVAIQGQQMECIGRPVGQQVDCAVQPAHFCRLDRFGRSHSFPARPIAGVNDRD

SEQ ID NO: 167474 - protein, 75 aa, Heterodera glycines
  misc_feature (24)..(24): Xaa can be any naturally occurring amino acid
  Homolog annotation: Hit_ID=NP_597632.1; Match level="QueryCoverage =100%, HitCoverage=23%, E-value=6e-14, Identity=54%"; Hit description= similarity to HYPOTHETICAL PROTEIN YGW1_yeast [Encephalitozoon cuniculi] emb|CAD26267.1| similarity to H
  Coding regions on vcDNA: vcDNA=SeqID_93897; Strand=+; Position=47-271
FIRWFEIDVPEAIGRMAIFTPGDXIGIGVTGGDDSTVLGHVLAPLNEKHSYGLPLDLLCVDQGLKSYRDRLILSM

SEQ ID NO: 167475 - protein, 216 aa, Heterodera glycines
  Homolog annotation: Hit_ID=NP_659425.1; Match level="QueryCoverage =92%, HitCoverage=93%, E-value=1e-32, Identity=37%"; Hit description =hypothetical protein MGC19780 [Homo sapiens] gb|AAH11706.1| Hypothetical protein MGC19780 [Homo sapiens]
  Gene Ontology: Cellular component=membrane; Biological process =protein modification
  Coding regions on vcDNA: vcDNA=SeqID_93898; Strand=+; Position=3-653
PFSSFLFEQFFPWLLSLIALFSIIIWLRSKTNRTLFVNHEKGRRLMAVLGSGGHTTEMLKLLAAQDDLFPGRLYVIAKSDNLSIVKVEEFERTHGNKFCVRIVPRAREVGQNLLSSLGSTVVAFFYSFKLVYQERADVVISNGPAIGLGICLSACLFDFLRLYRCRVVFVESICRVQKLSLTGWLIYYFRISHAFIVQWKNLQKKYPRSEYMGRLI

SEQ ID NO: 167476 - protein, 147 aa, Heterodera glycines
  Homolog annotation: Hit_ID=CAE70599.1; Match level="QueryCoverage =99%, HitCoverage=45%, E-value=5e-52, Identity=63%"; Hit description =Hypothetical protein CBG17273 [Caenorhabditis briggsae]
  Gene Ontology: Cellular component=integral to membrane; Biological process=erythrocyte differentiation
  Coding regions on vcDNA: vcDNA=SeqID_93899; Strand=+; Position=28-468
MLVKDALVRPDISKPRWDQSTFSGRARHFFTVVNPLNLLASNNQLENSRKIVTDYEKGKYSDNLSVDELWRAKHLYDSAFHPQTGEKLLLIGRMSAQVPANTIITGGMLSFYKSTPAVVGWQFINQTYNATVNYSNRSGDALSGAQL

SEQ ID NO: 167477 - protein, 159 aa, Heterodera glycines
  Homolog annotation: Hit_ID=NP_492746.1; Match level="QueryCoverage =72%, HitCoverage=24%, E-value=4e-20, Identity=43%"; Hit description =mothers against decapentaplegic homolog 6 like (1L81) [Caenorhabditis elegans]
  Coding regions on vcDNA: vcDNA=SeqID_93900; Strand=+; Position=1-477
VLLAWGRMVRWQHNDLVGDVVTLLGQFAVVGRLAGTVFDGQDVRTAWDVDNAASFALLRQPSDEVSETLDEVWLYNSSDQPLFMCVSRNVARAAAPPSDSALVPNIRRLSPGYCVRVHRICAPPAAVGSAADHAPPPLPSVASPFHRHQFVGNDLTLFS

SEQ ID NO: 167478 - protein, 110 aa, Heterodera glycines
  Coding regions on vcDNA: vcDNA=SeqID_93901; Strand=+; Position=3-335
SFQIRHEGPIKCHWAYVPFIQPDSATYICAENDAVREPGIRQQLVTLLREKKYESRMLLLLAKTYLMVQNRPTAAGCLKPPEFSKATSSRCCTLRWSTVLPTISSWPPTF

SEQ ID NO: 167479 - protein, 234 aa, Heterodera glycines
  Homolog annotation: Hit_ID=CAE59800.1; Match level="QueryCoverage =62%, HitCoverage=18%, E-value=2e-59, Identity=71%"; Hit description =Hypothetical protein CBG03262 [Caenorhabditis briggsae]
  Gene Ontology: Mol. function=chloride channel activity; Cellular component=integral to membrane; Biological process=transport
  Coding regions on vcDNA: vcDNA=SeqID_93902; Strand=+; Position=106-807
MFRTVELCAVVGVHGTERPRFAIVWSAAVQRDGTDAVEDVEAQDPADLDMGVAVDVAASATDNTWDTCAVEEPRQRIAETILGGGEECGICHSLEEASYYFPLKTMWRSFFCALVAGVILRFVNPFGSDQTSLFHVDYSMRWTFMELIPFAMLGIFGGVLGSLFIWANIKWCAYRKNSRWLGANPINEVLIVSAITGAISFFNPYTRKSASSLIKQLFDRCGPEDYTMDLCDYN

SEQ ID NO: 167480 - protein, 196 aa, Heterodera glycines
  Homolog annotation: Hit_ID=CAE67691.1; Match level="QueryCoverage =93%, HitCoverage=75%, E-value=1e-58, Identity=61%"; Hit description =Hypothetical protein CBG13259 [Caenorhabditis briggsae]
  Coding regions on vcDNA: vcDNA=SeqID_93903; Strand=+; Position=10-597
PQLLTRIRWALHHVDEDPRQADGKPVDEEEDREEVFVKPLITYYCHCGQMAMISDTAVARMPLRRRDGARVIDPKLTVAKTFCDQGETVYIRRREGLEQQYRKICRNCKVALFYQHPFNQHSVLFIFRDALLSAKEVGGLAGKSEEEKSRKVTLTKHVRNHGKVGSVTVSTIGEDEEEVEARELSESYSLNARIVE

SEQ ID NO: 167481 - protein, 270 aa, Heterodera glycines
  Homolog annotation: Hit_ID=NP_724868.2; Match level="QueryCoverage =89%, HitCoverage=54%, E-value=1e-61, Identity=45%"; Hit description =CG1407-PA, isoform A [Drosophila melanogaster] gb|AAM71050.2| CG1407- PA, isoform A [Drosophila melanogast
  Gene Ontology: Mol. function=cysteine-type endopeptidase activity; Cellular component=integral to membrane; Biological process=protein targeting
  Coding regions on vcDNA: vcDNA=SeqID_93904; Strand=+; Position=2-811
VRQAAFVVNFLFPLSLERRCLGNRCVRCFIATFRWVPVLFVWAIICWAYYVYVVIFCLGMVESIGLQIVFLFAFNTLIFLFLWSNTQTVISPVGRPPEIFNLPHQIRSELSAAVTETEFKAILERFVRERKIPMFSRSNDGAVRCCLKCSCVKPDRSHHCSVCGHCVLKFDHHCPWVNTCINFNNYKFFMLFLGYGSLLCFFGFFTILPFFISFWQHTDLSRAEVGRFLVFFLFFLAGLFGLSMGCLFGYNLFLISKNQSTIESFRPPFF

SEQ ID NO: 167482 - protein, 253 aa, Heterodera glycines
  Coding regions on vcDNA: vcDNA=SeqID_93905; Strand=+; Position=11-769
PPHANMSRPVFAHSPPTTKTNDDHGFISIASTWRSVRTESSAATVQTDPVALSSSACGPEPPVSIECQTTDDLAGSRPIGSAAAARSAELSVSTSRGKLFDVIELATFVQRVEGPLSEMLMENLQSSAFDDWPLVNPLASLSQDDDNAISNQVGLLALSDTLVADPQSTSPSSANGLSLVAADRSKSGSSLILAYAHPHDTANSPDSSSPWCTHTAHVSVILNSQKQRTAHWHVNACPTTLTTHPDLTNLVAV

SEQ ID NO: 167483 - protein, 248 aa, Heterodera glycines
  misc_feature (203)..(203): Xaa can be any naturally occurring amino acid
  Homolog annotation: Hit_ID=CAE75506.1; Match level="QueryCoverage =88%, HitCoverage=45%, E-value=9e-66, Identity=52%"; Hit description =Hypothetical protein CBG23516 [Caenorhabditis briggsae]
  Gene Ontology: Mol. function=GPI-anchor transamidase activity; Cellular component=extracellular space; Biological process =embryogenesis and morphogenesis
  Coding regions on vcDNA: vcDNA=SeqID_93906; Strand=+; Position=2-745
EEGAADQNIWDVLVAGSNGWSNYRHQADVCHAWHVLVDHGVSPDRIITMIYDDIAHNKRNPYPGKLFNNPTMKDVYEGVRIDYRGDEVTPANFKAILLGNEEAVEGKRVLKSTSNDRVFAFFSDHGAFGLVAFHYGDDYTENILTVMELTQTLRKMHAKRMYGQMTFYLEVCESGSMFYQKIAQQINVFAVTASNAFETSWGXYCDTPIVGLQYTCLGELFSVNWMEDSDIQLFLRNETIAETFNSAK

SEQ ID NO: 167484 - protein, 92 aa, Heterodera glycines
  Homolog annotation: Hit_ID=NP_850110.1; Match level="QueryCoverage =100%, HitCoverage=9%, E-value=3e-11, Identity=34%"; Hit description =argonaute protein, putative / AGO, putative [Arabidopsis thaliana]
  Coding regions on vcDNA: vcDNA=SeqID_93907; Strand=+; Position=50-325
MSALKMGCMDYDESYKPKFMFVVGTKRHFKKFFMVHDGTVVNLTPGSVINEKMVRPDIPEFFMQSHYPKKGTGKPVEYSVLVDEIGMTQDEL

SEQ ID NO: 167485 - protein, 82 aa, Heterodera glycines
  Coding regions on vcDNA: vcDNA=SeqID_93908; Strand=+; Position=2-250
DDVIYLEGQTFLIGSLGANYGGSGSALITPEGALAGILVGSDSKMTVNDALSEWLDSLHEQRHSKMVDIGAILISYRNMINN

SEQ ID NO: 167486 - protein, 128 aa, Heterodera glycines
  Coding regions on vcDNA: vcDNA=SeqID_93909; Strand=+; Position=79-465
EYFGDLWTFYLGTGTKNKFLGASGIDFLAIQLHKSENKMGEINLHKRDSNLWGQKQTPNAQPPHHRTTQNGANVYSIYWDRKKFGTSYLGTRTYFAENKTTFLKNPWVLYAPTKFHSETPRTPPDLPL

SEQ ID NO: 167487 - protein, 164 aa, Heterodera glycines
  Homolog annotation: Hit_ID=NP_508120.2; Match level="QueryCoverage =79%, HitCoverage=15%, E-value=1e-28, Identity=48%"; Hit description =metalloprotease family member (83.3 kD) (XB181) [Caenorhabditis elegans] gb|AAA83298.2| Nematode astacin
  Coding regions on vcDNA: vcDNA=SeqID_93910; Strand=+; Position=21-515
MPMPFSSSSSSDVPMPFSSSSPPPPPSSNECSLCLQWSEWNDCSQMCGGCGRKTRRRHCPSAVSCQREEKRICNRMACPEGTNFLFNNGEFHLLWKGCCVGLILNNSTAKGDGSSVRGECGPLENSENPFLRIISSLLSSHDGQKEKTKRNGGKSKSGEDKNGQ

SEQ ID NO: 167488 - protein, 206 aa, Heterodera glycines
  Coding regions on vcDNA: vcDNA=SeqID_93911; Strand=+; Position=8-628
TGSRIMSASPSAPDRSHGHHDLHRPGVDHQSAQFANPHIPPIDMLQAFCATDEKSRVWDPTFDSVLSHTANTGALAVDWTLLRELIKARMLHEVSGLHAQAEQQGQSLNRAEINAQLHVLGGFFNALTTAPFTVQRMCEIALTRQHTNVIKYLRQIERVVCVSSSVSDSDWIRNGTAGEDNDIVPIGLVASDANMATAEPIDTDMS

SEQ ID NO: 167489 - protein, 122 aa, Heterodera glycines
  Homolog annotation: Hit_ID=NP_495324.2; Match level="QueryCoverage =54%, HitCoverage=6%, E-value=1e-12, Identity=49%"; Hit description =human WeRNer syndrome related (118.5 kD) (wrn-1) [Caenorhabditis elegans] gb|AAA68410.2| Human wrn (werner
  Gene Ontology: Mol. function=3'-5' exonuclease activity; Cellular component=nucleus; Biological process=aging
  Coding regions on vcDNA: vcDNA=SeqID_93912; Strand=+; Position=103-468
MSFPVPSDDDFYDETTDYLYLTNDNANPTNCEQTLANEHSAVALSSAIPGNDENSSSPAVPSERSLELLKKYFGYSRFRPLQYEVIEAALSKRDQLVVMSTGYGKSVCYQLPSLIQNNLTLV

SEQ ID NO: 167490 - protein, 273 aa, Heterodera glycines
  Homolog annotation: Hit_ID=NP_510101.1; Match level="QueryCoverage =84%, HitCoverage=62%, E-value=2e-63, Identity=48%"; Hit description =neuropeptide receptor NPR1 family member (XN154) [Caenorhabditis elegans] pir||T19340 hypothetical protei
  Gene Ontology: Mol. function=neuropeptide receptor activity; Cellular component=integral to plasma membrane; Biological process=feeding behavior
  Coding regions on vcDNA: vcDNA=SeqID_93913; Strand=+; Position=2-820
MRQTDGQTLSPLPMTPEGASLEERLFLSNLSLADEFDVSMAFFNECVDMNHFLWEFQRDPTSRPITAAIFAVVYSLIVLVGVSGNICVLLSIGRTRSLQTVSNLFIFALSCSDIVVCCVSATFTPYTAFTKVWVFGVALCSLANFTAGTSLCFSIFVLAAISVDRFLLIRFPLNNQLRHNHALLIIPILCLFAMFVSFPMIFTQKLLRMEGYCGEFCVEDWGTNELYREIYGTLLLIVQFFVPLLIITICYIGISVRLNRNILLRRKKMGNSW

SEQ ID NO: 167491 - protein, 78 aa, Heterodera glycines
  Homolog annotation: Hit_ID=NP_598698.1; Match level="QueryCoverage =80%, HitCoverage=84%, E-value=2e-13, Identity=49%"; Hit description =RIKEN cDNA 6720456B07 [Mus musculus] gb|AAH10582.1| RIKEN cDNA 6720456B07 [Mus musculus] dbj|BAC25616.1|
  Coding regions on vcDNA: vcDNA=SeqID_93914; Strand=+; Position=2-238
SSKVPFIIHVHSTSLKEDWDNRELNSIISDNIRQISEFLSHFDETCKAKLATLNDTITSMERKVEFLESTVTRGETLN

SEQ ID NO: 167492 - protein, 89 aa, Heterodera glycines
  Coding regions on vcDNA: vcDNA=SeqID_93915; Strand=+; Position=25-291
CGGLCCRDFANAFLCPCDEISDSAFGGHWRWCGFEFANFIRSRSGGFHFRWASHLRPVFCSQCVQMASPSVLQIRVPPLMKCCGPQESG

SEQ ID NO: 167493 - protein, 157 aa, Heterodera glycines
  misc_feature (103)..(103): Xaa can be any naturally occurring amino acid
  Homolog annotation: Hit_ID=CAE57845.1; Match level="QueryCoverage =82%, HitCoverage=74%, E-value=9e-31, Identity=48%"; Hit description =Hypothetical protein CBG00875 [Caenorhabditis briggsae]
  Gene Ontology: Mol. function=zinc ion binding; Cellular component =ubiquitin ligase complex; Biological process=ubiquitin-dependent protein catabolism
  Coding regions on vcDNA: vcDNA=SeqID_93916; Strand=+; Position=1-471
SSSSAVSSASSVGSDNERINRRHKNLHSSSYVNQLYMNAAFGSGDESSSTETNAVDEKRKARVRGLLEQIPVDIYTEGAKGPAECAICMGDFEEGDSIRFLPXVHSYHLQCIDDWLLRSFTCPACMEPVDSALLSVFTGNTSTDLNALTGSASACNS

SEQ ID NO: 167494 - protein, 135 aa, Heterodera glycines
  Coding regions on vcDNA: vcDNA=SeqID_93917; Strand=+; Position=2-406
CSNLDPALINVLLDDVQLLTDSQTDNDTLLFPIVKAFRQLHAQLKEELSCVLSGQIGSEPKPFTLLSILEKQPKKKSDDKLEKEKEMPNSNGKEKALNECAESIEVISLKEQKASELNIDKMKTDVANTTRKNVL

SEQ ID NO: 167495 - protein, 95 aa, Heterodera glycines
  Homolog annotation: Hit_ID=NP_509859.1; Match level="QueryCoverage =90%, HitCoverage=60%, E-value=3e-19, Identity=49%"; Hit description =putative protein of ancient origin (XL738) [Caenorhabditis elegans] emb|CAA92002.1| Hypothetical protein
  Coding regions on vcDNA: vcDNA=SeqID_93918; Strand=+; Position=102-389
MTVLVVETVVQVFKNSVPEKFNLITVNGADLKFAGKSYVEDTWFPGMRWTSCVCSSCSSHIGWYFESQKDDFVGLVLDYLISSEYADTLTKVPFG

SEQ ID NO: 167496 - protein, 87 aa, Heterodera glycines
  Coding regions on vcDNA: vcDNA=SeqID_93919; Strand=+; Position=3-266
GEEQHQQHERVFSSVTDAVKLGFVDEWEPKEWEPTDNSLQSALACEPQFSERFTQNYEQWLEEEVYGQQTDWDSLLRNSRGLLDIYC

SEQ ID NO: 167497 - protein, 147 aa, Heterodera glycines
  Coding regions on vcDNA: vcDNA=SeqID_93920; Strand=+; Position=23-463
IPSSNRRTLFADGDLPQFLLRFSDERGRPNQRHRVFPKMCQSIVCHWHIHQKTAEGLAEDGLCRGKNTICRIGGLPKGPSTVFQRHKPKKQQQKCQRRRRAGRGNGKNAGTEQGRRSSSRTNDQNSLKIILLAHKIIRDGLIICILS

SEQ ID NO: 167498 - protein, 71 aa, Heterodera glycines
  misc_feature (7)..(7): Xaa can be any naturally occurring amino acid
  misc_feature (9)..(9): Xaa can be any naturally occurring amino acid
  misc_feature (15)..(15): Xaa can be any naturally occurring amino acid
  misc_feature (18)..(18): Xaa can be any naturally occurring amino acid
  Coding regions on vcDNA: vcDNA=SeqID_93921; Strand=-; Position=85-300
RPAPPGXGXKKKNPXLSXPSKEETSESCNDACHMFIAYAIRCNRRTERETGLQNRSYVTLSVKKPKKRRKL

SEQ ID NO: 167499 - protein, 76 aa, Heterodera glycines
  misc_feature (9)..(9): Xaa can be any naturally occurring amino acid
  Coding regions on vcDNA: vcDNA=SeqID_93922; Strand=-; Position=1-228
RRGPASAHXKPEMDEIQEFNEKLMKKFRLNTREKLAIPHQIQKPPKCFPLKLHFCLFLYAPRILGKILQRKAAKNR

SEQ ID NO: 167500 - protein, 139 aa, Heterodera glycines
  misc_feature (133)..(133): Xaa can be any naturally occurring amino acid
  Homolog annotation: Hit_ID=NP_608830.3; Match level="QueryCoverage =100%, HitCoverage=97%, E-value=8e-69, Identity=84%"; Hit description= CG3058-PA [Drosophila melanogaster] gb|AAF51017.2| CG3058-PA [Drosophila melanogaster] gb|EAL34050.1| GA
  Gene Ontology: Mol. function=pre-mRNA splicing factor activity; Cellular component=small nuclear ribonucleoprotein complex; Biological process=cell cycle
  Coding regions on vcDNA: vcDNA=SeqID_93923; Strand=+; Position=6-425
MLPHLHNGWQVDQAILAEEDRVVLIRFGHDWDPSCMRMDETLYKIANKVKNFAVIYLVDISEVPDFNKMYELYDPVTAMFFFRNKHIMFDLGTGNNNKINWPMHDGQELIDIIETVYRGEQKGRGLVISPKDXSTKYKY

SEQ ID NO: 167501 - protein, 141 aa, Heterodera glycines
  Homolog annotation: Hit_ID=AAL78214.1; Match level="QueryCoverage =99%, HitCoverage=70%, E-value=8e-10, Identity=27%"; Hit description =putative esophageal gland cell protein Hgg-20 [Heterodera glycines]
  Coding regions on vcDNA: vcDNA=SeqID_93924; Strand=+; Position=3-425
WVCNDVWMDILPSFDHAQLGLKMALLSPRFDALVDKHFDGKTQFTIWKAIKIRKDTDEMPKLFVEGKSEGFPLPDRPLPNKIIFTNHKHLQIQYIDHFVIEFLRSNQQIWDKGSSFSFIVCSADKNEDNKPIWSVFVREIW

SEQ ID NO: 167502 - protein, 74 aa, Heterodera glycines
  Coding regions on vcDNA: vcDNA=SeqID_93925; Strand=-; Position=1-222
FFFFLIFFQMRFSLPWGARVYNELRILHRIKWYFSLFSRAYFFTLFLCFSPLSYSEFAYLCPGGAEFGAGYWAI

SEQ ID NO: 167503 - protein, 24 aa, Heterodera glycines
  Coding regions on vcDNA: vcDNA=SeqID_93926; Strand=-; Position=70-144
FFFFFFFLTERTLLLIALNKLDGN

SEQ ID NO: 167504 - protein, 31 aa, Heterodera glycines
  Coding regions on vcDNA: vcDNA=SeqID_93927; Strand=-; Position=56-151
CLIVYSFKISLEQFFSFMCLRQAFLNIKIGK

SEQ ID NO: 167505 - protein, 171 aa, Heterodera glycines
  Coding regions on vcDNA: vcDNA=SeqID_93928; Strand=+; Position=1-513
ESISRSTRYVAYLLSLLREANETTSLRLSAFSALLSQQHIFDDDETDANGWLAPSRANATRRRKRTGKLVAQLVGIVSTFLDAQFELAYLSDVNDYVIRLREWSASCSESQLSAEGRADPTNAWSHCQAILFLNRIGMHLIDEKTSDELSAAIGRNGAEENEVQCPFEQLD

SEQ ID NO: 167506 - protein, 141 aa, Heterodera glycines
  Homolog annotation: Hit_ID=EAA77782.1; Match level="QueryCoverage =100%, HitCoverage=92%, E-value=2e-64, Identity=81%"; Hit description= hypothetical protein FG09733.1 [Gibberella zeae PH-1] ref|XP _389909.1| hypothetical protein FG09733.1 [Gi
  Gene Ontology: Mol. function=proteasome activator activity; Cellular component=proteasome core complex (sensu Eukarya); Biological process=protein catabolism
  Coding regions on vcDNA: vcDNA=SeqID_93929; Strand=+; Position=135-557
MSQSMRIVPGNNNPQTFTHTTHTSSAPSAPGIHDTLRHGVGVSPYDAKSSVPVSAHPLEARLKNWEATQESLRMETLRRSFGMAEPIRRGMELKIVRNGEWRPMALGGGLPSVHEDILKGRDDMITWEDIFTGDETRGLAG

SEQ ID NO: 167507 - protein, 159 aa, Heterodera glycines
  Homolog annotation: Hit_ID=AAO85552.1; Match level="QueryCoverage =97%, HitCoverage=40%, E-value=1e-46, Identity=58%"; Hit description =ubiquitin conjugating enzyme UBC-25 [Caenorhabditis elegans]
  Coding regions on vcDNA: vcDNA=SeqID_93930; Strand=+; Position=2-478
FIKEISTEGAATLTRFAGAQRQQHLSGNPTGSLTASDRLMKELKEIYRCQNYKNGVFTVELQNDNLYEWDVKLKKVDNDSLLAADMRQLAKPPHNQDHLLFHFTFANSFPFEPPFVRLVSPVVANGFVLSGGALCMELLTKQGWTSAYSVESLITQLGA

SEQ ID NO: 167508 - protein, 183 aa, Heterodera glycines
  Homolog annotation: Hit_ID=NP_497939.2; Match level="QueryCoverage =90%, HitCoverage=6%, E-value=8e-66, Identity=74%"; Hit description =Beige/BEACH domain and g-protein beta WD-40 repeat (3F688) [Caenorhabditis elegans] emb|CAA86337.2| Hypoth
  Gene Ontology: Mol. function=protein kinase A anchoring activity; Cellular component=integral to membrane; Biological process=eye photoreceptor cell development
  Coding regions on vcDNA: vcDNA=SeqID_93931; Strand=+; Position=114-662
MIYRDSLNNLMTSLATCDNLHARWNFHEIRAIFLRRYLHQYTALELFLASRTAIMFAFPDHETVKKVVAHLPRVGVCVKYGLPQNRRASLMTPKQLFKHSNMPQKWQQREISNFDYWMFLNTIAGRTYNDLNQYPVFPWVLNNYTSDRLDMGDVANFRDLSKPIVALSDSRRKHFQARDNKLT

SEQ ID NO: 167509 - protein, 230 aa, Heterodera glycines
  Homolog annotation: Hit_ID=CAE71449.1; Match level="QueryCoverage =95%, HitCoverage=56%, E-value=5e-39, Identity=37%"; Hit description =Hypothetical protein CBG18361 [Caenorhabditis briggsae]
  Gene Ontology: Biological process=tyrosine catabolism
  Coding regions on vcDNA: vcDNA=SeqID_93932; Strand=+; Position=61-750
MPSSAPEIPPVQCFHHIEFFVSNAKQASFWHCFHFDFRRFAQRQTENASEIAIRKGPIIFVFKCSISPDDSEGIGAEVGKRGDFVKDVSYEVDYLDAVLATLQENGLELLAPKQMTTDQNGCLFVAKIAGSAGSIAHTLIQNIDYRGLFMPGFRPIADFSLTSTLLPSISLLCLDHVVEAHPEQSLGNVVDWYQQTLQMRRFWSIDDKTVHTEFSALRALLVGNGGASGS

SEQ ID NO: 167510 - protein, 248 aa, Heterodera glycines
  Homolog annotation: Hit_ID=NP_497276.2; Match level="QueryCoverage =91%, HitCoverage=77%, E-value=3e-49, Identity=49%"; Hit description =RNA-binding protein S1 serine-rich domain like (rnp-4) [Caenorhabditis elegans] gb|AAK21429.2| Rnp (rrm r
  Gene Ontology: Mol. function=single-stranded DNA binding; Cellular component=nucleolus; Biological process=RNA splicing
  Coding regions on vcDNA: vcDNA=SeqID_93933; Strand=+; Position=51-794
MVERRKESPKRRRRSSSSSSSGSSSSTGSSSSGSSSSSSTTASRSPSPKKQRAAARPSARDDRTTRRSPRRSRSPHRVQPKTEKSTVSSRRSPSPRRRRPSPPSRGPRRRSRSPRHERAAPSPPPVKRERTPEPPPRRLCVRNLSRNITKAHMEEIFALFGALKSCELPMDRVHVHLPRGYGYVEYEKAEDAEKALKHMDGGQIDGLEIQCEMTFPFKGTGGGRGHSPVGINSMGIGIKRERSRSPAR

SEQ ID NO: 167511 - protein, 125 aa, Heterodera glycines
  misc_feature (45)..(45): Xaa can be any naturally occurring amino acid
  misc_feature (62)..(62): Xaa can be any naturally occurring amino acid
  Homolog annotation: Hit_ID=NP_503124.1; Match level="QueryCoverage =95%, HitCoverage=47%, E-value=2e-16, Identity=39%"; Hit description =translation Initiation Factor 4E eIF4E (ife-3) [Caenorhabditis elegans] gb|AAC17807.1| Initiation factor
  Coding regions on vcDNA: vcDNA=SeqID_93934; Strand=+; Position=2-379
LNNHIHHWSGLSWNMDYYLLMERIRPKREDQSDTQGDRRFAYVDXRNRQTKLDIYWHEMVMXNNEEHIYTGTDFLRGAAAHLLRKGDLPSQSDRKVNRNDTHKSIAYLLNAELSIPDTDHVQLHE

SEQ ID NO: 167512 - protein, 101 aa, Heterodera glycines
  misc_feature (54)..(54): Xaa can be any naturally occurring amino acid
  misc_feature (60)..(60): Xaa can be any naturally occurring amino acid
  misc_feature (67)..(67): Xaa can be any naturally occurring amino acid
  misc_feature (85)..(85): Xaa can be any naturally occurring amino acid
  Homolog annotation: Hit_ID=BAB33421.1; Match level="QueryCoverage =87%, HitCoverage=30%, E-value=2e-29, Identity=77%"; Hit description =putative senescence-associated protein [Pisum sativum]
  Coding regions on vcDNA: vcDNA=SeqID_93935; Strand=+; Position=84-385
KEHAQVNEQHIFPSSTDSDLEAFSRNPTHVSFAALAVQPTANTNDAIQRFLSYXVELLLXKIKFHQXGKTNLSHDGLNPAHVPYXWVNNPTLIEFCFNMIG

SEQ ID NO: 167513 - protein, 173 aa, Heterodera glycines
  misc_feature (7)..(7): Xaa can be any naturally occurring amino acid
  Coding regions on vcDNA: vcDNA=SeqID_93936; Strand=+; Position=2-523
IPSQGLXLEFLWEILLISLMNFLYPPSFMAFYRHHYSPPPFVPFVRSQYLMPLIRHYLHHLAVPFCPFINFSLCLPFVSSPYFIIHHRSSSFISSPLFRPFVPFTSICPFYSFFCPSRLTKCSAVHHHLFYDLFSLPSLFLLRSPRHCPIKNAVDFLSVRRSVARGEDKILFD

SEQ ID NO: 167514 - protein, 45 aa, Heterodera glycines
  Coding regions on vcDNA: vcDNA=SeqID_93937; Strand=-; Position=310-447
NFHNEQEFRFIFFVCSHHHHHHASAFVWRSLLLNKWLSRNGSNRQ

SEQ ID NO: 167515 - protein, 117 aa, Heterodera glycines
  Homolog annotation: Hit_ID=CAE73449.1; Match level="QueryCoverage =89%, HitCoverage=56%, E-value=5e-16, Identity=39%"; Hit description =Hypothetical protein CBG20898 [Caenorhabditis briggsae]
  Coding regions on vcDNA: vcDNA=SeqID_93938; Strand=+; Position=60-410
MSDPHLQLPIGRVKRICKLDPQMNTVSADAVKLLALAAEKYVALLGRCAGKWALANGRKTVQICDVEQCIQKDWLFAILEDALTDWPEDNAANREEGQSDGEEEEEENEKETRRGGI

SEQ ID NO: 167516 - protein, 159 aa, Heterodera glycines
  Homolog annotation: Hit_ID=NP_032863.1; Match level="QueryCoverage =92%, HitCoverage=34%, E-value=3e-36, Identity=51%"; Hit description =protein kinase C, alpha binding protein [Mus musculus] pir||A56486 perinuclear binding protein PICK1 - mo
  Gene Ontology: Mol. function=protein homooligomerization activity; Cellular component=presynaptic membrane; Biological process=protein kinase C activation
  Coding regions on vcDNA: vcDNA=SeqID_93939; Strand=+; Position=11-487
MLNPPQNVRLIPDVVDIEKDEKGQIGIAIGGGAPHCPCLYVVQIFENSPARKNGLLGIGDEIVAVNGKVLKGYEKNAVASMIRDVKGVVRISFNRLHLVADTDVVQTLDILLKKFKHRLVDSMDEATADALGFSRAILCNDVLAQLKTRMDQKQQFYGA

SEQ ID NO: 167517 - protein, 217 aa, Heterodera glycines
  misc_feature (124)..(124): Xaa can be any naturally occurring amino acid
  misc_feature (163)..(163): Xaa can be any naturally occurring amino acid
  Homolog annotation: Hit_ID=NP_492730.2; Match level="QueryCoverage =99%, HitCoverage=25%, E-value=4e-71, Identity=57%"; Hit description =FAD dependent oxidoreductase and glycine cleavage T protein (94.9 kD) (1L16) [Caenorhabditis elegans] emb
  Coding regions on vcDNA: vcDNA=SeqID_93940; Strand=+; Position=2-655
HDFPSFAFRTIHLGLVGPIRAISVSHWGELGWRLYIPNELELNAYEQLVDVGVEYSLRHCGYYALRHLRIEKFYGYWGQDIDSMTTSVECGRVFRVDYEKEFIGKEAMNRQLERRVSKRFVQLXVDGHDMDRDPWPHGDERIYRDGTLAGRTTTVAYGFTLEXQVRPGYVQNEQIGVTTDYLLRGSYEVEMAGKRFPSRIYLHSGLLPMIFVEDPQR

SEQ ID NO: 167518 - protein, 103 aa, Heterodera glycines
  Homolog annotation: Hit_ID=NP_508475.1; Match level="QueryCoverage =100%, HitCoverage=14%, E-value=4e-17, Identity=40%"; Hit description= putative protein, with 2 coiled coil-4 domains, of fungal and metazoan origin (XD302) [Caenorhabditis el
  Gene Ontology: Cellular component=mitochondrial inner membrane
  Coding regions on vcDNA: vcDNA=SeqID_93941; Strand=+; Position=3-314
GTLLRYVASWLQSLVTFELPGAYSADDRLDLNRYEPYELLARCRHFVQQKDLLNAVRVANLIRGESARIFSDWLNDAKAHLEVRLLVELLFAHAQATGIRTTY

SEQ ID NO: 167519 - protein, 227 aa, Heterodera glycines
  misc_feature (14)..(14): Xaa can be any naturally occurring amino acid
  Homolog annotation: Hit_ID=CAE67033.1; Match level="QueryCoverage =88%, HitCoverage=25%, E-value=8e-74, Identity=68%"; Hit description =Hypothetical protein CBG12435 [Caenorhabditis briggsae]
  Gene Ontology: Mol. function=DNA supercoiling activity; Cellular component=chromatin; Biological process=meiosis
  Coding regions on vcDNA: vcDNA=SeqID_93942; Strand=+; Position=3-685
ALISIKQRSKIVEXIYEAKSDCFAFLLSSKAGGCGLNLIGANRLVMFDPDWNPANDGQAMARVWRDGQKKACFVYRLLSRGSIEEKIFQRQAHKKALSSCVVDEETDVARHFSLDQLKTLFEFNANTASDTHDKLKCKRCFLGRELKDPPEEADTNSDLTQWHHSERDFGKVPDQMLKAVRDCAPDITFVFHQKSHDGETNRSNSPPADNGKGRRDGAEEEDRESEG

SEQ ID NO: 167520 - protein, 97 aa, Heterodera glycines
  Homolog annotation: Hit_ID=NP_497830.1; Match level="QueryCoverage =98%, HitCoverage=40%, E-value=9e-14, Identity=45%"; Hit description =RiNg Finger protein (24.9 kD) (rnf-5) [Caenorhabditis elegans] emb|CAA86745.1| Hypothetical protein C16C1
  Coding regions on vcDNA: vcDNA=SeqID_93943; Strand=+; Position=38-328
LDTAKEAAGSTRGQPSSRPSQYQRTDTRPNRQLRPECKTATSKDTATPPHGRGGGDSDPREKSRPRPPGPRTKETKQGPPRTVHGGGDNGGHGGGGA

SEQ ID NO: 167521 - protein, 272 aa, Heterodera glycines
  Homolog annotation: Hit_ID=AAM91337.1; Match level="QueryCoverage =99%, HitCoverage=43%, E-value=1e-92, Identity=61%"; Hit description =putative CCCH-type zinc finger protein [Arabidopsis thaliana] gb|AAM13015.1| putative CCCH-type zinc finge
  Coding regions on vcDNA: vcDNA=SeqID_93944; Strand=+; Position=3-818
ASRRATVLHCAVAGLSESSLEIVKLLLDAGADAECLDASGNKPVNLIAPAFDSLSKSRRKALEMFLRGGGERDELMSQEMELQMFSVPEKKEGSDNKKEYPVDISLPDINNGVYGTDEFRMYNFKVKPCSRAYSHDWTECPFVHPGENARRRDPRKYPYSCVPCPEFRKGTCQKGDSCEYAHGVFESWLHPPQYRTRLCKDETGCARKVCFFAHKPEELPPVYASTGSAMPSPKSYSARGLDMTAMSPLALNSTFLPMPTVSTPTHVSLWQK

SEQ ID NO: 167522 - protein, 242 aa, Heterodera glycines
  misc_feature (50)..(50): Xaa can be any naturally occurring amino acid
  misc_feature (200)..(200): Xaa can be any naturally occurring amino acid
  misc_feature (207)..(207): Xaa can be any naturally occurring amino acid
  Homolog annotation: Hit_ID=CAE64717.1; Match level="QueryCoverage =97%, HitCoverage=90%, E-value=2e-52, Identity=47%"; Hit description =Hypothetical protein CBG09503 [Caenorhabditis briggsae]
  Gene Ontology: Mol. function=electron transporter activity; Cellular component=mitochondrion; Biological process=carbohydrate metabolism
  Coding regions on vcDNA: vcDNA=SeqID_93945; Strand=+; Position=2-727
NPLKAIKGATNGIGLAIAERLSHLGSTLCVVSTTDEDYVKRAIDRIVSSXLKRSDLAGCTCHVTNSEDRCPLLKLTIQRIRSVHILVNNAGINPIFSDLLDLYESPWDKLFDENVNADFMMAKLFSPEIERICVGSIVFNSSICAYRSPQGIAAYGITKTALLGLTRDLAESLAPKWILVNAIAPGIINTKMIKSLWEGXTNGPVTXAIVTLMGRLGMPEECAALLAFFCSSDASYITGETV

SEQ ID NO: 167523 - protein, 162 aa, Heterodera glycines
  Coding regions on vcDNA: vcDNA=SeqID_93946; Strand=+; Position=1-486
ALKGIALGVTTLEHLIMRPDFGESRHGFLDQNREGIFSLIGYCFIYALSLMYARSSAKLTLRDKKLSPLNVAGELGFSLCCYCSQRVLEAHFGLSASRRLANLAYSFAMLTLFSTTCALFQLIQLVVPLPQDARRGGLVAAISRNALLHFLCANLMTGFVNL

SEQ ID NO: 167524 - protein, 61 aa, Heterodera glycines
  Coding regions on vcDNA: vcDNA=SeqID_93947; Strand=+; Position=196-381
LSPRTKPAGVLFSNSFKMSTLLYALINMSLYIVNNISDARVQAGGIHIDLENEKLICLIIP

SEQ ID NO: 167525 - protein, 80 aa, Heterodera glycines
  Coding regions on vcDNA: vcDNA=SeqID_93948; Strand=+; Position=336-578
MFEDPILPVFQCFVSSFDQIASPFVPPLGGPEFFRLFLLVPANLTYFISTISLFFCFAFSPISSKFAYYLNKHRGLCVHL

SEQ ID NO: 167526 - protein, 180 aa, Heterodera glycines
  Coding regions on vcDNA: vcDNA=SeqID_93949; Strand=+; Position=50-589
RSRGGRGRNAGQKLLAAAAHAAFPGGKNELLHTMSAIENDETKSRIWQQLKTKLHSTMVAFGSGSVQLPKLMDTFRHDWGSELTSYAVQLGFGCNDAAVYKMLLTMPDEIESGFISATGTFAFKVIPKAETSENLTKIDQSNQYQDEMRRIFARRRSSMSSGFHRSFPFNQSFHVRPPVR

SEQ ID NO: 167527 - protein, 135 aa, Heterodera glycines
  Coding regions on vcDNA: vcDNA=SeqID_93950; Strand=+; Position=3-410
SSTKSPSHFFYRNIFRGHPMGSHGKRRNVCVAKKMNKSLGTTKPKRCCSLHNNFWMDIFPFFDHAQLGLKLAMLSPRFNVLVDKHFDGKSELTIWKLIQIHNPRTAPKLSVLVNNRKLVPFPLPSKIHFKNLRIE

SEQ ID NO: 167528 - protein, 81 aa, Heterodera glycines
  Homolog annotation: Hit_ID=NP_491350.1; Match level="QueryCoverage =100%, HitCoverage=20%, E-value=1e-11, Identity=45%"; Hit description= GDP-mannose pyrophosphorylase (43.3 kD) (1E875) [Caenorhabditis elegans] gb|AAF60648.1| Hypothetical pro
  Coding regions on vcDNA: vcDNA=SeqID_93951; Strand=+; Position=2-244
SRFRAVSKKVGKALFLVAGGPLIEHHISQLCEELENLHEIFIVGLYPAEEFGKFMSDGEKKYRAGASRLIQENCPVGTGGG

SEQ ID NO: 167529 - protein, 85 aa, Heterodera glycines
  Homolog annotation: Hit_ID=CAE67664.1; Match level="QueryCoverage =61%, HitCoverage=50%, E-value=9e-09, Identity=42%"; Hit description =Hypothetical protein CBG13227 [Caenorhabditis briggsae]
  Coding regions on vcDNA: vcDNA=SeqID_93952; Strand=+; Position=3-260
LFVPFLPGCSSFYLAPPISPCVSSDIAKICGEPSVAHYFECCGDSGADCCLRLNTWSIVLVSLLAFCLVACLVLCLVKCICLCCC

SEQ ID NO: 167530 - protein, 104 aa, Heterodera glycines
  Homolog annotation: Hit_ID=CAE68238.1; Match level="QueryCoverage =95%, HitCoverage=37%, E-value=5e-25, Identity=53%"; Hit description =Hypothetical protein CBG13912 [Caenorhabditis briggsae]
  Coding regions on vcDNA: vcDNA=SeqID_93953; Strand=+; Position=30-344
MTERHVLYVLLSADLLDVLRWPLGAVFTQIAHAATACIWTFREDPEVAAYMTDMDNMHKVTLKVPDEKTLLEHAKRLADEGIGHRVWHEDGMAVCIAVKPMPKH

SEQ ID NO: 167531 - protein, 232 aa, Heterodera glycines
  misc_feature (108)..(108): Xaa can be any naturally occurring amino acid
  misc_feature (126)..(126): Xaa can be any naturally occurring amino acid
  Homolog annotation: Hit_ID=CAH10777.1; Match level="QueryCoverage =97%, HitCoverage=92%, E-value=6e-32, Identity=36%"; Hit description =hypothetical protein [Homo sapiens]
  Coding regions on vcDNA: vcDNA=SeqID_93954; Strand=+; Position=22-718
MDFENAKVLLGDAVNLDQKGATDQAIPKYLAGIDALLPCLNDFEGPKKDALRQQIERYMSRVETLRGRKMVKVEFMEQRRIVEDSIGHSYESIFAKCLDDKVTEVHVXYPWLANYHQVRSGGHHLXLVNLVKFCELLVRKCPNVRRILLQTTRPNGPSAQMDEALGQLGDSLRTKNIVLTVNYADNMHDREIRFNNGWVVKMGRGLDILQNVDKFSIGSHDYHLRAVQSNTD

SEQ ID NO: 167532 - protein, 69 aa, Heterodera glycines
  misc_feature (68)..(68): Xaa can be any naturally occurring amino acid
  Coding regions on vcDNA: vcDNA=SeqID_93955; Strand=-; Position=1-207
RGNRINVICFNCFINYFGFRFVFLWHLFTLEWVSCSTFQNQNISLGGRLTAHQRVLRHNNPLMFDHWXY

SEQ ID NO: 167533 - protein, 212 aa, Heterodera glycines
  Coding regions on vcDNA: vcDNA=SeqID_93956; Strand=-; Position=1-636
LEHFSQFEQCATCVLLRSLLLVNVALGTFHLLPPVFEFRLVFSRTRLQCGVLALQLAILPGMHSEFRFNSSQLVLQRQHALTVNVSHTQTLAQFGVEKFHVLLLGLLKSTETCQLFGELFPGPYHRFHVVRCAKRGQLNDRVGYFRHVRPQMRVQLHVPRLPYGNVDGGRRCEQCVDFVLICNNLIFDVFGSVGIIQRTECFNGINLIRSDS

SEQ ID NO: 167534 - protein, 214 aa, Heterodera glycines
  Homolog annotation: Hit_ID=XP_220207.2; Match level="QueryCoverage =61%, HitCoverage=7%, E-value=2e-10, Identity=38%"; Hit description =similar to splicing coactivator subunit SRm300; RNA binding protein; AT-rich element binding factor [Rattu
  Coding regions on vcDNA: vcDNA=SeqID_93957; Strand=+; Position=2-643
SPQRLSQISSSSSSSSSSSSFSSSHPSAIGEHNVDRSIDELEEFIVQQMATPAPYPTDGKSFYDTNECAAAASAVPLPRRFASLSDLSPSFSSSSSPSSSSSSSSSSLNCGTLGRRKSPAPQTPKPKRMAPGEWDYLRVYTAIKTDTDYKTLQVPAGVSTECVIRQLVLDKLRLSLRDLNLFHLFMEVRTPRMDGTEARKILELDRMARPLDLQ

SEQ ID NO: 167535 - protein, 147 aa, Heterodera glycines
  Homolog annotation: Hit_ID=CAE74230.1; Match level="QueryCoverage =95%, HitCoverage=47%, E-value=9e-22, Identity=41%"; Hit description =Hypothetical protein CBG21915 [Caenorhabditis briggsae]
  Coding regions on vcDNA: vcDNA=SeqID_93958; Strand=+; Position=83-523
ESRKRGICSRWLLDNPIRLGGVGHVVQIDEALIARRKYHRGHRVREIWLFGMYDVHTNIGVVRIVPDRSRATLLPIIEEFVVPGSIFYSDQWAAYMGGAIPAIPVIPPYVHHSVNHTIHFVDPLTGAHTNHVECFWKNLKMKFKAMS

SEQ ID NO: 167536 - protein, 104 aa, Heterodera glycines
  misc_feature (25)..(25): Xaa can be any naturally occurring amino acid
  misc_feature (69)..(69): Xaa can be any naturally occurring amino acid
  Homolog annotation: Hit_ID=XP_310190.1; Match level="QueryCoverage =90%, HitCoverage=26%, E-value=8e-34, Identity=70%"; Hit description =ENSANGP00000010898 [Anopheles gambiae]
  Gene Ontology: Mol. function=pre-mRNA splicing factor activity; Cellular component=snRNP U5; Biological process=mRNA splicing
  Coding regions on vcDNA: vcDNA=SeqID_93959; Strand=+; Position=5-316
MRLGLLPYKGGHSDTVTGLSLSPDXNHVLSNSMDCTARIWDIRPYASSQRCVKTLTGHQHNCEKNLLRXSWSPDGHRVSCGSSERFVYIWDGGCRNIDYKWGGH

SEQ ID NO: 167537 - protein, 72 aa, Heterodera glycines
  Coding regions on vcDNA: vcDNA=SeqID_93960; Strand=+; Position=2-220
SKVSDRLCFPCFFLLICQPLFCFTKYKANECPRGICMFPVSIKLDIFLAVLFDCTFLNVTCNILIVTLRLIN

SEQ ID NO: 167538 - protein, 145 aa, Heterodera glycines
  Coding regions on vcDNA: vcDNA=SeqID_93961; Strand=+; Position=3-437
SFDKLLLFDRQQTVGIDRSAYLREALRLPQSAAKVAVCRETGDVVGLCQARHLLGDRLGISLFYANSESIASALLRAVLLQFAGPDPSAKFDSFIYKTPSTNTESIRLFRQLGQNGPVERRLFYPQFSRYSLPFPGNRIFSIGDE

SEQ ID NO: 167539 - protein, 142 aa, Heterodera glycines
  misc_feature (14)..(14): Xaa can be any naturally occurring amino acid
  Homolog annotation: Hit_ID=NP_494974.2; Match level="QueryCoverage =95%, HitCoverage=18%, E-value=6e-63, Identity=82%"; Hit description =Adenosine/AMP deaminase (85.4 kD) (2F499) [Caenorhabditis elegans] gb|AAO21474.1| Hypothetical protein C3
  Gene Ontology: Mol. function=AMP deaminase activity; Biological process=purine nucleotide metabolism
  Coding regions on vcDNA: vcDNA=SeqID_93962; Strand=+; Position=2-431
VINLFYLAQIGIAXSPVSNNHLFLPYQRNPMPEFLMKGLNISLSTDDPLQFHITKEALMEEYSIAHQLWKLSSCDMCEMARNSVIQSGFEDRVKVYWLGPNYKEEGVLGNDVARTNVPDIRVSFRHEALVSELYNLFKALML

SEQ ID NO: 167540 - protein, 201 aa, Heterodera glycines
  misc_feature (90)..(90): Xaa can be any naturally occurring amino acid
  Homolog annotation: Hit_ID=NP_508627.3; Match level="QueryCoverage =96%, HitCoverage=41%, E-value=1e-88, Identity=74%"; Hit description =sensory AXon guidance SAX-1, ndr protein kinase family member (55.5 kD) (sax-1) [Caenorhabditis elegans]
  Gene Ontology: Mol. function=protein kinase activity; Cellular component=bud neck; Biological process=protein modification
  Coding regions on vcDNA: vcDNA=SeqID_93963; Strand=+; Position=9-609
GHIKLSDFGLCTLLRKIHRTELYRNWPSQLPTDFVSKPFESKRRAETWRKNRRAYAYSTVGTPDYIAPEVFQPNGYTKSCDWWSLGVIMXYPPFCSETPQETYRKVMNWQQILAFPPEIPISTEAKNTIKGFCCEVDKRLGNHSGIESIKQCPFFKRVDWQNIRLLPAPIRIEVKGIADTSNFDHFGDSDLALPGVKEVAS

SEQ ID NO: 167541 - protein, 76 aa, Heterodera glycines
  misc_feature (72)..(72): Xaa can be any naturally occurring amino acid
  Coding regions on vcDNA: vcDNA=SeqID_93964; Strand=+; Position=113-343
LFSPPLLLRLNLNFILGLNIVYTILFSFVPSLSIISPSSFPIFIVFFSAGASVYSRHRLFQFLITCIKYLIXKKNI

SEQ ID NO: 167542 - protein, 160 aa, Heterodera glycines
  misc_feature (125)..(125): Xaa can be any naturally occurring amino acid
  Homolog annotation: Hit_ID=NP_500248.1; Match level="QueryCoverage =100%, HitCoverage=55%, E-value=4e-20, Identity=34%"; Hit description= UBX domain containing protein (32.6 kD) (4D486) [Caenorhabditis elegans] gb|AAF60887.2| Hypothetical pro
  Coding regions on vcDNA: vcDNA=SeqID_93965; Strand=+; Position=2-481
PAELTMGAPGLVIDLRIEKKGTEYEQPKTRAFSGQGNELGTITPNVGGSADVVFVDAPPKLAAEETAKLVEQAQAELKEDDNLPTTQHQIQIPDTARTIVARLNQGHTVYQLRICIVTADASLGXRPLRLMTSYPTRPIDDEGLSVKDAGLLNATVLGKL

SEQ ID NO: 167543 - protein, 209 aa, Heterodera glycines
  Coding regions on vcDNA: vcDNA=SeqID_93966; Strand=+; Position=15-641
MPRLSLAVTLFATALLAALLLAPTAVNAHSRLLSPPTRFGGFCARRDEVCPPCGFRDKDHAKPENTVYARGQQVPMVWPRNNHAGGFVSFSIVPFNWKQTFEEFDANIFQFNCNESGCKSGYPEDLFGEDPKWMGENENHCSSNLEIPDYLPDGQYSVKWQWFAVGNWFGDYNRGHTDYYGCHDFTIRGGRPFNPASRPACPRFIPGDA

SEQ ID NO: 167544 - protein, 166 aa, Heterodera glycines
  misc_feature (124)..(124): Xaa can be any naturally occurring amino acid
  Homolog annotation: Hit_ID=XP_393544.1; Match level="QueryCoverage =87%, HitCoverage=96%, E-value=1e-52, Identity=67%"; Hit description =similar to putative MLC1 protein [Apis mellifera]
  Gene Ontology: Mol. function=structural constituent of muscle; Cellular component=muscle myosin; Biological process=muscle contraction
  Coding regions on vcDNA: vcDNA=SeqID_93967; Strand=+; Position=25-525
VNLLCKIFDLSDEDVAKVKFAFEIYDVDGIGAIDGTMLGALLRALNLNPTEGFIEKLGGTKKKGEKTISLEEFLPIYSQVKKDKDQGVYEDFIECLKLYDKAENGLMSYAELHHILLTLGEKLXEKEVDEIFKDCIDPEDDEGMIPYVPFLARVCEKPVPKSIIPE

SEQ ID NO: 167545 - protein, 118 aa, Heterodera glycines
  Coding regions on vcDNA: vcDNA=SeqID_93968; Strand=-; Position=2-355
FFFKKNFFFFFFFFENIIYDKTKSEKQNKRGEEIMPRAKPNRGKGTTHFGTLFFHPKYPRGHHFAEEVKPKEELVQAVRLLLRLLFASSIFSHFLFFPLSHPPRFLRSPPFPFSFLYC

SEQ ID NO: 167546 - protein, 253 aa, Heterodera glycines
  Homolog annotation: Hit_ID=NP_508377.1; Match level="QueryCoverage =92%, HitCoverage=40%, E-value=8e-28, Identity=31%"; Hit description =growth factor receptor (62.1 kD) (XC658) [Caenorhabditis elegans] gb|AAK39317.1| Hypothetical protein Y10
  Gene Ontology: Mol. function=protein binding; Cellular component =extracellular space; Biological process=protein amino acid phosphorylation
  Coding regions on vcDNA: vcDNA=SeqID_93969; Strand=+; Position=30-788
MFLFLPFCFVSLLFALMSKMTMASSNAPPELLPMEGQQSRIRIPLGTKMFKLKCPVKMDEDQSGDQSEEALIIKWSKDGAPLTGDDHFRVLSNAERDLRIRTPQVKDSGRYRCTAINEWGHRVVDFELEVFDPNGSVGAQKGALADGGSSLSEKVSAPKWRDPSTPRQTKIHLTPGAALHLQCPPSVGNPLPQVIWTREGVPVSLELTNPNAASFSLDKVPPTDSATYSCKVQNQLGSIQADFLVQVGSSTSQ

SEQ ID NO: 167547 - protein, 85 aa, Heterodera glycines
  misc_feature (30)..(30): Xaa can be any naturally occurring amino acid
  misc_feature (41)..(41): Xaa can be any naturally occurring amino acid
  Homolog annotation: Hit_ID=CAB88203.1; Match level="QueryCoverage =100%, HitCoverage=28%, E-value=9e-25, Identity=64%"; Hit description= putative cuticular collagen [Globodera pallida]
  Coding regions on vcDNA: vcDNA=SeqID_93970; Strand=+; Position=2-259
KTHIVIGIASVCPLLAIMDTIFTIPSLNSXMSQMNSILRDXPEAFPSNTYSAWTDLMDAQVALTPPPNPRDNPFNSIFRAIRQLP

SEQ ID NO: 167548 - protein, 82 aa, Heterodera glycines
  misc_feature (64)..(64): Xaa can be any naturally occurring amino acid
  misc_feature (66)..(66): Xaa can be any naturally occurring amino acid
  Homolog annotation: Hit_ID=CAB55572.1; Match level="QueryCoverage =100%, HitCoverage=34%, E-value=2e-21, Identity=54%"; Hit description= cytochrome oxidase subunit II [Globodera pallida]
  Gene Ontology: Mol. function=cytochrome c oxidase activity; Cellular component=mitochondrial inner membrane; Biological process =mitochondrial electron transport, cytochrome c to oxygen
  Coding regions on vcDNA: vcDNA=SeqID_93971; Strand=-; Position=3-248
FFFFFFFNFFFNLNLGFGLLEFWICFIPIFFLISQIIPSIFLLFFFNFSNTSSDLTIKVVGHQXYXSYEIGDKVGFFFDSFI

SEQ ID NO: 167549 - protein, 145 aa, Heterodera glycines
  Coding regions on vcDNA: vcDNA=SeqID_93972; Strand=-; Position=2-436
SAARPGSVPIDHSAIDGICSVSGVGPPAPLLPDRMLVAIVPLLPAPMAPFFVWAPANIGICVVVGAQVFRRVCQRPAPAPPLRGDNDGLRLQLAPDSDDSDLVVTAHPSRALATLNSPLGCCMCSPPSFSGLLLPLLLLLLFSNG

SEQ ID NO: 167550 - protein, 139 aa, Heterodera glycines
  Homolog annotation: Hit_ID=BAB13308.1; Match level="QueryCoverage =43%, HitCoverage=6%, E-value=6e-11, Identity=58%"; Hit description =vasa-related protein CnVAS2 [Hydra magnipapillata]
  Coding regions on vcDNA: vcDNA=SeqID_93973; Strand=+; Position=52-468
DLPIDYTTYVHRIGRTGRIKEGASTSFFDLAEDVELAKELVEGLQKQDQEVPDWLKLVAEGKMPLDESEAASGANSVPIAVRVPSETVPDTNSLPTFFTVPTDNVAATGANSVPLGTRVQDDGTPNGEAKDPAIQNNSA

SEQ ID NO: 167551 - protein, 218 aa, Heterodera glycines
  Homolog annotation: Hit_ID=AAM81354.1; Match level="QueryCoverage =84%, HitCoverage=35%, E-value=1e-70, Identity=70%"; Hit description =aldehyde dehydrogenase [Steinernema feltiae]
  Gene Ontology: Mol. function=aldehyde dehydrogenase (NAD+) activity; Biological process=aldehyde metabolism
  Coding regions on vcDNA: vcDNA=SeqID_93974; Strand=+; Position=60-713
MLFRASTSILLKNHRKSLLSAISTTMQANSSTASSAYLINQPKYAFLAELGIQQQNDGVFDGTWNASGTEVDSLCPATNTPIAKVRFGTAEDYERVIKASRAASAIWIEMPAPTRGEIVRQIGDSLRKNIDNLGKLVSLEMGKILSEGRGEVQEFVDIADYATGLSRMFSGRIMPSERKKHLLLEQWNPLGVVGVISAFNFPAAVYGWNAALALVCGN

SEQ ID NO: 167552 - protein, 99 aa, Heterodera glycines
  Coding regions on vcDNA: vcDNA=SeqID_93975; Strand=-; Position=4-303
RKTDNEQKSKRAANYGILIQTLRDGKQLNINKGYFGNVNDLQEKGIQKLHRKRGQSSGTIFSNSLIIRCRTILLFFPTTLQLSIPLKSSSSLICFRGGV

SEQ ID NO: 167553 - protein, 197 aa, Heterodera glycines
  Coding regions on vcDNA: vcDNA=SeqID_93976; Strand=+; Position=3-596
FHQVSHFIPPMFSIVLIQFFSSPFCSLFSPSFCPPPTGPSRDANTTRRKKQLIQTAVTSTIIVWTMITVSAFLLTRCQSPKMGTKVPKHHRQMRTERRTNGRIGTRRKSCADFLLNQKRGGNGTNHCSAERRRDGEDKRERDGGRSRDCNQRKSSSQSMTVKCNQPIYYWLITVAKRGFNYSADQQQETDQRTIQWF

SEQ ID NO: 167554 - protein, 155 aa, Heterodera glycines
  Homolog annotation: Hit_ID=CAE57906.1; Match level="QueryCoverage =78%, HitCoverage=94%, E-value=6e-21, Identity=37%"; Hit description =Hypothetical protein CBG00956 [Caenorhabditis briggsae]
  Coding regions on vcDNA: vcDNA=SeqID_93977; Strand=+; Position=17-484
MCRLWGRIRYCEGWDPVDQAQLALKSFSLKDVTAVFIQFDPLHGDSKSLREFWHRLTLPQVRATNPKMQVNVKMLSDGCRPQFVANLHDGRQVVFKTDGFQLPDLLMRLNRLLGLPAVGLRGEPDEALQQRIPEAKMEAHFRALAKKRKPIDFLS

SEQ ID NO: 167555 - protein, 70 aa, Heterodera glycines
  Homolog annotation: Hit_ID=XP_231287.2; Match level="QueryCoverage =87%, HitCoverage=3%, E-value=1e-11, Identity=52%"; Hit description =similar to MLL5 [Rattus norvegicus]
  Coding regions on vcDNA: vcDNA=SeqID_93978; Strand=-; Position=338-800
GSDARAVRKSCRPNAAVRHAISEGQIHIYWGATADIDKSNEVTIPFDSDYWDSCVPVSCACGFSKVIGNP

SEQ ID NO: 167556 - protein, 244 aa, Heterodera glycines
  misc_feature (16)..(16): Xaa can be any naturally occurring amino acid
  Homolog annotation: Hit_ID=NP_509396.1; Match level="QueryCoverage =99%, HitCoverage=32%, E-value=1e-44, Identity=37%"; Hit description =kinase Suppressor of activated Ras KSR-1, SUppressor of activated let-60 Ras SUR-3, KSR-1 protein kinase,
  Gene Ontology: Mol. function=protein serine/threonine kinase activity; Cellular component=intracellular; Biological process=RAS protein signal transduction
  Coding regions on vcDNA: vcDNA=SeqID_93979; Strand=+; Position=2-734
DPYERRSWNMFSIRRXAAWKDDTIPMGELKVISQIGIGRFGEVYEAYYYEPAVIKFFDMFHVDEQKRLETFKHDTACFQNVRHENLVFFRGFYTMELCRFGIVMELIGGHTLSHILHEEPTPHMNRSALEFNEIMEYAKQICQGMSYLHTKHILHKDLRSKNVFVNERRTVKITDFGVFNLKRLSFPARRDSFLVPSHWLSYAAPELVQILSHTFEPFQFTEACDVYSFGTIWVELLTNAFPFS

SEQ ID NO: 167557 - protein, 67 aa, Heterodera glycines
  Coding regions on vcDNA: vcDNA=SeqID_93980; Strand=-; Position=259-462
FFFFFFFFKLEFLLENQLNLCINSPNEKIRQKHLAIFVGTLVVFISDFFIFFNLSPVFGHFLAVLTN

SEQ ID NO: 167558 - protein, 148 aa, Heterodera glycines
  Homolog annotation: Hit_ID=AAB88376.1; Match level="QueryCoverage =80%, HitCoverage=63%, E-value=1e-09, Identity=40%"; Hit description =Fmrf-like peptide protein 13 [Caenorhabditis elegans] ref|NP _501255.1| FMRFamide-Like Peptide (17.7 kD) (f
  Coding regions on vcDNA: vcDNA=SeqID_93981; Strand=+; Position=8-454
KSQCFAVVRRFVLIKFFVRPPPPFLSLLSLLFLSLLSVNSHSYESSEMRIMEERGGKRMFYQPWSFMKRTPSVAKANDFQKRPEGRQFLLRWPSADHFGKRSTVVPLMRFGRRPAERAAPLIRFGKRAYIRTDAAPLIRFGRSSEERK

SEQ ID NO: 167559 - protein, 102 aa, Heterodera glycines
  Homolog annotation: Hit_ID=CAE74055.1; Match level="QueryCoverage =97%, HitCoverage=24%, E-value=2e-29, Identity=60%"; Hit description =Hypothetical protein CBG21707 [Caenorhabditis briggsae]
  Gene Ontology: Mol. function=ATPase activity; Cellular component=26S proteasome; Biological process=ATP-dependent proteolysis
  Coding regions on vcDNA: vcDNA=SeqID_93982; Strand=+; Position=49-357
RRPHYQFYSRAMRVRAYQQFLSPYKTVGLDVMAKCFGVSKEFIDKELFMFISLGALKCRIDTVKDVVEMGQADNKFYQYKKLLHDGDILLNRVQKLSRVINV

SEQ ID NO: 167560 - protein, 220 aa, Heterodera glycines
  Coding regions on vcDNA: vcDNA=SeqID_93983; Strand=+; Position=2-664
LLSAEYARIANSFGPLFEELSEKTGLNIPNLEILQKVTDAIVTRANLPAFLPLPQWASSDAYIDKIVQKRLELHEQLIDLFLDPLGGWHFDQLIGRMDDVVNNRTQQKAAFYSAHDTNILTLGRYLEISPINDSFFGYASFIAFELYQDSEEYFVEMKSHPQLNGTLSRLVIPHCAHPCPFSVFRTLRPRIPPANGCPAALAFLPTIVPFTGQFREYSSF

SEQ ID NO: 167561 - protein, 67 aa, Heterodera glycines
  Homolog annotation: Hit_ID=CAE70072.1; Match level="QueryCoverage =100%, HitCoverage=43%, E-value=4e-10, Identity=44%"; Hit description= Hypothetical protein CBG16512 [Caenorhabditis briggsae]
  Coding regions on vcDNA: vcDNA=SeqID_93984; Strand=+; Position=2-202
LQKELSEMRGNNSDAVRVLEVDESNLLHWSLMLYTDREPYNKGALRVNVDGPNEYTLNTPYVTFGTK

SEQ ID NO: 167562 - protein, 69 aa, Heterodera glycines
  Coding regions on vcDNA: vcDNA=SeqID_93985; Strand=-; Position=1-207
SKGWSTSCEDGWLAGAKVNKSTRPFPVPPSLPFFWLLSGKQVKMSVNNASSLLVVCTDFAVIWSLTSID

SEQ ID NO: 167563 - protein, 155 aa, Heterodera glycines
  misc_feature (54)..(54): Xaa can be any naturally occurring amino acid
  Homolog annotation: Hit_ID=CAE60497.1; Match level="QueryCoverage =98%, HitCoverage=83%, E-value=2e-37, Identity=51%"; Hit description =Hypothetical protein CBG04115 [Caenorhabditis briggsae]
  Gene Ontology: Cellular component=integral to membrane; Biological process=membrane organization and biogenesis
  Coding regions on vcDNA: vcDNA=SeqID_93986; Strand=+; Position=2-466
SAQPLNVLSDIDNKLHENNAFTYLLGEIETKTGLIRLHVFGALDDLYMLYLLFXRWGHLGCNITGFLYPAYISIKAIDSRQKEDDTQWLTYWVAFALLNVVEFFSNTIVYYFPFYWMMKCALLMWLNLPSTLSGPLLYTRIIRPFHLRLHKNIDS

SEQ ID NO: 167564 - protein, 227 aa, Heterodera glycines
  misc_feature (15)..(15): Xaa can be any naturally occurring amino acid
  Homolog annotation: Hit_ID=AAH09327.2; Match level="QueryCoverage =97%, HitCoverage=67%, E-value=4e-33, Identity=36%"; Hit description =NXN protein [Homo sapiens]
  Gene Ontology: Mol. function=thioredoxin reductase (NADPH) activity; Cellular component=nucleus
  Coding regions on vcDNA: vcDNA=SeqID_93987; Strand=+; Position=1-679
VLRTLMDDPVGTDFXPWKNIPLQQLFIGMEFLLNDQNGKTSKVAWDQLAKGVKRLFFCAKWCPPSKQMLGQLVEVYPKIKSDHPHFEIIFCSSDRSEESFNEHFSLMPWLAFPYGDEKLVQKIAKAYDICGIPSFILVDENFSLLTRNGRSVCLSDPHGYPWRRKALYELTEHTVHRLSEMPSLILFTEGSAEDIEFSCQILSPCAESVFTQQNESPQIAASLPAKL

SEQ ID NO: 167565 - protein, 147 aa, Heterodera glycines
  misc_feature (15)..(15): Xaa can be any naturally occurring amino acid
  Homolog annotation: Hit_ID=CAE62167.1; Match level="QueryCoverage =99%, HitCoverage=16%, E-value=3e-56, Identity=69%"; Hit description =Hypothetical protein CBG06214 [Caenorhabditis briggsae]
  Coding regions on vcDNA: vcDNA=SeqID_93988; Strand=+; Position=3-444
PFGRFADAHTLSLPXTIATRRNQDYQVQRMMSSYTATCFWLYGNNIQDGLLLQWVETAMGWEKFKFLFMQHFRINAEVERGLQDKDFDLLQYKIQCNDCSPPSSTFSGDRKITFKNILCPHLRYECGSTNVRFSVWRGLLELLQLFQ

SEQ ID NO: 167566 - protein, 114 aa, Heterodera glycines
  misc_feature (57)..(57): Xaa can be any naturally occurring amino acid
  Homolog annotation: Hit_ID=NP_728756.1; Match level="QueryCoverage =100%, HitCoverage=44%, E-value=1e-14, Identity=39%"; Hit description= CG1263-PB, isoform B [Drosophila melanogaster] ref|NP_524726.1| CG1263-PA, isoform A [Drosophila melanog
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_93989; Strand=+; Position=176-517
ELHKSTISINIHDKDGDRCVTAQVSVKYCTDTLHQHNDDLIHINLPSGAKKAVKSAXRGTADIVAPRGSIDQTMRKAGSAYHHSKDPRNPRLNTLGAHLNFANCPHSEENHNHL

SEQ ID NO: 167567 - protein, 151 aa, Heterodera glycines
  Homolog annotation: Hit_ID=CAE56730.1; Match level="QueryCoverage =67%, HitCoverage=48%, E-value=7e-46, Identity=85%"; Hit description =Hypothetical protein CBG24517 [Caenorhabditis briggsae]
  Gene Ontology: Cellular component=integral to plasma membrane; Biological process=ER to Golgi transport
  Coding regions on vcDNA: vcDNA=SeqID_93990; Strand=+; Position=10-465
KCPILFEFFPYSVRGFCFSLFLRLHELSIFTSLRLRKHVSLRKFRTRQCGAQLRVHLDIQVGEHAQDYEQVAAKDKLNELQLRVRQLLDQVEQITKEQNYQRYREERFRQTSESTNSRVLWWSVGQTIVLLLTGAWQMRHLKGFFEAKKLV

SEQ ID NO: 167568 - protein, 89 aa, Heterodera glycines
  Homolog annotation: Hit_ID=CAA74206.1; Match level="QueryCoverage =76%, HitCoverage=19%, E-value=9e-12, Identity=48%"; Hit description =serine proteinase [Heterodera glycines]
  Coding regions on vcDNA: vcDNA=SeqID_93991; Strand=+; Position=17-283
MVLLAFYSINSKLLIVSCQQSSNFSECGISDFEPQLANVSKMAIGTNHVYKGPEGGDEQAPPWIVRLIFGKSYLQRNNIGPRHILNGLH

SEQ ID NO: 167569 - protein, 41 aa, Heterodera glycines
  Coding regions on vcDNA: vcDNA=SeqID_93992; Strand=-; Position=2-124
RSNGKNSSAETHKNHWQTINQSSLSSMIVDGGGLVFRQHLR

SEQ ID NO: 167570 - protein, 65 aa, Heterodera glycines
  Coding regions on vcDNA: vcDNA=SeqID_93993; Strand=+; Position=1-195
VHSMQQQRQTLTHSNLRVATAIYRTALDVVQNISRILDSTANTATSQQQYNIVPGDCVVASVQTL

SEQ ID NO: 167571 - protein, 102 aa, Heterodera glycines
  Coding regions on vcDNA: vcDNA=SeqID_93994; Strand=+; Position=1-306
LILLMSLDKILKSDDQPYISPVINIRQFLADASAQMDRLRQYFDDIPSASAAADCSAVEQSTSSNASDPRKNFLKFVMDRGFSTEDAAKAIASGDGALAKMF

SEQ ID NO: 167572 - protein, 212 aa, Heterodera glycines
  Coding regions on vcDNA: vcDNA=SeqID_93995; Strand=+; Position=2-637
SVTLRRTDQPKHSHSFTGQLFAQFSQFLRMDTKTGGTENAAQFWLASSSDEVAPSSKKVIPPGTKVFFRWVNRTDVWASSAETHKKLLRHMQQNGRRDEARSDSNEHGMAPSPDGVDFFEPSLHSNADGLFFAVIVLLSLIGLVLVFLLGYFLVRFFQGGDDDENSLRREEKSPKHRHELRVVLVPKNGRRKSSLPSALIHPFGLGDKKHLI

SEQ ID NO: 167573 - protein, 99 aa, Heterodera glycines
  Coding regions on vcDNA: vcDNA=SeqID_93996; Strand=+; Position=14-313
VVVRSRVLTTVSRNVLPPCPPQAHSTWVSFSSSNRVWMQVAQGSEVMSMPRKHPDLTRPLQHYFFGFQLFINRRKQQVVEGFFPRFERVFCPYKTTPRN

SEQ ID NO: 167574 - protein, 225 aa, Heterodera glycines
  Homolog annotation: Hit_ID=CAE62667.1; Match level="QueryCoverage =99%, HitCoverage=19%, E-value=6e-34, Identity=38%"; Hit description =Hypothetical protein CBG06805 [Caenorhabditis briggsae]
  Gene Ontology: Mol. function=cell adhesion receptor activity; Cellular component=integral to membrane; Biological process=cell adhesion
  Coding regions on vcDNA: vcDNA=SeqID_93997; Strand=+; Position=3-677
SFEFHLRSDGASGAVGDVFYSAGVRRQKGDSARVFRAPKILRGTGAHSQFGAALTRLGNVDNDAEGTQDFAVGAPQSDSGQGSVFIYFGDKWDAFSTEPAQEIHASVLNGRIYGQNLTFFGSALAGGVDMDGDGYVELGVGAHQSDIVALFRARPIVDIQLAHFFPQKQIKIDADNTCSPSAHSCFSLFTSLRLLPRNDSSRLLSRHFADNKPQQPFLCRLSAIP

SEQ ID NO: 167575 - protein, 74 aa, Heterodera glycines
  misc_feature (29)..(29): Xaa can be any naturally occurring amino acid
  Homolog annotation: Hit_ID=CAE63533.1; Match level="QueryCoverage =95%, HitCoverage=14%, E-value=6e-10, Identity=46%"; Hit description =Hypothetical protein CBG08013 [Caenorhabditis briggsae]
  Coding regions on vcDNA: vcDNA=SeqID_93998; Strand=+; Position=2-223
PMASAALGFSNFVNGALIRHPFVVLRRQXQVHDHATCKHLTPISLFAVWSTGREKCTFFLWKGAIGTAFLWVVS

SEQ ID NO: 167576 - protein, 87 aa, Heterodera glycines
  Coding regions on vcDNA: vcDNA=SeqID_93999; Strand=-; Position=1-261
QIHPPSIYCCTSFSFGAVVAHFLQIFDESVETHLKLTESLNLCVRTTDNRFARLNIVCPMPCRVGAHMEPLKVRKKRCHHIKITLRH

SEQ ID NO: 167577 - protein, 164 aa, Heterodera glycines
  Coding regions on vcDNA: vcDNA=SeqID_94000; Strand=-; Position=194-688
AKLCAAFVRCIFPIRSHRLRPLPPAFCFRSAYVVRTFGRFGFVGWWNFVTPNWCAIDGHFGPTAFVIRDWLGFGGHVRRWTKFSTLEWSFIFRLFVFSLFCCFLSVVVLLDEFTSNFNGHFAVQCFVSELFRNLACRCHRKILFQHHKSVLLLALVSHPGSVDM

SEQ ID NO: 167578 - protein, 211 aa, Heterodera glycines
  misc_feature (135)..(135): Xaa can be any naturally occurring amino acid
  misc_feature (157)..(157): Xaa can be any naturally occurring amino acid
  misc_feature (174)..(174): Xaa can be any naturally occurring amino acid
  misc_feature (178)..(178): Xaa can be any naturally occurring amino acid
  misc_feature (186)..(186): Xaa can be any naturally occurring amino acid
  misc_feature (190)..(190): Xaa can be any naturally occurring amino acid
  Homolog annotation: Hit_ID=CAD38523.1; Match level="QueryCoverage =100%, HitCoverage=87%, E-value=8e-85, Identity=72%"; Hit description= secreted glutathione peroxidase [Globodera rostochiensis]
  Gene Ontology: Mol. function=electron transporter activity; Cellular component=extracellular space; Biological process=lipid metabolism
  Coding regions on vcDNA: vcDNA=SeqID_94001; Strand=+; Position=2-628
LFTFLLFGAAFSAERFKPQAQQKEQPGPKLIDETTRWSKCKTDQNLTIYDFEVETLEGDFTNLEKFKGQALLVINVATFCAYTQQYIDFNPLIEKNLANGNQFSILAFPCNQFYLQEPAENHEIMNGITHVRPGXGWKRTATALSASGVNGATAPLXESLRWCLKRYSIGKREXLMYXPIRPNNFXWNFXKFLLQSKGRPAFRFHPTGWPH

SEQ ID NO: 167579 - protein, 251 aa, Heterodera glycines
  Homolog annotation: Hit_ID=CAA47019.1; Match level="QueryCoverage =100%, HitCoverage=70%, E-value=1e-102, Identity=74%"; Hit description=G protein alpha subunit [Asterina pectinifera] sp|P30676|GBI_ASTPE Guanine nucleotide-binding protein G(
  Gene Ontology: Mol. function=ATP binding; Cellular component=membrane fraction; Biological process=response to nutrients
  Coding regions on vcDNA: vcDNA=SeqID_94002; Strand=+; Position=89-841
MGCIHSVSDKNAKARSRQIDEQLKADHDRAQREVKLLLLGAGESGKSTIVKQMKIIHETGYSDEERKAYRPVVYSNTIQSMNAILRAMVRLKINFSTPSRKEEFAQFVQLAQTTEDGELPLELASVMKHLWADTGVQECFERSREYQLNDSAAYYLNSLDRVAQPGYVPTQDDVLRTRVKTTGIVETHFTYKDLNFKMFDVGGQRSERKKWIHCFEGVTAIIFCVALSEYDMVLAEDDEMNRMIESMKLFD

SEQ ID NO: 167580 - protein, 43 aa, Heterodera glycines; identical to SEQ ID NO: 133861
  Coding regions on vcDNA: vcDNA=SeqID_94003; Strand=-; Position=96-227

SEQ ID NO: 167581 - protein, 113 aa, Heterodera glycines
  Homolog annotation: Hit_ID=NP_498766.1; Match level="QueryCoverage =99%, HitCoverage=48%, E-value=3e-25, Identity=52%"; Hit description =isopentenyl-diphosphate delta-isomerase (3J183) [Caenorhabditis elegans] gb|AAK18968.1| Isopentenyl dipho
  Gene Ontology: Mol. function=isopentenyl-diphosphate delta-isomerase activity; Cellular component=peroxisome; Biological process=steroid metabolism
  Coding regions on vcDNA: vcDNA=SeqID_94004; Strand=+; Position=2-340
AKYLEEPCIAVNERDEPIGTVSKRECHAKPILRRALSVFMFDADNRLILLYRSQTKITFPGLWTNTCCSHPHFVDEECAGEEGIRRAAQRKVNHELGIDVDLEHMHVMGRLIY

SEQ ID NO: 167582 - protein, 183 aa, Heterodera glycines
  misc_feature (108)..(108): Xaa can be any naturally occurring amino acid
  misc_feature (148)..(148): Xaa can be any naturally occurring amino acid
  Homolog annotation: Hit_ID=CAE74810.1; Match level="QueryCoverage =96%, HitCoverage=38%, E-value=7e-59, Identity=58%"; Hit description =Hypothetical protein CBG22645 [Caenorhabditis briggsae]
  Gene Ontology: Cellular component=mitochondrion
  Coding regions on vcDNA: vcDNA=SeqID_94005; Strand=+; Position=1-549
IRFHCGRLVVFSFTFASYALYHASRKTLSGVKSSLSDDWINGTDHPPFFHDSKSAQTFLGSLDSLFMFCYAIALVFWGWLGDRLKINSLMVVAFGMVGSALTLTAFGXIPFWFNFYSVPWYLFTYALFGRVPACGWPNEVPIMGYWFXKTNRGFIMGMWATCQPFGDNLGALVNSFRLPMGYD

SEQ ID NO: 167583 - protein, 46 aa, Heterodera glycines
  Coding regions on vcDNA: vcDNA=SeqID_94006; Strand=-; Position=3-140
KNKTTEAKITRYFENLKTRCISSQSRTHIQCQFRAVSPFSFAIPQR

SEQ ID NO: 167584 - protein, 228 aa, Heterodera glycines
  Coding regions on vcDNA: vcDNA=SeqID_94007; Strand=+; Position=2-685
RISKNDDVPIAKCALLSMLPKPKKEGGNGGKMLPAKKLLPISITTVQPKQTTGKQAWKNDVLDDDEEFDTKLAEKSAKRIGNEETDDDSSGAEEGSTRPTKHSFDEQSAQKQLGKSVAQITLNRPLGIDYGDSDSSEDEANDNNETDGEMDSRAKDFFGLLSTSPVEKRAKMDDQFNAEPQLFIEDVEPGPSRPPNHQIVGMGRAEGNEGPIKNVRAISDEQAHRLIY

SEQ ID NO: 167585 - protein, 253 aa, Heterodera glycines
  Homolog annotation: Hit_ID=XP_418874.1; Match level="QueryCoverage =77%, HitCoverage=43%, E-value=2e-19, Identity=32%"; Hit description =PREDICTED: similar to LanC lantibiotic synthetase component C-like 2; testis-specific adriamycin sensitiv
  Coding regions on vcDNA: vcDNA=SeqID_94008; Strand=+; Position=49-807
ENERHFRNPFLENVADGARAVSREWLLQKLETLTERIASRKIRAEENGKVGPYVGPSGIAYSLIKASRKLNQSQSNLSDYIRTLLATESDYDAKKTSDSHKCRYLTGSLGFFTVRAIADFYFKNETDVSSLSAHFRKLLPTVLSSNIEEFEMLNGRAGFLASLLELRTHFGQQLLSDSEVRQVLGFMVISGKNYSGKCNSTAKLMYKWHDKEYLGAAHGVSGIYQMMLSFWNLLDASAKSDLTQSVDWLMSTQ

SEQ ID NO: 167586 - protein, 266 aa, Heterodera glycines
  Homolog annotation: Hit_ID=NP_500384.1; Match level="QueryCoverage =69%, HitCoverage=47%, E-value=2e-33, Identity=42%"; Hit description =kinase, Germline helicase-Binding, mitogen/stress activated protein kinase, c-jun N-terminal kinase (kgb-
  Gene Ontology: Mol. function=MAP kinase kinase activity; Cellular component=nucleus; Biological process=JNK cascade
  Coding regions on vcDNA: vcDNA=SeqID_94009; Strand=+; Position=17-814
MVKSVVSLLPSYKISSPSTTSNTTPSTNSSDDSCDNERQQQQQQSDDIKRVNGDMKSLRNAAYGEKTMLARSEQGSVWKSIATDEDGTTRNVTIKLLRAPFHSPGTAKYTLREVALLSTLNHPNLIALYDVRLPPKLKPLKKFDDLHLVTEYFGKNLRERIVEKLKNGTLWTHQELSYCIIQILCGVNFLHNSGIVHRDLKPTNVVMNERGNLKILDYGIARDIVPENLTTEAGTPIYRAPEIYLGIDSYDKKVDLWSVGCIFVEL

SEQ ID NO: 167587 - protein, 172 aa, Heterodera glycines
  Coding regions on vcDNA: vcDNA=SeqID_94010; Strand=+; Position=39-557
CTCLLEITRMGRAGVVLSSGAEDMLQLRGPFDVSNLCSLFGLTPKCGRRFVSSNALSVLLRSQTRRHTVKGAIHQVDLAFSPQVASTSNNSLLPNKNITEQLATIEEFAIEMSAAQMEVKCPAEERENERGEKDEKRPKQKKRKLEEEVDREHGTGRGDPPTNFENLMELFA

SEQ ID NO: 167588 - protein, 167 aa, Heterodera glycines
  misc_feature (120)..(120): Xaa can be any naturally occurring amino acid
  misc_feature (145)..(145): Xaa can be any naturally occurring amino acid
  Homolog annotation: Hit_ID=NP_505736.1; Match level="QueryCoverage =95%, HitCoverage=19%, E-value=8e-34, Identity=49%"; Hit description =yeast MRE recombination/repair homolog (mre-11) [Caenorhabditis elegans] pir||T27512 hypothetical protein
  Gene Ontology: Mol. function=3'-5' exonuclease activity; Cellular component=mitochondrial inner membrane; Biological process=transport
  Coding regions on vcDNA: vcDNA=SeqID_94011; Strand=+; Position=72-572
MDDENEPQESEETAMDTEDDELPIVRLLIASDIHAGFAENKEHISNDSFETFREVLKIGVDSKVDFVLLGGDLFHENHPSRETQLKVVRLLRKHCFREGPLWLEFLSDPTRHFQHSNFPXAHYLGRESSRGPAPFFQSHGNHDDXCSEKGLSALELLPQRPGSLNLF

SEQ ID NO: 167589 - protein, 275 aa, Heterodera glycines
  Homolog annotation: Hit_ID=NP_497751.1; Match level="QueryCoverage =97%, HitCoverage=44%, E-value=1e-43, Identity=39%"; Hit description =2OG-Fe oxygenase superfamily (67.4 kD) (3E801) [Caenorhabditis elegans] emb|CAB63431.2| Hypothetical prot
  Coding regions on vcDNA: vcDNA=SeqID_94012; Strand=+; Position=9-833
ITKWRGTEKICHFVSSLKKDGIEISESATDTLFVSNSSHLVGVPFESLELLFRRFDLHCAFTVYPANKSYSLVHFSEVNLAIAARNALNGTKPKDFPSENAAQIHLFFVRQKAANRSPPAALPNGLQIVPDFISTQHESELEQFVANCLAERTNIQELKNRHVFHFGYVFNYNENNATDEAPQIPPIFDRIIDEICSSFDCQSAEIRPNQITVNVYEPGHGIPLHLDAHSAFEEPIYSLSLLSDVVMEFRDCANSARRASAHLPRRSILSLRGDV

SEQ ID NO: 167590 - protein, 26 aa, Heterodera glycines
  misc_feature (8)..(8): Xaa can be any naturally occurring amino acid
  Coding regions on vcDNA: vcDNA=SeqID_94013; Strand=-; Position=2-79
FFFFFFFXNLLVISSSSSFIHICFYG

SEQ ID NO: 167591 - protein, 87 aa, Heterodera glycines
  Homolog annotation: Hit_ID=CAE57933.1; Match level="QueryCoverage =98%, HitCoverage=25%, E-value=3e-18, Identity=50%"; Hit description =Hypothetical protein CBG00986 [Caenorhabditis briggsae]
  Gene Ontology: Cellular component=mitochondrion
  Coding regions on vcDNA: vcDNA=SeqID_94014; Strand=+; Position=2-262
EPVLTDTALGVAGSAERAKQLAACIPKSCIPMELANEADPEIHYRTTGPDIWQPTHGKVDACIYGIGSRTTVYGVRRFLRDMNPDID

SEQ ID NO: 167592 - protein, 42 aa, Heterodera glycines
  misc_feature (35)..(35): Xaa can be any naturally occurring amino acid
  Coding regions on vcDNA: vcDNA=SeqID_94015; Strand=+; Position=10-135
CLFFVSVHFLCLLLSEYTFTLLNYFECFPIKVRCXKKKKKKK

SEQ ID NO: 167593 - protein, 47 aa, Heterodera glycines
  Coding regions on vcDNA: vcDNA=SeqID_94016; Strand=-; Position=306-449
FFFFFFFFTGSRFIPMKSKFIFIPNSVLCEFTFIGWGYKQTLKIIYH

SEQ ID NO: 167594 - protein, 202 aa, Heterodera glycines
  Homolog annotation: Hit_ID=BAC97920.1; Match level="QueryCoverage =90%, HitCoverage=38%, E-value=3e-13, Identity=30%"; Hit description =mKIAA0286 protein [Mus musculus]
  Coding regions on vcDNA: vcDNA=SeqID_94017; Strand=+; Position=18-626
LSAIVSPPLPQCFFALLSLAVCYRVGPPSDLRTLNLLVWLLRLSSLSALYFFSLNRFRAIVSVIFLLIFSIWCNYRREIRSFAIITQNKISTFIYGPQPREFLTESEYREEARIYTQLELDKLRQHIQSRQVCDTLRLIYQLHTPNRTSSFIAGNAEHISPEERRSHCELFGFSEAQRNGDDETDEITDEYENDEYITDDDE

SEQ ID NO: 167595 - protein, 213 aa, Heterodera glycines
  misc_feature (98)..(98): Xaa can be any naturally occurring amino acid
  misc_feature (166)..(166): Xaa can be any naturally occurring amino acid
  misc_feature (192)..(192): Xaa can be any naturally occurring amino acid
  Homolog annotation: Hit_ID=NP_492457.1; Match level="QueryCoverage =98%, HitCoverage=24%, E-value=9e-68, Identity=61%"; Hit description =translation Elongation FacTor (94.8 kD) (eft-2) [Caenorhabditis elegans] emb|CAB02985.1| Hypothetical pro
  Gene Ontology: Mol. function=translation elongation factor activity; Biological process=protein biosynthesis
  Coding regions on vcDNA: vcDNA=SeqID_94018; Strand=+; Position=1-639
PTDDPKNRAKILTEKFEMDATDSRKIWCFGPEGTGANLLIDVTKGVQYLNEIKDSVVAGFQWATKEGVLCDENMRGVRFDIHDVTLHADAIHGGGGQXIPTARRVFYASVVTGKTSLLEPVYLRGDPLPQAGGGGIYGMPKPPPWGPPWRKNKMLGTPMLSAREFXPANKHSGSPAGLRPTPGGQGFRQWVXEHFQVFPGIPLMDFSPPGRVP

SEQ ID NO: 167596 - protein, 259 aa, Heterodera glycines
  Homolog annotation: Hit_ID=AAH78222.1; Match level="QueryCoverage =69%, HitCoverage=44%, E-value=1e-42, Identity=48%"; Hit description =Zgc:101021 protein [Danio rerio]
  Gene Ontology: Biological process=ribonucleoside diphosphate catabolism
  Coding regions on vcDNA: vcDNA=SeqID_94019; Strand=+; Position=3-779
SNSSDHQNEEEDSKGTKSKSGDSFPPRHSHTFIGSTFAIWSLIFLLFATFASLQYYLPKAASSCLCPAAEFGRLTAQRAYNDSSFGNPKILPDGRIEYELAVVSDLDHDSKMEDRKETWRSFFRRGRLLFRPDIPSVQVQWAKDKQDNTLYSQLSSGGRAMELSELCVYDGHLLTVDDRTGIVYRMDNFKDMVPWVLLNDGPGNATKGFKGEWMSVRHNLLYVGGLGKEWTSVTGEFINYNPMYVKVINPYGEVLHVDW

SEQ ID NO: 167597 - protein, 78 aa, Heterodera glycines
  Coding regions on vcDNA: vcDNA=SeqID_94020; Strand=+; Position=1-234
VLSCPFVISLFVNPFSMASLLSRVLYVTSIFFVFLYLLVPALFFFFPTFMQHIFFLHFVCFPFVDYHNNLRDVVRNHP

SEQ ID NO: 167598 - protein, 136 aa, Heterodera glycines
  Coding regions on vcDNA: vcDNA=SeqID_94021; Strand=+; Position=68-475
MFRSPALFAMFLLLLIVFQLFGVGIVQGSKRSKGRARTKESEGISNRGKESAKEKVDELEGKKTQKKEEEEQKEEKEKAKKDQLTGEGIGMAPTGGRRAHREGGEVNEHREDGQGTVTLRRAPGELGEMGTKKKHR

SEQ ID NO: 167599 - protein, 86 aa, Heterodera glycines
  Coding regions on vcDNA: vcDNA=SeqID_94022; Strand=-; Position=136-396
FINCFFLPSHNHCHAWTPCGILPCFVYVLNWFGIHCFSVAQRRNARAETKLRLRCDECSLENKCQQNISHFEYLLKLRCTPDKTTG

SEQ ID NO: 167600 - protein, 106 aa, Heterodera glycines
  Coding regions on vcDNA: vcDNA=SeqID_94023; Strand=+; Position=2-319
SIKVNQQMMTPQMGLFKAIPSKRTCNTSDTPNVAVNWDAIVRAQHSTTRFCSTSTARFCWYGCHPCGSVFCWCVDYRWSGLKSTDCRPTFQPSGGTTSDTDAANRR

SEQ ID NO: 167601 - protein, 218 aa, Heterodera glycines
  Homolog annotation: Hit_ID=AAT72456.1; Match level="QueryCoverage =91%, HitCoverage=78%, E-value=1e-10, Identity=26%"; Hit description =FOG-3 [Caenorhabditis remanei]
  Coding regions on vcDNA: vcDNA=SeqID_94024; Strand=+; Position=50-706
HFANNCFLRFHLYWNLNQPKQYEELRIIRVSNEYTDELFTNAANAVGLQLDELLACIPESLIMYVNPGEVFYCLGDYSPPVPVWVGSVCADLKYNETSNVTFPPPPIPSSILPTHTIQPLIPRAIGGVSATVDFSVVNYRIQLSLVHPRELGYATNPSSDFVMFRYVVPGTPNYTVESFASTRFGSYRKRPDYEFVTHLQRSLLLMNMNIHSCSDEST

SEQ ID NO: 167602 - protein, 202 aa, Heterodera glycines
  Homolog annotation: Hit_ID=BAD11764.1; Match level="QueryCoverage =98%, HitCoverage=42%, E-value=5e-52, Identity=49%"; Hit description =mitochondria processing peptidase subunit beta [Brugia malayi]
  Gene Ontology: Mol. function=mitochondrial processing peptidase activity; Cellular component=mitochondrial processing peptidase complex; Biological process=mitochondrial processing
  Coding regions on vcDNA: vcDNA=SeqID_94025; Strand=+; Position=1-609
VNQLIEDKQMEMVYASLAVEGTSWTSEDNIPVQVVNTLIGQFDRTHCRNSSRLARTLSPNSGVSSFMSYTTSYKDTGLTGLFFCAEPDALFNLAQSVCKEWRQLCEEVDVDELERAKRSLLTNSLLMLDGSTPICEDIGRQLLCFDRRISTEELEEKINSITPDTIRSIGRRYFVNKPFAYVIIGKTSNWPNPRKIQKWLSW

SEQ ID NO: 167603 - protein, 126 aa, Heterodera glycines
  Homolog annotation: Hit_ID=NP_490738.1; Match level="QueryCoverage =77%, HitCoverage=96%, E-value=7e-11, Identity=32%"; Hit description =putative cytoplasmic protein (1A963) [Caenorhabditis elegans] gb|AAC68725.1| Hypothetical protein W04C9.2
  Coding regions on vcDNA: vcDNA=SeqID_94026; Strand=+; Position=58-438
MGVLRFTLRNAGKITLVALAVKVAADNGVWSLNSEEGASLFANFRSTVLPGTIVYREELPSADNACRSIGAAWNRNVNCAFGALRSATHSARESVQKMAAEAMAFFDDDEENKSSRGRRTAAEQRQ

SEQ ID NO: 167604 - protein, 137 aa, Heterodera glycines
  Coding regions on vcDNA: vcDNA=SeqID_94027; Strand=+; Position=26-439
MSSPAIGTSILEHPREESGAGASMVVRVTTQHQEVFYSSSPGRNRKAQPIPRRQKPTNHQPIVTEISDDSAEEQLETVPNVRRSDLCTDDAEFFRNNDEQLEDDFVGDFGRINTNNYQQPFRRRRREATSAIRNKYK

SEQ ID NO: 167605 - protein, 145 aa, Heterodera glycines
  Homolog annotation: Hit_ID=NP_497846.3; Match level="QueryCoverage =98%, HitCoverage=38%, E-value=4e-67, Identity=85%"; Hit description =mitogen-activated Protein Kinase, plays a role in signal transduction during vulval development, involved
  Gene Ontology: Mol. function=MAP kinase activity; Cellular component =cytoplasm; Biological process=synaptic transmission
  Coding regions on vcDNA: vcDNA=SeqID_94028; Strand=+; Position=48-482
AVSVAEIANGVEEVHGQIFEVAPRYVNLSYIGEGAYGMVVSALDTVTRERVAIKKISPFEHQTFCQRTLREIKILSRFKHENIINIQAIIRAPSIELMKDIYIVQCLMETDLYKLLKTQRLSNDHICYFLYQILRGLKYIHSANV

SEQ ID NO: 167606 - protein, 94 aa, Heterodera glycines
  misc_feature (62)..(62): Xaa can be any naturally occurring amino acid
  misc_feature (81)..(81): Xaa can be any naturally occurring amino acid
  Homolog annotation: Hit_ID=AAN35160.1; Match level="QueryCoverage =100%, HitCoverage=24%, E-value=2e-38, Identity=85%"; Hit description= beta-tubulin [Rhizophydium sp. JEL138]
  Gene Ontology: Mol. function=MHC class I protein binding; Cellular component=tubulin; Biological process=natural killer cell mediated cytolysis
  Coding regions on vcDNA: vcDNA=SeqID_94029; Strand=+; Position=2-283
MVGFAPLTSRGSQQYRALTVPELTQQMFDAKNMMAASDPRHGRYLTVACMFRGRMVMKEGDXQMLHVQNQNSSYFVEGDPXNVKTALCDNSAQG

SEQ ID NO: 167607 - protein, 78 aa, Heterodera glycines
  misc_feature (56)..(56): Xaa can be any naturally occurring amino acid
  misc_feature (61)..(61): Xaa can be any naturally occurring amino acid
  Homolog annotation: Hit_ID=CAE60135.1; Match level="QueryCoverage =100%, HitCoverage=24%, E-value=1e-17, Identity=61%"; Hit description= Hypothetical protein CBG03681 [Caenorhabditis briggsae]
  Gene Ontology: Cellular component=mitochondrion
  Coding regions on vcDNA: vcDNA=SeqID_94030; Strand=+; Position=2-235
WDKACLLTRLVASSVRLSEAAGGIIKDIMKSGDLKIVNQEQTGQMKDFATEADRSXQFCIXRSLRGEFGENLTIFGEE

SEQ ID NO: 167608 - protein, 151 aa, Heterodera glycines
  Homolog annotation: Hit_ID=XP_392633.1; Match level="QueryCoverage =89%, HitCoverage=6%, E-value=1e-15, Identity=32%"; Hit description =similar to mKIAA1112 protein [Apis mellifera]
  Coding regions on vcDNA: vcDNA=SeqID_94031; Strand=+; Position=9-464
EDAIQKIWLWQKPVHGFRGPDLVESNHRMLINGELHCRALWRAQMQWAKSVHAYLFDQTIVLCRRDVLRRHQLVFKERMALNGVTVQELHDGKEPITGASLRNAFKVSSQARDYVFSCPDAATKGLWLEALRERPRPQPPTPAERRLAMLM

SEQ ID NO: 167609 - protein, 221 aa, Heterodera glycines
  Homolog annotation: Hit_ID=NP_499892.1; Match level="QueryCoverage =89%, HitCoverage=97%, E-value=2e-38, Identity=40%"; Hit description =pancreatic trypsin inhibitor precursor family member (20.1 kD) (4B21) [Caenorhabditis elegans] gb|AAC4809
  Gene Ontology: Mol. function=serine protease inhibitor activity; Cellular component=membrane fraction
  Coding regions on vcDNA: vcDNA=SeqID_94032; Strand=+; Position=3-668
LNICCHNSQNALSALAIKCLLLLSSSIFTLGFAELNDVCGEGRDKGNDGCGTPAGGRRFYYDTITKRCQPFAYEGCGGNGNRFDSLAQCRQKCANFESAAQGSSTGDEGQHHSMVLPVPKCSGGVRAAVNADARVIECAGTDKCPDGYTCVGNKNCCPASKEIVCGIEYDTGRYAFQGSHTPRYFYKKDIDNCLLFTYYGALGNGNNFETYNECIKYCKKT

SEQ ID NO: 167610 - protein, 159 aa, Heterodera glycines
  Homolog annotation: Hit_ID=CAE65029.1; Match level="QueryCoverage =89%, HitCoverage=60%, E-value=2e-16, Identity=36%"; Hit description =Hypothetical protein CBG09867 [Caenorhabditis briggsae]
  Coding regions on vcDNA: vcDNA=SeqID_94033; Strand=+; Position=2-478
EGGLQNWECTDDLCNFLLDNNQTMSGVDILELGCGAALPTNVALSMRADSICVQDYHALVGKCLTTRNFELHGHRMDGGKCAFMNGRWGGETLGKSGQNKLGLISARETIYDQATDSARREAMDSLLADEGKIHLAAKPHYFRRSDEVCRDSFEFVRSR

SEQ ID NO: 167611 - protein, 160 aa, Heterodera glycines
  Coding regions on vcDNA: vcDNA=SeqID_94034; Strand=+; Position=3-485
LWRKRTARTENAFAPMMQREVTKVAEAQGQTGERQTLFITAVSMLRDSECYDPTVFAAGTSPAKKHQTPSLAQIQQKFSYLVNTTKNRHAMEAHTLGENHKSEWNRALRKIARENERQQMLKGVANGKQRLVQLPLECCTESVVPVVKLVDIPLISFQND

SEQ ID NO: 167612 - protein, 248 aa, Heterodera glycines
  Homolog annotation: Hit_ID=CAE71944.1; Match level="QueryCoverage =57%, HitCoverage=35%, E-value=2e-38, Identity=54%"; Hit description =Hypothetical protein CBG19011 [Caenorhabditis briggsae]
  Gene Ontology: Mol. function=cytokine activity; Cellular component =extracellular space; Biological process=skeletal development
  Coding regions on vcDNA: vcDNA=SeqID_94035; Strand=+; Position=9-755
LQLPKTTETKGTLHRVGQLRERPSGEGVGTELARGGGGELADLLREHPTDREQLVLAWRLPPGSDPLATELLESVALIVFTNSEKYEGRKIWQKGTAKKRTKRWVSSQRTNSASKANDDDDATDNSSKRRRHRTHRKMAESEQRQQCRRTALYVDFRELNWDDWIIAPTGYEAYQCRGRCAHPLPAKLNTTNHAIVQSLIHSIDPHSVSAPSCVPVQMSAISILYKDINNVIVVKTYADMRVDSCGCH

SEQ ID NO: 167613 - protein, 211 aa, Heterodera glycines
  Coding regions on vcDNA: vcDNA=SeqID_94036; Strand=+; Position=1-636
ADQTDVFGVASSSIGKPIRVELGTGSRKTIISGNLLTTDPESGSIVLVEKRQQNKTSDQGKCSQRFILIPGSSVHSAKLDGQLEEGTKSNAELREKADGIESGDEATIESHGKRTLSETVRIFDEFALSRRLCLIDALNKYGIKFSEKPHVLVQNIDNGQTEGQMPSTVISLQSGGIKIYPPYGKNDIIGGGSIVVKELLHKLSTENVFDE

SEQ ID NO: 167614 - protein, 159 aa, Heterodera glycines
  Coding regions on vcDNA: vcDNA=SeqID_94037; Strand=+; Position=3-482
ASAALTLSRRNLLAPLSVVLLPAEPAALALSRRHLPAPLSVVLLPAEPAALALSRRNPPAPLSVVLLPAEPAALALSRRNLLAPPHVVLLPAIPAALALSRRHLPSPPKAVLLASRCLSYLERKRKAARENRNRNRKWTGQKMEAKRTNWKKFDGKLFF

SEQ ID NO: 167615 - protein, 119 aa, Heterodera glycines
  Homolog annotation: Hit_ID=AAL62471.1; Match level="QueryCoverage =95%, HitCoverage=94%, E-value=1e-47, Identity=82%"; Hit description =ribosomal protein L34 [Spodoptera frugiperda]
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_94038; Strand=+; Position=12-371
MVQRLVYRRRLSYNTKSNRRRVVRTPGGRLVYQYLKKPGKIPRCGQCKDTLRGIQPARPMERSRMPKRLKTVRRAYGGVLCHKCVKERIVRAFLIEEQKIVVKVLKAQKAAVKTKAPKK

SEQ ID NO: 167616 - protein, 238 aa, Heterodera glycines
  Coding regions on vcDNA: vcDNA=SeqID_94039; Strand=+; Position=3-716
ALGDANGEGDDERGRDGRRGEGGEESATEIRPCSSIGFQNNSIISRLRQSARRKVPPQNTQIQSDFPTDDGEAQETPTETLCGVNVRTLLVPNTNRPPDNISIVSSDLSEFESLGALGFSLGSWRKSSSRSYQRKAITSSALAVAAAATASAEIDKVGAAHRPVGNSSSLGTLTASSPTVLQSSPKLGFSNLLPRRPSTSPEAKKDKSAIEKAIGDTFDESKDSLMSRTEDETAAEQR

SEQ ID NO: 167617 - protein, 145 aa, Heterodera glycines
  Homolog annotation: Hit_ID=XP_417249.1; Match level="QueryCoverage =93%, HitCoverage=33%, E-value=3e-34, Identity=48%"; Hit description =PREDICTED: similar to protein phosphatase methylesterase-1 [Gallus gallus]
  Gene Ontology: Mol. function=protein phosphatase inhibitor activity; Biological process=protein amino acid demethylation
  Coding regions on vcDNA: vcDNA=SeqID_94040; Strand=+; Position=3-440
PFLRSRPQHFPSIERSVEWCVKSKTTSNLRAAKVSMPCRLKKVKDNSNGEVFQWRTNLARTEPHWQGWFSGLSKLFLQCEPVKVLILANVDRLDKELMTGQMRGQFQLEVLPKVGHAVHEDSPELVAKIFVTLVKRYNVIFQKYL

SEQ ID NO: 167618 - protein, 261 aa, Heterodera glycines
  Homolog annotation: Hit_ID=CAF90463.1; Match level="QueryCoverage =92%, HitCoverage=39%, E-value=3e-50, Identity=43%"; Hit description =unnamed protein product [Tetraodon nigroviridis]
  Gene Ontology: Mol. function=CAAX-protein geranylgeranyltransferase activity; Cellular component=CAAX-protein geranylgeranyltransferase complex; Biological process=C-terminal protein geranylgeranylation
  Coding regions on vcDNA: vcDNA=SeqID_94041; Strand=+; Position=25-807
QWIILHRTDCGEEINPLLIRKHTKLIRTCLDVLPSDYAVFHSTKPTILFFMLSGMDVLGKLDASIDRPRQIEMADWVYALQLPRGNGCLSPSRRCGGFRGCVLSVPSAGLCPYESAHLAQTYTSLCILLILGDDFSRLDRRAILRAVADSQGADGSFFDGDRSNENDMRFLYCACAICYLLDDFSPINIPSLLDFVRRSVSYDGGIAQGPSLESHGGSTFCAVSALLLTGHLWDGSVLDSAKMERLIKWALMKQEEGFHGR

SEQ ID NO: 167619 - protein, 214 aa, Heterodera glycines
  Homolog annotation: Hit_ID=CAE64299.1; Match level="QueryCoverage =98%, HitCoverage=43%, E-value=3e-45, Identity=45%"; Hit description =Hypothetical protein CBG08974 [Caenorhabditis briggsae]
  Gene Ontology: Mol. function=phosphoprotein amino acid binding; Biological process=programmed cell death
  Coding regions on vcDNA: vcDNA=SeqID_94042; Strand=+; Position=54-695
ETIKRSFSATANGIIGGVSPRSVLGSPASSKGSLGGWIHPPACLINARVEYVVKMLGQTEVPAPRGTKIVEDAIHAIRFHLQIERGKTGHSGAKQRMVVLQISVNCVNVLDAKSRAIIVKHHLSRISFCADDRQDKRLFSYIAKNEQGKYQCFVFLSDKMAENITLTVGEAFDLAYEKQVKKRGKELANQKHELLLRKKIAELEEENRQLKHRL

SEQ ID NO: 167620 - protein, 32 aa, Heterodera glycines
  Coding regions on vcDNA: vcDNA=SeqID_94043; Strand=-; Position=27-125
FFFFFFFVAKNVIKNNENINKTGFRQRLNCFF

SEQ ID NO: 167621 - protein, 53 aa, Heterodera glycines
  Homolog annotation: Hit_ID=NP_498940.1; Match level="QueryCoverage =96%, HitCoverage=18%, E-value=2e-09, Identity=60%"; Hit description =synaptosomal-associated protein 2 (31.1 kD) (3J867) [Caenorhabditis elegans] gb|AAK84538.1| Hypothetical
  Coding regions on vcDNA: vcDNA=SeqID_94044; Strand=+; Position=3-164
PKSAHLGRLRTFGALLGDEVQDQNLMLDRIQKKTERNDGVIRSQEDQMRKLLG

SEQ ID NO: 167622 - protein, 47 aa, Heterodera glycines
  misc_feature (13)..(14): Xaa can be any naturally occurring amino acid
  Homolog annotation: Hit_ID=XP_319983.1; Match level="QueryCoverage =100%, HitCoverage=14%, E-value=1e-13, Identity=80%"; Hit description= ENSANGP00000016639 [Anopheles gambiae]
  Gene Ontology: Mol. function=MAP kinase activity; Cellular component =cytoplasm; Biological process=synaptic transmission
  Coding regions on vcDNA: vcDNA=SeqID_94045; Strand=+; Position=2-142
LLRTQRLSNDHIXXILYQILRGLKDIRSANEMHRDLKPSKLLLNTTC

SEQ ID NO: 167623 - protein, 158 aa, Heterodera glycines
  Homolog annotation: Hit_ID=XP_396194.1; Match level="QueryCoverage =98%, HitCoverage=10%, E-value=3e-18, Identity=38%"; Hit description =similar to ENSANGP00000011596 [Apis mellifera]
  Gene Ontology: Mol. function=ATPase activity, coupled to transmembrane movement of ions, phosphorylative mechanism; Cellular component=membrane; Biological process=cell organization and biogenesis
  Coding regions on vcDNA: vcDNA=SeqID_94046; Strand=+; Position=1-474
TLEISRDELEHDLHSAGFAVISCPLKPDSKQVIAEIADASHRVVMITGDNVLTAIHVAVVLRFIRRSRIALILDDTRPIVTNGEQQHQQQSASTELLQSDDEDERNDNRRWIWRSSQDAGKSVALSTEALIGSHLRHGHHKFELCITGAAFEHLMDSL

SEQ ID NO: 167624 - protein, 65 aa, Heterodera glycines
  Coding regions on vcDNA: vcDNA=SeqID_94047; Strand=-; Position=126-323
PIISQQITHSFLLITWVGSFVEKPIPDFTLTIDLNFNLIPLIIKLPANRFLHPLSSHGYSGKRPQ

SEQ ID NO: 167625 - protein, 190 aa, Heterodera glycines
  misc_feature (57)..(57): Xaa can be any naturally occurring amino acid
  misc_feature (166)..(166): Xaa can be any naturally occurring amino acid
  Homolog annotation: Hit_ID=CAE67028.1; Match level="QueryCoverage =100%, HitCoverage=42%, E-value=2e-25, Identity=37%"; Hit description= Hypothetical protein CBG12429 [Caenorhabditis briggsae]
  Gene Ontology: Mol. function=homogentisate 12-dioxygenase activity; Biological process=phenylalanine catabolism
  Coding regions on vcDNA: vcDNA=SeqID_94048; Strand=+; Position=2-570
EHLSGIAVTGTRYSLQCNGVHRVRATDHTQTFPRMEGNGPSTADLSPILPNQTLVQXTPTPVPDSTANGGPLLDYVHGVYTDCGDGPLTSPCELAVPYHTCDADMDQAVMYNPDGDFLNVPHYSIIHIHTAMDVISVGPQKIDNISQGVPLSDDASMPSHRYHLEXYDEHFQLPEFGPTGDNGIGHAYRF

SEQ ID NO: 167626 - protein, 114 aa, Heterodera glycines
  Homolog annotation: Hit_ID=NP_491993.1; Match level="QueryCoverage =95%, HitCoverage=28%, E-value=6e-40, Identity=66%"; Hit description =sec14 -like 2 (43.8 kD) (1H585) [Caenorhabditis elegans] emb|CAB07482.1| Hypothetical protein H06O01.3 [C
  Gene Ontology: Mol. function=transcriptional activator activity; Cellular component=cytoplasm; Biological process=regulation of cholesterol biosynthesis
  Coding regions on vcDNA: vcDNA=SeqID_94049; Strand=+; Position=6-350
MTDYDQLTTVYAGDKHLIELKVKANTRIGWQYLTEEEDIGFAVYFDPSGNANNLTEMDCVFPYIRLECSQVPISGSLLCEQSGRYIIEFDNYYSWFSAKQLRYNIEIDDRGIGQ

SEQ ID NO: 167627 - protein, 84 aa, Heterodera glycines
  Coding regions on vcDNA: vcDNA=SeqID_94050; Strand=+; Position=288-542
LSPPNPFLRFVFRPFVPLSTLCPDTLVTLLQNCPALFIIRDYSFSFTLFAFVGDSLPRLRLSGRRVEEVATENHKISERQLINN

SEQ ID NO: 167628 - protein, 96 aa, Heterodera glycines
  Coding regions on vcDNA: vcDNA=SeqID_94051; Strand=+; Position=22-312
AIKRGNRRLYGSVAKAVEAKYHQREEQKVKQYQEEREEWERRMAETRRKFETERHNFEQKMRMKREQQTEELAQMEQQMDEQSQKHCREREQQQQR

SEQ ID NO: 167629 - protein, 182 aa, Heterodera glycines
  Homolog annotation: Hit_ID=CAE73345.1; Match level="QueryCoverage =63%, HitCoverage=89%, E-value=1e-12, Identity=33%"; Hit description =Hypothetical protein CBG20777 [Caenorhabditis briggsae]
  Coding regions on vcDNA: vcDNA=SeqID_94052; Strand=+; Position=139-786
MTMDVLPSCSAPHDTNFMSQLIEKLAAASILSSAGSLCSSTSASSSSVPSSSTHPPSPPPSGAARNFNQLSGARSKRFDSAAAVPGEFHSVQNAIAVAVLVRLHQWCCRLFWLTIVCLMSYYSDQQQNQRMSTTQRHGSKKVTDLEMQLLRHLTCPQTAVLRPLRPFHHKKRHFLSRPPSPQ

SEQ ID NO: 167630 - protein, 171 aa, Heterodera glycines
  Homolog annotation: Hit_ID=NP_502553.2; Match level="QueryCoverage =80%, HitCoverage=17%, E-value=9e-15, Identity=32%"; Hit description =beta-lactamase-like (79.3 kD) (4O40) [Caenorhabditis elegans] emb|CAC44310.2| Hypothetical protein Y67H2A
  Gene Ontology: Biological process=growth
  Coding regions on vcDNA: vcDNA=SeqID_94053; Strand=+; Position=3-515
QCVFYDGSFPLLLHHLRLLSSDAIVSNSDEASTSDKQQKESKNGGTPTYVVKMFRDEITINFYSVQHIVIVEWMSNPVNDLFADATLSAILHAQTNPILDKNVPKDFGAKAQQIEQNLESILVGTLCELCGDKSFVEVKEEENQGEKDAAAEESDKKEGKRRRVIQLELDG

SEQ ID NO: 167631 - protein, 133 aa, Heterodera glycines
  Homolog annotation: Hit_ID=NP_506089.1; Match level="QueryCoverage =88%, HitCoverage=63%, E-value=5e-16, Identity=37%"; Hit description =putative cytoplasmic protein of bilaterial origin (21.5 kD) (5M798) [Caenorhabditis elegans] emb|CAD01086
  Coding regions on vcDNA: vcDNA=SeqID_94054; Strand=+; Position=277-728
ICFRLSGSRTCNSFDPLMAVACGAALASLVFTLKSNPDEIALRARLAQLRQQMVLIPASIHSTRAVHERLEQYTVLLNGNRLELVDFLLFSVLVERPFDKKNDFYAAHDKTLRGWPWTELWRNAWDIGAFGRF

SEQ ID NO: 167632 - protein, 96 aa, Heterodera glycines
  Coding regions on vcDNA: vcDNA=SeqID_94055; Strand=+; Position=2-289
TMILTNKLGFICKSSMKLKMQFFVGSKLPLAFLLLLLLSFVFSNAKNQKAVHSAGGTCKRGRIHCNGKCHKKCTKNSQCFHKLRCKPCRGTKGRHA

SEQ ID NO: 167633 - protein, 142 aa, Heterodera glycines
  misc_feature (91)..(91): Xaa can be any naturally occurring amino acid
  Homolog annotation: Hit_ID=NP_493241.1; Match level="QueryCoverage =91%, HitCoverage=36%, E-value=4e-17, Identity=38%"; Hit description =predicted CDS, apolipoprotein A-I binding protein like (1N400) [Caenorhabditis elegans] emb|CAA22319.1| H
  Coding regions on vcDNA: vcDNA=SeqID_94056; Strand=+; Position=8-433
MRFLTQQKAIDIYGELFGSRRFSQHQLMELAGMACAQTICETIDPGNVLIKSRSGNTRLYGLGCARRFQHVGFSPTILWPEPSLDDLMQRXMLQVERHGIPCNQSFHDPSSIEKFTFLVDALVGVRFRPSTRGAGETIFKQM

SEQ ID NO: 167634 - protein, 230 aa, Heterodera glycines
  Homolog annotation: Hit_ID=XP_313459.1; Match level="QueryCoverage =100%, HitCoverage=34%, E-value=2e-33, Identity=38%"; Hit description= ENSANGP00000020183 [Anopheles gambiae]
  Coding regions on vcDNA: vcDNA=SeqID_94057; Strand=+; Position=53-742
SAMVPVKSAKEYDRQLDVAVLFSECLTRAIKMGYITKEQIDDCDPNVIISLPRLAIVWGLLFYPGGALNVNVPKEDISEMFRHFHKVLILVRNLLQTLEPSELSKLEQKLVGEHDGLGESCSSVRALEQQIEPFSGRSLNRHEQQKLIEKYEYGPNDFSDSISLMRNSHRNAPLISIPCTDYETDRKENSIDRFAYGTSENLIHRLFVCIASIADQLQSNYSADIRKVLK

SEQ ID NO: 167635 - protein, 110 aa, Heterodera glycines
  Coding regions on vcDNA: vcDNA=SeqID_94058; Strand=+; Position=10-342
DSDDLRLYFSIPLEDGQLFPFVSLCDSDDKIETNFGPNFMAIIPKTFKIVPTNHEIVFRTPSMNKSPSSNPENVLRTPTTSSIISPIILASFVMLMCWLFLIFIFFRIVM

SEQ ID NO: 167636 - protein, 232 aa, Heterodera glycines
  Homolog annotation: Hit_ID=NP_509684.1; Match level="QueryCoverage =36%, HitCoverage=13%, E-value=1e-11, Identity=38%"; Hit description =predicted CDS, sorl mouse sortilin-related receptor like (XK654) [Caenorhabditis elegans] emb|CAA96700.1|
  Coding regions on vcDNA: vcDNA=SeqID_94059; Strand=+; Position=106-801
MLFSIISFIIFFYSVSSDQQQNVSPLRNVRAHYDAKMDTILVDWEWSEIGRKEIEDYKLFVHYKVSNQHRHRGLNEWHRVSSEDDSLGAKIPLGQALNNGDEITVQVFAEPIERGFATEQSDPLVIWIARKSQDKGNESGENSENGAISMADELLPPYNFTANILSPGKVRLEWRTPPLPSPSSVPFYIVNVRQLRANTGDRFPPQTLRVDGTHFLLGNLVAGENFEVTIRN

SEQ ID NO: 167637 - protein, 217 aa, Heterodera glycines
  Coding regions on vcDNA: vcDNA=SeqID_94060; Strand=+; Position=9-659
VMIIIRCFSIVSSSGSFASCFQCSTISSRRFFCHQRRAKVSTPCPPPPDPSAEFRVVPTSSVIPPISGTENPSLGRGEARRISSLITDNFRADVVARRYRLDRLRPSDWLLVYNYRVGSWLFTVGRYAFALLCVIFLIAVDDFVRVGGGKFTLQKLRVTHNELIRLGIVGKFFCAIALLIFFLLLRVRSLFLLRMYVHRKEPNRICATIAKGVFSKK

SEQ ID NO: 167638 - protein, 251 aa, Heterodera glycines
  misc_feature (44)..(44): Xaa can be any naturally occurring amino acid
  misc_feature (104)..(104): Xaa can be any naturally occurring amino acid
  misc_feature (162)..(162): Xaa can be any naturally occurring amino acid
  misc_feature (184)..(184): Xaa can be any naturally occurring amino acid
  Homolog annotation: Hit_ID=NP_502269.1; Match level="QueryCoverage =99%, HitCoverage=67%, E-value=1e-67, Identity=52%"; Hit description =zinc-containing alcohol dehydrogenase superfamily (40.2 kD) (4M724) [Caenorhabditis elegans] emb|CAA98080
  Coding regions on vcDNA: vcDNA=SeqID_94061; Strand=+; Position=2-754
AATTAWISIGSPNDLNEEHFPDEYEPPDVPNYGAKVKVCYARVXLADKEISRARRLRLTPSAQDTRLFPDYEVPGVIHDLGPEAPPGEYDSQVAHLVIEWASDXMCQHGYADYGAVPHLPLLAEIPDTLAMHVATSLPASASWALSASVHAQPVVEDITSTXGCCSIFTAAAGGLGLWILTLAXAFLTAGLDNTIKLIVAASIDERLCLTEHHVPDFLVHCDDSESFEYIFLRTLARLTNGLHIVFDFVTS

SEQ ID NO: 167639 - protein, 172 aa, Heterodera glycines
  Homolog annotation: Hit_ID=AAK26375.1; Match level="QueryCoverage =100%, HitCoverage=39%, E-value=7e-98, Identity=100%"; Hit description=class V aminotransferase [Heterodera glycines]
  Gene Ontology: Mol. function=alanine-glyoxylate aminotransferase activity; Cellular component=peroxisome
  Coding regions on vcDNA: vcDNA=SeqID_94062; Strand=+; Position=45-798
AVDNYRPQVAFVCHGESSTGVVHPLERFGDICNAYDVLFLVDTVASICGAPFHADALKVDCVYAATQKVLNCPPGLAPISFSEKALEKITKRKTRVPSFYFDALELGNYWGCFDEPRRYHHTAPISLVYALREGLSAVAQEGIGHMVNRHKINAKLLYDAFDQLGLELFVQK

SEQ ID NO: 167640 - protein, 107 aa, Heterodera glycines
  misc_feature (77)..(77): Xaa can be any naturally occurring amino acid
  Homolog annotation: Hit_ID=CAE70241.1; Match level="QueryCoverage =99%, HitCoverage=15%, E-value=6e-24, Identity=50%"; Hit description =Hypothetical protein CBG16730 [Caenorhabditis briggsae]
  Gene Ontology: Biological process=nonselective vesicle transport
  Coding regions on vcDNA: vcDNA=SeqID_94063; Strand=+; Position=2-322
CSHEFLFICDPFMVNGQSAVDLFTSVMGRSISLLLKTLEEKIAANFDAISLFLCICFCAKFREMMADRAVVVINGYXDALVGFLWARVDAVMTGHSDSVRAIDVRKV

SEQ ID NO: 167641 - protein, 209 aa, Heterodera glycines
  misc_feature (40)..(40): Xaa can be any naturally occurring amino acid
  misc_feature (86)..(86): Xaa can be any naturally occurring amino acid
  misc_feature (148)..(148): Xaa can be any naturally occurring amino acid
  misc_feature (171)..(171): Xaa can be any naturally occurring amino acid
  Homolog annotation: Hit_ID=NP_492730.2; Match level="QueryCoverage =100%, HitCoverage=24%, E-value=1e-42, Identity=44%"; Hit description= FAD dependent oxidoreductase and glycine cleavage T protein (94.9 kD) (1L16) [Caenorhabditis elegans] em
  Coding regions on vcDNA: vcDNA=SeqID_94064; Strand=+; Position=2-628
LASPIQAISVSLCGELGWMLYIPNELDLNAYQHLVDLGVXYRLQHCGCYALPHLLLETFSVYCGPNIYTMTTPVKCRRLFWADFSXQFISHDALTRQLELGGSSRFVQLPVERSDLDRHPWPHRDEPLYRDGTLFRWTTTAAYRFSLXCAACLTLRALTRLLRVTSDYSPXAARATLQLAVTRFPGQICLHSPSLPVISSDHPLPYLPT

SEQ ID NO: 167642 - protein, 90 aa, Heterodera glycines
  misc_feature (36)..(36): Xaa can be any naturally occurring amino acid
  misc_feature (50)..(50): Xaa can be any naturally occurring amino acid
  misc_feature (56)..(56): Xaa can be any naturally occurring amino acid
  Coding regions on vcDNA: vcDNA=SeqID_94065; Strand=+; Position=3-272
SMCNNFQRIGFSIRGLNESAKKRINTPLMGSLTAGXSTLDILRLCQPDIXGGERGXFRMVAGWLNVGQFLFDGQLPGVVWGLRHEHSAAA

SEQ ID NO: 167643 - protein, 221 aa, Heterodera glycines
  Coding regions on vcDNA: vcDNA=SeqID_94066; Strand=+; Position=47-709
PHLLNRSFQMNSAGGDERKNDKMKGEKAEGKDGKGTAREHVEEAKTGEKDDEEDDDVVVIGEWEGGRERDTLSTASDRSPAVPHKALYPSLPSDSSASQMDPPPQYGHPQAQQQQQQQSTWFSPASFLGSSTNSPPSAANGTDQSVPSASASAQRLLTELRQRYQPWSVFFKCAKFGFPPGVAAIGPRVKRNLATFTTNYLCLFALLLLYCVLTSLLMLLS

SEQ ID NO: 167644 - protein, 60 aa, Heterodera glycines
  Coding regions on vcDNA: vcDNA=SeqID_94067; Strand=-; Position=66-248
SGKFVKMNKQKSLCFSTFVSFPFLPAFLCGIPTFQGPIGDHQTISFRHHQSDVYKHSTVL

SEQ ID NO: 167645 - protein, 231 aa, Heterodera glycines
  Homolog annotation: Hit_ID=EAA48685.1; Match level="QueryCoverage =75%, HitCoverage=49%, E-value=1e-23, Identity=33%"; Hit description =hypothetical protein MG00343.4 [Magnaporthe grisea 70-15] ref|XP _368901.1| hypothetical protein MG00343.4
  Coding regions on vcDNA: vcDNA=SeqID_94068; Strand=+; Position=87-779
MAHAASSLVSASAKYARRLLHIVLYGTAMGAIALTSNVVQVVTLLLYPFSRSSVARINAKICEVIWRTIDFAMERHNKAQITFSGDINSIPVNEQPVLLSQNPQLNAIESAIVISNHCAAMDWALINAVAMRRGMLAHCKYFVKASMQWVPFFGPGMRLAGFPYLSRNWAADNKKIEAVFHGLKSDKLPCWLISVLERTRSQPRKLAEAKAVSRFKKLPRVNNCMNPRKKA

SEQ ID NO: 167646 - protein, 243 aa, Heterodera glycines
  Coding regions on vcDNA: vcDNA=SeqID_94069; Strand=+; Position=1-729
RPLCEHQQLLDKLKRDLAELEAEAGGEVQKETAATKSGTVSPEKNAEMDVQDALRRKTRKRAATASSSVSSASSPTRSPKRSNAMDTCDRMEASSSHRTDESPPAINLNESNSLSHRHLAEEANASVAGDSATESTTTAAAALLVKKGRRRELDGLLKMDFGKHSPFQTSDPDKYAQEVLIEARQQQRTLALAQEEQRNARRSVESSCGGSATGKSSKRDKYAKKPFSPPVSPLPESRAASVR

SEQ ID NO: 167647 - protein, 141 aa, Heterodera glycines
  Homolog annotation: Hit_ID=AAH46935.1; Match level="QueryCoverage =84%, HitCoverage=31%, E-value=5e-30, Identity=53%"; Hit description =LOC398559 protein [Xenopus laevis]
  Gene Ontology: Mol. function=protein binding; Cellular component =nuclear body; Biological process=mitotic cell cycle
  Coding regions on vcDNA: vcDNA=SeqID_94070; Strand=+; Position=64-486
MSLNPSADPLAGIYQKELTEYDLNRLPHTLKKGEDDQLLKRSDLIDTLNTEFSCPICLDLLKNTMVTECLHRFCSECIKKCIYKGNRECPTCRKKIISKRNLRADPNMDKLIDKIWPDREQYEALQREKAQKWSKHFDVVA

SEQ ID NO: 167648 - protein, 116 aa, Heterodera glycines
  Coding regions on vcDNA: vcDNA=SeqID_94071; Strand=+; Position=367-717
RVNLSIVCCFAIISLFCLFVLCFSSDHFSLPQSNECSNPSPPPYFLIIRRHFVRFFSPPPKSVAPFPSVRFPCVCLLISQSFALLNHSIIDQISHFCLTDNFLCKMNYFECCNKKE

SEQ ID NO: 167649 - protein, 96 aa, Heterodera glycines
  misc_feature (44)..(44): Xaa can be any naturally occurring amino acid
  Homolog annotation: Hit_ID=NP_494439.1; Match level="QueryCoverage =100%, HitCoverage=36%, E-value=8e-11, Identity=39%"; Hit description= putative protein, with at least 4 transmembrane domains, of eukaryotic origin (2D354) [Caenorhabditis el
  Coding regions on vcDNA: vcDNA=SeqID_94072; Strand=+; Position=2-289
FRSLVLYRHFFDIDEDHVFARLLHSAMPAQTGNFISQFVRPYLXLRGPFWWTVCLVFSIATDGYLALFLHTYSSDDVLIDYFSYVTVATFLEYGYL

SEQ ID NO: 167650 - protein, 124 aa, Heterodera glycines
  Homolog annotation: Hit_ID=NP_498985.2; Match level="QueryCoverage =82%, HitCoverage=88%, E-value=3e-16, Identity=41%"; Hit description =putative protein of bilaterial origin (3K63) [Caenorhabditis elegans] emb|CAA78050.2| Hypothetical protei
  Coding regions on vcDNA: vcDNA=SeqID_94073; Strand=+; Position=8-382
MNKRSEVLRLYRPIIRLSKDWVAQEPTNTNEEQKYIREEAQKGFKAYKNEKDPEKISELLKEAEKRLEIACHYQIPYDRPFYLPPRSSFDVDSSSKSAKQRTLHRSPISSKFLPSAASRGNSSD

SEQ ID NO: 167651 - protein, 134 aa, Heterodera glycines
  Homolog annotation: Hit_ID=AAL78214.1; Match level="QueryCoverage =81%, HitCoverage=57%, E-value=2e-13, Identity=37%"; Hit description =putative esophageal gland cell protein Hgg-20 [Heterodera glycines]
  Coding regions on vcDNA: vcDNA=SeqID_94074; Strand=+; Position=82-483
MTNHPKKTQRIQRKIINAFSLFSSADSFWPSVFAFSSRAEVGLKFAQLSKHFDALTDKHLTVTECFLGILHIRRSEKGEGAEIVKFDEDGQKVLPIPQNELPDRVIGFRRLSIGFVDHSVLAFLRLIHRLIDNE

SEQ ID NO: 167652 - protein, 229 aa, Heterodera glycines
  Homolog annotation: Hit_ID=CAE69218.1; Match level="QueryCoverage =86%, HitCoverage=22%, E-value=2e-39, Identity=40%"; Hit description =Hypothetical protein CBG15258 [Caenorhabditis briggsae]
  Coding regions on vcDNA: vcDNA=SeqID_94075; Strand=+; Position=2-688
PLKKDWNLFYNEYLGLSSEERQLIHSMGLSEAVLIRHIHSHHQQKDPSKGMRIYVVFMLRQIWNQKPLWEVARYFGVPRGWLQSVLQSAVCQSSSIVRFAERTPDLWALRSLLPEMVRRLCECSRQELIPLLRIECVKIGRARQLYENGFRTVGSISKAEPCQLIKALEGKLSCWQCRRMISSAKAIIRDQIAEKAMELEELGADGLLAFPPTFSLDHQTDQRQNYESA

SEQ ID NO: 167653 - protein, 178 aa, Heterodera glycines
  Coding regions on vcDNA: vcDNA=SeqID_94076; Strand=+; Position=83-619
MSAAPTAHYAYNAGDPNVQGATSFDPQLAQKQYEAWQQYYAQTGAGQQPVQNIQQHTGQEVGGTYKAYFDQPVPGTVPPAAAPQPLASAYVGRPASNAPVFPPPQPPQVQQMAAPVGGAWAASGGPPQQRGPPAPLNSFMGGPPPYGQQTPRGGGFQRGGGSQSRWSSGGSERQFSRR

SEQ ID NO: 167654 - protein, 216 aa, Heterodera glycines
  Homolog annotation: Hit_ID=CAE59160.1; Match level="QueryCoverage =82%, HitCoverage=43%, E-value=1e-35, Identity=43%"; Hit description =Hypothetical protein CBG02466 [Caenorhabditis briggsae]
  Gene Ontology: Mol. function=fucosyltransferase activity; Cellular component=membrane fraction; Biological process=protein amino acid glycosylation
  Coding regions on vcDNA: vcDNA=SeqID_94077; Strand=+; Position=179-826
MDFRRTPGLSGTNVAAGQCEERFSHPRESECAKRLSPRGKAQKAPNFFHWTLTYLRSSDFVMPYGGFWISPEETLRLGFSPVRLPTDRTTILKDKIVRGAVWFVSNCRTESKRELAVDALSKHMLINIGGKCAKTEQGKKLCPRNATSCDHVFSAHYFFIAAENDICKDYVTEKYWDRYRLPSVPIVMRKHIYEGIVPNNSFIAMDQFDSPKAMAD

SEQ ID NO: 167655 - protein, 162 aa, Heterodera glycines
  Coding regions on vcDNA: vcDNA=SeqID_94078; Strand=-; Position=67-555
MVGHVVVSHRCCPKGKILSSRLCALTTSFPFLCIQNANKYLCIRGMHESAQNPWGWALHGRRKWGGGGFFKFGWAWHWASEKFPPGVQILSGGHFSTSSVFIFRSTKADPRGRPLSPIAHCGACQPFVSPTESHFWCHSFVELTAQKFAYCHPQWHQQKVCN

SEQ ID NO: 167656 - protein, 77 aa, Heterodera glycines
  Homolog annotation: Hit_ID=AAC63624.1; Match level="QueryCoverage =97%, HitCoverage=7%, E-value=7e-35, Identity=94%"; Hit description =putative ATP-dependent RNA helicase A [Arabidopsis thaliana] pir||C84918 probable ATP-dependent RNA helicas
  Coding regions on vcDNA: vcDNA=SeqID_94079; Strand=+; Position=60-293
MCFFFVKVEKLARESFFFLGESFPHDSESFGAFQDTLTIQKPMLVSRPISYVFNLHPPSDIQFGNYTSLLRKSLHNK

SEQ ID NO: 167657 - protein, 260 aa, Heterodera glycines
  Homolog annotation: Hit_ID=NP_496105.1; Match level="QueryCoverage =96%, HitCoverage=90%, E-value=2e-43, Identity=39%"; Hit description =putative protein, with at least 4 transmembrane domains, of bilaterial origin (30.5 kD) (2K58) [Caenorhab
  Coding regions on vcDNA: vcDNA=SeqID_94080; Strand=+; Position=22-801
MVVPLQSILPAIISVAYYLFVFFFAEVSRKLVDLSLKKSSLVHLFLIELIATAQMCTCVYENAIIIKHYGPSGFFLVVTFLQIAGAFFNRGAFVSPLAPIELFLRGKMDTEKFLAILLSQTLGGYSAFRLANSLWYYSQSYSTDHHQFYDSLPCALSYKVPFYCALLFELFGSFFLRFLLHRFPLSSRHFFAPPTIAAFLSFALTFIGVPGLNPVVTSSRLQGCPGLDLQWFIMTYWCCPVVGWLLASKLDKTPTKQKKK

SEQ ID NO: 167658 - protein, 95 aa, Heterodera glycines
  Coding regions on vcDNA: vcDNA=SeqID_94081; Strand=+; Position=27-314
MECVEVLILLFGKAREMAECQEIRQILPKSLTSTELYNHIFEKIFPALMPIRNSCILTVNHRYCFEGRDALGGTENRIELEENSEIAIIPPISGG

SEQ ID NO: 167659 - protein, 169 aa, Heterodera glycines
  misc_feature (143)..(143): Xaa can be any naturally occurring amino acid
  Homolog annotation: Hit_ID=CAE62113.1; Match level="QueryCoverage =92%, HitCoverage=25%, E-value=2e-42, Identity=57%"; Hit description =Hypothetical protein CBG06151 [Caenorhabditis briggsae]
  Gene Ontology: Mol. function=xenobiotic-transporting ATPase activity; Cellular component=plasma membrane; Biological process=response to singlet oxygen
  Coding regions on vcDNA: vcDNA=SeqID_94082; Strand=+; Position=132-637
MDYGLGRIRRRRSNYGAMSPTKSVQEVQPVALSWHGLTAVHAKSGRKILDNVSGMADAGQLVALMGASGAGKTTLLNTLLNRNLKSLSVEGQVLVNGHSLGRSITYVSGYVQQDDLFMGTLTVKEHLMAQAQLRMVGHTNGRXRRRVNEIIDELGLQECRHARIGFSGV

SEQ ID NO: 167660 - protein, 107 aa, Heterodera glycines
  misc_feature (50)..(50): Xaa can be any naturally occurring amino acid
  misc_feature (63)..(63): Xaa can be any naturally occurring amino acid
  Homolog annotation: Hit_ID=NP_491117.1; Match level="QueryCoverage =100%, HitCoverage=35%, E-value=3e-19, Identity=48%"; Hit description= brix domain containing protein 1 (33.5 kD) (1D742) [Caenorhabditis elegans] gb|AAF60765.1| Hypothetical
  Coding regions on vcDNA: vcDNA=SeqID_94083; Strand=+; Position=2-319
KACLILQGHLFESNGILRRIGNLMADLFRGPTVEYLRLQGTELIISLTAXLPKSGLNSYLTEXSLKKDMESATPKIELVDMGPNIDFKIDRTILASDSLFITALRKP

SEQ ID NO: 167661 - protein, 115 aa, Heterodera glycines
  Coding regions on vcDNA: vcDNA=SeqID_94084; Strand=-; Position=2-346
FLLLVSFLLPSSFGSFMAPSARRILSPCFGIGFNPKIPPNESFGRANSVILIWYLCLFCWMKIFHFSKAPKVILLNDSKDKPSFRRRKVSNLSKSMRLQQNALSVLSTRGFTYIS

SEQ ID NO: 167662 - protein, 95 aa, Heterodera glycines
  Coding regions on vcDNA: vcDNA=SeqID_94085; Strand=-; Position=49-336
QFSGGTNSEGMEVTEERRKSCRKCARRTKRRTRHPSAWTIERRSRRWRRTEWRTPCQKSSANGAGTAPTRSDRHGRSSSVLLELENEVNTVAIFL

SEQ ID NO: 167663 - protein, 69 aa, Heterodera glycines
  Homolog annotation: Hit_ID=CAE59627.1; Match level="QueryCoverage =94%, HitCoverage=14%, E-value=3e-13, Identity=53%"; Hit description =Hypothetical protein CBG03040 [Caenorhabditis briggsae]
  Coding regions on vcDNA: vcDNA=SeqID_94086; Strand=+; Position=2-208
PGAYIKFEDERGVEVDQPLTTTAFLDRALVCIPPHTNAIPDEETPLQTGITALPGQRQLPPHMTNQLHD

SEQ ID NO: 167664 - protein, 175 aa, Heterodera glycines
  Homolog annotation: Hit_ID=CAE63593.1; Match level="QueryCoverage =99%, HitCoverage=52%, E-value=8e-67, Identity=65%"; Hit description =Hypothetical protein CBG08084 [Caenorhabditis briggsae]
  Gene Ontology: Cellular component=cytoplasmic vesicle; Biological process=ommochrome biosynthesis
  Coding regions on vcDNA: vcDNA=SeqID_94087; Strand=+; Position=35-559
MINTIFIVNSSHDVILEKHYKSVIHRSICDYFFDVQKQSPNAENIPPVIAAPHHYLYIVHHNSLYFIAICVTETPPLMVIEVLHRIIAIFTEYFDECSDSAIKENIVIVFELLDEILDYGYPLCTELNVLQDMIQPPNFFRSFKNQVTGRTNISEILPTGPLSNVSWRRASVNFA

SEQ ID NO: 167665 - protein, 131 aa, Heterodera glycines
  Coding regions on vcDNA: vcDNA=SeqID_94088; Strand=+; Position=3-398
DFLCAIASASYTVHFYFHVSRTSIVEPFELLLNERTTNEKLTLMKEGGANFGRNCWWTMKRCPIVGEGAAAQLEDDDGGINWDDKLNNVQINMWAPKNCIGPLSSPPAAEEEEASGSMRRKKASDECAEVN

SEQ ID NO: 167666 - protein, 195 aa, Heterodera glycines
  Homolog annotation: Hit_ID=CAE58603.1; Match level="QueryCoverage =97%, HitCoverage=51%, E-value=1e-57, Identity=55%"; Hit description =Hypothetical protein CBG01770 [Caenorhabditis briggsae]
  Gene Ontology: Mol. function=kinase activity; Cellular component =plasma membrane; Biological process=zygotic determination of dorsal/ventral axis
  Coding regions on vcDNA: vcDNA=SeqID_94089; Strand=+; Position=253-837
MPATNSPQSSNLAEKATDSLLNGLQNTPAVTYEDLTVATDGFSPNKIVGRGGYGVVYRGVWKHTPVAIKRIQGKCGSDERQQRERIRQSLQELKTLAKFRHDNVLSLYGYSLDGPEPCLVYQFMSNGTLEDRLLCRNGTEPLGWAKKLFICGGVCRGLHFLHTINQMPIIHGDVKSANILLDKHFEPKLGDFGLS

SEQ ID NO: 167667 - protein, 233 aa, Heterodera glycines
  Homolog annotation: Hit_ID=XP_420496.1; Match level="QueryCoverage =87%, HitCoverage=57%, E-value=1e-48, Identity=52%"; Hit description =PREDICTED: similar to Multisynthetase complex auxiliary component p43 [Gallus gallus]
  Gene Ontology: Mol. function=tRNA binding; Cellular component =methionyl glutamyl tRNA synthetase complex; Biological process=tRNA -nucleus export
  Coding regions on vcDNA: vcDNA=SeqID_94090; Strand=+; Position=2-700
AATLLDPKHAAKLAKKEAKKAEKDAKKADKKADKPAEQPAAAAAPAKESKPASPAAAPKADAPASGVAPDTDPTRLDLRVGYIISAEKHPDAESLYVEKIDCGEDEPRTVISGLVNHIPIDQMQGRPCVVLCNLKPVKMRGIMSHAMVMCATSAEGKVDVLSPPEGSKPGDLIAYEGIEGGAGPDAQLNPKKKVFESIQPGLFTNDELAAGFIKHDGTFCKMHVGGNPVLAQS

SEQ ID NO: 167668 - protein, 181 aa, Heterodera glycines
  misc_feature (167)..(167): Xaa can be any naturally occurring amino acid
  Homolog annotation: Hit_ID=CAE73274.1; Match level="QueryCoverage =99%, HitCoverage=31%, E-value=2e-37, Identity=44%"; Hit description =Hypothetical protein CBG20692 [Caenorhabditis briggsae]
  Coding regions on vcDNA: vcDNA=SeqID_94091; Strand=+; Position=2-544
HEIVFTAQMPHMRDGVQLEYSPLYQFLIGFLDLEFEFRPETTSFSEDILMECDVRMAFWRRGGPPAAGGEWVELVRSTVRRALQCLVNPDKARLGFSFDCSLLDLFHFGSLPHPQYLLNIRIPANRTLCLLSNNKGPNCAFPGPLHELRLIEIHQNGGFTLVWLWLXSALSPVLLSVLFWF

SEQ ID NO: 167669 - protein, 139 aa, Heterodera glycines
  Homolog annotation: Hit_ID=AAH49005.1; Match level="QueryCoverage =79%, HitCoverage=18%, E-value=2e-16, Identity=42%"; Hit description =MGC53150 protein [Xenopus laevis]
  Gene Ontology: Mol. function=protein tyrosine kinase activity; Cellular component=nucleus; Biological process=TGFbeta receptor signaling pathway
  Coding regions on vcDNA: vcDNA=SeqID_94092; Strand=+; Position=2-418
LVLELMEGGSLSELILPAKSIAYQNCHVINWTFQVAKALEYLHKFSFIHRDGEPSNMWLSLDYVVLKLGDFGTIANHRTDMTTTCGPAAWMAPEVPTGESYDFRGDGFSLGSLSLRNARAKSAIRRRSRTKFLDRVLGR

SEQ ID NO: 167670 - protein, 131 aa, Heterodera glycines
  Homolog annotation: Hit_ID=XP_317881.1; Match level="QueryCoverage =97%, HitCoverage=87%, E-value=2e-50, Identity=73%"; Hit description =ENSANGP00000023979 [Anopheles gambiae]
  Gene Ontology: Cellular component=eukaryotic 48S initiation complex; Biological process=protein biosynthesis
  Coding regions on vcDNA: vcDNA=SeqID_94093; Strand=+; Position=11-406
MSAVEAVQTFGRKKTATAVAHCKRGKGMLRINGSPIDLVQPEILRYKVYEPILVVGKERFADVDIRVRVSGGGQVSQIYAIRQAIAKAIVAFYAKFVDEGSKNELRKMLVDYDRTLLVADPRRCEPKKVCG

SEQ ID NO: 167671 - protein, 248 aa, Heterodera glycines
  misc_feature (89)..(89): Xaa can be any naturally occurring amino acid
  misc_feature (107)..(107): Xaa can be any naturally occurring amino acid
  misc_feature (125)..(125): Xaa can be any naturally occurring amino acid
  misc_feature (138)..(138): Xaa can be any naturally occurring amino acid
  misc_feature (193)..(193): Xaa can be any naturally occurring amino acid
  misc_feature (231)..(231): Xaa can be any naturally occurring amino acid
  Homolog annotation: Hit_ID=CAB88203.1; Match level="QueryCoverage =98%, HitCoverage=81%, E-value=2e-64, Identity=53%"; Hit description =putative cuticular collagen [Globodera pallida]
  Gene Ontology: Mol. function=extracellular matrix structural constituent; Cellular component=collagen; Biological process =histogenesis and organogenesis
  Coding regions on vcDNA: vcDNA=SeqID_94094; Strand=+; Position=2-745
GNASVCSLFSKSATGDALTSLYSDMRPMITRVRDEVEAFRINTKSDCTDMMDVQMAKTAPLKILDNPYDSIFCAKCKLLGHCQCAGLQXPSCHPGTPCSVGPPGQPXTVWRRKNPGQAGQSGQPXAHCPAQNILCPLXPAGPFGRCGRHGQAGQHGASGQPGTLNGGGGSGTTGVLGPQGQPVQQGRSGFAGXPGQRGVNGIVSQQIPIPNGSPGASDQNANSGSQGLPGXPGRHGPSGSRGAPDRSA

SEQ ID NO: 167672 - protein, 246 aa, Heterodera glycines
  Homolog annotation: Hit_ID=CAE67869.1; Match level="QueryCoverage =61%, HitCoverage=24%, E-value=2e-22, Identity=39%"; Hit description =Hypothetical protein CBG13461 [Caenorhabditis briggsae]
  Coding regions on vcDNA: vcDNA=SeqID_94095; Strand=+; Position=73-810
MTAAEATTTALPTSADLSRSASAVEMFPRRHRRAVSVNECLFQQQQQGQFNQRSLLDETPSSSCLGSPCSSASLPAHFPAAAVAATSTVLKSDQISPIARFAFSDLVITVLRLDFYRTGDPEAIKFCKHSLDILLKWGELPAKTQQSLRHRIEENHPFNEDIGALITAVKLDPELCQPQGLLHLLGSLLLCVLVDGDYDARFRVLLRHISALLGIHWDLFEEFESTLCDRLIDQYNETVDNQKVRE

SEQ ID NO: 167673 - protein, 81 aa, Heterodera glycines
  Coding regions on vcDNA: vcDNA=SeqID_94096; Strand=+; Position=81-326
MLCRVIVFPLSFASFAFIKCQFPLPFPFLTFLCFLCCSFSFHFFRSFVSNHSFFDSMIDQMSFKSIETFLLILNLNCSNYK

SEQ ID NO: 167674 - protein, 102 aa, Heterodera glycines
  misc_feature (15)..(15): Xaa can be any naturally occurring amino acid
  misc_feature (21)..(21): Xaa can be any naturally occurring amino acid
  misc_feature (28)..(28): Xaa can be any naturally occurring amino acid
  misc_feature (51)..(51): Xaa can be any naturally occurring amino acid
  misc_feature (73)..(73): Xaa can be any naturally occurring amino acid
  Homolog annotation: Hit_ID=NP_572882.1; Match level="QueryCoverage =88%, HitCoverage=74%, E-value=2e-20, Identity=45%"; Hit description =CG1989-PA [Drosophila melanogaster] gb|AAF48266.1| CG1989-PA [Drosophila melanogaster] gb|AAD28537.1| put
  Gene Ontology: Mol. function=metal ion binding
  Coding regions on vcDNA: vcDNA=SeqID_94097; Strand=+; Position=2-310
QHMGGRKYYSCLRCXTYLTNXSELIYTXFTGATGQAYIFTNIANIIMATVXSPFMITGQHIFRYMLCKICNRXLGWMYEFAHQQQPLYNQRLDTYRALIANP

SEQ ID NO: 167675 - protein, 260 aa, Heterodera glycines
  Homolog annotation: Hit_ID=CAE58572.1; Match level="QueryCoverage =93%, HitCoverage=23%, E-value=1e-80, Identity=64%"; Hit description =Hypothetical protein CBG01737 [Caenorhabditis briggsae]
  Gene Ontology: Mol. function=oxoglutarate dehydrogenase (lipoamide) activity; Cellular component=mitochondrion; Biological process =embryogenesis and morphogenesis
  Coding regions on vcDNA: vcDNA=SeqID_94098; Strand=+; Position=21-800
MLTRSQIDLAAAKRLFPPSVPSLSTVPHATVVPRDMREVQPQTAGQVIPANELTRAINDHLKIQVLISSFQTRGHNIANLDPLGINSADLDDTIPPEVRKMFSFTEEDMDREFSLPPTTFIGGERATLSLPEIYKRLKKIYCHHIGVEYMHLTNDEQQDWIRNHFEAPEVTELPPEQKKVLFKRLIRSTKFEDFLAKKWPRKTRFGLEGCEVLVPAIEQVIDCSHELGVNSIVLGMPHRGRLNVFANVCQQPVSTVLGLF

SEQ ID NO: 167676 - protein, 123 aa, Heterodera glycines
  misc_feature (27)..(27): Xaa can be any naturally occurring amino acid
  Coding regions on vcDNA: vcDNA=SeqID_94099; Strand=-; Position=45-416
LIFVGILPFFFGCLFLFSPPAPAAFPXGTCSLSDSWPYLVLDEVYHLIWAAIPNNPTPRHVKMGRHRQLDRSCTFSGAPVKGNLNKRANPSSRSIRYTSQPQRSCDSALDSSQFTRRYYGNPR

SEQ ID NO: 167677 - protein, 71 aa, Heterodera glycines
  Coding regions on vcDNA: vcDNA=SeqID_94100; Strand=+; Position=2-214
DNRRDERTVQSRQRAAYDRLMCMFATQQRPDSCGFFEKEWKNEWNCEKSSPKCLMPAQINVNKAFNFEKKK

SEQ ID NO: 167678 - protein, 121 aa, Heterodera glycines
  Homolog annotation: Hit_ID=NP_509893.1; Match level="QueryCoverage =83%, HitCoverage=25%, E-value=1e-14, Identity=36%"; Hit description =hepatocyte nuclear factor 4 family member (XL939) [Caenorhabditis elegans] emb|CAA91462.1| Hypothetical p
  Coding regions on vcDNA: vcDNA=SeqID_94101; Strand=+; Position=86-448
MTAQPQQQCPASAEAVELKYLRRMLEGYQHFLSLRKASYTLVDGFPLSRRDNEDCPQSNFGTSKKICKIEASLIMDIVENFFHPFGQLPAEDKRKMFDTFYCLFSNAERAFRTYKMFGAED

SEQ ID NO: 167679 - protein, 169 aa, Heterodera glycines
  Coding regions on vcDNA: vcDNA=SeqID_94102; Strand=+; Position=2-508
VQQQCRINYSKTLDQRAQKLNELIIQWLSRNGSYYEFTTKDNFFLIANFRDFLDTAKRHEQTGTSIKAWEASFIGQFLNGFSRTRKNGNLFKRLRLVDQRMISMIDEFCEISVDFLISNQNVAAETAKTNEPEKFCAFWPKVKENASKFTQIDIAMDAFNKWINTSDLL

SEQ ID NO: 167680 - protein, 148 aa, Heterodera glycines
  misc_feature (79)..(79): Xaa can be any naturally occurring amino acid
  misc_feature (108)..(108): Xaa can be any naturally occurring amino acid
  misc_feature (121)..(121): Xaa can be any naturally occurring amino acid
  Homolog annotation: Hit_ID=AAO49799.1; Match level="QueryCoverage =100%, HitCoverage=41%, E-value=1e-32, Identity=54%"; Hit description= arginine kinase [Heterodera glycines]
  Coding regions on vcDNA: vcDNA=SeqID_94103; Strand=+; Position=2-445
DSSGKAGFEQLEGDDQKLLNYYQILSVILDFQIRLIVDPFLFKEGDRFLRAVNACHCCTTRRGIFHNIQNNFLVCANEXHLLRIISMQYAGHVVPTLELLIPGGNAIXSKVPISPYYRLGXLTLCPTQLPITVLASAHIRMSNILQKP

SEQ ID NO: 167681 - protein, 102 aa, Heterodera glycines
  Coding regions on vcDNA: vcDNA=SeqID_94104; Strand=+; Position=3-311
HHIFFVMTLRQSMIKCNKNTYRERVGNEQNTKHALHKTTDGTEAKGARAARVRSAPVQHGVDLAHDVHLAPVVPPGQVLLQLNERDAKITTDFGIQIKNAIN

SEQ ID NO: 167682 - protein, 32 aa, Heterodera glycines
  Coding regions on vcDNA: vcDNA=SeqID_94105; Strand=-; Position=0-95
FFFFSPQIFMLVLKMLKINNIQHKLINWPHIL

SEQ ID NO: 167683 - protein, 118 aa, Heterodera glycines
  Homolog annotation: Hit_ID=NP_384310.1; Match level="QueryCoverage =95%, HitCoverage=45%, E-value=1e-27, Identity=56%"; Hit description =hypothetical protein SMc02879 [Sinorhizobium meliloti 1021] emb|CAC41591.1| CONSERVED HYPOTHETICAL PROTEI
  Coding regions on vcDNA: vcDNA=SeqID_94106; Strand=+; Position=3-359
MTEILLEVCVDDADGLLAAIRGGADRVELCSALEVGGLTPTPGLIELARSLNGSVPVFAMVRPRAGDFSYSDREFDSMRKDIECVAKARLAGIVFGANHCDGTLDRHRLEIMAKMAKV

SEQ ID NO: 167684 - protein, 141 aa, Heterodera glycines
  Coding regions on vcDNA: vcDNA=SeqID_94107; Strand=+; Position=3-425
LFPRTKFMKQTERIVKVYLKLKDNPGGGWGPLIQKMFGEMILAKKLGKGDGASLRANCQLALELIGEGDGATEAMVDQLAKAKPYSNFWTLTKRTTKAILCLLKGNGTESERQRSTEDILRMLKTFAEDGESLKMVQKGKG

SEQ ID NO: 167685 - protein, 101 aa, Heterodera glycines
  misc_feature (6)..(6): Xaa can be any naturally occurring amino acid
  Coding regions on vcDNA: vcDNA=SeqID_94108; Strand=-; Position=34-339
FFYFFXEYIIYSFENGESGANEINIIIIVHYYFINWLAPLTVHLLPNTHPPPKPAPRAPIELPNQSNWRFIRSGAKRHGQKQKKKKQNGRKKKRAEERHCF

SEQ ID NO: 167686 - protein, 163 aa, Heterodera glycines
  misc_feature (114)..(114): Xaa can be any naturally occurring amino acid
  misc_feature (134)..(134): Xaa can be any naturally occurring amino acid
  Homolog annotation: Hit_ID=AAP41028.1; Match level="QueryCoverage =100%, HitCoverage=39%, E-value=4e-83, Identity=91%"; Hit description= arginine kinase [Heterodera glycines]
  Gene Ontology: Mol. function=creatine kinase activity; Cellular component=cytoplasm; Biological process=phosphocreatine metabolism
  Coding regions on vcDNA: vcDNA=SeqID_94109; Strand=+; Position=3-488
GVYAADSESYKVFSPLFDPVIDEYHGGFGPKQKHPPSNFGEDRLGELKDLDPDGKYILSTRIRCGRSLLGYPFNPLLMRDDYLVMQQKVRMALENLEDDPEIGGTYYPLQGMTXRTQKQLIADHFLFKEGDRFXLEGPNSNHFWPAGRDIFPSAKNTLLPRAN

SEQ ID NO: 167687 - protein, 140 aa, Heterodera glycines
  Coding regions on vcDNA: vcDNA=SeqID_94110; Strand=-; Position=82-504
EQKKKLDKKHISIFHQICSFCFHHLTRSTFLFRFSLAAFLFRSKQLRQREARRTTCGGAGRCLRDSVSAVGFAAALCVSETGADAFFADFLKCVSGRTSGAQSILKCSQKLIKTRVTKSTSNRSRGLHSFPGSASACICI

SEQ ID NO: 167688 - protein, 27 aa, Heterodera glycines
  misc_feature (2)..(3): Xaa can be any naturally occurring amino acid
  Coding regions on vcDNA: vcDNA=SeqID_94111; Strand=-; Position=2-82
FXXVVKYFFFTNKKYRNLCGKFEVFGM

SEQ ID NO: 167689 - protein, 70 aa, Heterodera glycines; identical to SEQ ID NO: 129709
  Coding regions on vcDNA: vcDNA=SeqID_94112; Strand=-; Position=244-456

SEQ ID NO: 167690 - protein, 121 aa, Heterodera glycines
  Coding regions on vcDNA: vcDNA=SeqID_94113; Strand=-; Position=183-548
VISKTRGGNGFFFFGGFVLFLSFSKPIFSKNFPEFFFFGGKGNCPGNFRIVPSFKSHLALKSFWESTGEEDEGCFQTENDCCPPRFVALLLKQKVRLSMRLYANVFQRCELLLLLPLVIIC

SEQ ID NO: 167691 - protein, 81 aa, Heterodera glycines
  Coding regions on vcDNA: vcDNA=SeqID_94114; Strand=+; Position=6-251
EERRKPSEKGNDAKIGIWGGELRLVAIVISTKNVLDYYGILATICFCLLFWSPICPSIRQIIPFVIFPRQIPWHSASRRCF

SEQ ID NO: 167692 - protein, 95 aa, Heterodera glycines
  Homolog annotation: Hit_ID=AAH81028.1; Match level="QueryCoverage =63%, HitCoverage=11%, E-value=4e-12, Identity=55%"; Hit description =MGC81679 protein [Xenopus laevis]
  Gene Ontology: Mol. function=protein phosphatase type 2A, intrinsic regulator activity; Cellular component=protein phosphatase type 2A complex; Biological process=signal transduction
  Coding regions on vcDNA: vcDNA=SeqID_94115; Strand=+; Position=1-340
GPQVYSIKIIPFRTIHGLIYNALKLFMEENQKLFDLCVQNFNKQKEQEQLKQQNNRRRWELLEKAAMENARAIRQQQTDGEAEPYSIGEGEKKPK

SEQ ID NO: 167693 - protein, 180 aa, Heterodera glycines
  Coding regions on vcDNA: vcDNA=SeqID_94116; Strand=+; Position=2-541
NNTVPFPLPERPLPRKIRFQALEILYIDHSVIEFLRANKQIFDNKGTNLVFKLSSYLSGKEDGRTIWQFLCREIWPIFTPNIRQLGFYNGDHLVNLRRLISPTILTDLNQLNPLDSGELFPAGVADDGPNATAGQALTKWLHTPTVDGQPKELYCSDHVWGFKFDWIKTFKEEFLRSTTP

SEQ ID NO: 167694 - protein, 119 aa, Heterodera glycines
  Homolog annotation: Hit_ID=XP_397365.1; Match level="QueryCoverage =65%, HitCoverage=15%, E-value=3e-09, Identity=33%"; Hit description =similar to SUMO1/sentrin specific protease 1 [Apis mellifera]
  Coding regions on vcDNA: vcDNA=SeqID_94117; Strand=+; Position=5-364
MDSMNHGYTDTEKKEFMETIMNILRDVAILQKVDIGDRSAWDVQERLSVPQQRNGTDCGIFALLFAQYSLERRQLEFGQCHIPYFRRRICHDIISVILHDQKSPVNRSDETVVQCPFAL

SEQ ID NO: 167695 - protein, 74 aa, Heterodera glycines
  Coding regions on vcDNA: vcDNA=SeqID_94118; Strand=-; Position=3-224
FVFFYFLKIKPIYCSKWRQMFTYFVLISVSPIQHSDHFRPFIHSFVSSVGVRHFALNFFFGQNLGHFALAGDLF

SEQ ID NO: 167696 - protein, 132 aa, Heterodera glycines
  Homolog annotation: Hit_ID=AAP37188.1; Match level="QueryCoverage =100%, HitCoverage=26%, E-value=1e-62, Identity=88%"; Hit description= vacuolar proton-ATPase B-subunit [Artemia franciscana]
  Gene Ontology: Mol. function=hydrogen-transporting ATPase activity, rotational mechanism; Cellular component=plasma membrane; Biological process=proton transport
  Coding regions on vcDNA: vcDNA=SeqID_94119; Strand=+; Position=3-401
LHNRQIYPPINVLPSLSRLMKSAIGEGMTRADHSDVSNQLYACYAIGKDVQAMKAVVGEEALSPDDLLYLEFLTKFEKNFISQGNYENRTVFDSLDIGWQLLRIFPREMLKRIPAKTLDKYYPRGGTGARNE

SEQ ID NO: 167697 - protein, 17 aa, Heterodera glycines
  Coding regions on vcDNA: vcDNA=SeqID_94120; Strand=+; Position=1-51
KQHSQKHMRTHSLTQCT

SEQ ID NO: 167698 - protein, 25 aa, Heterodera glycines
  Coding regions on vcDNA: vcDNA=SeqID_94121; Strand=-; Position=62-139
MNKYSISNKFIKNENVQLNFMDWAM

SEQ ID NO: 167699 - protein, 158 aa, Heterodera glycines
  Homolog annotation: Hit_ID=NP_498645.1; Match level="QueryCoverage =62%, HitCoverage=4%, E-value=4e-12, Identity=35%"; Hit description =transmembrane matrix receptor required for embryonic muscle attachment and epithelial cell adhesion at hem
  Gene Ontology: Cellular component=extracellular space; Biological process=growth
  Coding regions on vcDNA: vcDNA=SeqID_94122; Strand=+; Position=57-530
KFGGRRKRGRRNGGENGGDRGKATDRTRAKVQTKKAGETPVSATRSRTEETKEEAPTPAPMDVVLLLDGSSSITERVFKDQMLQFCREFAKQMGVSRKGNHLALVQFAGHCRTELGLTDYFNAKKLENAISMVRYLNGGTRLGGALLYTQKKVMASAR

SEQ ID NO: 167700 - protein, 101 aa, Heterodera glycines
  misc_feature (14)..(14): Xaa can be any naturally occurring amino acid
  Coding regions on vcDNA: vcDNA=SeqID_94123; Strand=-; Position=0-302
FFFFFFFFFFFFFXIFQLVLLLIMRTLKNKCGILQGHSLVLVFTLLFSPFGFLLPRVDCELSLFFFRRSPIAQLPSLFLLHSVLPWPIPFVSIFPVVLQSL

SEQ ID NO: 167701 - protein, 78 aa, Heterodera glycines
  misc_feature (64)..(65): Xaa can be any naturally occurring amino acid
  Coding regions on vcDNA: vcDNA=SeqID_94124; Strand=+; Position=3-236
PITGIQAQQIYSAFFLWHKLLTFPHLPCLFQFSYDTTFLNIHFYNFFKLILIHSTVYHKRNFIXXKKKKKKKKKKKKK

SEQ ID NO: 167702 - protein, 28 aa, Heterodera glycines
  Coding regions on vcDNA: vcDNA=SeqID_94125; Strand=-; Position=1-84
FFFFFFYVISTPLIIIRLEDRRRSVQQR

SEQ ID NO: 167703 - protein, 69 aa, Heterodera glycines
  Homolog annotation: Hit_ID=CAC84452.1; Match level="QueryCoverage =100%, HitCoverage=19%, E-value=7e-20, Identity=62%"; Hit description= polyglutamate synthase [Meloidogyne artiellia]
  Coding regions on vcDNA: vcDNA=SeqID_94126; Strand=+; Position=2-208
EEIARKIGKNRRPSGDVVVLSLHWGGNWGYEISKTERDFAHQLIDRGTVDILCGHSSIHPKAIEVYKGK

SEQ ID NO: 167704 - protein, 178 aa, Heterodera glycines
  Homolog annotation: Hit_ID=XP_242982.2; Match level="QueryCoverage =96%, HitCoverage=6%, E-value=3e-48, Identity=59%"; Hit description =similar to talin [Rattus norvegicus]
  Gene Ontology: Mol. function=structural molecule activity; Cellular component=focal adhesion; Biological process=cell adhesion
  Coding regions on vcDNA: vcDNA=SeqID_94127; Strand=+; Position=1-534
AASSAQQELVAQGRVADPGPANGSEEQQWTAGLVSAAKLVAAATNQLCEAANGLVQGHSTEEKLIAAAKQVASSTAHLLVACKVKCDLNSRAMQRLQSAGHAVKTATEHLVNAARQAITQEDCRGLVISEKIVTGITQMMDAHEEVLRKERELKEARNRLAQLNRSRYEKSPEPSPEK

SEQ ID NO: 167705 - protein, 169 aa, Heterodera glycines
  misc_feature (108)..(108): Xaa can be any naturally occurring amino acid
  Homolog annotation: Hit_ID=AAO49799.1; Match level="QueryCoverage =100%, HitCoverage=53%, E-value=8e-90, Identity=87%"; Hit description= arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_94128; Strand=+; Position=1-507
LTKENYVEMESKVKAVFEQLKGDADHFLFKEGDRFLQEANACRYWPTGRGIFHNAKKTFLVWVNEEDHLRIISMQNGGNVGQVLERLIKGVKAIESKVPFSRDDRLGXLTFCPTNLGTTVRASVHIRLPKISAKPDFKSICDGLKLQVRGIHGEHSESAGGVYDISNKA

SEQ ID NO: 167706 - protein, 143 aa, Heterodera glycines
  Homolog annotation: Hit_ID=CAE73168.1; Match level="QueryCoverage =99%, HitCoverage=36%, E-value=1e-54, Identity=71%"; Hit description =Hypothetical protein CBG20564 [Caenorhabditis briggsae]
  Coding regions on vcDNA: vcDNA=SeqID_94129; Strand=-; Position=107-538
SLSTSRQQFYGRIFAHYISDPNNLFVISSDFCHWGQRFRYTPIESNSGRPIHEQIANLDQQGMNAIATLDPTIFNEYLKKSQNTICGRNPICVMLQAAEYLRQMNNHTAELRFLKYAQSNKCRSMSDSSVSYASGALFISPRS

SEQ ID NO: 167707 - protein, 66 aa, Heterodera glycines
  Coding regions on vcDNA: vcDNA=SeqID_94130; Strand=-; Position=5-202
FFFFFFFFFFFFIFFFIKKFTVNSAGNTMTNLLVSDHNNPPGKCPPHSATTATRTELSYVVLFRSL

SEQ ID NO: 167708 - protein, 103 aa, Heterodera glycines; identical to SEQ ID NO: 148262
  Coding regions on vcDNA: vcDNA=SeqID_94131; Strand=+; Position=39-350

SEQ ID NO: 167709 - protein, 43 aa, Heterodera glycines
  Coding regions on vcDNA: vcDNA=SeqID_94132; Strand=+; Position=87-218
QSRLNKRTSLKPPYSAITPTKSNLNIKFPVMIYLMNSDGWLIN

SEQ ID NO: 167710 - protein, 22 aa, Heterodera glycines
  Coding regions on vcDNA: vcDNA=SeqID_94133; Strand=+; Position=2-67
HKCCFNPSLYINYYVKLKKLFA

SEQ ID NO: 167711 - protein, 145 aa, Heterodera glycines
  Coding regions on vcDNA: vcDNA=SeqID_94134; Strand=+; Position=3-437
SEKEKKVSKSTTEESSSIHCYGGNPKFKDQPEEWANSVCKDWTTWQIIEIPEFRFTYEYLDEPFRSWFKYQFYPDSIDVVKYVDDEYFEKYEGQTQDGKRHGEGVLTWKNGDVYKGPFKDDLAHGKFKLHRNDNHKFKLEFIKGM

SEQ ID NO: 167712 - protein, 123 aa, Heterodera glycines
  misc_feature (69)..(69): Xaa can be any naturally occurring amino acid
  Homolog annotation: Hit_ID=AAH41098.1; Match level="QueryCoverage =100%, HitCoverage=8%, E-value=3e-62, Identity=86%"; Hit description =UGCGL1 protein [Homo sapiens]
  Gene Ontology: Mol. function=UDP-glucose:glycoprotein glucosyltransferase activity; Cellular component=rough endoplasmic reticulum; Biological process=protein modification
  Coding regions on vcDNA: vcDNA=SeqID_94135; Strand=+; Position=1-370
APYGYTPFCDSRKSMDGFRFWRSGYWAQHLAGRKYHISALYVVDLVKFRQIAAGDRLRGQYQGLSSDPXSLSNLDQDLPNNMIHQVRIHSLPHEWLWCETWCDDVSKDSAKTIDLCNNPLTKE

SEQ ID NO: 167713 - protein, 97 aa, Heterodera glycines
  Homolog annotation: Hit_ID=NP_509734.1; Match level="QueryCoverage =97%, HitCoverage=32%, E-value=2e-31, Identity=61%"; Hit description =predicted CDS, cuticlin family member (XK952) [Caenorhabditis elegans] emb|CAA89068.1| Hypothetical prote
  Coding regions on vcDNA: vcDNA=SeqID_94136; Strand=+; Position=255-545
EDYPRGVFLSMRLVVAFHAQYLSKLDRVYDLRCFYMEMEHELEKPFTVRMDPPTMHSKQIQMPNCRYEVLSEGPHGPPVYYATVGQMIYHKWTCEAN

SEQ ID NO: 167714 - protein, 129 aa, Heterodera glycines
  Coding regions on vcDNA: vcDNA=SeqID_94137; Strand=+; Position=1-390
PQKQLLTVPGTNNNNNNSNNNSAIVGFVGDANGDHPPLSLENNTFFPRRRSGCSSSKRRRRERPFAVFGRAMRRLRHLFGSGVDLSKRVDIVSRVAFPTLYLAFLCFYYVRFVLFQSEEWETMGGAKKL

SEQ ID NO: 167715 - protein, 59 aa, Heterodera glycines
  Coding regions on vcDNA: vcDNA=SeqID_94138; Strand=-; Position=113-292
FPVGQPLDRFCFQKSPVDQFPFPGETIFSTKFSPTVTFKQCPGDKYLLRCENSKLINNF

SEQ ID NO: 167716 - protein, 93 aa, Heterodera glycines
  Coding regions on vcDNA: vcDNA=SeqID_94139; Strand=-; Position=0-278
SPPTPRELLRAHYSLDLLAMNDPSIATFFSRALRSLRPHSSVLECTDLLLTVDDCPGDFPFVASAACDQFMYVCRGTATTLDKAICPPGGAIL

SEQ ID NO: 167717 - protein, 158 aa, Heterodera glycines
  Coding regions on vcDNA: vcDNA=SeqID_94140; Strand=+; Position=2-475
LVSAVTYTPVSNGFSITASPSTSGQTCFTVHSAESGWAAIGVGSGSMSGADIYLGWKSSQGAISVGNFEGSGHVQPSANSVQNAQQVTLLETSPSWAKLSFSFCRPTAISSNGKSITSDQSYIYASSPDQPSGSSPSNLRFSQHAGTYGSFAIDFTST

SEQ ID NO: 167718 - protein, 159 aa, Heterodera glycines
  Homolog annotation: Hit_ID=NP_497963.1; Match level="QueryCoverage =99%, HitCoverage=72%, E-value=6e-17, Identity=31%"; Hit description =putative nuclear protein, with a coiled coil-4 domain, of bilaterial origin (27.0 kD) (3F788) [Caenorhabd
  Coding regions on vcDNA: vcDNA=SeqID_94141; Strand=+; Position=2-478
RTEDEAVIGGQTKVPWQADVQNSEREETEKNAGANVIEGVPKGFFDDEQMNSRVRETIEKQKKITSEIDRFYKEVEELEVQREDEREELNEQSALRSDIEMIDEQIERWKMVNELEKKKENIVESVATKFEQKPNFDPVEMSDDDDSDIVDFDRISWRT

SEQ ID NO: 167719 - protein, 103 aa, Heterodera glycines
  Coding regions on vcDNA: vcDNA=SeqID_94142; Strand=+; Position=11-322
MKFKLGTLPLFLLFSECLAVIPLSLSTERFLDNFEKMGKRSEVEYDQFIKGTGIPMIGFGKRDTEFDPATIPMMGFGKRGTGRPFRNNAMETKLQLWRMGLLG

SEQ ID NO: 167720 - protein, 155 aa, Heterodera glycines
  misc_feature (103)..(103): Xaa can be any naturally occurring amino acid
  Homolog annotation: Hit_ID=CAE59173.1; Match level="QueryCoverage =90%, HitCoverage=94%, E-value=1e-30, Identity=47%"; Hit description =Hypothetical protein CBG02480 [Caenorhabditis briggsae]
  Coding regions on vcDNA: vcDNA=SeqID_94143; Strand=+; Position=23-489
MAAASKSKYFELVSGFYKSYAAMQNFQRTAAKCRVVDVDEGRVKVEMEVQEEHTNTFGTLHGGLTATLVDIVTTTALCATRRGSAGVSVDLTVNYLAPAKIGXGDTILIDAFVNRRGQTMGFTGADIFRKSDGLKIATALHTKAFPREVSEAQEK

SEQ ID NO: 167721 - protein, 136 aa, Heterodera glycines
  Coding regions on vcDNA: vcDNA=SeqID_94144; Strand=+; Position=1-411
FAVFPLPISFGPSPVHFWLNCVRPISPLSRVWTLRQTHIGQAEELAQLRTMGEQMFCQEGMATELGGKLELTVRTVHQSRQYTSSDILQSLKYNAMMRRIGISEQLQCRIAKVLEEFDRVKRQLIKVRKGRSIANA

SEQ ID NO: 167722 - protein, 27 aa, Heterodera glycines
  Coding regions on vcDNA: vcDNA=SeqID_94145; Strand=-; Position=0-80
FFFFSHLFVLFFFWFSYNLFGIGHVFA

SEQ ID NO: 167723 - protein, 173 aa, Heterodera glycines
  misc_feature (129)..(129): Xaa can be any naturally occurring amino acid
  Homolog annotation: Hit_ID=AAH50603.1; Match level="QueryCoverage =90%, HitCoverage=25%, E-value=9e-31, Identity=48%"; Hit description =MGC3329 protein [Homo sapiens]
  Coding regions on vcDNA: vcDNA=SeqID_94146; Strand=+; Position=23-540
LLHFFISNRHLLILAEMHDRNIFKLCPPNYELLARKYHDFRVKCFIGAGGKVCVNFADAESVRLLSQILLIEYFQLNVQLPIGHLVPRVPQRLNYILLVEDLICKNNFDTSNVWGFDIGTNLSLTRITXIISGTGASCIFPLLGARLNGWNFVATEVDANSFAYAAQNVDRNN

SEQ ID NO: 167724 - protein, 24 aa, Heterodera glycines
  Coding regions on vcDNA: vcDNA=SeqID_94147; Strand=+; Position=44-115
SCAIIFIFLFLQFYQQICEKKKKK

SEQ ID NO: 167725 - protein, 32 aa, Heterodera glycines
  misc_feature (14)..(14): Xaa can be any naturally occurring amino acid
  Coding regions on vcDNA: vcDNA=SeqID_94148; Strand=-; Position=185-283
FFFFFFFFFFFFFXIGSFIHILLPKFNSADNE

SEQ ID NO: 167726 - protein, 88 aa, Heterodera glycines
  Homolog annotation: Hit_ID=CAE75428.1; Match level="QueryCoverage =78%, HitCoverage=25%, E-value=3e-09, Identity=40%"; Hit description =Hypothetical protein CBG23421 [Caenorhabditis briggsae]
  Coding regions on vcDNA: vcDNA=SeqID_94149; Strand=+; Position=1-267
MDENKRTKREPSEGAEGQVERYTYGNGEEAPMALNLNELDNRRLEESLTKIIAYMRKVHFYCLYCGCAFSSSEEIDFECPGIIRDDHE

SEQ ID NO: 167727 - protein, 87 aa, Heterodera glycines
  Coding regions on vcDNA: vcDNA=SeqID_94150; Strand=+; Position=1-264
WLGFFLLCDASKKDGNWSRKCSATFRIVSQKSGVEDFKREYNETVFNNEAKSWGNYFISFAELMDPSKGLYNKDEDNVTLAIDFTCE

SEQ ID NO: 167728 - protein, 115 aa, Heterodera glycines
  Homolog annotation: Hit_ID=AAO49799.1; Match level="QueryCoverage =100%, HitCoverage=31%, E-value=2e-60, Identity=100%"; Hit description=arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_94151; Strand=+; Position=104-451
QVLERLIKGVKAIESKVPFSRDDRLGWLTFCPTNLGTTVRASVHIRLPKISAKPDFKSICDGLKLQIRGIHGEHSESAGGVYDISNKARLGLTEFEAVKQMYDGVKHLIELEKKA

SEQ ID NO: 167729 - protein, 50 aa, Heterodera glycines
  misc_feature (21)..(24): Xaa can be any naturally occurring amino acid
  misc_feature (26)..(27): Xaa can be any naturally occurring amino acid
  misc_feature (30)..(30): Xaa can be any naturally occurring amino acid
  Homolog annotation: Hit_ID=AAO49799.1; Match level="QueryCoverage =100%, HitCoverage=12%, E-value=2e-12, Identity=78%"; Hit description= arginine kinase [Heterodera glycines]
  Coding regions on vcDNA: vcDNA=SeqID_94152; Strand=+; Position=1-151
TKENYVEMESKVKAVFEQLKXXXXMXXSWXGTYCPLQGMTKDVQNQLIAD

SEQ ID NO: 167730 - protein, 104 aa, Heterodera glycines
  Coding regions on vcDNA: vcDNA=SeqID_94153; Strand=+; Position=238-549
LAQLNSNQFIHYISLTWFKFNFAFRSLPEDFHFEYGAGQIQRKNSFVGSARLFKKQMTRRARVLKRTLNQLRGREMATKIDQKSRIIFPAAFLLMNVFYWSYYL

SEQ ID NO: 167731 - protein, 92 aa, Heterodera glycines
  Coding regions on vcDNA: vcDNA=SeqID_94154; Strand=+; Position=1-279
VFHAFASQQWLLNFELIELRKPFQRQNRLLGVGRLALISNNESIEMEMELIRPIEKRKAPIGGEGKGRGKVGEETIGKARIEISAYDDPFYI

SEQ ID NO: 167732 - protein, 80 aa, Heterodera glycines
  Coding regions on vcDNA: vcDNA=SeqID_94155; Strand=+; Position=44-286
MALSAIKLLSLFLLVLCIGMAIEQTQAYYGWGGYGYGYPYGFYGKRQAGFGPSANVGTFGRNEGENANGGGGGPFSLNNF

SEQ ID NO: 167733 - protein, 160 aa, Heterodera glycines
  Coding regions on vcDNA: vcDNA=SeqID_94156; Strand=+; Position=1-483
QMEEEEQMEEEEEEEEEEPTPEQMARWRRRRLLPNEVVSDICEFMSFAEGSRLYTSSGLFVALLEPKRKLCLAMFLKRVEETRQKLDKTIEEVNERRRHVVQLTENIGTINARLAEMGNHLANLDTQIVVNHLKLDELHKRIAALKEPMGKLRSEGRDEK

SEQ ID NO: 167734 - protein, 147 aa, Heterodera glycines
  misc_feature (39)..(39): Xaa can be any naturally occurring amino acid
  misc_feature (54)..(54): Xaa can be any naturally occurring amino acid
  misc_feature (66)..(66): Xaa can be any naturally occurring amino acid
  Homolog annotation: Hit_ID=T02995; Match level="QueryCoverage=81%, HitCoverage=22%, E-value=2e-34, Identity=72%"; Hit description =unspecific monooxygenase (EC 1.14.14.1) - common tobacco dbj|BAA10929.1| cytochrome P450 like_TBP [Nicotiana t
  Coding regions on vcDNA: vcDNA=SeqID_94157; Strand=+; Position=2-445
IPHKSFHKVGLESSSTGSSFPADYSKPVPLAVGSLDSRXDSGNLIDPFMRVTNXMTRHLATLRESXVTPAVYLRLVEFLHFDIQSTGQKSHCVNTFSGHHNALFLLNSRIPLVRFSSELAVDCIEDLPRSESRQSCRPQLPAASKTA

SEQ ID NO: 167735 - protein, 63 aa, Heterodera glycines
  Coding regions on vcDNA: vcDNA=SeqID_94158; Strand=-; Position=171-362
LISIIKCALIWCDCNTNGNKQFVLIYPSPLLVSQWPMEEGTSRISSTSRQIRRSDDGWMDDPR

SEQ ID NO: 167736 - protein, 179 aa, Heterodera glycines
  Homolog annotation: Hit_ID=NP_496710.1; Match level="QueryCoverage =97%, HitCoverage=8%, E-value=3e-61, Identity=65%"; Hit description =u5 small nuclear ribonucleoprotein helicase (2N18) [Caenorhabditis elegans] emb|CAB60351.1| Hypothetical p
  Gene Ontology: Mol. function=ATP dependent RNA helicase activity; Cellular component=spliceosome complex; Biological process=RNA splicing
  Coding regions on vcDNA: vcDNA=SeqID_94159; Strand=+; Position=1-537
SPQVKVNLLLHAHLMRIQLSAELTKDTDWIVLKTVRLVQACVDVLSSNGWLSPAIHAMELSQMLTQAMYSNESYMKQLPHCTPELLERCKEKKVESIFELLELNDEDRDELLQMNQAQLADIAVFCNNYPSIEVRHEITTQKSTVGQPVEIRIDLERENDFNGFAPSVIAPFFPRYPYP

SEQ ID NO: 167737 - protein, 171 aa, Heterodera glycines
  Homolog annotation: Hit_ID=CAE67798.1; Match level="QueryCoverage =99%, HitCoverage=25%, E-value=1e-15, Identity=28%"; Hit description =Hypothetical protein CBG13376 [Caenorhabditis briggsae]
  Coding regions on vcDNA: vcDNA=SeqID_94160; Strand=+; Position=3-515
MVGHKRWAHFERMRHRLDTLRERFNSLHCTVDRWNARVPGLNSSGKGTTVRSTQSMLAKHPELHIDRLAQAWPELFADFADDQNLEERLRNEHRYASQEKHARAQIEELRKEMSMALPHDLDYQSMEFMRPELRDAMDERKPNSLAAAARVPGINDTALHFLLRYVKMRRQ

SEQ ID NO: 167738 - protein, 118 aa, Heterodera glycines
  Coding regions on vcDNA: vcDNA=SeqID_94161; Strand=+; Position=157-510
LIRLLKKDEIEENTTEMNEFGQIVSQICHKNGMENGQMVLRKISTLGQQILAQLKMAEKKTQKFVYGQNRQQEAGLPLAKFGTEMMAFVKRLPDKMPEKSAFVDKLKAMETNLSLPSD

SEQ ID NO: 167739 - protein, 164 aa, Heterodera glycines
  Homolog annotation: Hit_ID=YP_005449.1; Match level="QueryCoverage =94%, HitCoverage=17%, E-value=1e-19, Identity=34%"; Hit description =alanyl-tRNA synthetase [Thermus thermophilus HB27] gb|AAS81822.1| alanyl-tRNA synthetase [Thermus thermop
  Gene Ontology: Mol. function=tRNA binding; Cellular component =cytoplasm; Biological process=reproduction
  Coding regions on vcDNA: vcDNA=SeqID_94162; Strand=+; Position=32-523
QESIDVAYRIVSDHMRAVTVALADGIGFTNQQQKKSSRKIKELFKRATIYGSQMLGMERMSMHLMVPVIVEQLGETFPEMAQNKHKIADAVRIEEERLWKQRDDGMRHLEELFRNHPPTSKVFPGKFAFIIVQNYRIELELVKRKAAQRGLTVDEAEYQRLHAQ

SEQ ID NO: 167740 - protein, 133 aa, Heterodera glycines
  Homolog annotation: Hit_ID=NP_505961.1; Match level="QueryCoverage =64%, HitCoverage=19%, E-value=2e-18, Identity=48%"; Hit description =RHesus antigen Related (51.0 kD) (rhr-2) [Caenorhabditis elegans] emb|CAA98418.1| Hypothetical protein B0
  Gene Ontology: Mol. function=transporter activity; Cellular component= integral to membrane; Biological process=embryogenesis and morphogenesis
  Coding regions on vcDNA: vcDNA=SeqID_94163; Strand=+; Position=49-447
MAYKVQNAVSNTLQRRQFSVLACVFQSLFVVLFASFGEFHNHEEDKHNRVHANYPMFQDIHTMVIIGFGFLLSFLKKYGFSALSINLLLSSFFPSFNAGSIPHSTPEMRHRATRDLRTQAFFQLAGLALTFLM

SEQ ID NO: 167741 - protein, 7 aa, Heterodera glycines
  Coding regions on vcDNA: vcDNA=SeqID_94164; Strand=-; Position=1-21
FFNFYFI

SEQ ID NO: 167742 - protein, 63 aa, Heterodera glycines
  Coding regions on vcDNA: vcDNA=SeqID_94165; Strand=-; Position=3-191
KKHIKLERNEVERYSQSCKYRVDKAGDWRGITIIRQERDGNSKITINNYVGWQRKKGAKMRKK

SEQ ID NO: 167743 - protein, 135 aa, Heterodera glycines
  Homolog annotation: Hit_ID=AAO31950.1; Match level="QueryCoverage =87%, HitCoverage=32%, E-value=3e-28, Identity=50%"; Hit description =MAP kinase JNK [Aedes albopictus]
  Gene Ontology: Mol. function=JUN kinase activity; Cellular component =nucleus; Biological process=JNK cascade
  Coding regions on vcDNA: vcDNA=SeqID_94166; Strand=+; Position=3-410
PTVRQYVESRPRIDARPWQQIFPDISFPPDFVKERVKLDALLARDLLSQMLVIDPNNRINVQEALKHPYVNLWYDAGEVDGPAPTPYIEPTHGANLNVEQWKELIYNQIKDFERTRDIFGIGVTMNGDGEMLDET

SEQ ID NO: 167744 - protein, 123 aa, Heterodera glycines
  Coding regions on vcDNA: vcDNA=SeqID_94167; Strand=+; Position=2-373
LLKFHPDKYGNDEKMVKLAKQAFQVVEGLYKECNKLLLTIQSKAANRLNRSFSQSATSFHRTAYESAINEHNSSNYNHRKSVDATSSSSYFSQTDMNAKKSYQRSNSAIPTNQNINRMFTADE

SEQ ID NO: 167745 - protein, 92 aa, Heterodera glycines
  misc_feature (88)..(90): Xaa can be any naturally occurring amino acid
  Coding regions on vcDNA: vcDNA=SeqID_94168; Strand=+; Position=91-366
FPSNFPPSFCCCFCSLCCTFLHRPMLVPNGITPTQFRWPTIVALFSTICGDGSDLALKKTNKTIVNLCIILCKVLFNFVLINAINSKXXXKK

SEQ ID NO: 167746 - protein, 99 aa, Heterodera glycines
  Coding regions on vcDNA: vcDNA=SeqID_94169; Strand=+; Position=3-302
DCIRQIAQGRGWQAATANLRSRSRMSESKFVVTNRRYTMSSSSGSPLSKPSFSFFLTTSNKCITTLRRTFNQNATGDISCDILQQQQAIRFMEGHDLFL

SEQ ID NO: 167747 - protein, 184 aa, Heterodera glycines
  Homolog annotation: Hit_ID=CAE63214.1; Match level="QueryCoverage =100%, HitCoverage=44%, E-value=5e-87, Identity=79%"; Hit description= Hypothetical protein CBG07571 [Caenorhabditis briggsae]
  Gene Ontology: Mol. function=calcium ion binding; Cellular component =smooth endoplasmic reticulum; Biological process=regulation of muscle contraction
  Coding regions on vcDNA: vcDNA=SeqID_94170; Strand=+; Position=2-553
MTIINDQFDLEEFEALDDDCVRIIGYFEPGSAALKEFEEAAEEFMGEIEFFAVVTSYWAKKTGLKRIGEVQLHHPFEDDPIYAPSSVDTEEEFEQWVEKHREPVMQKLQLDNYFNLWKDPEEDEKLVLVFCDEETREGRAMFKLMKKLADENQEHAGTLEIVLIDPDEFPLMVDVWEEMFGIDI

SEQ ID NO: 167748 - protein, 150 aa, Heterodera glycines
  Homolog annotation: Hit_ID=CAE61272.1; Match level="QueryCoverage =83%, HitCoverage=94%, E-value=1e-23, Identity=45%"; Hit description =Hypothetical protein CBG05087 [Caenorhabditis briggsae]
  Coding regions on vcDNA: vcDNA=SeqID_94171; Strand=+; Position=13-465
MFPLFTQLPFPSLLLFLSNFPSFAISFRLQGVGVKGVLLCNGAFAAHTNLAIFDVDRNPGDSDDLLDKGHTDGKGRFVLDGTTRELSQIEPELRIIHDCADDIKPCHRLFVIKVPPEFIHSGRAHKIFDIGTLDLEKKREDEQRTCQNNF

SEQ ID NO: 167749 - protein, 114 aa, Heterodera glycines
  Homolog annotation: Hit_ID=CAE68824.1; Match level="QueryCoverage =98%, HitCoverage=15%, E-value=2e-33, Identity=58%"; Hit description =Hypothetical protein CBG14783 [Caenorhabditis briggsae]
  Gene Ontology: Mol. function=long-chain-fatty-acid-CoA-ligase activity; Biological process=gametogenesis
  Coding regions on vcDNA: vcDNA=SeqID_94172; Strand=+; Position=1-345
VDNICVYGNPQKDYLIALVVPNRKNLQALAEKNAVNESSWEAICANKEMAKLLEKELQNFVSGKLRREEIPRKVIICAEPWTADSGMLTEALKLKRKNIERKFAEEIRQLYEGK

SEQ ID NO: 167750 - protein, 137 aa, Heterodera glycines
  Homolog annotation: Hit_ID=CAE75284.1; Match level="QueryCoverage =86%, HitCoverage=53%, E-value=6e-10, Identity=30%"; Hit description =Hypothetical protein CBG23251 [Caenorhabditis briggsae]
  Coding regions on vcDNA: vcDNA=SeqID_94173; Strand=+; Position=13-448
MSQVRPNSYLSLEGFPEGQGYCARTRTVPDMTGHVRMPDRYKPHWGKYRDRRYPPGRRFLHKTFGLLQNPHRSNAYFYFSPLYYQSLHSERYPPTADLAPFKYNTDWALYKGPWFDYTEWFHYKRWYPPFYDMHAYH

SEQ ID NO: 167751 - protein, 152 aa, Heterodera glycines
  Coding regions on vcDNA: vcDNA=SeqID_94174; Strand=+; Position=3-458
KIHSLMICPTFSFIFAFALVRLCFGNKVIEVDGSIQEKLVLKKVNVSEDYVHYFNKFGKLGQNYFIGINENDEATKSYLPYINCQKYNKNDCDKGRSDGCMKTVKCVVTDPIRGSQQLACMANYYLRDASPNKSFSEGDIIEPSLMDCWQHE

SEQ ID NO: 167752 - protein, 65 aa, Heterodera glycines
  Coding regions on vcDNA: vcDNA=SeqID_94175; Strand=+; Position=3-197
HSSYCAVVLPFFMMCSVETDLQITVAYHFISLLPSLSLCSNFSHPFTMLKIQIWRFVHTNKAIIY

SEQ ID NO: 167753 - protein, 173 aa, Heterodera glycines
  Coding regions on vcDNA: vcDNA=SeqID_94176; Strand=+; Position=3-521
EFIFGFTGDDSSKYNGPYKLELFNGLETIDQCISSDNSSVVFSDTCKAQYPPEVVESAIALLHIVNEQRNSSSKAKQQQHHHAQALFSVLAAYLCNVGKGETETNACREKHLDKAKRMYEKMGNNEVTEKQIMEMQKARQTVFDTIIAYNDAKTGEAVHEAIVAVRKAVSASP

SEQ ID NO: 167754 - protein, 38 aa, Heterodera glycines
  Coding regions on vcDNA: vcDNA=SeqID_94177; Strand=+; Position=29-142
LKKNHSFLHGFIFSELSFNLKIINLSLNKGCFLKKKKK

SEQ ID NO: 167755 - protein, 62 aa, Heterodera glycines
  Coding regions on vcDNA: vcDNA=SeqID_94178; Strand=-; Position=19-207
IQLSSAIVLTAQMRRMLILCAEAWRRDEPVLLVGETGCGKTTAVHQFVRLHICNWHFSFINF

SEQ ID NO: 167756 - protein, 84 aa, Heterodera glycines
  Coding regions on vcDNA: vcDNA=SeqID_94179; Strand=+; Position=239-490
LNLWIEPINNLSGELSLTLWPLKILINPLTPFHVYRQPIKKSFLKWPCMFSFLEIFKTFFAAYKGTLRTVSRKMHICYIPLDRA

SEQ ID NO: 167757 - protein, 23 aa, Heterodera glycines
  Coding regions on vcDNA: vcDNA=SeqID_94180; Strand=+; Position=3-71
QFCHLFFLNIMFCLIMRIKLDNT

SEQ ID NO: 167758 - protein, 148 aa, Heterodera glycines
  Homolog annotation: Hit_ID=NP_498662.1; Match level="QueryCoverage =97%, HitCoverage=21%, E-value=1e-23, Identity=43%"; Hit description =putative protein, with at least 8 transmembrane domains, of ancient origin (69.0 kD) (3I666) [Caenorhabdi
  Coding regions on vcDNA: vcDNA=SeqID_94181; Strand=+; Position=3-449
ASATSYVSIVSPTHLKGTSQHILALLFNGLGRGVGPIIGGFFIRQYGTRALFLSIAFLTLCVLAVYYAVNLKLKNESVKYSGFDAFDEDTAGGETLAPQGLPMHRFGGNKITEAFNQTAVTNQNYGAIEANSEEKQRDDAYDRYVTGQ

SEQ ID NO: 167759 - protein, 172 aa, Heterodera glycines
  Homolog annotation: Hit_ID=NP_508470.1; Match level="QueryCoverage =100%, HitCoverage=37%, E-value=2e-40, Identity=42%"; Hit description= ectonucleotide pyrophosphatase phosphodiesterase (53.1 kD) (XD230) [Caenorhabditis elegans] gb|AAA81706.
  Gene Ontology: Mol. function=nucleotide pyrophosphatase activity; Cellular component=integral to plasma membrane; Biological process =phosphate metabolism
  Coding regions on vcDNA: vcDNA=SeqID_94182; Strand=+; Position=2-517
PNWFSLATGLYVESHNFTSDFMFAPNSSMLFQRDIGANDSNPFWWTGNRAPFWYAVGKAGIDVHCYWFPACHKAHVDLIVQVPQNRRHSFNNSNSIDLLPHLPTIVKHIKKYQPYRQQLVLLRYNGLDKALRSGGQSSSQTRQALSTVDNYLRKIQEELDTMDLHQSTNLVV

SEQ ID NO: 167760 - protein, 39 aa, Heterodera glycines
  Coding regions on vcDNA: vcDNA=SeqID_94183; Strand=-; Position=391-510
YQQLYNCSYDVNQVPFEDRQHIALGIHLNINSLFSELNN

SEQ ID NO: 167761 - protein, 41 aa, Heterodera glycines
  Coding regions on vcDNA: vcDNA=SeqID_94184; Strand=+; Position=3-125
KKVAAPALAHQPNDRLKQPMEGTNDLFIHSFFFVFYYCAVI

SEQ ID NO: 167762 - protein, 55 aa, Heterodera glycines
  misc_feature (44)..(44): Xaa can be any naturally occurring amino acid
  Coding regions on vcDNA: vcDNA=SeqID_94185; Strand=+; Position=1-165
NAEKGANGDGQTANSEIFNCFFSLCIFLFVYFVRIAQLNLTLFXKKKKKKKKKKK

SEQ ID NO: 167763 - protein, 70 aa, Heterodera glycines
  Coding regions on vcDNA: vcDNA=SeqID_94186; Strand=-; Position=1-210
KFCLHLIHTKTICVVERASLCSVTLLHEQRVGPQRLLLGPVQHHGKVVRSEEHGQDHHPLAHLEGDLLVS

SEQ ID NO: 167764 - protein, 81 aa, Heterodera glycines
  Coding regions on vcDNA: vcDNA=SeqID_94187; Strand=+; Position=3-248
NIDKVALLLELFERRHLPLTNEDFFHNPAILRDFGPTGKCAVRASPFYYPLANYTDTCTASYYFSGSFIHACESYIVYFFV

SEQ ID NO: 167765 - protein, 134 aa, Heterodera glycines
  Homolog annotation: Hit_ID=NP_499157.1; Match level="QueryCoverage =61%, HitCoverage=10%, E-value=4e-24, Identity=60%"; Hit description =vps53-like, N-terminal (3K844) [Caenorhabditis elegans] emb|CAA81595.1| Hypothetical protein T05G5.8 [Cae
  Coding regions on vcDNA: vcDNA=SeqID_94188; Strand=+; Position=1-402
ERRRGELDWKLLSHAINHTQMFEQLLAKRFPSKNNYNFDRVIWSVFDSHMDIFVQEQRGKLLRFLDECALRIRSGEEKPQRETMCEPSLQAMNKINWSNVDQVGDESPYVSTIRKNLRASVPLIRDYFRTSKIF

SEQ ID NO: 167766 - protein, 114 aa, Heterodera glycines
  Homolog annotation: Hit_ID=NP_499625.2; Match level="QueryCoverage =94%, HitCoverage=21%, E-value=1e-11, Identity=33%"; Hit description =CD36 antigen family member (60.2 kD) (3N544) [Caenorhabditis elegans] emb|CAB11566.3| Hypothetical protei
  Gene Ontology: Mol. function=transporter activity; Cellular component= plasma membrane; Biological process=apoptosis
  Coding regions on vcDNA: vcDNA=SeqID_94189; Strand=+; Position=3-523
SVIALLIFGIICLCFGIFSLIFAPKLVNKAIRENVFVGRFPNGSDNFAMEQYRDPKYDVKMQIWVFSVQNPNEIVNKGEKVNVTELGPFTYDIRMHKNNVKFGSNDSRLFYRNV

SEQ ID NO: 167767 - protein, 129 aa, Heterodera glycines
  Coding regions on vcDNA: vcDNA=SeqID_94190; Strand=+; Position=14-403
TGEALRLLIAEPERIERLHSNAIVLHQLIRNALEGTKFGLISIDCAPQKHIEYRTKDGEGREIVEQKLDRMVNRLLDHGILVTRARYLLDKEKFCPKLTIKVSCRADLNGDELENLGQKLRLTFATLEF

SEQ ID NO: 167768 - protein, 64 aa, Heterodera glycines
  Homolog annotation: Hit_ID=AAQ84177.1; Match level="QueryCoverage =54%, HitCoverage=4%, E-value=6e-11, Identity=82%"; Hit description =Smad4 [Schistosoma mansoni]
  Gene Ontology: Mol. function=transcription cofactor activity; Cellular component=cytoplasm; Biological process=SMAD protein heteromerization
  Coding regions on vcDNA: vcDNA=SeqID_94191; Strand=+; Position=323-514
MPADEVESCGKSAQICLPLSFFLYRRTVSLSFVKGWGEGYGRRTIKETPCWIEVQLHRPLQLLN

SEQ ID NO: 167769 - protein, 179 aa, Heterodera glycines
  Homolog annotation: Hit_ID=CAE72223.1; Match level="QueryCoverage =100%, HitCoverage=34%, E-value=3e-77, Identity=78%"; Hit description= Hypothetical protein CBG19334 [Caenorhabditis briggsae]
  Coding regions on vcDNA: vcDNA=SeqID_94192; Strand=+; Position=3-539
YPHLNRGDLYTKQGILSMLQSGIKVEPLLLKDWSAVMDWAPHPEHKGEYLQLWGNHNLDRAVAQSQAFINECRRALGLSMKFWVAEIHEIVKNTILHYSEIRGKCNELNDALKQLDLTATPHKIRTTPSKRRSFIDMHELRDKLLMRGGTSTEGGAGKGAKNGSSVSVASEEAHAQAMV

SEQ ID NO: 167770 - protein, 140 aa, Heterodera glycines
  Homolog annotation: Hit_ID=NP_524463.2; Match level="QueryCoverage =98%, HitCoverage=24%, E-value=2e-43, Identity=60%"; Hit description =CG10161-PB [Drosophila melanogaster] gb|AAF56158.1| CG10161-PB [Drosophila melanogaster]
  Gene Ontology: Cellular component=eukaryotic 48S initiation complex; Biological process=cell organization and biogenesis
  Coding regions on vcDNA: vcDNA=SeqID_94193; Strand=-; Position=1-519
GTAITLVARTEHDAVMLAGTSTKEVQKLTVKAFNEWDSSLSGGVDWRSKLDIQKGAVLATEMRNNSFKLAKWTLQAILVGSDYIKLGYVSRVNSRNSTQHIILGTQQFRPNESASNMNLNLDTCWGILRAIIDFFMEKPP

SEQ ID NO: 167771 - protein, 21 aa, Heterodera glycines
  misc_feature (1)..(1): Xaa can be any naturally occurring amino acid
  Coding regions on vcDNA: vcDNA=SeqID_94194; Strand=-; Position=3-65
XSTFFFFLTEKHLLQTKKPNS

SEQ ID NO: 167772 - protein, 46 aa, Heterodera glycines
  Coding regions on vcDNA: vcDNA=SeqID_94195; Strand=+; Position=103-243
IFCWSNHQSPFFNHELTSFAIPPTFYHEIFIYIYIFCFFSWKTRSQ

SEQ ID NO: 167773 - protein, 72 aa, Heterodera glycines
  Coding regions on vcDNA: vcDNA=SeqID_94196; Strand=-; Position=0-215
ICFFLLFFYKIYGGKNYSSASSALIVLRSCNTIANFSNALQFSSRNSLAFSVASSMVSRTALSRALFSLFLP

SEQ ID NO: 167774 - protein, 54 aa, Heterodera glycines
  Coding regions on vcDNA: vcDNA=SeqID_94197; Strand=+; Position=1-162
FAKLFKYVPPPLFRRSAGVLRHVQLGLGTNCRHCWCFARWRRCWPRGRSACRRW

SEQ ID NO: 167775 - protein, 142 aa, Heterodera glycines
  Homolog annotation: Hit_ID=NP_503408.1; Match level="QueryCoverage =68%, HitCoverage=66%, E-value=1e-10, Identity=35%"; Hit description =putative secreted or extracellular protein precursor (5B870) [Caenorhabditis elegans] gb|AAF60880.2| Hypo
  Coding regions on vcDNA: vcDNA=SeqID_94198; Strand=+; Position=14-442
MSKSFINIIIQFLFLLCLFYNFAKSFGEKSAPNPQQSPNFQQIPSDVLSVLSKDVAAQLEAIQNNGTLTVHEKAEQIDQIMTEQPSEVLDKIPDPPNFGTLPMNVKNHIKQILRQKGKSLDEKETELEEYVQSLQEDKPKEA

SEQ ID NO: 167776 - protein, 146 aa, Heterodera glycines
  Coding regions on vcDNA: vcDNA=SeqID_94199; Strand=+; Position=3-440
DTAHLEDTFLMSGVLGHERESDPLSRTQPVEEGKGEREEERKLNSTYPLTTPHNKVYLTEPNRTQTIEDGPTLLNLTHPVAIGGTAGEEPPKQQQHKQSQEHTDEEQRDISALAGVVPYPVTDDSSLLLLDPALATACPLINIIDS

SEQ ID NO: 167777 - protein, 65 aa, Heterodera glycines
  Coding regions on vcDNA: vcDNA=SeqID_94200; Strand=+; Position=2-199
LHTRRTHSFRRSICADAMEFVGDPFVLWPDQNTGDGVYWHPNGPLHLGLPNSARPSLNKAKKRSN

SEQ ID NO: 167778 - protein, 77 aa, Heterodera glycines
  Coding regions on vcDNA: vcDNA=SeqID_94201; Strand=+; Position=3-236
WPTNLLSPSVENCFAGSLLLLVANVFLRKGETRHVHCLIRTLCQITKPNLTQKRIKHIDMFFCHVFDFCPFLLPNFL

SEQ ID NO: 167779 - protein, 49 aa, Heterodera glycines
  Coding regions on vcDNA: vcDNA=SeqID_94202; Strand=-; Position=2-148
FFFFSTFFLIHFTMKGGPAVPIGAARTIFAFLMQFVNRFIHKKAKICGF

SEQ ID NO: 167780 - protein, 29 aa, Heterodera glycines
  Coding regions on vcDNA: vcDNA=SeqID_94203; Strand=-; Position=0-86
FFFFFKILRSFFFKIRLPKTIPLMNDHRL

SEQ ID NO: 167781 - protein, 58 aa, Heterodera glycines
  Coding regions on vcDNA: vcDNA=SeqID_94204; Strand=+; Position=376-549
HHRHKLCDCFCIQYLTTMVNVVHFVQYPSKKPKTIFYIKIYFVWNMPMYCNNIIICST

SEQ ID NO: 167782 - protein, 26 aa, Heterodera glycines
  Coding regions on vcDNA: vcDNA=SeqID_94205; Strand=-; Position=2-79
LLSNRKTANKKLVQNKNNLIEFYMAI

SEQ ID NO: 167783 - protein, 75 aa, Heterodera glycines
  Coding regions on vcDNA: vcDNA=SeqID_94206; Strand=+; Position=1-228
DPTTRICLRERERCRTRTKDAMANGRIVPMPNVIGFINFKYFFNDGRFMLFCLSLFTHLLLLSIIFLFDLILRFL

SEQ ID NO: 167784 - protein, 77 aa, Heterodera glycines; identical to SEQ ID NO: 148315
  Coding regions on vcDNA: vcDNA=SeqID_94207; Strand=+; Position=85-315

SEQ ID NO: 167785 - protein, 19 aa, Heterodera glycines
  Coding regions on vcDNA: vcDNA=SeqID_94208; Strand=-; Position=2-58
NPRSLSVIKVQITNSDQNT

SEQ ID NO: 167786 - protein, 142 aa, Heterodera glycines
  Homolog annotation: Hit_ID=AAF20016.1; Match level="QueryCoverage =78%, HitCoverage=18%, E-value=1e-17, Identity=41%"; Hit description =asparaginase [Dirofilaria immitis] sp|Q9U518|ASPG_DIRIM L -asparaginase (L-asparagine amidohydrolase) (DiAs
  Coding regions on vcDNA: vcDNA=SeqID_94209; Strand=+; Position=1-429
RDANDENALLCAVRSRNLVVISMVRQAGGQLVVPRPRIGVELCLSAGTGGLDALKAWHAAGANLSTPDYEGRTALHIAASRGFDELCFWLCENGADPLLRDRLGRSPAEDARANIDEHMVQGLLAPNFQRIFAFFGTPWKGT

SEQ ID NO: 167787 - protein, 184 aa, Heterodera glycines
  misc_feature (107)..(107): Xaa can be any naturally occurring amino acid
  Homolog annotation: Hit_ID=NP_492192.1; Match level="QueryCoverage =98%, HitCoverage=54%, E-value=4e-19, Identity=32%"; Hit description =muscle-derived protein MDP77 (38.3 kD) (1I521) [Caenorhabditis elegans] emb|CAA99923.2| Hypothetical prot
  Gene Ontology: Mol. function=transcriptional repressor activity; Cellular component=nucleus; Biological process=negative regulation of transcription from Pol II promoter
  Coding regions on vcDNA: vcDNA=SeqID_94210; Strand=+; Position=1-553
NTKLNSVEKLLSKTEVAKSKMEQLCRELNKAHREEKEQNQLRCKQMQNVHADTVESFKKSLAEIQLSVEEKREHNKRVADVEKLSEHLNQLTSDYETRLAELKKIVXERESNLGVIAKTKDSELDTLHLQIGEMQKRVQQVFAENVELKKEPLSSEDRVKKSIESEIGMRKFVDDYSEKYSELT

SEQ ID NO: 167788 - protein, 139 aa, Heterodera glycines
  Coding regions on vcDNA: vcDNA=SeqID_94211; Strand=+; Position=1-417
PKEAVEEEHGEEEGHNNIHFMYSITLDHYRTRPLVTVSTHSVQKPSFVSFFPFQCRPLFLIRSFASISLPKHKSRHNPSHPNSFLFLFPLIFSLIPLPPLNALTNPKDFQILFHSNFKFANNKCITIKKKKKEKKKKKK

SEQ ID NO: 167789 - protein, 27 aa, Heterodera glycines
  misc_feature (23)..(23): Xaa can be any naturally occurring amino acid
  Coding regions on vcDNA: vcDNA=SeqID_94212; Strand=-; Position=2-85
FFFFFFLFFFLAVQIYYIYILRXKQIQ

SEQ ID NO: 167790 - protein, 47 aa, Heterodera glycines
  misc_feature (9)..(9): Xaa can be any naturally occurring amino acid
  Coding regions on vcDNA: vcDNA=SeqID_94213; Strand=-; Position=397-541
PPMPPPPPXGCRPQIVAHHPPQHRRLCRSRSALIWPLNSILVGSQLN

SEQ ID NO: 167791 - protein, 91 aa, Heterodera glycines
  Coding regions on vcDNA: vcDNA=SeqID_94214; Strand=+; Position=264-536
MRDYMPRGIHLHRICHSSMRFNIVFIQQKWTMGAVKLSVSKAFAANEIVPDVVSKAPEKLVTVEYAVGVCAKLGNELAPKNLTNAPKLSWD

SEQ ID NO: 167792 - protein, 129 aa, Heterodera glycines
  Homolog annotation: Hit_ID=CAE61993.1; Match level="QueryCoverage =100%, HitCoverage=19%, E-value=4e-27, Identity=47%"; Hit description= Hypothetical protein CBG06001 [Caenorhabditis briggsae]
  Gene Ontology: Mol. function=ubiquitin-like conjugating enzyme activity; Cellular component=cytoplasm; Biological process=membrane fusion
  Coding regions on vcDNA: vcDNA=SeqID_94215; Strand=+; Position=2-391
ISRSGISMIASGIATELLASVLQHELGAEAPALLAEVDENASQLGATPHQIRGFMSRFHLMMPTVRRYDRCTACGHTVKQFYRTEGFEFLNRIFQCPAELEQITGLAELQRQADAFQSEVIEMDDSESI

SEQ ID NO: 167793 - protein, 33 aa, Heterodera glycines
  Coding regions on vcDNA: vcDNA=SeqID_94216; Strand=+; Position=2-103
NAFGFAPCTFMFHSFPSVYPIIALTSFLDDKYD

SEQ ID NO: 167794 - protein, 147 aa, Heterodera glycines
  Coding regions on vcDNA: vcDNA=SeqID_94217; Strand=+; Position=3-443
LSNSIEVWSSSPSQQNNNGSPAETVGEAPSLRQMQLQKNIKMLALHTLHDVVSVGPDLPSVEQYEQKKLDNQQRAMVAMRRHSGAVMAPTNNQQQQQHGTPTADHDDLVRNAQNPFIKTASILTRKMARDRPSSSSFSEFLFGDETA

SEQ ID NO: 167795 - protein, 91 aa, Heterodera glycines
  Coding regions on vcDNA: vcDNA=SeqID_94218; Strand=+; Position=25-300
HPIFHHFLRGLDTNLWSKALIASGFDINCQLTTFPSHPKRSRTKTRNSTICWRQTKAVGRTKDRPISVSNTDTRDRWIYGDNLFFSDGIFS

SEQ ID NO: 167796 - protein, 184 aa, Heterodera glycines
  Homolog annotation: Hit_ID=NP_638970.1; Match level="QueryCoverage =97%, HitCoverage=54%, E-value=4e-58, Identity=61%"; Hit description =arabinogalactan endo-1,4-beta-galactosidase [Xanthomonas campestris pv. campestris str. ATCC 33913] gb|AA
  Coding regions on vcDNA: vcDNA=SeqID_94219; Strand=+; Position=8-559
MHSLKLAFLCQLCVLLIGTASAAFYKSADVSWVSQQEKNGQSFYDSSGTKKDPFVLLKSYGVNAVRLRVWVNPSGGWCDGADTLHKAQRAKAQGMAIMIDFHYSDSWADPGQQNIPAAWKSHSLAQLNTDVYEHTYGILNYLKSNGISVAWVQVGNEINSGMMWPSGKVTNSNFAKLASLINNG

SEQ ID NO: 167797 - protein, 151 aa, Heterodera glycines
  Coding regions on vcDNA: vcDNA=SeqID_94220; Strand=-; Position=1-453
TEFYKPCQQKIEYLHQNDSYQLFKFSNSKYSSVYNKRLLELGIMGRPLLKQPKELENEKAIKLEKEKAKELENECNSVVEQTLRHILRTNKNAKHVVLVSHLGVIALIHELLSGEWVSVGQTTVSKFVQYAEKDSQNVDDELKRFRLEYSS

SEQ ID NO: 167798 - protein, 38 aa, Heterodera glycines
  Homolog annotation: Hit_ID=CAE63826.1; Match level="QueryCoverage =94%, HitCoverage=10%, E-value=1e-14, Identity=100%"; Hit description= Hypothetical protein CBG08377 [Caenorhabditis briggsae]
  Coding regions on vcDNA: vcDNA=SeqID_94221; Strand=+; Position=1-117
ERKKWIHCFDNVNAIIFISSLSEYDQTLREDNCTNRSN

SEQ ID NO: 167799 - protein, 108 aa, Heterodera glycines
  Coding regions on vcDNA: vcDNA=SeqID_94222; Strand=+; Position=20-346
IILGFIIDFVGDLIKGLAEKENRELLKNFFPIHVFVDVKEISVHLGELKVNILFRKIAALFGSPAASFDQICVDGSPKRIQKEEKQLALLLLYSSHNFGKLKLFKCDD

SEQ ID NO: 167800 - protein, 157 aa, Heterodera glycines
  Coding regions on vcDNA: vcDNA=SeqID_94223; Strand=-; Position=2-472
SGSDDDCETFEDEQPIDAFASQLAAADKVQKSLPKKPKKVSMPSAESIQNSLLDSLKNPSNFGPSIGKFLNLVKWKQVMNANLLLAQPQPNNQQISMPTDLNINMFKAPKEKKRVYAGRRKTTGDVQIVPYLFDICMRFLLNNIDGICQFGVGNGNF

SEQ ID NO: 167801 - protein, 60 aa, Heterodera glycines
  Coding regions on vcDNA: vcDNA=SeqID_94224; Strand=+; Position=2-184
MTNFLLVCGLNERSVRLGALFFDVFWQFVTDFCSTTFAFLVTHCLIIMLKLCHLFIVSFL

SEQ ID NO: 167802 - protein, 123 aa, Heterodera glycines
  Coding regions on vcDNA: vcDNA=SeqID_94225; Strand=+; Position=3-374
VERIDETGNVLLFIVANKCDLKEMRMVSEEEGRQFAEKQNAHYCETSALSGKGIETVMSSIAECLLQEQQRLLKSAELGHSSFDLATSSVAEAVDEKGAKRRGEEKKNGSGGNANGRGCCTIL

SEQ ID NO: 167803 - protein, 162 aa, Heterodera glycines
  Coding regions on vcDNA: vcDNA=SeqID_94226; Strand=+; Position=1-489
ALLVKYNSSKTAPPPPPSPSPPFALDAQKEESSEEKQAEAVVVGEPEQHQQQPVLETMPTTTASKQEVATQMPGEDDDEPPPPPPMPKKTASKEAETQVPDGGGDGPSPLLPQVPPNTTVKMEAATQMPPDGPPAAEEMTAVVVAIVAMILMFLFEFVSAVH

SEQ ID NO: 167804 - protein, 84 aa, Heterodera glycines
  Coding regions on vcDNA: vcDNA=SeqID_94227; Strand=-; Position=281-535
NQASHPHESCTLRPEILDAQYRHDLLAMNVYGHLLHPFQFLFHHDSILQLLQFSISPLHICGFLHHLKALNLTDYFCLRTLLNL

SEQ ID NO: 167805 - protein, 71 aa, Heterodera glycines
  Homolog annotation: Hit_ID=AAH57117.1; Match level="QueryCoverage =60%, HitCoverage=25%, E-value=6e-11, Identity=72%"; Hit description =Mak3p homolog [Mus musculus]
  Coding regions on vcDNA: vcDNA=SeqID_94228; Strand=+; Position=342-554
MVNNEKICHEFRDKCRVDSVVRCSGRCDIELGEVTKHNVMQLKRLNLSVFPVFYNDKFYKEVVNTGELAKL

SEQ ID NO: 167806 - protein, 170 aa, Heterodera glycines
  Coding regions on vcDNA: vcDNA=SeqID_94229; Strand=-; Position=2-511
SVLPQIDVHAAKLSDIVLECVDLQPFGQLLVNLLISFVGSAIVLHRQLHIPKSPNRRIFAEHSPALSPDQQDGNGKSALANQWANDNFVVHYFGQFCFGHFCSCDARIVREGNGKEIIFQSLFRARAEKGPLGHCIADLHDHTDRRIVAVRIIITGVPNARDAPVDQQQQ

SEQ ID NO: 167807 - protein, 127 aa, Heterodera glycines
  Homolog annotation: Hit_ID=AAP30836.1; Match level="QueryCoverage =96%, HitCoverage=68%, E-value=4e-52, Identity=87%"; Hit description =putative gland protein G30C02; Hg-G30C02 [Heterodera glycines]
  Coding regions on vcDNA: vcDNA=SeqID_94230; Strand=+; Position=61-441
GNFQFLLLFSACCYLQRKEYFAEKTERKIHRAANKKPKEETEGMAEVALFQMAMACMANRMDFQMAMACMANRMDFQMADLAAPVSIQIAAGRIAFQMVDLAAPVAFHRWDITRADFTALGPAHLLE

SEQ ID NO: 167808 - protein, 66 aa, Heterodera glycines
  Coding regions on vcDNA: vcDNA=SeqID_94231; Strand=+; Position=193-393
SLNMQILCKIGRNFDLCDHFISSCFDNIKSHFSIFHGLHPFICLVSPTQHFSYKWDCQSLFIYIFG

SEQ ID NO: 167809 - protein, 32 aa, Heterodera glycines
  Coding regions on vcDNA: vcDNA=SeqID_94232; Strand=-; Position=2-97
DCLLSALGYHTLCCLCTTGWSCLSFRILNCFI

SEQ ID NO: 167810 - protein, 70 aa, Heterodera glycines
  misc_feature (69)..(69): Xaa can be any naturally occurring amino acid
  Coding regions on vcDNA: vcDNA=SeqID_94233; Strand=+; Position=1-210
KLMKINYQIEMNLTNAGSLKKNTTEVLMPFFARTKHKMQKHKSSSKTRSKKFTICVKLIFLSYNKTKAXK

SEQ ID NO: 167811 - protein, 103 aa, Heterodera glycines
  Homolog annotation: Hit_ID=CAE68425.1; Match level="QueryCoverage =81%, HitCoverage=12%, E-value=1e-16, Identity=47%"; Hit description =Hypothetical protein CBG14205 [Caenorhabditis briggsae]
  Coding regions on vcDNA: vcDNA=SeqID_94234; Strand=+; Position=1-312
FPLLVATKLTQYAAEDANLLVLDAKSYARQAVNIIGNYRISTGCFMHDMQIAFGSFIGFNLFKLFYVPFGILGIHKRRIDAYNRKKLANERNSGGKGEGIKSE

SEQ ID NO: 167812 - protein, 82 aa, Heterodera glycines
  Coding regions on vcDNA: vcDNA=SeqID_94235; Strand=+; Position=84-332
SATPKTPGNLFSRLLKTTKNFFKKGGQPSAVLPKINAFCLLKFVKKWYFPRISVVLDFIFSRCGRVIPISQSPVHCNFYRFW

SEQ ID NO: 167813 - protein, 113 aa, Heterodera glycines
  Homolog annotation: Hit_ID=NP_492694.1; Match level="QueryCoverage =87%, HitCoverage=23%, E-value=1e-26, Identity=58%"; Hit description =casein kinase gamma (46.4 kD) (1K804) [Caenorhabditis elegans] emb|CAB60309.2| Hypothetical protein Y106G
  Gene Ontology: Biological process=glia cell migration
  Coding regions on vcDNA: vcDNA=SeqID_94236; Strand=+; Position=3-461
YARRLDFFETPDYEYCYGLFKTVLERTGHTYDYEFDWTHKLNQATTPSGSIHTAVGVEGGELRKTRTDYAKRAIGHHGPGFGSTQVVNSNAGEMEESARPPAPNRQQEEEHSE

SEQ ID NO: 167814 - protein, 82 aa, Heterodera glycines
  Homolog annotation: Hit_ID=AAO45883.1; Match level="QueryCoverage =52%, HitCoverage=9%, E-value=1e-11, Identity=69%"; Hit description =serotonin receptor protein [Haemonchus contortus]
  Coding regions on vcDNA: vcDNA=SeqID_94237; Strand=+; Position=132-508
MTITVTLVTVYYFIFLTSGKARSSSHQLLAFPRPALKCAVKKKRGPRETVEMGRERKAWRTLAIITGSFIACWMPFFVLSLY

SEQ ID NO: 167815 - protein, 118 aa, Heterodera glycines
  Coding regions on vcDNA: vcDNA=SeqID_94238; Strand=-; Position=2-355
NAICRTSFISGIKLTQMGKRTTQKSNGNIWHKNDTDVTNGEKFVQSVRTVHIEQGQNELCDCLSIQTIQEIRQQRSSARIARLEMNDHCSMGIVRSVDCLNAALLLCRTLIHCLWRHL

SEQ ID NO: 167816 - protein, 161 aa, Heterodera glycines
  misc_feature (123)..(123): Xaa can be any naturally occurring amino acid
  Homolog annotation: Hit_ID=NP_508418.2; Match level="QueryCoverage =45%, HitCoverage=21%, E-value=1e-15, Identity=50%"; Hit description =salvador (XC902) [Caenorhabditis elegans] gb|AAB37990.2| Hypothetical protein T10H10.3 [Caenorhabditis el
  Gene Ontology: Biological process=induction of apoptosis
  Coding regions on vcDNA: vcDNA=SeqID_94239; Strand=+; Position=9-492
MENAQTSHESEGLSRQGQGRLCPSASFGNFTDPLMIPPIALQHVYATANMVTQANVDQSNKLDLDRLPPGWEVRLTEDGSYRYYVDHNNGRTHWIHPFAPEVLKPNWTKIFDTVHGVVYYKSXDQRSQFDHPGFINGAFLPTIHGSSSFQSLLENEQEQNC

SEQ ID NO: 167817 - protein, 183 aa, Heterodera glycines
  misc_feature (53)..(53): Xaa can be any naturally occurring amino acid
  Homolog annotation: Hit_ID=CAE69872.1; Match level="QueryCoverage =93%, HitCoverage=38%, E-value=1e-49, Identity=51%"; Hit description =Hypothetical protein CBG16208 [Caenorhabditis briggsae]
  Gene Ontology: Mol. function=alpha-L-fucosidase activity; Biological process=fucose metabolism
  Coding regions on vcDNA: vcDNA=SeqID_94240; Strand=+; Position=3-552
DWEQPDTYWRSKEFLAWLYNKSPVKEKVVVNDRWGSGIAGKHGGFLTYQDHYXDKRSWGYRRYLKPSDVLSLAELINQLVRTISCGGNMLLNVGPDHTGRIVPIFEQRLREFGEWMNVNSEAIYGSKAWIHQSDGPTIWYTSQIRNATELSPSRMFNPQDTFKTIVYAFVLSIPRSGRINFPS

SEQ ID NO: 167818 - protein, 51 aa, Heterodera glycines
  Coding regions on vcDNA: vcDNA=SeqID_94241; Strand=+; Position=1-156
KFDSADLPLVEGAGDDLLVVGGDDLHMDISSCPGTPQISPMVSADEGDGDD

SEQ ID NO: 167819 - protein, 58 aa, Heterodera glycines
  Coding regions on vcDNA: vcDNA=SeqID_94242; Strand=+; Position=2-178
QRRLFHRKDWIINPLCAESELTDRHAMLRFYHPTHSFSVIFASAISFPFCCLFCDGFN

SEQ ID NO: 167820 - protein, 154 aa, Heterodera glycines
  Homolog annotation: Hit_ID=XP_419126.1; Match level="QueryCoverage =90%, HitCoverage=23%, E-value=3e-19, Identity=40%"; Hit description =PREDICTED: similar to protein tyrosine phosphatase, non-receptor type 2 isoform 2; T-cell protein tyrosin
  Gene Ontology: Mol. function=protein tyrosine phosphatase activity; Cellular component=cytoplasm; Biological process=protein amino acid dephosphorylation
  Coding regions on vcDNA: vcDNA=SeqID_94243; Strand=+; Position=3-464
KEQATDNAGKERNSRIIHHFQFTTWPDFGVPVHTDHFLNFLEEVRNAREKLPEPGSEAGTVGPDSPIVCHCSAGIGRAGTFVIVDSILSMFERKWKGQQVEEGEKNGTENDERERADRTVDEKMDSLEALVVFIRRHRMGLIQTPQQLRFCWKT

SEQ ID NO: 167821 - protein, 31 aa, Heterodera glycines
  Coding regions on vcDNA: vcDNA=SeqID_94244; Strand=-; Position=0-92
MKSSQIQKIIIHSASQSSSFFTFFRFSHAVV

SEQ ID NO: 167822 - protein, 71 aa, Heterodera glycines
  Homolog annotation: Hit_ID=CAE70530.1; Match level="QueryCoverage =97%, HitCoverage=44%, E-value=8e-10, Identity=39%"; Hit description =Hypothetical protein CBG17161 [Caenorhabditis briggsae]
  Coding regions on vcDNA: vcDNA=SeqID_94245; Strand=+; Position=3-218
TQIVWKSTREVGVGRSTMRSFPQQMEKDEKITNGHSEEAVKKVVVIAFYRPAGNSNRSGQFELNVPKPIAQ

SEQ ID NO: 167823 - protein, 162 aa, Heterodera glycines
  Homolog annotation: Hit_ID=NP_497969.1; Match level="QueryCoverage =100%, HitCoverage=10%, E-value=7e-22, Identity=33%"; Hit description= EMB-5, abnormal EMBryogenesis EMB-5 (175.8 kD) (emb-5) [Caenorhabditis elegans] emb|CAA84801.1| Hypothet
  Gene Ontology: Cellular component=nucleus; Biological process =chromatin modeling
  Coding regions on vcDNA: vcDNA=SeqID_94246; Strand=+; Position=1-486
HSLYGRHYIKDKPVKELKDDEYLSFVRAQKDGLIEIDLHINSNEESENKCLRACMENDGCATFKRNENSEIVEEWNKLRNLVLTICVNKMLIPVLRRESHENLIEEAKEFVIMKAAERLHGLIETESYKPQFSYDNQDDDLHDVGTRILAVCYSSDIADASF

SEQ ID NO: 167824 - protein, 146 aa, Heterodera glycines
  Coding regions on vcDNA: vcDNA=SeqID_94247; Strand=+; Position=36-473
MDAEYSALMAELGEKPPISLEAGTAPPLVGGKPIPGFPGSGLRPRFALPAPTPIVRVNLAKQQNTPQQQSVSGGGYPGWDGAGFYGFSGLPGQDPAAAAAAWAAWQAGQSGFPSPVPPPPGGGFGHANMEAASTPGTSAGGLAMFP

SEQ ID NO: 167825 - protein, 96 aa, Heterodera glycines
  Coding regions on vcDNA: vcDNA=SeqID_94248; Strand=-; Position=0-287
LLLQQMLFLSLVKGNNDKSFDRTLKYCILLLQIKRKAEIAKTMGMNDLFCVFLFRFLGNTADVIIFKTGQIKVISAIVAHLRNALYHFAVFVVERA

SEQ ID NO: 167826 - protein, 27 aa, Heterodera glycines
  Coding regions on vcDNA: vcDNA=SeqID_94249; Strand=+; Position=12-92
FTPHFPFRHSTDILLFNNCPFLNTEFP

SEQ ID NO: 167827 - protein, 95 aa, Heterodera glycines
  Coding regions on vcDNA: vcDNA=SeqID_94250; Strand=-; Position=0-284
IFLSFFLFINFRLFSEFCPTVSAYPPIRFPSFGLSFGCVLPLSPCTFPWPSSGVSVRCIAVLTFGLPGLLVVLCVAVKWQIRCFIIRGLCLVPNP

SEQ ID NO: 167828 - protein, 130 aa, Heterodera glycines
  Homolog annotation: Hit_ID=DAA01153.1; Match level="QueryCoverage =61%, HitCoverage=8%, E-value=7e-17, Identity=52%"; Hit description =TPA: RTl1 [Mus musculus] ref|NP_908998.1| retrotransposon-like 1 [Mus musculus]
  Gene Ontology: Mol. function=protein binding; Cellular component =axoneme; Biological process=eye photoreceptor cell development
  Coding regions on vcDNA: vcDNA=SeqID_94251; Strand=+; Position=75-464
MDNRLRFAQEIKDSIRDCYPQLFIDAPIPTKEDIEKLRDSLNLSDQVLVCDKDGEVEEGEHEEDGEEAAMDKDNANEDEEEDGEEDGEDEEEKEEEDVEKEEEEEEEETEQQSTANDEEEAEEMIGEGEE

SEQ ID NO: 167829 - protein, 143 aa, Heterodera glycines
  misc_feature (66)..(66): Xaa can be any naturally occurring amino acid
  Homolog annotation: Hit_ID=NP_491528.2; Match level="QueryCoverage =97%, HitCoverage=42%, E-value=1e-24, Identity=44%"; Hit description =lipase family like precursor (1F699) [Caenorhabditis elegans] gb|AAF60431.2| Hypothetical protein Y110A7A
  Coding regions on vcDNA: vcDNA=SeqID_94252; Strand=+; Position=3-432
YTPDPLPCLSKRNATLQMLQQIPCDAFKNECWAFVALSPSKIVFSVRGTRTSAQLIIELIETMTVXAPKKSFPAGGSVQHYFYTSLDALWSVGFGRKLRELKMLNPQLPILFTGHSLGGAIASLASARFAFENRDFVKSSEIF

SEQ ID NO: 167830 - protein, 24 aa, Heterodera glycines
  Coding regions on vcDNA: vcDNA=SeqID_94253; Strand=-; Position=1-72
FFSFFLNSIYFMFVFMNLSEINLK

SEQ ID NO: 167831 - protein, 116 aa, Heterodera glycines
  Homolog annotation: Hit_ID=NP_501743.1; Match level="QueryCoverage =86%, HitCoverage=42%, E-value=6e-21, Identity=48%"; Hit description =caveolin, structural component of caveolae membranes (26.3 kD) (cav -1) [Caenorhabditis elegans] emb|CAB03
  Gene Ontology: Mol. function=protein binding; Cellular component =lipid raft; Biological process=endocytosis
  Coding regions on vcDNA: vcDNA=SeqID_94254; Strand=+; Position=5-355
MNGVWKMSLTVFLTVRNFCYKLLSLIFAIPLAVLFGILFGLFSMLSVFVFVPVGRLLSIPFGWLAKFWAVLISAVCDPLCRSFALTFGNVKVTRYGINQDPTAVGVELNLNECVNK

SEQ ID NO: 167832 - protein, 121 aa, Heterodera glycines
  Coding regions on vcDNA: vcDNA=SeqID_94255; Strand=+; Position=3-365
LNTSDLFLSPPFGLPLFPFISLSDSGDLIETNFGPKFEFDPAKVQQQASSNFRQNYWDANFCHENLEIIGNKSLIVHYKKNSYDAWRSVFAKYPILLNKDSSNIFYYEILVKNKNYWFISF

SEQ ID NO: 167833 - protein, 45 aa, Heterodera glycines
  misc_feature (36)..(38): Xaa can be any naturally occurring amino acid
  Coding regions on vcDNA: vcDNA=SeqID_94256; Strand=+; Position=133-267
RNMKFGRTTILSIRIVHSMFFLNLLFVQFYKCSLFXXXKKKKKKK

SEQ ID NO: 167834 - protein, 60 aa, Heterodera glycines
  Coding regions on vcDNA: vcDNA=SeqID_94257; Strand=-; Position=2-181
FDPLLVDTKAPCNCCHHKAKSGCCSNCSNLGSPIGPSPSLSCAWKFSRVPFTVIVAPVTC

SEQ ID NO: 167835 - protein, 80 aa, Heterodera glycines
  misc_feature (14)..(14): Xaa can be any naturally occurring amino acid
  Homolog annotation: Hit_ID=CAE59812.1; Match level="QueryCoverage =100%, HitCoverage=51%, E-value=2e-09, Identity=36%"; Hit description= Hypothetical protein CBG03276 [Caenorhabditis briggsae]
  Coding regions on vcDNA: vcDNA=SeqID_94258; Strand=+; Position=183-426
KRRKSKRKESKVQXKMQKAKQKKQKQKDKPRRLKTQRAQGHIDDEQYREKKKNYKQKKDKQKLKARKNKRKLNNGHQQMW

SEQ ID NO: 167836 - protein, 149 aa, Heterodera glycines
  Homolog annotation: Hit_ID=CAE61603.1; Match level="QueryCoverage =94%, HitCoverage=18%, E-value=1e-22, Identity=40%"; Hit description =Hypothetical protein CBG05522 [Caenorhabditis briggsae]
  Gene Ontology: Mol. function=transcriptional activator activity; Cellular component=cytoplasm; Biological process=N signaling pathway
  Coding regions on vcDNA: vcDNA=SeqID_94259; Strand=+; Position=3-449
VKMVDSVSGLALPMMRICKVEKCNGTDVVVINDGDSGEQVSQLHKCGFQMLSGAESRPLFMCFNGENIVQQDVGNDRSFVANDGQFMTDRRYPIRDGAQWTIISTDTIQYRFFEALRPVQNEVAPVPIVSSLDMHSTDPTSSSGAYVEL

SEQ ID NO: 167837 - protein, 155 aa, Heterodera glycines
  misc_feature (142)..(142): Xaa can be any naturally occurring amino acid
  Homolog annotation: Hit_ID=AAH42242.1; Match level="QueryCoverage =89%, HitCoverage=34%, E-value=3e-59, Identity=74%"; Hit description =Rpl3-prov protein [Xenopus laevis]
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_94260; Strand=+; Position=1-465
VHGIRRVSHSQLRVPVRKVKAFPKDDPKKPIHLTAFIAYKAGMSHIVRDVDKLGSKVHKKEVVEAVTILETPPMVIVGVVGYIETPRGPRPLKTVFAEHLSEDCKRRFYKNWYKCEKKAFTKYAKKWQDEAGQKFIEADLKXIKKYCFYVRVIAH

SEQ ID NO: 167838 - protein, 106 aa, Heterodera glycines
  Homolog annotation: Hit_ID=AAD13405.1; Match level="QueryCoverage =47%, HitCoverage=11%, E-value=6e-13, Identity=56%"; Hit description =putative glutamate-gated chloride channel alpha subunit [Haemonchus contortus]
  Coding regions on vcDNA: vcDNA=SeqID_94261; Strand=+; Position=160-480
MDAAAYGTHRPFRSASAFSTSTRYYLDADILKRLRNRTGLIGWWCELWTVRYREKSRRIDLLARVLFPLFFVLFNIIYWICYLRPYLAEEMEENFAKGKANEGTTN

SEQ ID NO: 167839 - protein, 106 aa, Heterodera glycines
  Coding regions on vcDNA: vcDNA=SeqID_94262; Strand=-; Position=1-318
HLFHSHNNDYIVVERLICPVVFPPRPLFSHPLHSFGRSSIWPIIRAVVASIWRPFPLLIVSFGTVHLCPHGTSIVFGFTTRPHFDDHFICSASCCSISNWPIRWPN

SEQ ID NO: 167840 - protein, 91 aa, Heterodera glycines
  misc_feature (4)..(4): Xaa can be any naturally occurring amino acid
  Coding regions on vcDNA: vcDNA=SeqID_94263; Strand=-; Position=1-273
PCPXPPFPPSFPLPPLPHVPPPLPLFSFFPSSTSASLFSIFSSFTSVFSLSASRSLPFPDGYASMINAQKAKESNKIIESFIFKEDLLFLI

SEQ ID NO: 167841 - protein, 173 aa, Heterodera glycines
  Homolog annotation: Hit_ID=XP_322249.1; Match level="QueryCoverage =90%, HitCoverage=34%, E-value=2e-13, Identity=32%"; Hit description =hypothetical protein [Neurospora crassa] gb|EAA27440.1| hypothetical protein [Neurospora crassa]
  Gene Ontology: Cellular component=membrane; Biological process =protein modification
  Coding regions on vcDNA: vcDNA=SeqID_94264; Strand=+; Position=1-519
HAVLPNISLFKKFGKPPDECLLISLTFSAFAFFCFGWHVHEKDPTFMQPFALLYVASIFAQFPLFFTPFECFLKWAFTLWHFAFCQFLANFVWCIRLAEFAQFTVAKFALFQMVSAQFYADFCHRLIFGSNFAFLPMMVPSVACALFVFFAYLHFILIVFAESVQIHFFKFRC

SEQ ID NO: 167842 - protein, 182 aa, Heterodera glycines
  Coding regions on vcDNA: vcDNA=SeqID_94265; Strand=+; Position=3-548
DLNNCYTSFEHKVLDEILHKITPSDSKFVVVSVQVTSKIYKYRKTKTEAGLSYDDAFSRIICKGSEEFNSPFKSEISSVEFLKMITQFAMRTLIREPFCALTSSAQNRPLRQRLFVSGRGIGQGSSLSVALCNLYLGWVERQICLHSPEMGLTNCAITLFCCRYMDDYLIISNKRERVEKLI

SEQ ID NO: 167843 - protein, 178 aa, Heterodera glycines
  Homolog annotation: Hit_ID=CAD55810.1; Match level="QueryCoverage =94%, HitCoverage=74%, E-value=2e-33, Identity=41%"; Hit description =p38 protein [Tetrahymena thermophila]
  Coding regions on vcDNA: vcDNA=SeqID_94266; Strand=+; Position=36-569
MGNTCGCADKANEAGNIQVDDRKGNRHGNDDAAFDNFEQGGAKITNYGGKRDVRNALPEENGATSSEHAPNPSFATLLSQMPNYSNPNTTATLQRIGPFVYDQDDHEDGYLPQLGPYELENSAVYIGQWKNGIRHGKGKQIWSDGSQYEGYWKNNMANGKGRLIHADGDVYEGEWFND

SEQ ID NO: 167844 - protein, 177 aa, Heterodera glycines
  Homolog annotation: Hit_ID=CAE60491.1; Match level="QueryCoverage =95%, HitCoverage=21%, E-value=2e-57, Identity=61%"; Hit description =Hypothetical protein CBG04106 [Caenorhabditis briggsae]
  Coding regions on vcDNA: vcDNA=SeqID_94267; Strand=-; Position=2-532
SLPSKEQLDSNLQFLPHLSSPDERVLLVLNREGDFGILKGRWHGFVRRQTGDKRRKGKSGSAGVLNVELFNLLKNTVQKFQVPNSDGSTLFAIGDAQARLNGRRMHCRTTQTSEYLSCIFGIGTLFILCNPDKVRARSESTTPVSHQCQKWPMTLACGYGRPVPSNRILAAQRYQQN

SEQ ID NO: 167845 - protein, 129 aa, Heterodera glycines
  Homolog annotation: Hit_ID=NP_492378.1; Match level="QueryCoverage =79%, HitCoverage=27%, E-value=1e-26, Identity=51%"; Hit description =Malate/L-lactate dehydrogenase (40.5 kD) (1J377) [Caenorhabditis elegans] emb|CAB09417.1| Hypothetical pr
  Coding regions on vcDNA: vcDNA=SeqID_94268; Strand=+; Position=1-390
ELFCGLLGGASFGKNVRSWREVQKAANLGQCFVAIDPECFAPTFVDNLQLFLDQTRGLKPRDPSKSVLVPGDPERMNSERSAKAGGVIYSEGQIRDLEKLAKKAKRWHVPLQGKFVAEQKNCFLFVPKR

SEQ ID NO: 167846 - protein, 86 aa, Heterodera glycines
  Homolog annotation: Hit_ID=CAE61993.1; Match level="QueryCoverage =89%, HitCoverage=11%, E-value=2e-16, Identity=58%"; Hit description =Hypothetical protein CBG06001 [Caenorhabditis briggsae]
  Gene Ontology: Mol. function=ubiquitin activating enzyme activity; Cellular component=cytoplasm; Biological process=membrane fusion
  Coding regions on vcDNA: vcDNA=SeqID_94269; Strand=+; Position=1-261
CTISRSGISMIASGIATELLASVLQHELGAEAPALLAEVDENASQLGATPHQIRGFMSRFHLMMPTVRRDNPCTAWGHTGKQFYPT

SEQ ID NO: 167847 - protein, 70 aa, Heterodera glycines
  Coding regions on vcDNA: vcDNA=SeqID_94270; Strand=-; Position=17-229
WKFSHLSIRAISKGFLLQIKTFGGRQLANHSQVAVAMGGRHLCLGRHASGHRFRGAPSTAWSARRQSVAL

SEQ ID NO: 167848 - protein, 129 aa, Heterodera glycines
  Homolog annotation: Hit_ID=XP_394347.1; Match level="QueryCoverage =55%, HitCoverage=13%, E-value=8e-13, Identity=48%"; Hit description =similar to MGC53313 protein [Apis mellifera]
  Coding regions on vcDNA: vcDNA=SeqID_94271; Strand=+; Position=93-479
MISTCNNDIVDDNSEFSQDLDGDHQYTVKGEDNDDYCGDVNSLRPGDVYVTNHSNLSAVQVVFHVVGDRQLVEQDISSRHPCINALRNVIRLAPHSGINHITFPLLLVEHMTEVFLHSFLYYISPRPSG

SEQ ID NO: 167849 - protein, 129 aa, Heterodera glycines
  misc_feature (102)..(102): Xaa can be any naturally occurring amino acid
  Homolog annotation: Hit_ID=AAL05844.1; Match level="QueryCoverage =58%, HitCoverage=17%, E-value=3e-12, Identity=49%"; Hit description =latency associated antigen [Ovine herpesvirus 2]
  Gene Ontology: Mol. function=protein binding; Cellular component =axoneme; Biological process=eye photoreceptor cell development
  Coding regions on vcDNA: vcDNA=SeqID_94272; Strand=+; Position=53-441
MPLFPSLNPSPLSIHSISHSKELQIRWFGWTLLTIWLLTVICMTREFWRITNSGRRGGGKQSEEEQNDGRGRKSGNDEEEEQERKEEEEQERRERKGIEEEXKEEEEEEQERNEEEEQERRERKGIEEE

SEQ ID NO: 167850 - protein, 125 aa, Heterodera glycines
  Coding regions on vcDNA: vcDNA=SeqID_94273; Strand=+; Position=1-378
FCSNDSQNVSSHSTNQIEIEAKKTEHGSAGLSILEILLLWLSRFSVLEIVLWALVPVVICVFVVVCACVISRRRPSLRNELLRLIDLGHQIQVVDENIYRWKVKIPGPPTSLYFAEELLRERTDR

SEQ ID NO: 167851 - protein, 23 aa, Heterodera glycines
  Coding regions on vcDNA: vcDNA=SeqID_94274; Strand=-; Position=2-70
FFFFFIEKKFKRNQKNKTIRKNF

SEQ ID NO: 167852 - protein, 17 aa, Heterodera glycines
  Coding regions on vcDNA: vcDNA=SeqID_94275; Strand=-; Position=1-51
YFFFFFSIICNIRLIQK

SEQ ID NO: 167853 - protein, 65 aa, Heterodera glycines
  Homolog annotation: Hit_ID=NP_505983.1; Match level="QueryCoverage =66%, HitCoverage=11%, E-value=4e-12, Identity=69%"; Hit description =acid Phosphatase family member (5M313) [Caenorhabditis elegans] emb|CAB04655.1| Hypothetical protein R13H
  Coding regions on vcDNA: vcDNA=SeqID_94276; Strand=+; Position=360-554
LLLILCFSIFKTAEQQQQPDEKDHRQLLFVQAIWRHGDRAPGKLPYPGDQYYDKYWPRGWGQLTN

SEQ ID NO: 167854 - protein, 24 aa, Heterodera glycines
  misc_feature (2)..(2): Xaa can be any naturally occurring amino acid
  Coding regions on vcDNA: vcDNA=SeqID_94277; Strand=-; Position=1-72
FXITVFFKKIIRLLADGVVNRWTR

SEQ ID NO: 167855 - protein, 155 aa, Heterodera glycines
  Coding regions on vcDNA: vcDNA=SeqID_94278; Strand=+; Position=1-465
GDLGRDLNKDPARLVVSERKSLVGTVLSPNTSMDESNNQEKLILHIKKNTNPTPIPIDLIPYMHFRIEDLVKVTCAPEVDANKVIRLIYQGKQLKDDDRVKDIKFKPETVMHIFISEPVQKDVNITTISAELYEPERRGFDKFRPLDLMEEEIIL

SEQ ID NO: 167856 - protein, 117 aa, Heterodera glycines
  Coding regions on vcDNA: vcDNA=SeqID_94279; Strand=-; Position=94-447
RGFIGPKIIYIFLPIIASQLDVSIKLETLRNSESVCQSQLANLQQRKLGGCTIKLGMEFHEIFHFFYSQSGFVISSFDVPCPKRCPAETKRHSEKPRECSGWLNIGILRCDRTVIRC

SEQ ID NO: 167857 - protein, 28 aa, Heterodera glycines
  Coding regions on vcDNA: vcDNA=SeqID_94280; Strand=-; Position=1-84
FLSIYMCFIKSFLQQLKKSSLQKFAISP

SEQ ID NO: 167858 - protein, 79 aa, Heterodera glycines
  Homolog annotation: Hit_ID=NP_498776.1; Match level="QueryCoverage =98%, HitCoverage=70%, E-value=4e-28, Identity=73%"; Hit description =heat shock protein (hsp-12.2) [Caenorhabditis elegans] gb|AAA27953.1| Heat shock protein protein 12.2 [Ca
  Gene Ontology: Mol. function=chaperone activity; Cellular component =cytoplasm; Biological process=muscle contraction
  Coding regions on vcDNA: vcDNA=SeqID_94281; Strand=+; Position=1-240
DKFEVGLDVQFFAPQEIEVKVSGQDVIIHCLHEIRKDQHGSVKREIHRQYRLPNDVDAATLKSHLSTRGVLTLTASKKD

SEQ ID NO: 167859 - protein, 18 aa, Heterodera glycines
  Coding regions on vcDNA: vcDNA=SeqID_94282; Strand=-; Position=1-54
FFFQLSFICHILHFNIII

SEQ ID NO: 167860 - protein, 22 aa, Heterodera glycines
  Coding regions on vcDNA: vcDNA=SeqID_94283; Strand=-; Position=1-66
EHSYTKTGVNIESSAKTIKKDF

SEQ ID NO: 167861 - protein, 46 aa, Heterodera glycines
  Coding regions on vcDNA: vcDNA=SeqID_94284; Strand=-; Position=1-138
FIHSVALFVLSIPFFIFFLSLLPSSPCFHIFVLSFFFVCFNFYFQF

SEQ ID NO: 167862 - protein, 72 aa, Heterodera glycines
  Coding regions on vcDNA: vcDNA=SeqID_94285; Strand=-; Position=1-216
LGSNYNLFLIKAGQIFGKQRTLIVYGEMFDDDQSRRWFVFADDKRKKTGIPNPNSPLMFKSLEKPTNKRAVR

SEQ ID NO: 167863 - protein, 55 aa, Heterodera glycines
  Coding regions on vcDNA: vcDNA=SeqID_94286; Strand=-; Position=13-180
IRRKLSIFSVFGDVHMSTFFDQTRIFRRNISENKTGQQLFHCILIMVSAPQRIVR

SEQ ID NO: 167864 - protein, 91 aa, Heterodera glycines
  Coding regions on vcDNA: vcDNA=SeqID_94287; Strand=-; Position=85-360
VDILTVLHPIHEYYSRFYVADGQTNQISDTVKDTSKLLCIFLQRLVINQKYAVRLSLLGKNTVNFIKNFINFWFKKRFLFYFFLLFSTKNF

SEQ ID NO: 167865 - protein, 43 aa, Heterodera glycines
  Coding regions on vcDNA: vcDNA=SeqID_94288; Strand=-; Position=2-130
FFFFFYHLSSFIIVSIDSDRSLFDHFLIASFSISPFEFAWSTH

SEQ ID NO: 167866 - protein, 79 aa, Heterodera glycines
  misc_feature (72)..(72): Xaa can be any naturally occurring amino acid
  misc_feature (74)..(78): Xaa can be any naturally occurring amino acid
  Coding regions on vcDNA: vcDNA=SeqID_94289; Strand=+; Position=17-253
TDREEEGREIRFWWRTNAEEWEKDTGKVKAIANKKNDELMTTPSLSNIKWKEKQRATIHPILLFITAIKANXYXXXXXK

SEQ ID NO: 167867 - protein, 117 aa, Heterodera glycines
  Homolog annotation: Hit_ID=CAE68366.1; Match level="QueryCoverage =68%, HitCoverage=31%, E-value=7e-09, Identity=40%"; Hit description =Hypothetical protein CBG14120 [Caenorhabditis briggsae]
  Coding regions on vcDNA: vcDNA=SeqID_94290; Strand=+; Position=93-443
MRPALFGDKAMDTKALHLLIRLNARKIKVGQRCSKLDSELNLAPQEPKYLYRAGRPSDHFILLIEGNAVAHFPKNQMKFDVGAWECFGTEILDQMEAQMVNNYQMDKNIGKMHHQKT

SEQ ID NO: 167868 - protein, 71 aa, Heterodera glycines
  Coding regions on vcDNA: vcDNA=SeqID_94291; Strand=-; Position=207-422
YRCACVLHHLSTNSRRCLARLSSTSLESSYKSLTFHMRSVHEINVSYEFSFICNHAKTATRKWPRENVLAR

SEQ ID NO: 167869 - protein, 68 aa, Heterodera glycines; identical to SEQ ID NO: 150538
  Coding regions on vcDNA: vcDNA=SeqID_94292; Strand=-; Position=2-205

SEQ ID NO: 167870 - protein, 115 aa, Heterodera glycines
  Homolog annotation: Hit_ID=NP_493272.1; Match level="QueryCoverage =40%, HitCoverage=19%, E-value=5e-12, Identity=75%"; Hit description =translation factor (26.3 kD) (1N561) [Caenorhabditis elegans] emb|CAB16860.1| Hypothetical protein C47B2.
  Gene Ontology: Cellular component=cytoplasm; Biological process =ribosomal large subunit biogenesis
  Coding regions on vcDNA: vcDNA=SeqID_94293; Strand=+; Position=2-349
RLERDGKLADAHAKFGQLLALCPDHQGALDGIARLDKNDDNIGGTDIELVELSDDEHTDHDDDNGSCCVNDWIAFTGLDTTSAELSVLESIFKLGDAAPSAISTDLRDTLIESML

SEQ ID NO: 167871 - protein, 151 aa, Heterodera glycines
  Homolog annotation: Hit_ID=NP_491668.1; Match level="QueryCoverage =85%, HitCoverage=25%, E-value=7e-28, Identity=51%"; Hit description =LIM domain protein (lim-7) [Caenorhabditis elegans] gb|AAC16985.1| Lim domain family protein 7 [Caenorhab
  Gene Ontology: Mol. function=ATP binding; Cellular component=nucleus; Biological process=torso signaling pathway
  Coding regions on vcDNA: vcDNA=SeqID_94294; Strand=+; Position=27-479
MGNGTAMLQGNFEVIGSAGGIAHFASSAGGESNCSSSSSSVVVHKGKKSKKDKPAQRVRTVLNENQLRILKQTYQGNQRPDTNTKEQLVKMTGLNARVIRVWFQNKRCKDKKVFRRQIEQREKQQSQEKDQTIRSVRAVGVGPMIARFAGP

SEQ ID NO: 167872 - protein, 133 aa, Heterodera glycines
  Homolog annotation: Hit_ID=NP_741797.1; Match level="QueryCoverage =97%, HitCoverage=27%, E-value=4e-58, Identity=86%"; Hit description =MEChanosensory abnormality MEC-2, stomatin-like protein required for mechanosensation (51.9 kD) (mec-2) [
  Gene Ontology: Mol. function=protein binding; Cellular component =integral to membrane; Biological process=signal transduction
  Coding regions on vcDNA: vcDNA=SeqID_94295; Strand=+; Position=2-403
VKVVREYERAVIFRLGRLLPGGARGPGIFIVIPCIDTYRKVDLRVLSFDVPPQEILSRDAVTVAVDVVVYFRISNATISVTNVEDSSRSTKLLAQTTLRNILGTKTLAEMLSDREQISLQMQSTLDEITKSEI

SEQ ID NO: 167873 - protein, 164 aa, Heterodera glycines
  Homolog annotation: Hit_ID=NP_999093.1; Match level="QueryCoverage =100%, HitCoverage=38%, E-value=5e-66, Identity=73%"; Hit description= aspartate aminotransferase [Sus scrofa] sp|P00506|AATM_PIG Aspartate aminotransferase, mitochondrial pre
  Gene Ontology: Cellular component=extracellular space; Biological process=aspartate catabolism
  Coding regions on vcDNA: vcDNA=SeqID_94296; Strand=+; Position=3-494
QGHNICLAQSFAKNMGLYGERVGAYTVVCKDQEEATRVMSQLKILVRAMISNPPIHGARIASKILSDSKLRQQWLADVKGMADRIISMRTQLREQLAKAGSKRNWDHIVNQIGMFCFTGITPEQVDRLSKEFSIYLTRDGRISMAGITSKNIEYIANALHEVTK

SEQ ID NO: 167874 - protein, 82 aa, Heterodera glycines
  Coding regions on vcDNA: vcDNA=SeqID_94297; Strand=+; Position=180-428
TVCARQKRTLVKWFPAGTDTQSVVHFCDQPTVTIFIILMMLPSTHSVFLSPRHRVDARVRLQFGGHENAEDGVVEAAQRVID

SEQ ID NO: 167875 - protein, 157 aa, Heterodera glycines
  Homolog annotation: Hit_ID=NP_499689.1; Match level="QueryCoverage =100%, HitCoverage=30%, E-value=9e-69, Identity=76%"; Hit description= UNCoordinated locomotion UNC-25, glutamic acid decarboxylase, mutation leads to shrinker phenotype famil
  Gene Ontology: Mol. function=sulfinoalanine decarboxylase activity; Biological process=L-cysteine catabolism to taurine
  Coding regions on vcDNA: vcDNA=SeqID_94298; Strand=+; Position=3-473
YLFQQDKPYDVSYDTGDKAMQCGRHNDIFKLWLMWRSKGMEGYRRQINQLMDLAKYFTDKIKRTEGFEMVLDEPEFLNICFWYIPPSLRKQIDNKEKMARLEKVAPKIKARMMERGTTMVGYQPDKQRPNFFRMIISNPAIREIDLDFLINEIVTLG

SEQ ID NO: 167876 - protein, 96 aa, Heterodera glycines
  Homolog annotation: Hit_ID=NP_509029.1; Match level="QueryCoverage =98%, HitCoverage=71%, E-value=2e-11, Identity=38%"; Hit description =putative membrane protein of bilaterial origin (14.5 kD) (XG746) [Caenorhabditis elegans] gb|AAB52666.1|
  Coding regions on vcDNA: vcDNA=SeqID_94299; Strand=+; Position=301-588
MVESRIKCYVCNSGTKGQADCTEDDHDKLKTFIKQCNPLTFGTFAGEKRRRAEKCAKRVEDETTIVRECAYTGEELDGKRRTGTKGSQCSSNSAST

SEQ ID NO: 167877 - protein, 151 aa, Heterodera glycines
  Coding regions on vcDNA: vcDNA=SeqID_94300; Strand=+; Position=89-541
VFVFCAVLSPTSYRHRLRALQRISVPIREKSRLFEFYFGKFSLPHGSFIYLLTRFMPRISHWLIILSRPLDWLSITYPMGNLSSSLRRSMPSVNSSADGTGAGAEHLVQRVGTARHSSFSTEDGAAMCQKEKQQNSVGIADSETKCEQLTL

SEQ ID NO: 167878 - protein, 153 aa, Heterodera glycines
  Coding regions on vcDNA: vcDNA=SeqID_94301; Strand=+; Position=7-465
LVMYVRELESPDEHSLVLFNPLRSCFRPTRDELFSAIACQRRSIARLDTERARFRRLNGAQFRVVVRLSGGFLPNFAAVMPQQQNVVNVTAVIANANPNGQNYNRLQRLHADLTETIARLTVEISQLGYMYEQLTEQLEHLTEVPPNPNFNPA

SEQ ID NO: 167879 - protein, 30 aa, Heterodera glycines
  Coding regions on vcDNA: vcDNA=SeqID_94302; Strand=-; Position=1-90
QHWFLKPTYNTKLGNEKITGFNPPQRLLPS

SEQ ID NO: 167880 - protein, 145 aa, Heterodera glycines; identical to SEQ ID NO: 125010
  Homolog annotation: Hit_ID=NP_704833.1; Match level="QueryCoverage =62%, HitCoverage=41%, E-value=1e-10, Identity=35%"; Hit description =hypothetical protein [Plasmodium falciparum 3D7] emb|CAD51976.1| hypothetical protein, conserved [Plasmod
  Coding regions on vcDNA: vcDNA=SeqID_94303; Strand=+; Position=34-468

SEQ ID NO: 167881 - protein, 118 aa, Heterodera glycines
  Coding regions on vcDNA: vcDNA=SeqID_94304; Strand=+; Position=2-358
MRKKEHKVQIDDKHKEPFSFLASIGRVYTSDHEEMPVLRNALPLEPTFLLVSMKRRMLVLEIRKAFVFLLMLILPLFVRICLRFGDIKKRRLCARNGGKSESQLLSFIKKKGSLHSDI

SEQ ID NO: 167882 - protein, 47 aa, Heterodera glycines
  Coding regions on vcDNA: vcDNA=SeqID_94305; Strand=+; Position=1-144
RRLFHRKDWIINPLCAESELTDRHAMLRFYHPTHSFSVIFASAVSFP

SEQ ID NO: 167883 - protein, 83 aa, Heterodera glycines
  Homolog annotation: Hit_ID=AAK60209.1; Match level="QueryCoverage =100%, HitCoverage=100%, E-value=8e-24, Identity=74%"; Hit description=vap-1 [Heterodera glycines]
  Coding regions on vcDNA: vcDNA=SeqID_94306; Strand=+; Position=79-330
MEHFPSKFVLCLLIAFIAVPCSVLALSAGSRVSMLACHNNYRSQLAKGTADNKSVYKKGAACSKCSDYNGATCDSASGLCKLP

SEQ ID NO: 167884 - protein, 14 aa, Heterodera glycines
  Coding regions on vcDNA: vcDNA=SeqID_94307; Strand=-; Position=26-70
EKKPPPPPPPLLKF

SEQ ID NO: 167885 - protein, 37 aa, Heterodera glycines
  Coding regions on vcDNA: vcDNA=SeqID_94308; Strand=-; Position=37-150
DFFLLITAPQYHHSLRAPFALMKYSNFSIIICIYIYI

SEQ ID NO: 167886 - protein, 66 aa, Heterodera glycines
  Coding regions on vcDNA: vcDNA=SeqID_94309; Strand=+; Position=266-466
FFFFLFPYFFLNFLTSKFKLLTIKNFDHLKCFFQDLNVSYINIPRKYKTFRFVFWGFRFVASSTPK

SEQ ID NO: 167887 - protein, 55 aa, Heterodera glycines
  misc_feature (15)..(16): Xaa can be any naturally occurring amino acid
  Coding regions on vcDNA: vcDNA=SeqID_94310; Strand=-; Position=82-249
FFFFFFFFFFFFFFXXNQSFIKFLINLPFKRIWGKRENRTTNITSKPMGNYVGNK

SEQ ID NO: 167888 - protein, 55 aa, Heterodera glycines
  Coding regions on vcDNA: vcDNA=SeqID_94311; Strand=-; Position=1-165
FFFRFVLRFLFKWKSFGTFVVDERKMANSEEKVEQMLCLFSKRFAPPKTFFPSFS

SEQ ID NO: 167889 - protein, 134 aa, Heterodera glycines
  Coding regions on vcDNA: vcDNA=SeqID_94312; Strand=+; Position=35-436
MSFGAADSGDFDDYDKNGADEKEFRWPPEFCSDSLCIQPNATAPGGASFVLLPLLTHCLQDEALSQILPLFLLVTLPILWVQLSAARREQRETHCDRSLPRGILIKMRKGITIMLFVLKSLLLVRNCYGWLWGN

SEQ ID NO: 167890 - protein, 168 aa, Heterodera glycines; identical to SEQ ID NO: 143873
  Coding regions on vcDNA: vcDNA=SeqID_94313; Strand=-; Position=1-504

SEQ ID NO: 167891 - protein, 86 aa, Heterodera glycines
  misc_feature (57)..(57): Xaa can be any naturally occurring amino acid
  Homolog annotation: Hit_ID=AAO49799.1; Match level="QueryCoverage =94%, HitCoverage=22%, E-value=9e-17, Identity=58%"; Hit description =arginine kinase [Heterodera glycines]
  Coding regions on vcDNA: vcDNA=SeqID_94314; Strand=+; Position=2-259
FLYTLKALLVCINNEDRLRMISMTDVGYVGLVLERLIKGVLGIESTAPLSRDDRRAXVTFCTTTWITTDRSTVHIPLPNIWANPTY

SEQ ID NO: 167892 - protein, 28 aa, Heterodera glycines
  Coding regions on vcDNA: vcDNA=SeqID_94315; Strand=+; Position=1-87
MFVVTMAYCFDSYCISLRCSLFLVIFPY

SEQ ID NO: 167893 - protein, 103 aa, Heterodera glycines
  Coding regions on vcDNA: vcDNA=SeqID_94316; Strand=+; Position=174-482
RKKQKPVKCRMFGYVPFASFSNDWSAQFSPPFALPTQPKSRPSSSNSPPSAAEEDENPLPAAFRIGNESESSDESGAERSEHEEEVIRRSKQIRNRERWELLK

SEQ ID NO: 167894 - protein, 127 aa, Heterodera glycines
  Coding regions on vcDNA: vcDNA=SeqID_94317; Strand=-; Position=1-381
SCRFLFNHVRLITLMDICAGLRSTALLELCTRIRPYGLRALVLFRVGVRFLVNEVRDAEVCNGIAAGLAFLSTTVLDLCADAAAGAGDLDVMARVASPPLPADGTALAERIKEAEAREEAALTVDAD

SEQ ID NO: 167895 - protein, 39 aa, Heterodera glycines
  Coding regions on vcDNA: vcDNA=SeqID_94318; Strand=+; Position=71-190
GLIFSFFNFYSLFLSFNIPSHLKVQYFFIFINCDCWKMC

SEQ ID NO: 167896 - protein, 29 aa, Heterodera glycines
  Coding regions on vcDNA: vcDNA=SeqID_94319; Strand=+; Position=3-89
LFSILNSNYNITKCIWPILLIKIFIMSLN

SEQ ID NO: 167897 - protein, 126 aa, Heterodera glycines
  Homolog annotation: Hit_ID=EAL50634.1; Match level="QueryCoverage =99%, HitCoverage=65%, E-value=3e-26, Identity=48%"; Hit description =hypothetical protein 19.t00007 [Entamoeba histolytica HM-1:IMSS]
  Gene Ontology: Biological process=protein biosynthesis
  Coding regions on vcDNA: vcDNA=SeqID_94320; Strand=+; Position=1-378
PEEKPEAPAEGVAVVPEAKKAEETKERLKQEEKPVEVPPSPAEKKRKEAEEKKAQKDAEAKAKKDAEEKAQKDAEAKAKKDAEEKAQKDAEAKAKKDAEEKAQKDAEAKAKKDAEEKAKTDAEAKA

SEQ ID NO: 167898 - protein, 146 aa, Heterodera glycines
  Homolog annotation: Hit_ID=NP_502974.1; Match level="QueryCoverage =94%, HitCoverage=20%, E-value=2e-37, Identity=58%"; Hit description =signal transducer activator of transcription (80.2 kD) (4R613) [Caenorhabditis elegans]
  Coding regions on vcDNA: vcDNA=SeqID_94321; Strand=+; Position=1-438
CEEDGIKVPFHLHPFTIKDLDILSMASRLRTCPQLKEIRYLHPDFDKEEMLAYFESEEQRLRANESTTGYIESEIVMVAKTTGSKLCSALGSDSPSPMSNQWSPGDIQQGNSMEISDEIVSMLSQNHLEAPNVESLLGGLQIGQRM

SEQ ID NO: 167899 - protein, 159 aa, Heterodera glycines
  misc_feature (112)..(112): Xaa can be any naturally occurring amino acid
  Homolog annotation: Hit_ID=AAO49799.1; Match level="QueryCoverage =100%, HitCoverage=44%, E-value=4e-72, Identity=83%"; Hit description= arginine kinase [Heterodera glycines]
  Gene Ontology: Mol. function=creatine kinase activity; Cellular component=cytoplasm; Biological process=muscle contraction
  Coding regions on vcDNA: vcDNA=SeqID_94322; Strand=+; Position=2-478
KENYVQMESKDEAVFQQLKGDAQLGGTYYPLQGMTNDVQNQLIADHFLFKEGDRFLQEANACRYWPTGLGIFHNAKKTFLVCVNEEDHLRIMSMQNGCNVGQALERLINGAXDIGSTSPLSRDDRLGWLTFCSTHMGTTDRAKGHIRLSKISAKPDFKS

SEQ ID NO: 167900 - protein, 44 aa, Heterodera glycines
  Coding regions on vcDNA: vcDNA=SeqID_94323; Strand=+; Position=2-136
ELAKRKPVQMIRQKVRGRNRQRSFRDRQKSLRAYLLRQQGKKVK

SEQ ID NO: 167901 - protein, 49 aa, Heterodera glycines
  misc_feature (14)..(21): Xaa can be any naturally occurring amino acid
  misc_feature (25)..(25): Xaa can be any naturally occurring amino acid
  Coding regions on vcDNA: vcDNA=SeqID_94324; Strand=+; Position=2-151
NDDAEEVEEGGRRXXXXXXXXITGXTRQARKPNPHPGHLGILKIKKIYF

SEQ ID NO: 167902 - protein, 178 aa, Heterodera glycines
  Homolog annotation: Hit_ID=CAE74694.1; Match level="QueryCoverage =55%, HitCoverage=16%, E-value=4e-18, Identity=45%"; Hit description =Hypothetical protein CBG22508 [Caenorhabditis briggsae]
  Gene Ontology: Mol. function=protein serine/threonine kinase activity; Cellular component=nucleus
  Coding regions on vcDNA: vcDNA=SeqID_94325; Strand=+; Position=21-554
FGVYCIFLRLGDIPEIHTKPILGIEAEVSSDSEGASVALQKTETVDAIVSQTDCELYEWETTPFCQGAEARLFACTFLRRRAVMKERFVKRYRHAELDARLAKERTRAELKAILKCQEIGIRVPSVFFVDPLKNRIIFELICSSGSSDRAPTAKHFLDKLQRDESASNNGEQFAAQLA

SEQ ID NO: 167903 - protein, 139 aa, Heterodera glycines
  Coding regions on vcDNA: vcDNA=SeqID_94326; Strand=+; Position=2-418
RTAICGVENELKEYKMLLNKFNSGATRAQLFNEHAFRRVVYLNNLTPRAICPSIFNVVFNAEYVAGNRKIARAQIIHFVIREVLALTRNACVDIDIYLDTLLDYLSSKINRTEIVIFLKQRGIQNPHHFLITQPISLRR

SEQ ID NO: 167904 - protein, 112 aa, Heterodera glycines; identical to SEQ ID NO: 158708
  Coding regions on vcDNA: vcDNA=SeqID_94327; Strand=-; Position=0-335

SEQ ID NO: 167905 - protein, 46 aa, Heterodera glycines
  Coding regions on vcDNA: vcDNA=SeqID_94328; Strand=+; Position=1-141
ISIHEQVMENTKRMTFRSQQVALQLEKIRIDSRKGATWKKGEREIV

SEQ ID NO: 167906 - protein, 136 aa, Heterodera glycines
  Homolog annotation: Hit_ID=XP_320456.1; Match level="QueryCoverage =80%, HitCoverage=15%, E-value=7e-14, Identity=40%"; Hit description =ENSANGP00000016570 [Anopheles gambiae]
  Gene Ontology: Mol. function=calcium ion binding; Biological process =digestion
  Coding regions on vcDNA: vcDNA=SeqID_94329; Strand=+; Position=3-410
SFVKNPQYWIHIAANEQNRSEFMVISLLQKYRREERRVKLQIGFSVFRVYESSEFLKAENFPLPVYAETPAFSRVREATHHFQLEAGNYVIIPSTFGRNEEGEFLLRIFTTGTIGMYNSTPKNLCPEQRYNFGVRE

SEQ ID NO: 167907 - protein, 94 aa, Heterodera glycines
  Homolog annotation: Hit_ID=NP_060277.1; Match level="QueryCoverage =98%, HitCoverage=27%, E-value=1e-34, Identity=76%"; Hit description =O-sialoglycoprotein endopeptidase [Homo sapiens] dbj|BAA91150.1| unnamed protein product [Homo sapiens] g
  Gene Ontology: Biological process=proteolysis and peptidolysis
  Coding regions on vcDNA: vcDNA=SeqID_94330; Strand=+; Position=2-286
VEITERAMAHSGTAEVLIVGGVGCNERLQQMMDTMAQERGAKLFATDERFCIDNGAMIAQAGWEMYRAGLRASLDQCTYTQRYRTNQVNVCWRK

SEQ ID NO: 167908 - protein, 150 aa, Heterodera glycines
  Coding regions on vcDNA: vcDNA=SeqID_94331; Strand=+; Position=3-455
FSPIHRIYLAQERMSSGGAKVIPGGVVAVKRFCPRALCAAIGCWQFAAVCCALLMVQASIVTSMHIKDTQNDEDVLRRHLQFRQQQQPIFALPLDVFDASPTAVIGLKPFAEHLVFEKRFAPREMGKRERIIMDAMGGNDYLIKRSFGRK

SEQ ID NO: 167909 - protein, 16 aa, Heterodera glycines
  Coding regions on vcDNA: vcDNA=SeqID_94332; Strand=-; Position=1-51
FFFFFGLKFNRQFSSY

SEQ ID NO: 167910 - protein, 141 aa, Heterodera glycines
  Coding regions on vcDNA: vcDNA=SeqID_94333; Strand=+; Position=62-484
FLKMHRIPFIQLFILLINMIGIANSKDGIKNLFVGKKNNNDYDKCSDQFHYEVIEDGTTEEEDMKKAIQIGKTFFWREMIAKWECENEDLYNNPQKIGKKSIKKLKRICENWKMKALSADAFVKSLKCKKKQKYFMVTLLI

SEQ ID NO: 167911 - protein, 145 aa, Heterodera glycines
  Homolog annotation: Hit_ID=CAE60607.1; Match level="QueryCoverage =99%, HitCoverage=20%, E-value=3e-34, Identity=48%"; Hit description =Hypothetical protein CBG04247 [Caenorhabditis briggsae]
  Gene Ontology: Mol. function=translation initiation factor activity; Cellular component=eukaryotic 48S initiation complex; Biological process=nucleobase, nucleoside, nucleotide and nucleic acid metabolism
  Coding regions on vcDNA: vcDNA=SeqID_94334; Strand=+; Position=2-436
GKIEPANGLNTAMWAPQGGWVVVMGVNTSSGIVSFIDATGAEANKAETIEHTSLSQGSWDPTGRYFATCTFAGKSRYETGYRIHSFQGRELRRKAVDALLRLKWRPRPPVSLSEQKVRETRKSLKQLSAKFEEEDKREMLKVSKE

SEQ ID NO: 167912 - protein, 131 aa, Heterodera glycines
  Coding regions on vcDNA: vcDNA=SeqID_94335; Strand=+; Position=3-395
YDAIMRECVRRKYFFWRNVLKERPETKEKQQSKEQVVQAVRGYKLPTQLFFTAAGIGIAYMLGLYNNPMSYRIICLGTGLLFGTFYGEFKYATEIFDSLPKLPDKALEKERQDIYNYCFSLDVRLIADALA

SEQ ID NO: 167913 - protein, 152 aa, Heterodera glycines
  Coding regions on vcDNA: vcDNA=SeqID_94336; Strand=+; Position=1-456
DEEVSPSGSCAEEEEEEEDEQQHQGGTGPPMLNVLDELVGQLEGLDIDQQQEHKMGLSDHLHQQQHHQPMPPAPRYADSWLDNISLVPSDSGSACLYTGANNVCAAAVPMASPFQQSLPPSSLVEPPCSDYMTVPPMLASVDLAMPAEPSPL

SEQ ID NO: 167914 - protein, 37 aa, Heterodera glycines; identical to SEQ ID NO: 126029
  Coding regions on vcDNA: vcDNA=SeqID_94337; Strand=+; Position=2-115

SEQ ID NO: 167915 - protein, 150 aa, Heterodera glycines
  Coding regions on vcDNA: vcDNA=SeqID_94338; Strand=+; Position=71-520
MKNNLEEGLNTEQRNTNQRKDQSSSTASSSRSEQTSKIEERLSPDQKHDKLNKNDRKTSTTSKKDETKLKIKPTFEQNQDQNATRSSSKTKQKKGNEKPINDQRPSRNLEQTTSIASNSDQAKSKKEINLANRQGSGQISQNATAASKSD

SEQ ID NO: 167916 - protein, 79 aa, Heterodera glycines
  misc_feature (72)..(72): Xaa can be any naturally occurring amino acid
  Coding regions on vcDNA: vcDNA=SeqID_94339; Strand=+; Position=20-256
SRHGKWSGQVEQKERGKVRQSLVVDVLALHAHLFYFLKLSNKSGSFSHNHFPLLIFYFPCFFICNKFVYFFXKKKKKKK

SEQ ID NO: 167917 - protein, 78 aa, Heterodera glycines
  Coding regions on vcDNA: vcDNA=SeqID_94340; Strand=+; Position=378-611
CFSNCPSADVVLVVLFVYVVYKLFFARRHIPPPPDVPQVEPLGEQDMTVEQLRRYDGVQDEHICMAICGKICDVTKGR

SEQ ID NO: 167918 - protein, 73 aa, Heterodera glycines
  Coding regions on vcDNA: vcDNA=SeqID_94341; Strand=+; Position=211-429
NNYLIIFLENASPPPIMNVHKIVLFLFVLLSFCAAGVHCHSDNDERNKPKSALKKQKDKTKGGNPHTPTRRKM

SEQ ID NO: 167919 - protein, 151 aa, Heterodera glycines
  Homolog annotation: Hit_ID=NP_032206.1; Match level="QueryCoverage =89%, HitCoverage=27%, E-value=3e-10, Identity=36%"; Hit description =glutathione synthetase [Mus musculus] gb|AAH03784.1| Glutathione synthetase [Mus musculus] gb|AAL87534.1|
  Coding regions on vcDNA: vcDNA=SeqID_94342; Strand=+; Position=121-573
MLQRAGFQPAPEDLPENWPDKAQIESIKMAWEAYNKSDAIVVILINEISETIFDANFFETELDRLSNGRIKVERITLNDCAHRCKLDENFALRLDGREVAVVKSRYSVLGLRARGSELNILKNLRLMLERSLAIKIPSTFIGFSCSKKVPQ

SEQ ID NO: 167920 - protein, 135 aa, Heterodera glycines
  Coding regions on vcDNA: vcDNA=SeqID_94343; Strand=+; Position=2-409
QKKRISKTGEGEEEEGEELIQQEDDLQSVESQNENCRADFCLDRHDHQQNGNAADDDDDDDECCDQEKLKLIEQQETMTTAEAPLEAKGRPRPAMLQIHTVQPYQSAEKVKSPAPNAAADEAFLGQMREKKKWPV

SEQ ID NO: 167921 - protein, 166 aa, Heterodera glycines
  Homolog annotation: Hit_ID=XP_419258.1; Match level="QueryCoverage =96%, HitCoverage=8%, E-value=5e-15, Identity=34%"; Hit description =PREDICTED: similar to kinesin family member 21B; N-5 kinesin [Gallus gallus]
  Gene Ontology: Mol. function=microtubule motor activity; Cellular component=kinesin complex; Biological process=anterograde axon cargo transport
  Coding regions on vcDNA: vcDNA=SeqID_94344; Strand=+; Position=3-500
TCVSPNEVDANETLSSLNYANRAKNIKNKVVANQNKSSTLITDLRIKIQLLEAELHEWKTGKRRRSGHIAVTEPEDKNSTEQVFGCLARLDEEEEAEDADNEEEPGEMEHERICTDLDKLQENISSKERLMANYEKELEKIKQEINRLEETKKENKQEINRLEETK

SEQ ID NO: 167922 - protein, 163 aa, Heterodera glycines
  Coding regions on vcDNA: vcDNA=SeqID_94345; Strand=+; Position=3-491
AGGDAAMQRQHQQQQQQQQNSLCPQQHMGMMCENGWRASDNAIGDPSLPFPTGQLGKRNRAVHEIHIPSGSGGAPLLHSQLRKMRISTGASVPSTPNPTTSDQNSPGPTEKRVGGVGTVLGMSKRISLPENLEFQPQMLLNLKQSIHVEKQLTSNSDTSDSAS

SEQ ID NO: 167923 - protein, 11 aa, Heterodera glycines
  Coding regions on vcDNA: vcDNA=SeqID_94346; Strand=-; Position=2-34
FEFCFYSTLTI

SEQ ID NO: 167924 - protein, 51 aa, Heterodera glycines
  misc_feature (46)..(46): Xaa can be any naturally occurring amino acid
  misc_feature (50)..(51): Xaa can be any naturally occurring amino acid
  Homolog annotation: Hit_ID=CAE75515.1; Match level="QueryCoverage =92%, HitCoverage=32%, E-value=1e-13, Identity=63%"; Hit description =Hypothetical protein CBG23530 [Caenorhabditis briggsae]
  Coding regions on vcDNA: vcDNA=SeqID_94347; Strand=+; Position=2-154
PPCPPPCPPPCCCCGGGGGGGGGRPIIVNCGGGGGGCGGGCGGGGXGCGXX

SEQ ID NO: 167925 - protein, 100 aa, Heterodera glycines
  Coding regions on vcDNA: vcDNA=SeqID_94348; Strand=-; Position=63-365
WVLSSCCFTTSSNCGFTFKSPPTNASTANAIIFHFSHNLTNSSADSSSPISSGFFIFPISQCQWRQMCCEFVSLFQCLSSPLCHNSQSFQIGTGPSHPQK

SEQ ID NO: 167926 - protein, 80 aa, Heterodera glycines
  Coding regions on vcDNA: vcDNA=SeqID_94349; Strand=-; Position=1-240
SPHGIFEEHHLCSCCWCCSPNSLRFPPFLLGHKLSVVRWSSLARGKMPKMAKQIGAKQRQICPQICSLFYFMWIIVFILI

SEQ ID NO: 167927 - protein, 131 aa, Heterodera glycines
  Homolog annotation: Hit_ID=NP_493376.1; Match level="QueryCoverage =99%, HitCoverage=60%, E-value=2e-66, Identity=91%"; Hit description =RAB family member (24.0 kD) (rab-27) [Caenorhabditis elegans] dbj|BAD07035.1| Rab27 [Caenorhabditis elega
  Gene Ontology: Mol. function=RAB small monomeric GTPase activity; Cellular component=synaptic vesicle; Biological process =neurotransmitter secretion
  Coding regions on vcDNA: vcDNA=SeqID_94350; Strand=+; Position=64-456
MADYDYLIKFLALGDSGVGKTSFLHRYTDNSFTGQFISTVGIDFKEKKVVYKNARGGFGGRGQRILLQLWDTAGQERFRSLTTAFFRDAMGFIQIFDITNEQSFLNVRDWLSQLKIHAYTETPDIILCGNN

SEQ ID NO: 167928 - protein, 161 aa, Heterodera glycines
  Coding regions on vcDNA: vcDNA=SeqID_94351; Strand=+; Position=1-483
KADEFGSPLKLKRPTDGYTKLTHERADETQSSSAGNGTEFGRSVPSSSDLVLLVRAPSPSLRQLPFLSPVKNWGGFLSPKQTVETVSAISEFSADLFKTPSPARLGKRPIICANVGQLLTPEKSTISMAEKSDESSQLNEKGAETEMERELVEKKKRTQRK

SEQ ID NO: 167929 - protein, 146 aa, Heterodera glycines
  Coding regions on vcDNA: vcDNA=SeqID_94352; Strand=-; Position=0-437
SLFFLHRSSNHFSFSFPLFLRSHFFPLITFLLRFSYLITFFLRFSFDHFSSSIVPLIIFFSFPLFLRSHFFPLITFLLRFSYLITFSSAFPLITFLLRFSFDHFSSSSVPPITFLLRFSSLITFSSAFPLITFLLRFSFDHFSSSS

SEQ ID NO: 167930 - protein, 147 aa, Heterodera glycines
  misc_feature (98)..(98): Xaa can be any naturally occurring amino acid
  Homolog annotation: Hit_ID=CAE73700.1; Match level="QueryCoverage =94%, HitCoverage=24%, E-value=2e-18, Identity=40%"; Hit description =Hypothetical protein CBG21211 [Caenorhabditis briggsae]
  Coding regions on vcDNA: vcDNA=SeqID_94353; Strand=+; Position=1-440
YLQGGLQGVGLKTAEEVFTKASSHATLPSVLVRLQLYTNKRLKVKVDADFVDAFVRAENTFLYQIVFDPLKREQRPLNAYPETGEEKENLLDNEKKSXSPRNALRLALGNDDLSKSSLEDEFVLPSEIPVSSIWNSNYKKVLETEKD

SEQ ID NO: 167931 - protein, 94 aa, Heterodera glycines
  Coding regions on vcDNA: vcDNA=SeqID_94354; Strand=-; Position=0-281
ALPFINKKHISSKFKAINMSFCHFIGRAFRVSLCFSFFSAFHPSAVAYGVVCSWTNLVASSVNSFAPGRTRSSTNLPAPVSSLIWLALAPTSFA

SEQ ID NO: 167932 - protein, 109 aa, Heterodera glycines
  Coding regions on vcDNA: vcDNA=SeqID_94355; Strand=-; Position=17-346
ISRFSIPESRNFSGFLGSRFSYRFSGSFLGLVSRFPVKITSRTALLHYPPFSSSSSASFPPFVFFLFLPLFILLSRSSFLTLPLLASFPQFLFLPTTVGPTSLSRTIIF

SEQ ID NO: 167933 - protein, 152 aa, Heterodera glycines
  Homolog annotation: Hit_ID=NP_625403.1; Match level="QueryCoverage =97%, HitCoverage=54%, E-value=5e-31, Identity=48%"; Hit description =putative secreted lyase [Streptomyces coelicolor A3(2)] emb|CAC13062.1| putative secreted lyase [Streptom
  Coding regions on vcDNA: vcDNA=SeqID_94356; Strand=+; Position=23-478
MHSFLVLTILFANLATNAFGQQWPKATSEETVKATIKVSGGVKDFGFKRLTASSALGSGDQSEGQKALIRAEKNAVIKNLIIGQNGADGIHCYDGCTLQNVWWENDGEHAATFRSSIGCKEYSFTDTRGGVKNAKDKVFQMNGGGTLTIKNF

SEQ ID NO: 167934 - protein, 80 aa, Heterodera glycines
  Coding regions on vcDNA: vcDNA=SeqID_94357; Strand=+; Position=1-243
YVAYCRNSDDLDWYEFDDANVTRVNSLEVLSQEAYILFYRQKETLEDEEAMEEDEVLEEEEEWVEANSSDEMETEGGNGT

SEQ ID NO: 167935 - protein, 120 aa, Heterodera glycines
  Homolog annotation: Hit_ID=CAE67840.1; Match level="QueryCoverage =95%, HitCoverage=51%, E-value=5e-15, Identity=33%"; Hit description =Hypothetical protein CBG13426 [Caenorhabditis briggsae]
  Coding regions on vcDNA: vcDNA=SeqID_94358; Strand=+; Position=1-363
NNYNVIKSGNVKMTITNPNYDKPLCLKGLSQYEALPSSLCNFDLCNFIGRNLCELLQRPGNHTVREMEQKAGWNATVVIPESPRIFGIPFVDLFAGEFNFEFLMKTDERKERKTALIENQ

SEQ ID NO: 167936 - protein, 24 aa, Heterodera glycines
  Coding regions on vcDNA: vcDNA=SeqID_94359; Strand=-; Position=2-73
FMYKNHYNIKMINGIKRINALIYR

SEQ ID NO: 167937 - protein, 99 aa, Heterodera glycines
  Homolog annotation: Hit_ID=NP_001002323.1; Match level="QueryCoverage= 98%, HitCoverage=63%, E-value=4e-14, Identity=37%"; Hit description =zgc:91915 [Danio rerio] gb|AAH76454.1| Zgc:91915 [Danio rerio]
  Coding regions on vcDNA: vcDNA=SeqID_94360; Strand=+; Position=3-302
TAAIRETMEEAGIDVNKLRIHKEFMYEMRYLSKSTKYGEEQKKVTYWLAESTDPEVIVMLSDEHQNWKWAELKSALELAKFDEMKKLLNKAEMFIAENL

SEQ ID NO: 167938 - protein, 104 aa, Heterodera glycines
  Coding regions on vcDNA: vcDNA=SeqID_94361; Strand=+; Position=3-317
LFWPCANGARGVPFADAYCEGAPPKENEHSPRPPGGGVPLRGPGGRSRDNPALSETNFFLFWLAFFPKVPTFFKCNISIDRKSIQILQKYYFHIIVLIKFVLFT

SEQ ID NO: 167939 - protein, 128 aa, Heterodera glycines
  misc_feature (62)..(62): Xaa can be any naturally occurring amino acid
  misc_feature (90)..(90): Xaa can be any naturally occurring amino acid
  Homolog annotation: Hit_ID=AAL78212.1; Match level="QueryCoverage =89%, HitCoverage=100%, E-value=2e-30, Identity=53%"; Hit description= putative esophageal gland cell secretory protein Hgg-25 [Heterodera glycines]
  Coding regions on vcDNA: vcDNA=SeqID_94362; Strand=+; Position=68-453
MRTFLFIAVVGLMLAVILENVNATGKNSPSKGKPSSDSTNHKKDHKNEHPKYDSPILAGSSXVRKKENRRMPIRKKAASHHVPVTPGKVXEQSLKMVKKLCGTMMPTMNKPKAVVVDVEKKLWYHHAF

SEQ ID NO: 167940 - protein, 45 aa, Heterodera glycines
  Homolog annotation: Hit_ID=NP_500424.2; Match level="QueryCoverage =64%, HitCoverage=4%, E-value=1e-09, Identity=86%"; Hit description =zinc finger plus homeodomain, Axon Guidance ZAG-1, ZAG-1 (zag-1) [Caenorhabditis elegans]
  Gene Ontology: Biological process=mesoderm development
  Coding regions on vcDNA: vcDNA=SeqID_94363; Strand=+; Position=3-140
KCLKRFSHSGSYSQHMNHRYAYCKPFMQQRQRAEERTPSKDENTE

SEQ ID NO: 167941 - protein, 49 aa, Heterodera glycines
  Coding regions on vcDNA: vcDNA=SeqID_94364; Strand=+; Position=2-151
QNQNMKFETYFSFGPRLKNPRLFPRRSNNIVNDKYLVNISKDMVPPARA

SEQ ID NO: 167942 - protein, 72 aa, Heterodera glycines
  Homolog annotation: Hit_ID=AAM44291.1; Match level="QueryCoverage =61%, HitCoverage=28%, E-value=2e-13, Identity=75%"; Hit description =superoxide dismutase [Aplysia californica]
  Gene Ontology: Mol. function=copper, zinc superoxide dismutase activity; Cellular component=cytoplasm; Biological process =neurogenesis
  Coding regions on vcDNA: vcDNA=SeqID_94365; Strand=+; Position=98-316
SFSKHPKSRGRLLLNSVVGRALVVHEKADDMGKGGNEESGKTGNAGKRIACGVVGVIREEPMKVTTDQTNGM

SEQ ID NO: 167943 - protein, 39 aa, Heterodera glycines
  Coding regions on vcDNA: vcDNA=SeqID_94366; Strand=-; Position=2-118
FFFFHIKIYQIAISNGLSSRITSLFPCRPIMPNRHTSSN

SEQ ID NO: 167944 - protein, 138 aa, Heterodera glycines
  Homolog annotation: Hit_ID=XP_516604.1; Match level="QueryCoverage =99%, HitCoverage=22%, E-value=1e-24, Identity=40%"; Hit description =PREDICTED: similar to ADP-ribosylation factor-like 2-like 1 isoform 1 [Pan troglodytes]
  Gene Ontology: Mol. function=ARF small monomeric GTPase activity; Cellular component=cytosol; Biological process=ER to Golgi transport
  Coding regions on vcDNA: vcDNA=SeqID_94367; Strand=+; Position=17-430
MVGFSRAELRVKKYRITVYDLGGSARIREIWPIYFAEVFGVVFVLDASAASLISENKKMVDSLVGLPDLLGKPILFLLNKKDLPEALDEMQFSERFNLHSMAKQNRTDIRVEGICAVKGTGKEIDQVIVEGLEWLIEV

SEQ ID NO: 167945 - protein, 47 aa, Heterodera glycines
  Coding regions on vcDNA: vcDNA=SeqID_94368; Strand=-; Position=1-141
MIIHQHDRRFPPMMMHQHDRRFPPHCFCWAPWTCFVDSMHHHHQNHL

SEQ ID NO: 167946 - protein, 120 aa, Heterodera glycines
  Coding regions on vcDNA: vcDNA=SeqID_94369; Strand=+; Position=94-453
SKKKNPLNYREFMELLEQTNCIYQTMSNSAICNTTRIFVNIQNWVEFSMVCGSFVAIAMNVLIIYCALRIFNRKNRDTIHVYIISMTMGDLILVICQFLESMNRLTPVQFISSSYYACFL

SEQ ID NO: 167947 - protein, 96 aa, Heterodera glycines
  Coding regions on vcDNA: vcDNA=SeqID_94370; Strand=+; Position=187-474
MNVIQSKTVIKKKSQWKPLEIGSKSERLRNKVRNFQSKTRFFVQQRKFRTQKNCLSELYRLHSELQIGCARPQKIRPSLLTPMDRSGKGRDGELGT

SEQ ID NO: 167948 - protein, 161 aa, Heterodera glycines
  Homolog annotation: Hit_ID=AAK08974.1; Match level="QueryCoverage =96%, HitCoverage=59%, E-value=3e-87, Identity=100%"; Hit description= pectinase precursor [Heterodera glycines]
  Coding regions on vcDNA: vcDNA=SeqID_94371; Strand=+; Position=43-525
MMLFILLVITFVQIGQLNAGICTFPNPSKSVTVQSMMTVSSSTDYKNTLFVGGSGILNGACDVNNDKLKYLMTLKNGVTIKNAILDTPGLGIYCEGNCVLENIYYKRLCYHATGFGYKSTSTSYTYQVIGGAGQGSPDKYFTQSGKGTTIIKNFCAEANTA

SEQ ID NO: 167949 - protein, 175 aa, Heterodera glycines
  Coding regions on vcDNA: vcDNA=SeqID_94372; Strand=-; Position=2-526
QIEGANGNVTLALVLPLNASPGFSLRRAIVFDSSVRPVGCSCASSVLNVDQQIDYAGFRVLFEPFVPNTAQFPVDDLAEQFVLVPIVLLPFRFRRPSRAPFAFFGISFRFLCQMGSLMVRMRKGGTREWTQQRSGHNGRAAAAAKGRGGRSGRGRADHVGRGGRNFLARHPFRNC

SEQ ID NO: 167950 - protein, 171 aa, Heterodera glycines
  Homolog annotation: Hit_ID=CAE56922.1; Match level="QueryCoverage =98%, HitCoverage=31%, E-value=3e-35, Identity=38%"; Hit description =Hypothetical protein CBG24767 [Caenorhabditis briggsae]
  Gene Ontology: Cellular component=membrane fraction; Biological process=metabolism
  Coding regions on vcDNA: vcDNA=SeqID_94373; Strand=+; Position=2-514
VFVNVDEFTDFPRPLFPNFIFIGGLELEGTPELKALQEPFKSELLKGRKGVVFFSMGSAVKTDVLPAPFMKNVIGAFAELPDWHFIVKIEPDDEQSRRMAENVPNIRLTSWAPQPAILSHPRLRLFITHGGYNSLLEGAQGGTPVLSIGFFADQRKNALVAQRNGWGKRDR

SEQ ID NO: 167951 - protein, 81 aa, Heterodera glycines
  Coding regions on vcDNA: vcDNA=SeqID_94374; Strand=+; Position=55-300
MLPMDGDFVVRLHQRTPPLRFRFFNLLSVPSQVQAESIDKVSRIAFPTMFALFNIVYWSYYGRKAAETSAELHSSGGMMIQ

SEQ ID NO: 167952 - protein, 47 aa, Heterodera glycines
  Coding regions on vcDNA: vcDNA=SeqID_94375; Strand=-; Position=103-246
TSPIYSFVNEQKSIQPHSNGIIPNPIFDHIIASINQSTNQFISSVCC

SEQ ID NO: 167953 - protein, 163 aa, Heterodera glycines
  Coding regions on vcDNA: vcDNA=SeqID_94376; Strand=+; Position=3-491
GKLEQKVRELSERCAEAERRSIELEAKMADKTEQTKTGQSEAIVENVTVAKRFRAFDRQLLQQKSDVDPITVLCSETFSLGLQKSDNGEGNSDPSECPREFSTSTPVPSFCSKSESSVSLNILQNADTDCEIPHIMANEGNLCDFCVTSRKELDYFKSLLGHL

SEQ ID NO: 167954 - protein, 144 aa, Heterodera glycines
  Coding regions on vcDNA: vcDNA=SeqID_94377; Strand=+; Position=2-433
ENPFQSLNSPDDDFMVEIGDRKVALSASRLRCFSPVIDRMLSVEMREKQQRSVTLNELSIDMDQFLDFLLYISPNALSQPILPNPKNVLTLLSLASYFQIDWLKSRCETLLFNCVEVPLIDRVNLIEKYGLTNLKNFFLNLNVH

SEQ ID NO: 167955 - protein, 41 aa, Heterodera glycines
  Coding regions on vcDNA: vcDNA=SeqID_94378; Strand=+; Position=1-126
RLQHGCNDGCSCLQNQHIILVSRKFREILYPFIDTTHSCFY

SEQ ID NO: 167956 - protein, 87 aa, Heterodera glycines
  Coding regions on vcDNA: vcDNA=SeqID_94379; Strand=-; Position=123-386
FLKKNFFFGNLCHFQLLFRTNSNFLFLKVRTSSTAFVLSILCGTSIELCTPKKFFQYIGTYSKVTHVPFTINVVMLNDSHQMQRSAG

SEQ ID NO: 167957 - protein, 149 aa, Heterodera glycines
  Homolog annotation: Hit_ID=CAB40412.1; Match level="QueryCoverage =80%, HitCoverage=24%, E-value=1e-37, Identity=64%"; Hit description =hexokinase [Haemonchus contortus]
  Gene Ontology: Mol. function=hexokinase activity; Cellular component =membrane; Biological process=glycolysis
  Coding regions on vcDNA: vcDNA=SeqID_94380; Strand=+; Position=3-449
IYFFFPFSAPTASVKMLPTYIRAIAVGEEHGEFLALDLGGTNFRVLLITLKGDCRSTMRSKIYRVPDHIQKGTGTALFDHIAACLAKFMEEHKLTGRPKLPLGFTSSFPCQQHGLTSARLTNWTKGFKVKANGWVVFGISFGVRRARHD

SEQ ID NO: 167958 - protein, 81 aa, Heterodera glycines
  Coding regions on vcDNA: vcDNA=SeqID_94381; Strand=+; Position=65-310
MGSERTEYQQMLRRSFDGMLERLPTFFDGEKFLPDVTSQDGKAALGGANSQLVNGVLDRLSQIGGMAAEMHIFDSISGLSE

SEQ ID NO: 167959 - protein, 170 aa, Heterodera glycines
  Coding regions on vcDNA: vcDNA=SeqID_94382; Strand=-; Position=1-510
CVFRAFSAQISCSFADVLVEVVDYVQQIAHHTNGGHFVFRVLLNAFPHPDVRSLRLYVQNVMVLQERVQLSNSMLKGRHNLRREFCAKCKRRIIHNFPHFRLNFLEEWHQPIVPMARPLFRRGNFVDGTEEHRSGVFAIVATKQRKDFLFDLLGDSNHMLIPLLLNKFRK

SEQ ID NO: 167960 - protein, 99 aa, Heterodera glycines
  Coding regions on vcDNA: vcDNA=SeqID_94383; Strand=-; Position=77-376
IKKYKNLFLFLKFNILNAAKNKRLKAFCARSFLSSILCFFFLAMASNHHLRRCCHFLLRVLLHVLHFRFSFFHLLFLHFRFFVVSFKIFTISRWICIDD

SEQ ID NO: 167961 - protein, 24 aa, Heterodera glycines
  Coding regions on vcDNA: vcDNA=SeqID_94384; Strand=-; Position=7-81
MNCFSSHRNNGTYIYIYNTSMVLF

SEQ ID NO: 167962 - protein, 29 aa, Heterodera glycines
  Coding regions on vcDNA: vcDNA=SeqID_94385; Strand=+; Position=3-92
DLVIYWHNLSIKYQNLAKKQTSRFVDLRL

SEQ ID NO: 167963 - protein, 142 aa, Heterodera glycines
  Coding regions on vcDNA: vcDNA=SeqID_94386; Strand=+; Position=3-428
MALENGRTMNGTQQNNKTAIRPSEFEDDTESRDFENLSMSVSEASSEVGSVSIQDGAMLNQNERPMLENGITKRNVRLKSDLRISPASSGSWERAIRPVVNKHHNANAASVGRRPAANTQRSSVCWYCGVKGHAAAHCQKKR

SEQ ID NO: 167964 - protein, 107 aa, Heterodera glycines
  Homolog annotation: Hit_ID=CAE56933.1; Match level="QueryCoverage =61%, HitCoverage=25%, E-value=6e-14, Identity=50%"; Hit description =Hypothetical protein CBG24778 [Caenorhabditis briggsae]
  Coding regions on vcDNA: vcDNA=SeqID_94387; Strand=+; Position=1-324
RKCEKTHILTNKIIMTSCGFYGDVLQLRRILELRINHFEFIYQRPMSLDQCGEMLSRTLYSRRWWPNECHDDVGRGRSIAWPIRESRPNSVQGHRNFNQIEFKIQTQ

SEQ ID NO: 167965 - protein, 142 aa, Heterodera glycines
  Homolog annotation: Hit_ID=XP_316970.1; Match level="QueryCoverage =93%, HitCoverage=88%, E-value=2e-38, Identity=54%"; Hit description =ENSANGP00000019353 [Anopheles gambiae]
  Coding regions on vcDNA: vcDNA=SeqID_94388; Strand=+; Position=23-448
METLLDKTIFSVIDPPNLRINLPRWFTFPTPMQTFFFILLTYFLVSGGIVYDVINEPPSIGSTVDERGNSRPVAIMPYRVNGQYIMEGLVASLMFCLGGLGIIILDKCTHPLTAKNNRMMLFGLGFSLLCIGFFTTRMFMKM

SEQ ID NO: 167966 - protein, 54 aa, Heterodera glycines; identical to SEQ ID NO: 140431
  Coding regions on vcDNA: vcDNA=SeqID_94389; Strand=-; Position=157-321

SEQ ID NO: 167967 - protein, 24 aa, Heterodera glycines
  Coding regions on vcDNA: vcDNA=SeqID_94390; Strand=-; Position=1-72
NQNYSIKIIDRKINFLHSLRWNFR

SEQ ID NO: 167968 - protein, 100 aa, Heterodera glycines
  Homolog annotation: Hit_ID=NP_508864.2; Match level="QueryCoverage =83%, HitCoverage=53%, E-value=2e-32, Identity=79%"; Hit description =unidentified Vitellogenin-linked Transcript (17.8 kD) (uvt-2) [Caenorhabditis elegans] gb|AAA81454.2| Uni
  Gene Ontology: Mol. function=calcium ion binding; Biological process =signal transduction
  Coding regions on vcDNA: vcDNA=SeqID_94391; Strand=+; Position=117-419
LAHCFYGQISFQEFLCIARANPLSLSLKSVFDELDVDGDGFITRSELRMAFQQMGHALNDADIKAIYKRVDKNQDGKINFKEFCEMMTRGSTSNSSNSNS

SEQ ID NO: 167969 - protein, 39 aa, Heterodera glycines
  Coding regions on vcDNA: vcDNA=SeqID_94392; Strand=-; Position=5-124
TRKLKCLRSIIHPPPNGSIDPAQFTLILRSDVPRRGRVG

SEQ ID NO: 167970 - protein, 18 aa, Heterodera glycines
  Coding regions on vcDNA: vcDNA=SeqID_94393; Strand=-; Position=1-54
LFASLGFFQKCLLIIFRD

SEQ ID NO: 167971 - protein, 54 aa, Heterodera glycines; identical to SEQ ID NO: 158706
  misc_feature (12)..(12): Xaa can be any naturally occurring amino acid
  Homolog annotation: Hit_ID=AAC78831.1; Match level="QueryCoverage =100%, HitCoverage=68%, E-value=2e-14, Identity=66%"; Hit description= lacZ alpha peptide [Expression vector pYZ81N] gb|AAC78828.1| lacZ alpha peptide [Expression vector pYZ41N
  Coding regions on vcDNA: vcDNA=SeqID_94394; Strand=+; Position=2-163

SEQ ID NO: 167972 - protein, 30 aa, Heterodera glycines
  Coding regions on vcDNA: vcDNA=SeqID_94395; Strand=-; Position=99-191
FFFFFFKKIFFFFFFFFFFFSIGYFYFLMR

SEQ ID NO: 167973 - protein, 39 aa, Heterodera glycines
  Coding regions on vcDNA: vcDNA=SeqID_94396; Strand=+; Position=1-120
CGKRTRKRQKILTRCCGVPKYSKNSVFNPVVLILHYTCF

SEQ ID NO: 167974 - protein, 136 aa, Heterodera glycines
  misc_feature (56)..(56): Xaa can be any naturally occurring amino acid
  misc_feature (74)..(74): Xaa can be any naturally occurring amino acid
  misc_feature (88)..(88): Xaa can be any naturally occurring amino acid
  misc_feature (106)..(106): Xaa can be any naturally occurring amino acid
  Homolog annotation: Hit_ID=AAL31950.1; Match level="QueryCoverage =88%, HitCoverage=27%, E-value=8e-23, Identity=55%"; Hit description =CDH1-D [Gallus gallus]
  Coding regions on vcDNA: vcDNA=SeqID_94397; Strand=+; Position=2-410
VDDSPLQGIPRSRTIIAMSDPNHGKSSPVYQPLSGKDKHADFASVARVKPRTSKGXHRPVIAQFRAAEHRKSLXEVVPTEAMSQLFSXARVSLVIGINQTNRSTNXERPCTTIHRIMKKLSICQSLRCPGRVSSWI

SEQ ID NO: 167975 - protein, 64 aa, Heterodera glycines
  Coding regions on vcDNA: vcDNA=SeqID_94398; Strand=-; Position=43-237
KWQMNNSSLSTSFFCHSHLFVLIQRSLSSKNSSILSQFFPFCPRFYGPCCLIGCRSFDHQKNNG

SEQ ID NO: 167976 - protein, 74 aa, Heterodera glycines
  misc_feature (48)..(48): Xaa can be any naturally occurring amino acid
  misc_feature (51)..(52): Xaa can be any naturally occurring amino acid
  misc_feature (74)..(74): Xaa can be any naturally occurring amino acid
  Coding regions on vcDNA: vcDNA=SeqID_94399; Strand=+; Position=2-226
HPCPRGRSLRFLHPQPFFYSFCWTFRSIFFTILRIFNSSIASLINFVXGKXXKNFFFLKKKKKGKNKKFFFFIX

SEQ ID NO: 167977 - protein, 37 aa, Heterodera glycines
  Coding regions on vcDNA: vcDNA=SeqID_94400; Strand=-; Position=2-112
TFPQRAYPVLASVSRRYSEPKGRFPRVTHPCTTKAEA

SEQ ID NO: 167978 - protein, 22 aa, Heterodera glycines
  Coding regions on vcDNA: vcDNA=SeqID_94401; Strand=-; Position=50-118
FFFFFFFKENHFYQILYNIKTL

SEQ ID NO: 167979 - protein, 39 aa, Heterodera glycines
  Coding regions on vcDNA: vcDNA=SeqID_94402; Strand=+; Position=3-122
PVDAVIVRNNETKSSPSPFFLFLLFTDHCIALNFRFHFT

SEQ ID NO: 167980 - protein, 41 aa, Heterodera glycines
  Coding regions on vcDNA: vcDNA=SeqID_94403; Strand=+; Position=2-127
MSTLTISNNSRGGRICRSIPILLPLPIRESQIIFFMMFHKI

SEQ ID NO: 167981 - protein, 25 aa, Heterodera glycines
  Coding regions on vcDNA: vcDNA=SeqID_94404; Strand=-; Position=1-75
DVIVFRCKQPLLNVNIVCGLVNLVW

SEQ ID NO: 167982 - protein, 1 aa, Heterodera glycines
  Coding regions on vcDNA: vcDNA=SeqID_94405; Strand=-; Position=1-3
F

SEQ ID NO: 167983 - protein, 49 aa, Heterodera glycines
  misc_feature (1)..(5): Xaa can be any naturally occurring amino acid
  Coding regions on vcDNA: vcDNA=SeqID_94406; Strand=-; Position=142-291
XXXXXMRWYLWYNEKNAFKRITNAGKIRSNQIRTVNNINLTPILGIISC

SEQ ID NO: 167984 - protein, 19 aa, Heterodera glycines
  Coding regions on vcDNA: vcDNA=SeqID_94407; Strand=+; Position=17-73
NFSNLLNQIKLDLTAKKKK

SEQ ID NO: 167985 - protein, 63 aa, Heterodera glycines
  Coding regions on vcDNA: vcDNA=SeqID_94408; Strand=-; Position=112-303
MLTNEWNVSVNANLFIIIHPSFLSRPFTALICQSMQISVAFCLICLIPPPPVFVHLAARIIYK

SEQ ID NO: 167986 - protein, 47 aa, Heterodera glycines; identical to SEQ ID NO: 127979
  Coding regions on vcDNA: vcDNA=SeqID_94409; Strand=-; Position=120-263

SEQ ID NO: 167987 - protein, 57 aa, Heterodera glycines; identical to SEQ ID NO: 139256
  Coding regions on vcDNA: vcDNA=SeqID_94410; Strand=+; Position=1-171

SEQ ID NO: 167988 - protein, 104 aa, Heterodera glycines
  Coding regions on vcDNA: vcDNA=SeqID_94411; Strand=-; Position=71-385
KKYKNLFLFLKFNILNAAKNKRLKALCARSFLSSILCFFFLAMASNHHLHFLSFPSSLPPLLLLSFPSSLPPLPLLFFPSSLPSLPFFRCQLQDLYHFPMDMHR

SEQ ID NO: 167989 - protein, 80 aa, Heterodera glycines
  Homolog annotation: Hit_ID=XP_453836.1; Match level="QueryCoverage =81%, HitCoverage=69%, E-value=3e-21, Identity=75%"; Hit description =unnamed protein product [Kluyveromyces lactis] emb|CAH00932.1| unnamed protein product [Kluyveromyces lac
  Coding regions on vcDNA: vcDNA=SeqID_94412; Strand=-; Position=111-353
LIRQVSCYTLLSGFRLPWPPSCCLYQPTPFMGSNERALWHLNSTFGSSHIASSAYQKWPTWSSNIQRLGSESSNPGFIPI

SEQ ID NO: 167990 - protein, 122 aa, Heterodera glycines
  Homolog annotation: Hit_ID=NP_033593.1; Match level="QueryCoverage =84%, HitCoverage=58%, E-value=7e-28, Identity=46%"; Hit description =zinc finger protein 93 [Mus musculus] gb|AAH03776.1| Zinc finger protein 93 [Mus musculus] sp|Q61116|Z235
  Gene Ontology: Mol. function=transcription factor activity; Cellular component=nucleus; Biological process=regulation of transcription, DNA-dependent
  Coding regions on vcDNA: vcDNA=SeqID_94413; Strand=+; Position=2-367
DFARANTLNIHQRIHTGEKPYQCHLCDARFTQDGQLKTHILIHTGEKPYKCTYCPQKFTRAGNLITHLRRHTEKKPFMCSHCGKQFAESSNLQIHLLTHYRKRKANGQLSNRMNELVPPKNG

SEQ ID NO: 167991 - protein, 119 aa, Heterodera glycines
  Coding regions on vcDNA: vcDNA=SeqID_94414; Strand=+; Position=1-360
PVTCSTVSASKAPDVSHAVRLTVPEVQAKQRPVSRRSLSQVREQTSAIVQPPMRFGNTSRRTVISKGTSNEGMTVSSGPVTRSTVSAAKASGVSHAVRGICVVRNMPTNNKKQQTKDKQ

SEQ ID NO: 167992 - protein, 167 aa, Heterodera glycines
  Coding regions on vcDNA: vcDNA=SeqID_94415; Strand=+; Position=1-501
AAQRARSMQRQTQNAAARQPSRAQRQSAEERHGSSSRESNINAKLEKIDQMFEQGIALEVIERTVNVPTVELKCRFARLYLMKAFALPKEEWKKHGVIDKGIGFANEALAIDPTHNDALKYLCMLMGLKIGQMQKSLTNAKKIVQLTVELDKLLQRADQHDPEILHA

SEQ ID NO: 167993 - protein, 26 aa, Heterodera glycines
  misc_feature (5)..(5): Xaa can be any naturally occurring amino acid
  misc_feature (13)..(13): Xaa can be any naturally occurring amino acid
  Coding regions on vcDNA: vcDNA=SeqID_94416; Strand=-; Position=0-77
VPFIXIYLHKISXRIKTLTILIVKSV

SEQ ID NO: 167994 - protein, 64 aa, Heterodera glycines
  Coding regions on vcDNA: vcDNA=SeqID_94417; Strand=-; Position=2-196
QCYNKGVIFGHLYFATDSTKRRPRHRESKKNVQMGKKYQPLRMFQSVQKQHSRCPTKGSSISRI

SEQ ID NO: 167995 - protein, 50 aa, Heterodera glycines
  Coding regions on vcDNA: vcDNA=SeqID_94418; Strand=+; Position=3-152
CIFKLGNQIEDGGFSPNFPLSYCFFHIYIYAFSINKILILKKKKKKKKKK

SEQ ID NO: 167996 - protein, 37 aa, Heterodera glycines
  Coding regions on vcDNA: vcDNA=SeqID_94419; Strand=+; Position=1-114
GLINAALYLAWLEAMSAELPPTLMLRGNQQSVLTFYS

SEQ ID NO: 167997 - protein, 184 aa, Heterodera glycines
  Homolog annotation: Hit_ID=XP_422735.1; Match level="QueryCoverage =100%, HitCoverage=15%, E-value=3e-52, Identity=53%"; Hit description= PREDICTED: similar to proteasome 26S non-ATPase subunit 1; 26S proteasome non-ATPase regulatory subunit
  Gene Ontology: Mol. function=proteasome endopeptidase activity; Cellular component=proteasome regulatory particle (sensu Eukarya); Biological process=proteolysis and peptidolysis
  Coding regions on vcDNA: vcDNA=SeqID_94420; Strand=+; Position=1-552
EPLLQAKENYVRQGALVSLAFVLIQQTTSTCPKVADFRKTLIKVVGEKGEDTITKFGAVVAQGILDAGGRNVTLSLHNQNNQNDMPSVLGIFVFLQHWHWHSMTHFISLALRPTCVIGLNKDLKMPKMDFRCNAKQSMFAYPQPIEEKRKERMEKVETAVLSTTKKKANFGQKAEDADGKAEEK

SEQ ID NO: 167998 - protein, 61 aa, Heterodera glycines
  Homolog annotation: Hit_ID=AAB96842.1; Match level="QueryCoverage =98%, HitCoverage=6%, E-value=3e-25, Identity=91%"; Hit description =vinculin [Brugia malayi] sp|Q17162|VINC_BRUMA Vinculin
  Gene Ontology: Mol. function=protein binding; Cellular component =focal adhesion; Biological process=cell adhesion
  Coding regions on vcDNA: vcDNA=SeqID_94421; Strand=-; Position=190-375
WEPMDGTEEDEEAMEQLVLNAQNLMQSVKDTVRAAEAASIKIRTNSGLRLRWIRKPMWSNY

SEQ ID NO: 167999 - protein, 48 aa, Heterodera glycines
  Homolog annotation: Hit_ID=CAE60080.1; Match level="QueryCoverage =97%, HitCoverage=10%, E-value=1e-10, Identity=61%"; Hit description =Hypothetical protein CBG03600 [Caenorhabditis briggsae]
  Coding regions on vcDNA: vcDNA=SeqID_94422; Strand=+; Position=2-145
FAEVPSHFRSNWSSYQVELLALLIIFVYALNYAYGKSKNHSIAHKWFM

SEQ ID NO: 168000 - protein, 105 aa, Heterodera glycines
  Coding regions on vcDNA: vcDNA=SeqID_94423; Strand=-; Position=3-317
NKNERKRKKERAKLVEISLGKEEKIWTKWRGGKWRKTEGPSNGEERMDELGVIYATEIADLTVLEMLRQNYSVTFDRVFSVHGTEIRQQIYIICNEEDELDAETV

SEQ ID NO: 168001 - protein, 108 aa, Heterodera glycines
  Coding regions on vcDNA: vcDNA=SeqID_94424; Strand=+; Position=2-325
DHLQYLYFCAVFFLYSDGMRNCCRACRLRRCFEAGMRLDLAPNAHGNDWPYAELKSAVSSANFLERPRPTKRAISDAIISAIPTTSFLSSPSAFDAGLLLSPLPVTNR

SEQ ID NO: 168002 - protein, 27 aa, Heterodera glycines
  misc_feature (2)..(2): Xaa can be any naturally occurring amino acid
  Coding regions on vcDNA: vcDNA=SeqID_94425; Strand=-; Position=1-81
FXAILVFWLLFVGKQLNGYLIIFIICP

SEQ ID NO: 168003 - protein, 24 aa, Heterodera glycines
  Coding regions on vcDNA: vcDNA=SeqID_94426; Strand=+; Position=3-77
SSARHFFSNVCKYKQFIFQYKIII

SEQ ID NO: 168004 - protein, 135 aa, Heterodera glycines
  Homolog annotation: Hit_ID=CAE59483.1; Match level="QueryCoverage =99%, HitCoverage=10%, E-value=1e-23, Identity=41%"; Hit description =Hypothetical protein CBG02868 [Caenorhabditis briggsae]
  Gene Ontology: Mol. function=phosphatidylinositol 3-kinase activity; Cellular component=1-phosphatidylinositol 3-kinase complex; Biological process=aging
  Coding regions on vcDNA: vcDNA=SeqID_94427; Strand=+; Position=1-405
SAKQPLFLTWRNPELLAHLTMPCHQLIFKCGDDMRQDMLTLHVMRIMDAKWKSQLQQDFCMTLYEVLPMGKNIGLIHVVPDCQTLFQIQCESKRKYTGTSLNMEVDLLNKHIYKKCCANDSKKYLECVDRFTFSL

SEQ ID NO: 168005 - protein, 73 aa, Heterodera glycines
  Homolog annotation: Hit_ID=CAE70782.1; Match level="QueryCoverage =90%, HitCoverage=4%, E-value=4e-11, Identity=48%"; Hit description =Hypothetical protein CBG17537 [Caenorhabditis briggsae]
  Coding regions on vcDNA: vcDNA=SeqID_94428; Strand=+; Position=2-223
DRIQSNVFRYMGNNMLAYRSCDELAELNLRMWMSCCDETCSARASTGIDSANDGNEQSRRRKRAVHLYANGNN

SEQ ID NO: 168006 - protein, 153 aa, Heterodera glycines
  Coding regions on vcDNA: vcDNA=SeqID_94429; Strand=+; Position=1-459
NTMGGMPTLQAQPNAMGGMPMYYAVQQQQPYAQLQFVSQQQPATVRLGTPSASVKPGTNQPMMPISPTQSVLVRILKKRENMDENPCPPLSSPADDLTVHIGNREVTVSAAWLMCQSPMVRQMLSVEMKEKQQRSLTLNELGIDMEQFMDFLE

SEQ ID NO: 168007 - protein, 156 aa, Heterodera glycines
  Coding regions on vcDNA: vcDNA=SeqID_94430; Strand=+; Position=1-468
YDLAKTVTDNRFDLVLHKPEHFVNAETDLWMGNIWADLTKIEPSSTKDKVGGMRRMCGSIPLFTNSLEHLLYLIFNRYDRHEFQQGMFLVKAEFGQDWFTPIMQHPHCILRQPVRQVALRRNSTAGTEYKNLTPNVHQSFVLFYLGPNVPQFCATF

SEQ ID NO: 168008 - protein, 83 aa, Heterodera glycines
  Coding regions on vcDNA: vcDNA=SeqID_94431; Strand=+; Position=11-259
FCRAFSFCFVHYLIFPPIVLSEDEKPNNASARLRERVQLQKARRGHTTVGRITQHYSKSDQIRRERRPLTLRNSSIWHLYARG

SEQ ID NO: 168009 - protein, 128 aa, Heterodera glycines
  Homolog annotation: Hit_ID=NP_499767.1; Match level="QueryCoverage =77%, HitCoverage=63%, E-value=2e-22, Identity=47%"; Hit description =transthyretin-like (3O495) [Caenorhabditis elegans] emb|CAB02929.1| Hypothetical protein F11F1.7 [Caenorh
  Coding regions on vcDNA: vcDNA=SeqID_94432; Strand=+; Position=10-393
MLPTPTHLFVFIVFFLKIYLLSARVWARSQCVLARGRVICPTDPDSHFNVQIELMDSDALPWETDDVMGSATTDLLGNFSVRGCASDSGLWNDPDPYLLITHRCPQMGHDISVVKRKHRIPIDRIYLP

SEQ ID NO: 168010 - protein, 62 aa, Heterodera glycines
  Coding regions on vcDNA: vcDNA=SeqID_94433; Strand=+; Position=1-189
KRRTDHSGEAGAAQNVRAEQKLLEHEEILTVFLCFVIWSKFDPFLFYLFIFWSLFLPFPFKY

SEQ ID NO: 168011 - protein, 72 aa, Heterodera glycines; identical to SEQ ID NO: 167942
  Homolog annotation: Hit_ID=AAM44291.1; Match level="QueryCoverage =61%, HitCoverage=28%, E-value=2e-13, Identity=75%"; Hit description =superoxide dismutase [Aplysia californica]
  Gene Ontology: Mol. function=copper, zinc superoxide dismutase activity; Cellular component=cytoplasm; Biological process =neurogenesis
  Coding regions on vcDNA: vcDNA=SeqID_94434; Strand=+; Position=87-305

SEQ ID NO: 168012 - protein, 164 aa, Heterodera glycines
  misc_feature (140)..(140): Xaa can be any naturally occurring amino acid
  misc_feature (153)..(153): Xaa can be any naturally occurring amino acid
  Homolog annotation: Hit_ID=CAE57999.1; Match level="QueryCoverage =100%, HitCoverage=58%, E-value=1e-48, Identity=55%"; Hit description= Hypothetical protein CBG01062 [Caenorhabditis briggsae]
  Coding regions on vcDNA: vcDNA=SeqID_94435; Strand=+; Position=3-491
LDQVNGLPDMVFACNSGLFYRNKLYLSHFRHAQRIGEQRHFADFYKGLGLELYGADCAEVFEGGGDAFFSDERTLWAGWGGPRTNRKAYEHIRKMGDFETVPCELVDPRFYHLDTCLCPVGIDSALWFPPAFSEKPKKKXLRRLPRAIAVSEXEAMTFVCNAIT

SEQ ID NO: 168013 - protein, 142 aa, Heterodera glycines
  Homolog annotation: Hit_ID=AAF81283.1; Match level="QueryCoverage =100%, HitCoverage=67%, E-value=3e-14, Identity=33%"; Hit description= glutathione S-transferase [Haemonchus contortus]
  Gene Ontology: Mol. function=glutathione transferase activity; Biological process=glutathione conjugation reaction
  Coding regions on vcDNA: vcDNA=SeqID_94436; Strand=+; Position=1-429
LQYLGEKFGLVNETAEEKAICAMLAQRINDHFEYLKPYVNCLLGLIPANKLPALAEKCLRPCITEDFGPMFERQLEANNTGYLVGDKLTWVDFYVASFADLALTFGRFDILDRFPRVLHHCRAVFSLPQLQQHIKNRPDTLF

SEQ ID NO: 168014 - protein, 172 aa, Heterodera glycines
  Homolog annotation: Hit_ID=NP_490889.1; Match level="QueryCoverage =95%, HitCoverage=54%, E-value=8e-46, Identity=54%"; Hit description =hydroxymethylglutaryl-coa lyase (34.3 kD) (1C227) [Caenorhabditis elegans] gb|AAK73908.1| Hypothetical pr
  Coding regions on vcDNA: vcDNA=SeqID_94437; Strand=+; Position=10-525
MQISCRRRALLRSAIAAVGESFRIVEVGARDGLQNEQKIVPTATKVTLIDRLSDCGLKTIEATSFVSPKWVPQMADHAEVISRCKKFAGVSYPVLVPNLAGLHNAIKNGNVREIAVFRAASDAFTRKNLNCSREEGERRVGEVTEGAVANGLRVIRCPYEGQIKANTVAAMA

SEQ ID NO: 168015 - protein, 152 aa, Heterodera glycines
  Coding regions on vcDNA: vcDNA=SeqID_94438; Strand=+; Position=2-460
SKLKVLSSSADFSSFLFLALLFDFSFSQPTIQQKSIQELLNTPTFLPTAEKHDYFVAPFLQQQKQRWLSVRPFQEFRRSPQTADLGLLLQYLDNKRNAPSLMEDEGNGRHGISGSPLGTMRFGKRTFNSPLGTMRFGKREYNKSPPGTMRFG

SEQ ID NO: 168016 - protein, 145 aa, Heterodera glycines
  Coding regions on vcDNA: vcDNA=SeqID_94439; Strand=-; Position=1-435
VANPLIQKSIHFWPTKSNFPSLFDSQSIRHSFLLGNQTSPHSRPPSVFIWFPLSPPISSAPCTNCTFFAHFASPRLFFLSFSVPLNESVQTNNKRSIISLRCFCFYSFYLPFSNYFAHFDIFSDNDKFYWPGSISYLCIPLDLST

SEQ ID NO: 168017 - protein, 67 aa, Heterodera glycines
  Coding regions on vcDNA: vcDNA=SeqID_94440; Strand=+; Position=3-206
KHWEEDEEANRRTSSNKWSGSGHRGPKSIHLAADSRSDRNDQSSAARVASLWLINSREGRKPDGIIF

SEQ ID NO: 168018 - protein, 101 aa, Heterodera glycines
  Coding regions on vcDNA: vcDNA=SeqID_94441; Strand=+; Position=3-308
IIIMSPAKPFLLMLFLCCFFGFPLASKDGLLKEEIAQHEDKKIAAMLLDVFLNGWRECIDWKRGEPSIRCVPFPEKKPEKCAKNMWENAMENVRNGKIKKC

SEQ ID NO: 168019 - protein, 138 aa, Heterodera glycines
  Homolog annotation: Hit_ID=NP_494780.1; Match level="QueryCoverage =92%, HitCoverage=40%, E-value=9e-36, Identity=59%"; Hit description =nucleotidase (2E711) [Caenorhabditis elegans] gb|AAA83579.1| Hypothetical protein ZK430.2 [Caenorhabditis
  Gene Ontology: Cellular component=mitochondrion
  Coding regions on vcDNA: vcDNA=SeqID_94442; Strand=+; Position=1-417
QQTDGQMPRVAVTTASHHTELVQKALDALVEGKLISEIERVGGAGFKVLRCLEGATAYVFASRGCKKWDTAAPEALLLAAGGTLSDMSGRLINYGPSVQLINSGGVLATAPGVDHQSFVAAIPQLVKESLPETEIVGL

SEQ ID NO: 168020 - protein, 86 aa, Heterodera glycines
  Homolog annotation: Hit_ID=NP_055185.1; Match level="QueryCoverage =100%, HitCoverage=15%, E-value=9e-38, Identity=82%"; Hit description= serine/threonine kinase 23 [Homo sapiens] sp|Q9UPE1|ST23_HUMAN Serine/threonine-protein kinase 23 (Muscl
  Gene Ontology: Mol. function=ATP binding; Cellular component =cytoplasm; Biological process=protein amino acid phosphorylation
  Coding regions on vcDNA: vcDNA=SeqID_94443; Strand=+; Position=242-499
DEQEDPKDYRKGGYHPVQIGDVFKNGRYHVIRKLGWGHFSTVWLSWDIEIKRFVAMKIVKSAEHYTEAALDEIKLLECVRDSDPTD

SEQ ID NO: 168021 - protein, 172 aa, Heterodera glycines
  Homolog annotation: Hit_ID=CAE72950.1; Match level="QueryCoverage =94%, HitCoverage=48%, E-value=2e-17, Identity=35%"; Hit description =Hypothetical protein CBG20281 [Caenorhabditis briggsae]
  Coding regions on vcDNA: vcDNA=SeqID_94444; Strand=+; Position=2-517
RNCEQSAKILSLAGATCTGKTSLANSLVEELRRCGLSVRLIGQDRFYKTKEIVRTLANAEDPSITFYDYDQTDALNEHLILDEIASASKDPELDALIMEGNMLTDLDAIRWADCTVFLTIDKESCRQRRVLRTYDPPDEIGYFDQVVWPAYERTLQKAKEFKETSTRPLAFV

SEQ ID NO: 168022 - protein, 40 aa, Heterodera glycines
  misc_feature (11)..(12): Xaa can be any naturally occurring amino acid
  Coding regions on vcDNA: vcDNA=SeqID_94445; Strand=-; Position=1-120
FFFFFFFFFFXXYLIHNFMSQKSKTTTLHLLISAQKVAAF

SEQ ID NO: 168023 - protein, 17 aa, Heterodera glycines
  Coding regions on vcDNA: vcDNA=SeqID_94446; Strand=+; Position=1-51
KKKKKKTLTKKPLTLIK

SEQ ID NO: 168024 - protein, 151 aa, Heterodera glycines
  misc_feature (33)..(33): Xaa can be any naturally occurring amino acid
  misc_feature (41)..(41): Xaa can be any naturally occurring amino acid
  misc_feature (67)..(67): Xaa can be any naturally occurring amino acid
  misc_feature (118)..(118): Xaa can be any naturally occurring amino acid
  Homolog annotation: Hit_ID=AAC48326.1; Match level="QueryCoverage =96%, HitCoverage=44%, E-value=1e-36, Identity=60%"; Hit description =beta-1,4-endoglucanase-2 precursor [Heterodera glycines]
  Coding regions on vcDNA: vcDNA=SeqID_94447; Strand=+; Position=33-483
MFVQLVLLAIVGITFVDAAAPPFGQLSLKGTNXLVGSNGKXPVQLIGNSLVWEPPVPTILNAQTVKXLKWHWNSNGLRPPIGGEKGRLFGCPETPPTHLTALGFEGAFSRGFYCIPNXHALNPNREKGFYFFPKISKGWGSTPFLFLKKVL

SEQ ID NO: 168025 - protein, 64 aa, Heterodera glycines
  misc_feature (63)..(63): Xaa can be any naturally occurring amino acid
  Coding regions on vcDNA: vcDNA=SeqID_94448; Strand=+; Position=2-196
KIISSMSFLLFVTIAFANLAPNAFGQQWPKATSDETVPATIVVTGGSRDFGYKRLTASSALGXR

SEQ ID NO: 168026 - protein, 79 aa, Heterodera glycines
  misc_feature (23)..(23): Xaa can be any naturally occurring amino acid
  Homolog annotation: Hit_ID=AAA73456.2; Match level="QueryCoverage =98%, HitCoverage=69%, E-value=2e-13, Identity=47%"; Hit description =beta-galactosidase alpha peptide [Cloning vector pSport1]
  Coding regions on vcDNA: vcDNA=SeqID_94449; Strand=+; Position=173-408
KGGLSKGSKFTNSGVRRYTSSIXEKKFNSRTYFLKRQNWKTPGVTKLNSFEQIPLFTSWGNNKKSRTDPLSKNLPTLKG

SEQ ID NO: 168027 - protein, 90 aa, Heterodera glycines
  Coding regions on vcDNA: vcDNA=SeqID_94450; Strand=+; Position=24-296
KCPPPLPVFTSFFCWSSAAFQPFCVWHWPTLLAKVKLTQLVFALVANIMTNGATIGAVAIPIGGTGERNKWKRMGDEVITNDQIKTLNKI

SEQ ID NO: 168028 - protein, 120 aa, Heterodera glycines
  Homolog annotation: Hit_ID=AAC48326.1; Match level="QueryCoverage =76%, HitCoverage=28%, E-value=5e-46, Identity=97%"; Hit description =beta-1,4-endoglucanase-2 precursor [Heterodera glycines]
  Coding regions on vcDNA: vcDNA=SeqID_94451; Strand=+; Position=139-498
LNASKSESRLGKIAIFLLPGVGRHYLCAYRLTAAVIEAAIAQGIYVIVDWHAHEPNEDKAIEFFTKIAKAYGSNPHLLYETFNEPLDVSWNDVLVPYHKKGISAIRAIDKKNVIILGTPN

SEQ ID NO: 168029 - protein, 101 aa, Heterodera glycines
  Coding regions on vcDNA: vcDNA=SeqID_94452; Strand=-; Position=1-303
IIVRAKRCCCWVGIVLLTVKNVQCGSGGGSRLGFVSTMFWVEIVENIRSIFSGGPFFKYSFLFGRGDGTHFPPFVLRQFFTDLFEFYFQKFFTPVRRRFHW

SEQ ID NO: 168030 - protein, 137 aa, Heterodera glycines
  Homolog annotation: Hit_ID=NP_496397.1; Match level="QueryCoverage =89%, HitCoverage=45%, E-value=5e-20, Identity=44%"; Hit description =interferon gamma inducible protein 30 like precursor (2L479) [Caenorhabditis elegans] emb|CAB04345.1| Hyp
  Gene Ontology: Biological process=regulation of protein activity, epigenetic
  Coding regions on vcDNA: vcDNA=SeqID_94453; Strand=+; Position=120-530
IDPSGNGKDLEADNESLCPFCQRFIRDTLFNAYNRFRTHIKLELVPYGNAKTNGTHFTCQHGTEECRINKFESCAINYMNDPMPFVYCLETLLYENVKFDDATKLCFDLINPGKFVLDRITQCFDGSEGILLQNLAA

SEQ ID NO: 168031 - protein, 87 aa, Heterodera glycines
  Homolog annotation: Hit_ID=CAE75100.1; Match level="QueryCoverage =100%, HitCoverage=26%, E-value=2e-10, Identity=40%"; Hit description= Hypothetical protein CBG23022 [Caenorhabditis briggsae]
  Coding regions on vcDNA: vcDNA=SeqID_94454; Strand=+; Position=3-263
MPENPTNTSDHQRLEEMLCHLTPHGAAVPYNVCFDSDHCLWVASKRSLFNSLSGLLESVQLVFPFKMNSPRKWDIPSGFYFNSNIIF

SEQ ID NO: 168032 - protein, 17 aa, Heterodera glycines
  Coding regions on vcDNA: vcDNA=SeqID_94455; Strand=-; Position=1-51
FFFFFDVRYKILEVLLI

SEQ ID NO: 168033 - protein, 143 aa, Heterodera glycines
  Homolog annotation: Hit_ID=CAG11079.1; Match level="QueryCoverage =98%, HitCoverage=19%, E-value=5e-28, Identity=45%"; Hit description =unnamed protein product [Tetraodon nigroviridis]
  Gene Ontology: Mol. function=prolyl oligopeptidase activity; Cellular component=cytoplasm; Biological process=protein metabolism
  Coding regions on vcDNA: vcDNA=SeqID_94456; Strand=+; Position=3-434
DLFGAVITQLGLLDMLRFNKLGIGSDWVSEYGDPDNATDFSYIYKYSPLQQLSVTPGKQWPATLLLSADHDDLVDVSHTLKYTAQLYHLLRTNAESWQRNPVVAKILVDQGHAFTGTPTEKKIKEKVDIYTFIARALGLKWTE

SEQ ID NO: 168034 - protein, 79 aa, Heterodera glycines
  Coding regions on vcDNA: vcDNA=SeqID_94457; Strand=+; Position=2-241
LSKFSVKKLMSSTECTERVSKCDGWPNHLAPFMQIKSWRWFIGAFLYLASGFGIPFFAAEFQLKIFFHSPRAERNTMVR

SEQ ID NO: 168035 - protein, 53 aa, Heterodera glycines
  Coding regions on vcDNA: vcDNA=SeqID_94458; Strand=-; Position=2-163
LILVIIIGKINWHFSVRRLCLGSSAADDFVGPASDQHNKNSNNTMLSDQCKSG

SEQ ID NO: 168036 - protein, 88 aa, Heterodera glycines
  Coding regions on vcDNA: vcDNA=SeqID_94459; Strand=-; Position=0-263
GGGKKKKWLPFVLRVTNKICWRICAPIWTLPFVHNFPFHFHFHSSKGIRTAPEANVFSSSVKIWLPLRSVCSVSPPFRHFSSPPIVVV

SEQ ID NO: 168037 - protein, 97 aa, Heterodera glycines
  Coding regions on vcDNA: vcDNA=SeqID_94460; Strand=-; Position=3-293
SNCFSLFRLPDAVLTILEDEKKSTAAEKQQKKADDGGQETADSESGGNEWTGRKRIRQQNEQKEDEKGEGPPAKKSLLERVAECNFIFKKKSKNYSL

SEQ ID NO: 168038 - protein, 48 aa, Heterodera glycines
  Coding regions on vcDNA: vcDNA=SeqID_94461; Strand=-; Position=290-436
FIRTPFQAHCDWLEHPFRDEVIWDIERIYFVHSQHELDLNDFNHLPAK

SEQ ID NO: 168039 - protein, 131 aa, Heterodera glycines
  Coding regions on vcDNA: vcDNA=SeqID_94462; Strand=+; Position=65-457
MHNTPRQLQVLPMLLSINKKLLAILVIIRNMEPDPDPAVMRSLLRFLFLTQPDRDLFTVDALKLIVDYSDNIPPMSDCISKMVKHAIHNDEIIAPFGQTKLGKARPRVPVVENILDHLDRFRRHCIDRESK

SEQ ID NO: 168040 - protein, 95 aa, Heterodera glycines
  Homolog annotation: Hit_ID=NP_001002618.1; Match level="QueryCoverage= 98%, HitCoverage=24%, E-value=9e-15, Identity=48%"; Hit description =zgc:92263 [Danio rerio] gb|AAH75969.1| Zgc:92263 [Danio rerio]
  Coding regions on vcDNA: vcDNA=SeqID_94463; Strand=+; Position=3-290
REPFNKILKQMESVQNRVPIVSIDIPSGKFEQPTDLFLIKGQPKGWDVEKGPPDEKSGLPILSPLFFISLTAPKQCAQFFKGEYHFLGGRFVPPA

SEQ ID NO: 168041 - protein, 50 aa, Heterodera glycines
  Homolog annotation: Hit_ID=AAP30776.1; Match level="QueryCoverage =94%, HitCoverage=19%, E-value=6e-14, Identity=80%"; Hit description =putative gland protein G34B08 [Heterodera glycines]
  Coding regions on vcDNA: vcDNA=SeqID_94464; Strand=+; Position=53-205
MRTFLFIAVVGLMLAVILENVNATGKNSPSKGKPSPDSTNHKKDHKNVFF

SEQ ID NO: 168042 - protein, 67 aa, Heterodera glycines
  Coding regions on vcDNA: vcDNA=SeqID_94465; Strand=-; Position=2-202
KEISRKHGLYEARIQDLVPNGQWAFSNYGLAAVKKLTIHSTRAEPTACSTVDGHVWVDAKLPVSTFG

SEQ ID NO: 168043 - protein, 134 aa, Heterodera glycines
  misc_feature (123)..(125): Xaa can be any naturally occurring amino acid
  misc_feature (127)..(127): Xaa can be any naturally occurring amino acid
  Coding regions on vcDNA: vcDNA=SeqID_94466; Strand=+; Position=2-403
TLCHIDGPNGANALTLAHLRRRRCGRRSELANIAPFSSHRRWSAALLLLRRVIIATSDVGRRPFTVSRVLELWTTATASSTAASVSARRSSASPSSISSTSPSSIPNQLIIVNNAFVLNVFFXXXKXKKKKKKK

SEQ ID NO: 168044 - protein, 100 aa, Heterodera glycines
  Coding regions on vcDNA: vcDNA=SeqID_94467; Strand=+; Position=1-303
CTARHAFPVRLIWHPTIHPVRPAVHQIWAPTLAPMVASPARHPHAFRHRVPSSRRGYDSRAERGAAVTGVAVIRLRSSNECVCGMIWRCRNVSPANDRIN

SEQ ID NO: 168045 - protein, 59 aa, Heterodera glycines
  Coding regions on vcDNA: vcDNA=SeqID_94468; Strand=-; Position=5-184
ILNSRFTKKCPINKLLSRMFYHRSLATFMFGLARGSNKGSSSPAPRDESLPVRNKPRKK

SEQ ID NO: 168046 - protein, 130 aa, Heterodera glycines
  Coding regions on vcDNA: vcDNA=SeqID_94469; Strand=-; Position=1-390
DQARSKETLKARFDADTDSLRSLLEDTAHKLHNDLIGKDALKLAISDFDARWTTAFGQLNSDLNSLRPLMDSAEAAKLEAISDELAESAKKLRTNAAQRMAEIEQEEGRVGNLLERTTNLANDVSVVGEK

SEQ ID NO: 168047 - protein, 32 aa, Heterodera glycines
  Coding regions on vcDNA: vcDNA=SeqID_94470; Strand=+; Position=3-101
ERLLPPPPPPTISKLHRSCTEESSAQNSVILY

SEQ ID NO: 168048 - protein, 34 aa, Heterodera glycines
  Coding regions on vcDNA: vcDNA=SeqID_94471; Strand=-; Position=9-113
FFFFFGLIFKNLSFIQNIITNKINNPFDNCSKFP

SEQ ID NO: 168049 - protein, 31 aa, Heterodera glycines
  Coding regions on vcDNA: vcDNA=SeqID_94472; Strand=+; Position=2-97
FFILAIKYHTSLYIICYHISFVYNFFALITY

SEQ ID NO: 168050 - protein, 80 aa, Heterodera glycines
  Coding regions on vcDNA: vcDNA=SeqID_94473; Strand=-; Position=1-240
MLKKIIVDGDCFFKFKFFLLAQQVVVRCEAFPKRAIWADISESGVFGPGEKRRRRTISASATCIWNSAKRMPMQLRGPSP

SEQ ID NO: 168051 - protein, 170 aa, Heterodera glycines
  Homolog annotation: Hit_ID=NP_504659.1; Match level="QueryCoverage =99%, HitCoverage=27%, E-value=2e-78, Identity=77%"; Hit description =long-chain-fatty-acid-CoA ligase (70.5 kD) (5H11) [Caenorhabditis elegans] gb|AAD14712.1| Hypothetical pr
  Gene Ontology: Biological process=embryogenesis and morphogenesis
  Coding regions on vcDNA: vcDNA=SeqID_94474; Strand=+; Position=1-510
YEASTQPDDPCNIQYTSGTTGKPKGATLTHHNILNNAFFVGLRAGYANHRTVICIPNPLYHCFGCVMGSLAALVHFQTCVFPAPSFEPLAALQAIHEERCTAVYGTPTMYINMMSHAEYPSFDYSSIRSGIVAGAPCPVTLCSRLVNELGMKDLQVCYGTTETSPVSFMS

SEQ ID NO: 168052 - protein, 57 aa, Heterodera glycines
  Coding regions on vcDNA: vcDNA=SeqID_94475; Strand=-; Position=3-173
KFVFNVIKLAKMYCANAKKCCRPLVNHSRAFSIHQWRAFKACRESNWTMAISFVGII

SEQ ID NO: 168053 - protein, 127 aa, Heterodera glycines
  Coding regions on vcDNA: vcDNA=SeqID_94476; Strand=-; Position=83-466
CGDGVIQFAKAEHGQGEQQRKGQAERNVEESGAEKGDQPDELKIGRGMGERDGRLVFLIALLKIFISLIIINASFFRQMPKIPAQLKAFYYTLFGVSKMSFIMPILDFLWLMPGPLFCAYFAIFSAY

SEQ ID NO: 168054 - protein, 37 aa, Heterodera glycines
  Coding regions on vcDNA: vcDNA=SeqID_94477; Strand=-; Position=87-200
TTIVLKKGAQKTHLCVKIFSFGRHFSSLEITILGFCH

SEQ ID NO: 168055 - protein, 127 aa, Heterodera glycines
  Homolog annotation: Hit_ID=CAE73755.1; Match level="QueryCoverage =100%, HitCoverage=29%, E-value=1e-27, Identity=45%"; Hit description= Hypothetical protein CBG21290 [Caenorhabditis briggsae]
  Coding regions on vcDNA: vcDNA=SeqID_94478; Strand=+; Position=3-383
DWRTNGFFPRVTFCDLKTRDIGQFREHTVQCVLMINMFAEKIFIFLWLWFFVFLIIASLNLLFWTYQILSMRSKERMIIDALRLQNIRPSRQIVKVFVYKFLKLDGILVLRLIDSNTGQIHMADIVH

SEQ ID NO: 168056 - protein, 133 aa, Heterodera glycines
  Homolog annotation: Hit_ID=CAG11079.1; Match level="QueryCoverage =97%, HitCoverage=17%, E-value=7e-35, Identity=55%"; Hit description =unnamed protein product [Tetraodon nigroviridis]
  Gene Ontology: Mol. function=prolyl oligopeptidase activity; Cellular component=cytoplasm; Biological process=protein metabolism
  Coding regions on vcDNA: vcDNA=SeqID_94479; Strand=+; Position=2-403
VMDMLRFHKFTVGSYWMNEYGDPEKPEEFEYIYKYSPLHNIRLSRGTQWPATLLMTADHDDRVVPSHTLKYAAQLYHYLKKPEVKLTQRKPVIVRVETDAGHGAGKPRDKVIDELTDIMSFLQRVIQLKWYDD

SEQ ID NO: 168057 - protein, 115 aa, Heterodera glycines
  Coding regions on vcDNA: vcDNA=SeqID_94480; Strand=-; Position=0-344
MISHRIACLSLSKKGVIFCHSLKKFSSLTDGGNGQRASLVVVLLLIGGTIASAVNDIKNFWRGIDYGWEEGRVEKTSILGVVGTQFIMRRLRASIVNKWVGIWDDGVGVVANICP

SEQ ID NO: 168058 - protein, 152 aa, Heterodera glycines
  Homolog annotation: Hit_ID=NP_502587.2; Match level="QueryCoverage =86%, HitCoverage=26%, E-value=1e-21, Identity=44%"; Hit description =Pelle/Interleukin receptor associated Kinase (54.0 kD) (pik-1) [Caenorhabditis elegans] emb|CAB05550.2| H
  Coding regions on vcDNA: vcDNA=SeqID_94481; Strand=+; Position=2-457
WPNPNDGKSHCQVELDTGDERPMIASHVKGTLAYLAPEFLTSRILTTKPDVFGFGVDLLEVSTGQRAFSVSRNPQGIVEFVLKMCTEAKHKDDTNFKNKCYFELADKRTPKTDDERSLLIFNKLLSVGISCTEKDRFARPIFSETFARLDDE

SEQ ID NO: 168059 - protein, 46 aa, Heterodera glycines
  Homolog annotation: Hit_ID=AAF08341.1; Match level="QueryCoverage =100%, HitCoverage=42%, E-value=9e-14, Identity=78%"; Hit description= peptidyl-prolyl cis-trans isomerase [Brugia malayi]
  Gene Ontology: Mol. function=FK506 binding; Cellular component =membrane; Biological process=protein folding
  Coding regions on vcDNA: vcDNA=SeqID_94482; Strand=+; Position=1-141
GVAKMSVGQRAKLTISPDMGYGAKGIPGTIPGNSTLIFDVELIAVK

SEQ ID NO: 168060 - protein, 178 aa, Heterodera glycines
  Homolog annotation: Hit_ID=CAE63438.1; Match level="QueryCoverage =100%, HitCoverage=25%, E-value=3e-57, Identity=60%"; Hit description= Hypothetical protein CBG07886 [Caenorhabditis briggsae]
  Gene Ontology: Mol. function=carnitine O-palmitoyltransferase activity; Cellular component=mitochondrion; Biological process=fatty acid beta-oxidation
  Coding regions on vcDNA: vcDNA=SeqID_94483; Strand=+; Position=2-535
PKNGEKHLGALTAGRRDHWAKVRKEHFTGNNKTSLRLIERSAFVVVLDEEPVFYDPNDTSKLDRWAEKLLHGKGYDRWFDKSFNLIISQSGRIGINTEHSWGDAAVTAHFMEYVVLQDYCVQGYTSSGDCKGEVCQSVKLERILFDLDEVVQKQIEVSRHVADELIADVEMALLVWTD

SEQ ID NO: 168061 - protein, 85 aa, Heterodera glycines
  Coding regions on vcDNA: vcDNA=SeqID_94484; Strand=+; Position=2-259
EEEREGDNKCQSEEVPSVEEQQKMGKFETEFHAAFSHEGIFKVSPVLAKLKFADDAEKTGKGRCQMPSEEHIFLPSLSVDVTRKL

SEQ ID NO: 168062 - protein, 59 aa, Heterodera glycines
  Coding regions on vcDNA: vcDNA=SeqID_94485; Strand=+; Position=95-274
LGLSRKARLFSVQRIPVPLFVQPSKFRYPNLVFLNGQISWVSKMPIRRVGCHLKPQKQL

SEQ ID NO: 168063 - protein, 74 aa, Heterodera glycines
  Homolog annotation: Hit_ID=AAH82699.1; Match level="QueryCoverage =55%, HitCoverage=14%, E-value=5e-10, Identity=68%"; Hit description =Unknown (protein for MGC:86260) [Xenopus laevis]
  Gene Ontology: Mol. function=protein binding; Cellular component =cytoplasm; Biological process=signal transduction
  Coding regions on vcDNA: vcDNA=SeqID_94486; Strand=+; Position=93-317
ESFIRDVNCNREREFSFCCPFVIKHFLEGQIIQLDSQIDEHWFEGTVDGRTGFFPITYVEVIVPIPSSSTTAQQ

SEQ ID NO: 168064 - protein, 69 aa, Heterodera glycines
  Coding regions on vcDNA: vcDNA=SeqID_94487; Strand=+; Position=1-210
LLQLFNEMAKAHEVWRPIHEFLSVWPSTWSRPLFVHFCWCCVSWRAYEALLERKDEEMVVQLEGGLTNH

SEQ ID NO: 168065 - protein, 170 aa, Heterodera glycines
  Coding regions on vcDNA: vcDNA=SeqID_94488; Strand=+; Position=1-510
IGHVFIWDLTCPARPTWKLHFDDWNSPPQSICWTEKDKIAISFRRRLFRIYGLIPPSESDQFGSSHPVLECDLNKTCGAKCCSQPLIFPGLISFESSTFSYFGITQQAPSYIWVTSSPDDESEKDQICATTLMQGRTLLHLIMHDKSIAESEDNNKNFCFSHDECCTYRR

SEQ ID NO: 168066 - protein, 113 aa, Heterodera glycines
  Coding regions on vcDNA: vcDNA=SeqID_94489; Strand=+; Position=122-460
AAPVRPDSGMGSDELSGGWVGRFMCQTLDKYINSMTMLMSPFSSLSIVPVLPASLPASSVCKWVDFTNKHGFGVTFRDGTRSLLFNDQSSLSTSYCQRYFTYRAQKFVGNFVE

SEQ ID NO: 168067 - protein, 143 aa, Heterodera glycines
  Homolog annotation: Hit_ID=NP_650438.2; Match level="QueryCoverage =94%, HitCoverage=52%, E-value=1e-45, Identity=60%"; Hit description =CG4299-PA [Drosophila melanogaster] gb|AAF55155.1| CG4299-PA [Drosophila melanogaster] gb|AAM50782.1| LD2
  Gene Ontology: Biological process=cell proliferation
  Coding regions on vcDNA: vcDNA=SeqID_94490; Strand=+; Position=2-473
LEDLDKVQTELDTLNETASDEILKVEQKYNQMRKPFFEKRTHFIKQIPNFWVTVFINHPQISNILEEEEEECLHYLTKVEIEENEDIKAGYKLKFSFDPNPFFENSEIVKEFNWTAAEPNSVTTEIKWKQGKNKLANGTGSEE

SEQ ID NO: 168068 - protein, 66 aa, Heterodera glycines
  Coding regions on vcDNA: vcDNA=SeqID_94491; Strand=+; Position=1-201
TQKYRKALEQIKAEMVKDADYCKDCAIPTVTQVLATPIPLSEQTKELMQKGAKKLDEKFKTFTKRS

SEQ ID NO: 168069 - protein, 86 aa, Heterodera glycines
  Coding regions on vcDNA: vcDNA=SeqID_94492; Strand=-; Position=1-258
RPRSTPPSSTALCGWPNCASVASIPLHLSDALLSLHPFFDALSLFVVWNCKRFAELEKRRYIVVYKVPIVAKFCAVPMKKKRRSFF

SEQ ID NO: 168070 - protein, 132 aa, Heterodera glycines
  Coding regions on vcDNA: vcDNA=SeqID_94493; Strand=+; Position=1-396
GCMPPTDATESQAESSTQAAYDEQCEFGWEQCRIGGGQQQHGFRSRTAVAAALSPHNYFAHLSPQTPSSSACASVSTFSCEPNPSSNNSPSPIYPKVPSPCLSSHSTFIDEFASPAFEDDQHNFVHFRQIDS

SEQ ID NO: 168071 - protein, 165 aa, Heterodera glycines
  Homolog annotation: Hit_ID=NP_003162.2; Match level="QueryCoverage =50%, HitCoverage=10%, E-value=1e-10, Identity=40%"; Hit description =suppressor of var1, 3-like 1 [Homo sapiens] emb|CAH71499.1| suppressor of var1, 3-like 1 (S. cerevisiae)(
  Gene Ontology: Mol. function=helicase activity; Cellular component =mitochondrion; Biological process=growth
  Coding regions on vcDNA: vcDNA=SeqID_94494; Strand=+; Position=3-500
GAHPFLNSAFIKMVRRYSEGNAITFAWIRPLVLPELRIVDRVDAVNRLVDVYDFMGAYLWLSYRFEEHFSDRDKVRELQRECVGFIQKSMDKMLSEYGEEEAKGAPRKGKRRENSDSEYELRAMGLHRNSSKRHDDTVSKVQKEGLQEQFNALISKMRKQRKQVK

SEQ ID NO: 168072 - protein, 171 aa, Heterodera glycines
  Coding regions on vcDNA: vcDNA=SeqID_94495; Strand=+; Position=2-514
IHFRQLYLKMNLWMLILMFGPIHSVRIRRHWVKGQLNDEVNRKDFEHNVTDHSCANANHSADQIANFVLSDQSKNCGKDRNVFDQSQQSDELNDRDEKANHSVDSLESDQCLSNKSKSERKCKFADHQKLRITNQYNHFISAYLRKGNHSKNEWGNFLKKLANVLGVKGRT

SEQ ID NO: 168073 - protein, 28 aa, Heterodera glycines
  Coding regions on vcDNA: vcDNA=SeqID_94496; Strand=-; Position=23-109
SISSDPTHLLISTRDVNEQDENKKHGLF

SEQ ID NO: 168074 - protein, 137 aa, Heterodera glycines
  Homolog annotation: Hit_ID=CAE68087.1; Match level="QueryCoverage =73%, HitCoverage=15%, E-value=3e-19, Identity=42%"; Hit description =Hypothetical protein CBG13722 [Caenorhabditis briggsae]
  Coding regions on vcDNA: vcDNA=SeqID_94497; Strand=+; Position=2-412
RRLVATVDTIEHFCALMDLHNIKDRLALVKAAFAPLTLFCAVSSTARVTRNRDILCLCNFGYVPRGAHLSYAEPYHFSNRLVDRALDELVEPFRTFNFKEQMNTQSALNCTQIEEECGGHLLGVSGRCFHNSGEFPP

SEQ ID NO: 168075 - protein, 82 aa, Heterodera glycines
  Coding regions on vcDNA: vcDNA=SeqID_94498; Strand=-; Position=2-247
KHYLSIGLENEKESARNVRNLSIQKFVTVLRWGVGKRKEDDLRDDTRVPNQKSDVTGDSVIFHFIWMCCGQNPIVQLGQPAN

SEQ ID NO: 168076 - protein, 103 aa, Heterodera glycines
  Homolog annotation: Hit_ID=CAE67580.1; Match level="QueryCoverage =100%, HitCoverage=11%, E-value=1e-28, Identity=57%"; Hit description= Hypothetical protein CBG13113 [Caenorhabditis briggsae]
  Gene Ontology: Mol. function=electron transporter activity; Cellular component=integral to membrane; Biological process=thyroid hormone generation
  Coding regions on vcDNA: vcDNA=SeqID_94499; Strand=+; Position=213-521
DDIDLYVGGLVEEPLIGALVGPTFACIIGDQFRRTRDGDRFYYENPGIFSSAQLAELKKTSLARLLCDNGDQISKVPFYALLLPSAIGTVPCARLAQLDLHKW

SEQ ID NO: 168077 - protein, 73 aa, Heterodera glycines
  Coding regions on vcDNA: vcDNA=SeqID_94500; Strand=+; Position=2-220
SGSGGSMVAKLKLSDTVLRMDYEHRNRPVQLTVNWDAVTHDKLDFYHFHWTKPEDEVLDHLEDALGIGTESDG

SEQ ID NO: 168078 - protein, 31 aa, Heterodera glycines
  misc_feature (26)..(26): Xaa can be any naturally occurring amino acid
  Coding regions on vcDNA: vcDNA=SeqID_94501; Strand=+; Position=3-95
RKKRKTKFDGRFVCFTFRQNSSKLIXEKKKK

SEQ ID NO: 168079 - protein, 58 aa, Heterodera glycines
  Coding regions on vcDNA: vcDNA=SeqID_94502; Strand=-; Position=1-174
QKMDGRINFPVLFHCFFAFLRLSSSAESPICCCTLCRLFFGRINFRALSIKNSTRIFV

SEQ ID NO: 168080 - protein, 35 aa, Heterodera glycines
  Coding regions on vcDNA: vcDNA=SeqID_94503; Strand=+; Position=1-108
NEKQLVYFHVFSCDLVSFYRIITVVQYMAHAIKNK

SEQ ID NO: 168081 - protein, 174 aa, Heterodera glycines
  Coding regions on vcDNA: vcDNA=SeqID_94504; Strand=+; Position=1-522
TESSSPITSPDNISQLCTPSNPSPPQGILSLPEFANSYQLDIISALRGNEHDFLAKAAIADAIRAFQSDEDKMELIDFIASEEHGAIALTLENNACKMFNCSPSELPLVSSNYKTKKHFLSELCELFTTSLCQSIPTLFAMLYPLQHSNPNFQIRKIILRHFRDRVLIRLLANF

SEQ ID NO: 168082 - protein, 21 aa, Heterodera glycines
  Coding regions on vcDNA: vcDNA=SeqID_94505; Strand=+; Position=1-66
LEFLLIKCDECTKTSNLIKHV

SEQ ID NO: 168083 - protein, 109 aa, Heterodera glycines
  misc_feature (78)..(78): Xaa can be any naturally occurring amino acid
  Coding regions on vcDNA: vcDNA=SeqID_94506; Strand=+; Position=3-333
KFREPEVLNFTKYLNHRTGDGHFFVLSCSFFGISTGESESESSLESDDEEEGEEGEFGEEEEEGEGEHEEEEEHREGXKRGKGEMKVTRKKANDANGWGHGKTEGHCPF

SEQ ID NO: 168084 - protein, 122 aa, Heterodera glycines
  Coding regions on vcDNA: vcDNA=SeqID_94507; Strand=+; Position=56-424
LKLTTFQKPLFFLVTFSNPIKFTHFTLFQVQEYTGPRKAICSLVNVENQAVNGSITFTQESPADSMAFEGRIKGINANHCDLFVHEFDDLSEGLSSVGPVFNPPQTLFSGHQFFGSFHKFQG

SEQ ID NO: 168085 - protein, 78 aa, Heterodera glycines
  Coding regions on vcDNA: vcDNA=SeqID_94508; Strand=+; Position=182-415
GKFCCRTKRPTSELTWLNPQQSPRKETALRTWHMADKCTAHNWTCQKPIKRFRTIYFALDKNYRIEMPNANVIKFKRT

SEQ ID NO: 168086 - protein, 63 aa, Heterodera glycines
  Homolog annotation: Hit_ID=XP_397445.1; Match level="QueryCoverage =61%, HitCoverage=7%, E-value=6e-10, Identity=61%"; Hit description =similar to CG3810-PB [Apis mellifera]
  Coding regions on vcDNA: vcDNA=SeqID_94509; Strand=+; Position=3-194
VGSAKAKLVETTGGPCVIEAGGWIFNTEAHPLDPGIVYCCSKKHQSDTALLQQFEQDIDFIPP

SEQ ID NO: 168087 - protein, 42 aa, Heterodera glycines
  Coding regions on vcDNA: vcDNA=SeqID_94510; Strand=+; Position=139-264
LICYLKTITLKGPLKLIIKKQFKKIKKKITHYSKKKTFRKKN

SEQ ID NO: 168088 - protein, 174 aa, Heterodera glycines
  Homolog annotation: Hit_ID=CAE61814.1; Match level="QueryCoverage =99%, HitCoverage=48%, E-value=1e-47, Identity=53%"; Hit description =Hypothetical protein CBG05782 [Caenorhabditis briggsae]
  Gene Ontology: Mol. function=structural constituent of cuticle; Cellular component=extracellular; Biological process=reproduction
  Coding regions on vcDNA: vcDNA=SeqID_94511; Strand=+; Position=8-529
MISARSAGLLTVSASLIAMVSIFFYLPLLVFKIQRINEQLKVDSDEFKAMADETWDQLITVRSTLPQEMLLRKRRQAYELPKAYPLHNSYAKQDAYVHGPTCACNPLNNCPAGPPGPPGKPGEDGIPGTRGPAGGPGLPGNAPPVAVDPNAGCRVCPHGPTGPAGPPGESGPTG

SEQ ID NO: 168089 - protein, 41 aa, Heterodera glycines
  Coding regions on vcDNA: vcDNA=SeqID_94512; Strand=+; Position=1-123
MTIYLFFYFMRNQNYNVFVLYILKDKFLTSKKKKKKKKKKK

SEQ ID NO: 168090 - protein, 53 aa, Heterodera glycines
  Homolog annotation: Hit_ID=NP_493644.1; Match level="QueryCoverage =98%, HitCoverage=12%, E-value=1e-10, Identity=63%"; Hit description =proteasome Regulatory Particle, ATPase-like, S10b (rpt-4) [Caenorhabditis elegans] gb|AAB70326.2| Proteas
  Coding regions on vcDNA: vcDNA=SeqID_94513; Strand=+; Position=2-160
AKVKIIMATNRPDTLDPALLRPGRLDTNIEIGLINGNTSLDALNTPCHQSVEH

SEQ ID NO: 168091 - protein, 134 aa, Heterodera glycines
  Coding regions on vcDNA: vcDNA=SeqID_94514; Strand=+; Position=1-405
WSEDTPISAGPIFGHHSHRIGAAPPPPPPQHAARAAVGAAGALATDRSAQQQRLPSHYDRDGANANANHALLARGDLANDDGNNDPMGFGQAEAGQTARHRRGPALILLLVVLPLVVGAFTVLLVFLNYHCNML

SEQ ID NO: 168092 - protein, 94 aa, Heterodera glycines
  Coding regions on vcDNA: vcDNA=SeqID_94515; Strand=+; Position=100-384
GFLGPAVPIGAAGKFLKISRQFINRKLYKNCYFFDKKIKKNSEKFQLFIKNFGSRKSEFRPQKCRNWNSEVRAIPGIYAGSLGHIKNFSVKNCF

SEQ ID NO: 168093 - protein, 29 aa, Heterodera glycines
  Coding regions on vcDNA: vcDNA=SeqID_94516; Strand=-; Position=1-87
FFFFLTFMEMYAPKPNKKSNKKVTITKFK

SEQ ID NO: 168094 - protein, 121 aa, Heterodera glycines
  Coding regions on vcDNA: vcDNA=SeqID_94517; Strand=-; Position=83-448
LIRADNSATKREKFPGIVPKKRMVYDIVRCVQVESKSIAAVIHHQNCGCSFSQHSDDGLNDPFAGHGQTAPFLDQLGHLGLAVRLRQQHINGRLNFGTEFHLFLKVSARFGGKRFTRTNAD

SEQ ID NO: 168095 - protein, 52 aa, Heterodera glycines
  Coding regions on vcDNA: vcDNA=SeqID_94518; Strand=+; Position=22-180
QKNGRKLFSFFSASINCLSVKQNKYILFIKIKTISSKQLDWPIYACLTVNPG

SEQ ID NO: 168096 - protein, 83 aa, Heterodera glycines; identical to SEQ ID NO: 147661
  Coding regions on vcDNA: vcDNA=SeqID_94519; Strand=+; Position=79-330

SEQ ID NO: 168097 - protein, 94 aa, Heterodera glycines
  Coding regions on vcDNA: vcDNA=SeqID_94520; Strand=-; Position=34-318
LIFVGILPFFFGCLFLFSATNKATASTTSIVTTKNANNDEVRLNSSNIGTESDLAVFAFLAIGQPQIVEAEHGTDQQQNGEKTKRGHFVNLIIW

SEQ ID NO: 168098 - protein, 76 aa, Heterodera glycines
  Coding regions on vcDNA: vcDNA=SeqID_94521; Strand=+; Position=3-233
SKSSLKMKLSIILLLSLAFCALIIDAYPSGNGKDLEADNEKNSDCCRCVSRNFVRNQIINNVYYFEKFLSYFCCFL

SEQ ID NO: 168099 - protein, 80 aa, Heterodera glycines
  Coding regions on vcDNA: vcDNA=SeqID_94522; Strand=-; Position=2-241
ADKFIFRNNPILIGISIHFCSVLFLKCGGIYTFPPPAAGVSCEVGCGVAAGFDTVRQLFWESAVLVIPVGLVLQFESPSL

SEQ ID NO: 168100 - protein, 87 aa, Heterodera glycines
  Homolog annotation: Hit_ID=AAP30776.1; Match level="QueryCoverage =56%, HitCoverage=20%, E-value=3e-15, Identity=83%"; Hit description =putative gland protein G34B08 [Heterodera glycines]
  Coding regions on vcDNA: vcDNA=SeqID_94523; Strand=+; Position=58-321
MRTFLFIAVVGLMLAVILENVNATGKNSPTKGKQSLDSPNHEKDHKIEHEKYEAAYFQSLLFFYMSKVTYRTMLPVTRLFSNHKIFI

SEQ ID NO: 168101 - protein, 51 aa, Heterodera glycines
  Homolog annotation: Hit_ID=NP_497455.1; Match level="QueryCoverage =64%, HitCoverage=35%, E-value=6e-10, Identity=75%"; Hit description =putative secreted or extracellular protein precursor (3C853) [Caenorhabditis elegans] gb|AAF60614.2| Caen
  Coding regions on vcDNA: vcDNA=SeqID_94524; Strand=+; Position=302-454
NDNLIKVFSYLFSSQLVRHKRWGYGYGGGWGGGWGRGGWGGGWGGRGWGGG

SEQ ID NO: 168102 - protein, 107 aa, Heterodera glycines
  Homolog annotation: Hit_ID=CAE61632.1; Match level="QueryCoverage =71%, HitCoverage=32%, E-value=3e-09, Identity=42%"; Hit description =Hypothetical protein CBG05562 [Caenorhabditis briggsae]
  Coding regions on vcDNA: vcDNA=SeqID_94525; Strand=+; Position=155-475
RRIGSVPFSSTTDSPTGVPFLFLWSQIRWSFSFFGCVSGHDWAIVELEVPIAFSDRVLPICLPASPALQQISDGEVLTVTSWGRRDAFHKGDPLIREIPLRHDAGCK

SEQ ID NO: 168103 - protein, 148 aa, Heterodera glycines
  Homolog annotation: Hit_ID=AAO49799.1; Match level="QueryCoverage =100%, HitCoverage=59%, E-value=7e-62, Identity=94%"; Hit description= arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_94526; Strand=+; Position=2-448
YVEMESKVKAVFEQLKGDAELGGTYYPLQGNVGQVLERLIEGVKAIESKVPFSRDDRLGWLTFCPTNLGTTVRASVHIRLPKISAKPDFKSTCDGLKLQIRGIHGEHSESAGGVYDISNKARLGLTEFEAVKQMYDGVKHLIELEKKA

SEQ ID NO: 168104 - protein, 25 aa, Heterodera glycines
  Coding regions on vcDNA: vcDNA=SeqID_94527; Strand=-; Position=117-194
FFFFFFFFFFLNFFFFFFFFFFFFK

SEQ ID NO: 168105 - protein, 141 aa, Heterodera glycines
  Coding regions on vcDNA: vcDNA=SeqID_94528; Strand=+; Position=20-442
MWPNIFFNLLIFILIFGALTEAQNQQKIETKTLVSDGQSHTLEISGLYMTMTQETLSDGTIVLRFTGKNIDVETSKSDDNSLTTEASLPTNEVSSSTAKEASTLNCAKEEEEGEEAQNAAESDDGSFSMPDESDDSMADRV

SEQ ID NO: 168106 - protein, 55 aa, Heterodera glycines
  Coding regions on vcDNA: vcDNA=SeqID_94529; Strand=-; Position=184-351
RVNHHIYITMLLLNVNVGNIYYLSCLIGLDYAKNGVKDQSSFSWEVEIFGRRVII

SEQ ID NO: 168107 - protein, 29 aa, Heterodera glycines
  Coding regions on vcDNA: vcDNA=SeqID_94530; Strand=-; Position=1-87
NPWHFKMSATSTHHWHITMVEMTSSIDRI

SEQ ID NO: 168108 - protein, 39 aa, Heterodera glycines; identical to SEQ ID NO: 167895
  Coding regions on vcDNA: vcDNA=SeqID_94531; Strand=+; Position=91-210

SEQ ID NO: 168109 - protein, 112 aa, Heterodera glycines
  Coding regions on vcDNA: vcDNA=SeqID_94532; Strand=-; Position=2-337
SWYSSSVFLTILVLLCYLIPPFCFLFEFFPFLVFCCCCCFWSFPYPLARSLHGTLLSMKGKMCRTLSQFFSLQYYKKWTNLAKFGPTMLLNSSNSSDLSYFVAIESQFRPAA

SEQ ID NO: 168110 - protein, 40 aa, Heterodera glycines
  Coding regions on vcDNA: vcDNA=SeqID_94533; Strand=+; Position=49-171
FDYSRHQRTTCDRLVGFDDGRLELMNAKSNFCLMKTHNYF

SEQ ID NO: 168111 - protein, 180 aa, Heterodera glycines
  Homolog annotation: Hit_ID=CAE59064.1; Match level="QueryCoverage =100%, HitCoverage=21%, E-value=5e-76, Identity=71%"; Hit description= Hypothetical protein CBG02349 [Caenorhabditis briggsae]
  Gene Ontology: Mol. function=AMP deaminase activity; Biological process=purine nucleotide metabolism
  Coding regions on vcDNA: vcDNA=SeqID_94534; Strand=+; Position=2-541
TDLEESKYQQMEPRLSIYGRAKDEWDKLARWAIGHDVWSPNARWIIQVPRLFDIYRTNKILKTFDDFLDNLFTPLFEVTNDPNSHPDLHRFLQHVSGIDSVDDESKPENVAFTKDSPEPADYDNDQNPSYSYYLYYMYANLTALNAFRRMRGLNTFALRPHCGEAGAVGHLSVSYLTSES

SEQ ID NO: 168112 - protein, 126 aa, Heterodera glycines
  Homolog annotation: Hit_ID=CAE65756.1; Match level="QueryCoverage =98%, HitCoverage=23%, E-value=3e-61, Identity=87%"; Hit description =Hypothetical protein CBG10845 [Caenorhabditis briggsae]
  Coding regions on vcDNA: vcDNA=SeqID_94535; Strand=+; Position=1-381
SSIPRLDNVRVLVMGVAEDCCPKVTAKIHIDQFIDCIAQHCPQLTRLEIRWDDETLRFSDKSSKFIDVLRMKCPKLHSLVLSDGQYYELVRSNFERADRLSVVRTTEMCKTGLLHCSKYFNQLLFN

SEQ ID NO: 168113 - protein, 76 aa, Heterodera glycines; identical to SEQ ID NO: 129528
  Coding regions on vcDNA: vcDNA=SeqID_94536; Strand=+; Position=89-319

SEQ ID NO: 168114 - protein, 152 aa, Heterodera glycines
  Homolog annotation: Hit_ID=NP_497174.1; Match level="QueryCoverage =100%, HitCoverage=76%, E-value=4e-57, Identity=65%"; Hit description= ubiquitin conjugating enzyme (22.3 kD) (ubc-20) [Caenorhabditis elegans] gb|AAC68796.1| Ubiquitin conjug
  Gene Ontology: Mol. function=ubiquitin conjugating enzyme activity; Cellular component=proteasome complex (sensu Eukarya); Biological process=protein modification
  Coding regions on vcDNA: vcDNA=SeqID_94537; Strand=+; Position=56-511
MSNIAFIRIQKECKEIILCKELQENGVTIEPVNETLFEIIGKIRGPPDIPYENGIFILDVRIPQEYPFQPPKVKFTTHIWHPNISSQTGAICLDILKDQWAASMTLRTVLLSVQSLLLSPEPKDPQDAIVAKQCLSDPALFRSTAKYWAQHY

SEQ ID NO: 168115 - protein, 158 aa, Heterodera glycines
  misc_feature (83)..(83): Xaa can be any naturally occurring amino acid
  Homolog annotation: Hit_ID=NP_504277.1; Match level="QueryCoverage =91%, HitCoverage=63%, E-value=1e-12, Identity=34%"; Hit description =histone H1 like, linker histone H1.4, H1.4 (26.0 kD) (hil-4) [Caenorhabditis elegans] gb|AAC17754.1| Hist
  Coding regions on vcDNA: vcDNA=SeqID_94538; Strand=+; Position=2-479
AKKYPVGDRNGAINAFIRKAIKKLVEQNILILVEGATQKSARYRLAPEVKQHMKKVESKTIPTSPKPKSEEAKKAGEAKKKTXVSAAKIKDVEGKKKKKTGVSKKKVVMTRKPAQEKTNVLAKPKVKKSAKKKTPKAAIKKSAPAAASVKSSVKTDKA

SEQ ID NO: 168116 - protein, 105 aa, Heterodera glycines
  Coding regions on vcDNA: vcDNA=SeqID_94539; Strand=-; Position=1-315
FFFFFFFLFFPPPLFFFFFFFFGTYTLFNFPRQNKRTSARKQINCLNKFPLVSKRMPFFTQCQRMNGRAFFGRIWRQQRRVQLNQPIWLIGGCSFLGRVNPLIKR

SEQ ID NO: 168117 - protein, 52 aa, Heterodera glycines
  Coding regions on vcDNA: vcDNA=SeqID_94540; Strand=+; Position=3-161
KEMIIGRGQNYELSIKAKQRKTVFSSIFLAICVNFLLSNFFNAFNRKKKNFF

SEQ ID NO: 168118 - protein, 97 aa, Heterodera glycines
  Coding regions on vcDNA: vcDNA=SeqID_94541; Strand=-; Position=2-292
SKKIIVFSHSFAITFILLLQLDLINFSLGFSLPLVVRSTNVHTITSRLGSIGLLNFSFFLFLDSLPLRQSTIKQRVDFVSLFFEFEHNVIHLVNLFG

SEQ ID NO: 168119 - protein, 161 aa, Heterodera glycines
  Coding regions on vcDNA: vcDNA=SeqID_94542; Strand=+; Position=2-484
MHADANVDWAKLLGTMDGENEGEDEDGQEQRQAEEEWHQKRLQMIKWRAEQEERNIRAKKRTRQDDDEEGTNGRRRDADDEKGPIVELLELDSPLFALGKKLLCAAKDANSASPSSSRVVPSSSLSAASLFADVSIPPPAKRRDSLLNSYLRRTDAATIRT

SEQ ID NO: 168120 - protein, 118 aa, Heterodera glycines
  Homolog annotation: Hit_ID=CAE67637.1; Match level="QueryCoverage =92%, HitCoverage=19%, E-value=2e-37, Identity=68%"; Hit description =Hypothetical protein CBG13195 [Caenorhabditis briggsae]
  Gene Ontology: Mol. function=protein binding; Cellular component =cell; Biological process=embryonic development
  Coding regions on vcDNA: vcDNA=SeqID_94543; Strand=+; Position=3-359
GNRIATALFYFSQPEKGGFTVFTELKTPQKPSKYDALFWYNLLRNGEGDLRTCHAACPVLLGVKCVSNKWIHEKGQELLRPCALKPSVQERYVGDLGGPEPRGHPNVSPYCKTALYCE

SEQ ID NO: 168121 - protein, 74 aa, Heterodera glycines
  Coding regions on vcDNA: vcDNA=SeqID_94544; Strand=+; Position=92-316
QINWGSTICWQNHRPNVRIKVVIKWLSNHQNIHSFYYFIGPFPKIQFTKMVSKLLPVILCCLFLVCLSIRYKIL

SEQ ID NO: 168122 - protein, 65 aa, Heterodera glycines
  Coding regions on vcDNA: vcDNA=SeqID_94545; Strand=-; Position=20-217
SVIGEKKNSKFFFVYRFLKKKFNDKKCQLVNRSTLNLSPNGTSFSQHAHCGFLMSFELNEKLISI

SEQ ID NO: 168123 - protein, 184 aa, Heterodera glycines
  misc_feature (118)..(118): Xaa can be any naturally occurring amino acid
  Homolog annotation: Hit_ID=NP_502180.1; Match level="QueryCoverage =100%, HitCoverage=48%, E-value=4e-63, Identity=58%"; Hit description= mammalian RIB-affecting EXT family related (44.9 kD) (rib-1) [Caenorhabditis elegans] emb|CAB61014.1| Hy
  Gene Ontology: Cellular component=integral to membrane; Biological process=skeletal development
  Coding regions on vcDNA: vcDNA=SeqID_94546; Strand=-; Position=3-554
HLVFNLYFGTFPDYANTDLGFDFGKAMVAWASSNLQNFRPNFDLSFPLFNNEHPFKDDKPWHLQPHFPNHDKYLASFKGKRYVYGVGSKTRNILHHSNDNRSIVIATTCKHNTDWKKXEDERCEVDNANYGRWDYEQLMANSTFCLIPRGRRLGSFRFLEALRSVCIPVILSDEWVLPFSEVIN

SEQ ID NO: 168124 - protein, 72 aa, Heterodera glycines
  Homolog annotation: Hit_ID=CAE61905.1; Match level="QueryCoverage =87%, HitCoverage=20%, E-value=5e-13, Identity=61%"; Hit description =Hypothetical protein CBG05897 [Caenorhabditis briggsae]
  Coding regions on vcDNA: vcDNA=SeqID_94547; Strand=+; Position=2-220
SGLIVQYYNAFLKRNYVVSWQCLDIIRKDMVDPLSGKRMAESDIIELQRGGTGYAATNKLDAKLIRPQLELQ

SEQ ID NO: 168125 - protein, 125 aa, Heterodera glycines
  misc_feature (10)..(10): Xaa can be any naturally occurring amino acid
  misc_feature (24)..(24): Xaa can be any naturally occurring amino acid
  misc_feature (41)..(41): Xaa can be any naturally occurring amino acid
  Coding regions on vcDNA: vcDNA=SeqID_94548; Strand=-; Position=99-476
LMNWLVGFGXFFFFCLLSVLLPFXVSSSSAAFCLLSLVSAXGRCLCAHCRWQMAINGGEETVPLVVGHQSKPTPSHRFPKALLQHLSVDRVELKCGRNSTIVWAIGGWEGGGKEGGGGTNCQNGR

SEQ ID NO: 168126 - protein, 119 aa, Heterodera glycines
  Homolog annotation: Hit_ID=NP_060720.1; Match level="QueryCoverage =95%, HitCoverage=18%, E-value=2e-18, Identity=42%"; Hit description =hypothetical protein FLJ10871 [Homo sapiens] dbj|BAA91867.1| unnamed protein product [Homo sapiens]
  Coding regions on vcDNA: vcDNA=SeqID_94549; Strand=+; Position=1-357
RQPCVVFAGHPSLRIGEIVQLLDLWGGMSRNAIIMIDPDYPLETYYAPYKSLAIRAYYYPIETRLDGTQVLNKIIGECGPKQVLFPEEYASAFSTLQALPMQAMSFRQNECVSLDSAKG

SEQ ID NO: 168127 - protein, 78 aa, Heterodera glycines
  Coding regions on vcDNA: vcDNA=SeqID_94550; Strand=+; Position=133-369
LYVFTQFKFCRSWTRIRTKCATMPHLPTQTGIDLTQMALNSHLFVHKNTQNANLLFYYTIKSRRSSTFYLSFLIVLLF

SEQ ID NO: 168128 - protein, 119 aa, Heterodera glycines
  misc_feature (6)..(6): Xaa can be any naturally occurring amino acid
  misc_feature (8)..(8): Xaa can be any naturally occurring amino acid
  misc_feature (12)..(12): Xaa can be any naturally occurring amino acid
  misc_feature (20)..(20): Xaa can be any naturally occurring amino acid
  misc_feature (31)..(31): Xaa can be any naturally occurring amino acid
  misc_feature (99)..(99): Xaa can be any naturally occurring amino acid
  Coding regions on vcDNA: vcDNA=SeqID_94551; Strand=+; Position=155-511
LFRRFXLXPVNXSAPDAHSXIDGVDRCRVSXPFSSDNPFALFAVAQEADENGGIGSASLMAKRHLFEALARQGRSPRSASSATMRNALVRFGKHALFPXVALDDKHNPPQPFIHFGHSA

SEQ ID NO: 168129 - protein, 95 aa, Heterodera glycines
  misc_feature (74)..(74): Xaa can be any naturally occurring amino acid
  misc_feature (84)..(84): Xaa can be any naturally occurring amino acid
  Homolog annotation: Hit_ID=CAE73955.1; Match level="QueryCoverage =98%, HitCoverage=15%, E-value=8e-18, Identity=44%"; Hit description =Hypothetical protein CBG21580 [Caenorhabditis briggsae]
  Gene Ontology: Mol. function=cysteine-type endopeptidase activity; Cellular component=intracellular; Biological process=proteolysis and peptidolysis
  Coding regions on vcDNA: vcDNA=SeqID_94552; Strand=+; Position=2-380
GSPEWEQVTEEQKWRLGITVDEDGEFWMPWHEFVRYFTDICLSMQLSNVTIGLTEKRWREWTFFNRWSSNSVKXGAPKNHAGGXVHFPATFCYNP

SEQ ID NO: 168130 - protein, 177 aa, Heterodera glycines
  misc_feature (115)..(115): Xaa can be any naturally occurring amino acid
  misc_feature (155)..(155): Xaa can be any naturally occurring amino acid
  Homolog annotation: Hit_ID=AAC48326.1; Match level="QueryCoverage =100%, HitCoverage=55%, E-value=8e-84, Identity=83%"; Hit description= beta-1,4-endoglucanase-2 precursor [Heterodera glycines]
  Coding regions on vcDNA: vcDNA=SeqID_94553; Strand=+; Position=46-578
MFVQLVLLAIVGITFVDAAAPPFGQLSVKGTNLVGSNGKPVQLIGNSLFWHQWYPQFWNAQTVKALKCNWNSNVVRTAMGVEQGGYLNDTNTAYRLTAAVIEAAIAQGIYMIINXHTHKPNTNKAIEFFTKITKAYSSNPHLLYKTFNKPLNICXEHLLIPDHKKIISTIHTIHKNN

SEQ ID NO: 168131 - protein, 152 aa, Heterodera glycines
  misc_feature (135)..(135): Xaa can be any naturally occurring amino acid
  Homolog annotation: Hit_ID=NP_502549.1; Match level="QueryCoverage =86%, HitCoverage=83%, E-value=1e-42, Identity=59%"; Hit description =transthyretin-like precursor family member (4O16) [Caenorhabditis elegans] pir||T23149 hypothetical prote
  Coding regions on vcDNA: vcDNA=SeqID_94554; Strand=+; Position=48-506
MPLVHNCIAGTRHSLLIVLGLIMIMANCGQAMRQQAVAVRGQLRCGNRPASGVKVKLWDEDDGPDPDDVLDEAFTDSSGSFQMKGSTRELTNIDPVLKMYHNCDDGIIAKQHKLKLHIPNQYITNRRLTKRTFKXEVLNCKTVFTEEEKNFI

SEQ ID NO: 168132 - protein, 193 aa, Heterodera glycines
  misc_feature (55)..(55): Xaa can be any naturally occurring amino acid
  misc_feature (66)..(66): Xaa can be any naturally occurring amino acid
  misc_feature (71)..(71): Xaa can be any naturally occurring amino acid
  Homolog annotation: Hit_ID=CAE58432.1; Match level="QueryCoverage =90%, HitCoverage=22%, E-value=7e-13, Identity=32%"; Hit description =Hypothetical protein CBG01567 [Caenorhabditis briggsae]
  Gene Ontology: Biological process=regulation of protein activity, epigenetic
  Coding regions on vcDNA: vcDNA=SeqID_94555; Strand=+; Position=1-580
ERQRREMLRAEHDRRQSQLRHKMEHMRQMKHEMLLNERQLAIQRFQNNERQIMQXANGWYNNAQQXSSVPXPPMVSPYPHQQHYQQIPNSMPPNTAVTMNAIPSLPQNITTPMPPNEMLTNVNLVGIRAFQSNEHQIMQQQMMGQQPQMHQYQMPHLASPYPHQQQPHYQQIPNSMPPNAITADEQKNQMTGV

SEQ ID NO: 168133 - protein, 76 aa, Heterodera glycines
  misc_feature (10)..(10): Xaa can be any naturally occurring amino acid
  misc_feature (40)..(40): Xaa can be any naturally occurring amino acid
  misc_feature (59)..(59): Xaa can be any naturally occurring amino acid
  misc_feature (62)..(62): Xaa can be any naturally occurring amino acid
  misc_feature (69)..(69): Xaa can be any naturally occurring amino acid
  Coding regions on vcDNA: vcDNA=SeqID_94556; Strand=+; Position=118-348
DSLLCPLCQXSKMAFFNKHLVGFVFTQPPSLRELCFWTVXRQLAEWRPRGKIWRGGRTXKEXQAMFKIXQTIQIVH

SEQ ID NO: 168134 - protein, 93 aa, Heterodera glycines
  Homolog annotation: Hit_ID=NP_492636.1; Match level="QueryCoverage =100%, HitCoverage=40%, E-value=3e-30, Identity=66%"; Hit description= tetraspanin family member (tsp-7) [Caenorhabditis elegans] emb|CAB03397.2| Hypothetical protein T23D8.2
  Coding regions on vcDNA: vcDNA=SeqID_94557; Strand=+; Position=183-461
MVEGGITLVKYLLFFANFVLWTLGLAFLIAGVVLQLKYTGLLDILGDERLTTPMLLLAIGCLCTLLGFVSYCSTIHKNYCLTVSFTILLTLLL

SEQ ID NO: 168135 - protein, 94 aa, Heterodera glycines
  misc_feature (69)..(69): Xaa can be any naturally occurring amino acid
  misc_feature (90)..(90): Xaa can be any naturally occurring amino acid
  Homolog annotation: Hit_ID=NP_958447.1; Match level="QueryCoverage =94%, HitCoverage=17%, E-value=8e-10, Identity=41%"; Hit description =chaperonin containing TCP1, subunit 6A (zeta 1) [Danio rerio] gb|AAH71416.1| Chaperonin containing TCP1,
  Gene Ontology: Mol. function=chaperone activity; Cellular component =cytoplasm; Biological process=protein folding
  Coding regions on vcDNA: vcDNA=SeqID_94558; Strand=+; Position=2-365
KFQIFVLALLVLLRFFNPPNCQAIVKLVETFSAADELVGLDLESGSRVFLRCGVWDNVCVKQASLNACXNITSNLLEVDEVMHAGMPHLXGGQK

SEQ ID NO: 168136 - protein, 78 aa, Heterodera glycines
  Homolog annotation: Hit_ID=CAE60876.1; Match level="QueryCoverage =100%, HitCoverage=17%, E-value=1e-28, Identity=69%"; Hit description= Hypothetical protein CBG04588 [Caenorhabditis briggsae]
  Gene Ontology: Mol. function=apoptosis inhibitor activity; Cellular component=cytoplasm; Biological process=chromatin modification
  Coding regions on vcDNA: vcDNA=SeqID_94559; Strand=-; Position=3-367
GHGKCVTFFCDCNLLLMLLGGGGYTPRNVARCWTYETSLAVDIDISDELPYNDYFEYFAPNYRLHIDASNETNHNTEE

SEQ ID NO: 168137 - protein, 149 aa, Heterodera glycines
  misc_feature (97)..(97): Xaa can be any naturally occurring amino acid
  misc_feature (121)..(121): Xaa can be any naturally occurring amino acid
  Coding regions on vcDNA: vcDNA=SeqID_94560; Strand=+; Position=33-479
MMPSSVIPSGSSALAHLGAVDYYSAAALQQQLLQQQLTALAAANPALSVAAAQQQQQYAAAIAAAVASNSSIGQQCAVPTQSNGSDSPSAGGWSLSXHNLASEVREPTLWQMFRPFSAVLXIKLSKRKEQATISITNYKETIITANTLN

SEQ ID NO: 168138 - protein, 103 aa, Heterodera glycines
  misc_feature (69)..(69): Xaa can be any naturally occurring amino acid
  misc_feature (94)..(94): Xaa can be any naturally occurring amino acid
  Coding regions on vcDNA: vcDNA=SeqID_94561; Strand=+; Position=114-425
SPGIWRVFSYKHGARQKKATRRRKSKNTQKFEDERNSFNTRQQNLREHAKNELLGKILKAKNEFMEKIXNERAQIAEKLFCKFGRRSDGGAKHXITGGQPNHR

SEQ ID NO: 168139 - protein, 72 aa, Heterodera glycines
  Coding regions on vcDNA: vcDNA=SeqID_94562; Strand=-; Position=228-446
FFFFFFFFFFFFFLFFFFFVLKKIYSPNSKAEKELKKEQTTNMKRICNKIPALLHSSQVWHFFPPVSYGSAQ

SEQ ID NO: 168140 - protein, 55 aa, Heterodera glycines
  Coding regions on vcDNA: vcDNA=SeqID_94563; Strand=-; Position=0-164
SVKSNQLMFTSLPMPNRIGSHNQPRNLPNTPLRRFGFAESASSSSISWIVGPTPL

SEQ ID NO: 168141 - protein, 64 aa, Heterodera glycines
  misc_feature (9)..(9): Xaa can be any naturally occurring amino acid
  misc_feature (56)..(59): Xaa can be any naturally occurring amino acid
  Homolog annotation: Hit_ID=NP_625403.1; Match level="QueryCoverage =95%, HitCoverage=22%, E-value=4e-11, Identity=50%"; Hit description =putative secreted lyase [Streptomyces coelicolor A3(2)] emb|CAC13062.1| putative secreted lyase [Streptom
  Coding regions on vcDNA: vcDNA=SeqID_94564; Strand=+; Position=200-391
LFCIGAVIXSEGQKALIRAEKGAVIKNLIIGQNGADGIHCYNGCTLQNVWWEKVGXXXXTFRTS

SEQ ID NO: 168142 - protein, 157 aa, Heterodera glycines
  Coding regions on vcDNA: vcDNA=SeqID_94565; Strand=+; Position=2-475
HLLADVRQRFLQKGGRLALCRKMVPFRLFDVFFCLEVFTLAKVRCAFVAALKGKDAPSLSLNDDTTPSLNGSGSFLDVTADENFNRLIPASSQLEKRDIAIGVLSSQLDVLNSQLEKKDIAIGVLNSQLEKKDIAIGVLSIAVVGMGATIIYLLNRR

SEQ ID NO: 168143 - protein, 117 aa, Heterodera glycines
  misc_feature (31)..(31): Xaa can be any naturally occurring amino acid
  Homolog annotation: Hit_ID=CAE60451.1; Match level="QueryCoverage =100%, HitCoverage=23%, E-value=4e-40, Identity=65%"; Hit description= Hypothetical protein CBG04059 [Caenorhabditis briggsae]
  Gene Ontology: Mol. function=transaminase activity
  Coding regions on vcDNA: vcDNA=SeqID_94566; Strand=+; Position=3-352
SIEEYNLGQVGYYLDEENNWALDMDELERAXEGSEHDVKAIVVINPGNPTGQVLSRANIENIIQFAHKHRLYIFADEVYQENVYAEGAEFHSFRKVMFEMGAPFDKLELASFYSCSK

SEQ ID NO: 168144 - protein, 74 aa, Heterodera glycines
  Coding regions on vcDNA: vcDNA=SeqID_94567; Strand=+; Position=1-225
MKLVTLLLFLKIVFADNDKDDCDDDKDKSLKDLDYRDQIGFVDCGCSTINGTVVCAYADPFPPYQMKGGFDCQS

SEQ ID NO: 168145 - protein, 140 aa, Heterodera glycines; identical to SEQ ID NO: 125863
  Coding regions on vcDNA: vcDNA=SeqID_94568; Strand=-; Position=85-507

SEQ ID NO: 168146 - protein, 226 aa, Heterodera glycines
  misc_feature (106)..(106): Xaa can be any naturally occurring amino acid
  misc_feature (176)..(176): Xaa can be any naturally occurring amino acid
  misc_feature (209)..(209): Xaa can be any naturally occurring amino acid
  misc_feature (224)..(224): Xaa can be any naturally occurring amino acid
  misc_feature (226)..(226): Xaa can be any naturally occurring amino acid
  Coding regions on vcDNA: vcDNA=SeqID_94569; Strand=+; Position=76-753
SRSKRRRRKGMPSGGDDEQQFEEAVKPALESLLADLQKTTEVLRQGKHGKGRRQQKEDESAALLDLKKLRNSPRQRNQSPAAVANLRNGGSEELQACRDPMLEGDXLGIHTIPEGDCAPCNQAGDRPAAIALGTILHTEVRPGGYQSVGRRCHWWAAPTRRRQEHAAQRGTRPRGXDAAPRRGRHPARRMRVARDGALREGARNAAADXADRPAQAHVSGGRAXAX

SEQ ID NO: 168147 - protein, 89 aa, Heterodera glycines
  misc_feature (46)..(46): Xaa can be any naturally occurring amino acid
  misc_feature (52)..(52): Xaa can be any naturally occurring amino acid
  Coding regions on vcDNA: vcDNA=SeqID_94570; Strand=-; Position=29-298
MAMAFAQKKGPKAEGRRCRTVGRRRTKKWPKFEWVELLLLTARLFXNCSPPXAISDELFGASLCPLTKMAIVKIKAAIKNLLAIFAINY

SEQ ID NO: 168148 - protein, 121 aa, Heterodera glycines
  Homolog annotation: Hit_ID=NP_491475.2; Match level="QueryCoverage =94%, HitCoverage=30%, E-value=4e-25, Identity=50%"; Hit description =NHL repeat (38.6 kD) (1F479) [Caenorhabditis elegans] gb|AAB42278.2| Hypothetical protein F21F3.1 [Caenor
  Coding regions on vcDNA: vcDNA=SeqID_94571; Strand=+; Position=3-368
VADRENERIQCFSAGLEGTTHNRRAYVPTGTFVTKAENIGRIYAIREKEHFLVGVTSWDRSGQLEPQVFVMDMNTGKANSFAKGLANAHAVALSNGGDIFVSQLEPQQIVKFSIPSAGDAQ

SEQ ID NO: 168149 - protein, 83 aa, Heterodera glycines
  Homolog annotation: Hit_ID=CAE74438.1; Match level="QueryCoverage =100%, HitCoverage=17%, E-value=4e-19, Identity=48%"; Hit description= Hypothetical protein CBG22171 [Caenorhabditis briggsae]
  Gene Ontology: Mol. function=protein binding; Cellular component =mitochondrial inner membrane; Biological process=proteolysis and peptidolysis
  Coding regions on vcDNA: vcDNA=SeqID_94572; Strand=+; Position=3-254
KVQLKSQLLMNLEMRPVQFEDLARQMLAHGQRKTADEYSDLIDRVENTDIIRIAHKMLDSRLSIVGYGDLRNMPTYKSIESRL

SEQ ID NO: 168150 - protein, 65 aa, Heterodera glycines
  Coding regions on vcDNA: vcDNA=SeqID_94573; Strand=-; Position=2-196
PGKYCQANEQYKAYRRCSVAHSKCTMKNTPSDVKYTILKQVNGSNLSKNFIEIMPPITSWDPASP

SEQ ID NO: 168151 - protein, 40 aa, Heterodera glycines
  Coding regions on vcDNA: vcDNA=SeqID_94574; Strand=+; Position=3-125
EADLLCIRDRIYLYLYVLSCIHLAVVISFTCIFQINIGKY

SEQ ID NO: 168152 - protein, 121 aa, Heterodera glycines
  Homolog annotation: Hit_ID=CAE62352.1; Match level="QueryCoverage =87%, HitCoverage=43%, E-value=2e-09, Identity=32%"; Hit description =Hypothetical protein CBG06429 [Caenorhabditis briggsae]
  Coding regions on vcDNA: vcDNA=SeqID_94575; Strand=+; Position=44-409
MFFCSLLKKDELPADLAALLSSKVVADINALLANKSLDCAQKLEKIDELMKTVPDEVMEKLPMPPHLAQLPEEVQAQIKKLCLETKHKSVEEKKEAFKAYAGTLPAEQRAIICKEKPSCGK

SEQ ID NO: 168153 - protein, 171 aa, Heterodera glycines
  misc_feature (46)..(46): Xaa can be any naturally occurring amino acid
  Homolog annotation: Hit_ID=NP_741835.1; Match level="QueryCoverage =61%, HitCoverage=21%, E-value=2e-26, Identity=55%"; Hit description =somatostatin Receptor subtype 5 like (XI5) [Caenorhabditis elegans] gb|AAA80406.1| Hypothetical protein C
  Gene Ontology: Mol. function=angiotensin type II receptor activity; Cellular component=integral to plasma membrane; Biological process =behavior
  Coding regions on vcDNA: vcDNA=SeqID_94576; Strand=+; Position=8-519
MGGVTQRSSIATADLMLPRQVSIVTVGTSTRAAEKRRNRTTVLLIXMAGSYAVLWLPFTFVSILIDLDWLGVESGSPIVERIDQTCKLLSITSICVNPFLYGYLNTNFRHEFNEIFLYCFAWLPAVKESRQSEISSSLGGGGGSHRRSIPQYSAIVSKTDGSTQQSNGVKV

SEQ ID NO: 168154 - protein, 36 aa, Heterodera glycines
  Coding regions on vcDNA: vcDNA=SeqID_94577; Strand=+; Position=10-120
IYGKINNTLKLKYKIKFKIPALCHALAHVPLMSSKY

SEQ ID NO: 168155 - protein, 122 aa, Heterodera glycines
  Coding regions on vcDNA: vcDNA=SeqID_94578; Strand=+; Position=174-539
KKKAYRRLKNTIRLINAKFDVFPPLEKLLDIKRRICGSLQYAPIETSAGVGFVCTGCEGALEARLSSAKDNLIRFGDEIFIKLSGDHGQSCTKITASFSQAARSNSPSNNFVCAVFPTKDSR

SEQ ID NO: 168156 - protein, 90 aa, Heterodera glycines
  Coding regions on vcDNA: vcDNA=SeqID_94579; Strand=-; Position=54-326
LYESNKLIKACVSQPVLPNLNFVGSKVKSEFCSIKMKNDRLDCNTANVFVLIIRYAEGTTDHELIWSGKAVHFFHADFAGTFHQCPVQYL

SEQ ID NO: 168157 - protein, 173 aa, Heterodera glycines
  Coding regions on vcDNA: vcDNA=SeqID_94580; Strand=+; Position=2-520
NLFLLPRSRRSERTKNHRKSPQNCSTNRRNFAPLNQLCRYSVSPSRIRTKEEIWDGFRRFRAGDIVRIIDEDEGKGYFAQTVAFITDDYTNQFAMVIWLLPKLSRNSFPKPFEFNADRFQHGFAEERPVPIKACEFISKCPPFPPYKRKWTPINQILAQKRSEITRRIEEMNL

SEQ ID NO: 168158 - protein, 59 aa, Heterodera glycines
  Homolog annotation: Hit_ID=NP_502842.1; Match level="QueryCoverage =96%, HitCoverage=19%, E-value=5e-18, Identity=68%"; Hit description =excreted secreted protein 1 like precursor (32.5 kD) (4Q36) [Caenorhabditis elegans] emb|CAB70225.1| Hypo
  Coding regions on vcDNA: vcDNA=SeqID_94581; Strand=+; Position=1-333
LKNKFKGLKKGCYPRPTGRCLCVVGKDSAGREITERRRKETDCKCQKGERSAQCPADGA

SEQ ID NO: 168159 - protein, 88 aa, Heterodera glycines
  Coding regions on vcDNA: vcDNA=SeqID_94582; Strand=+; Position=1-267
CTAQRNGGCSHGCVNTEGSFYCACPPGMVVDPAHPRQCLPIDGGLKRAADLFSYWAKMSKKAGKEAMMNVCRAMDKRLLRRVLIKTKN

SEQ ID NO: 168160 - protein, 59 aa, Heterodera glycines
  Coding regions on vcDNA: vcDNA=SeqID_94583; Strand=+; Position=265-444
FQSLLFWDFAGRCLAYIDNNMEKLIKSDDFLPIDQKLFLEILSRDQLKVGEESHIWQAV

SEQ ID NO: 168161 - protein, 31 aa, Heterodera glycines
  Coding regions on vcDNA: vcDNA=SeqID_94584; Strand=+; Position=2-97
GRRRVTATHFKLYIVLLLLIHNKFKKDMYNL

SEQ ID NO: 168162 - protein, 176 aa, Heterodera glycines
  Homolog annotation: Hit_ID=NP_509893.1; Match level="QueryCoverage =55%, HitCoverage=24%, E-value=2e-18, Identity=47%"; Hit description =hepatocyte nuclear factor 4 family member (XL939) [Caenorhabditis elegans] emb|CAA91462.1| Hypothetical p
  Gene Ontology: Mol. function=retinoid-X receptor activity; Cellular component=nucleus; Biological process=neuronal remodeling
  Coding regions on vcDNA: vcDNA=SeqID_94585; Strand=+; Position=3-530
TCRACAAFFRRTVSLKLQYSCKRKDHCEVDKAARNMCRACRYQKCLRQGMLTTAVQHSRDGIGKRSGSVQRERLLVTSTGTSGETKIARGASDAVSSSSSSAGGPQALIGIQQKAQHLLGTAYGRNRPLSPCSSSSALLLDQAANAATIVQLNAAPGHSSARPSALSPLSITTPAA

SEQ ID NO: 168163 - protein, 59 aa, Heterodera glycines
  Coding regions on vcDNA: vcDNA=SeqID_94586; Strand=+; Position=76-252
TTKSRKASFRKNHKKIPKSYRKVHVFLTSPLPLTIFFLCYFSFSLCYSMPSVIKLFFGK

SEQ ID NO: 168164 - protein, 113 aa, Heterodera glycines
  Coding regions on vcDNA: vcDNA=SeqID_94587; Strand=+; Position=34-375
LVRTAETLNTKHSNAHCAIGVTSIGTPGSGPLCLIIHFRIIIIQNPFPFIIHVHSTSNEEGVIWIIRVRKRHHHLYPLKLLNLCFVFTIVHLCLFTLHFSMCSFLPSSVLIVI

SEQ ID NO: 168165 - protein, 79 aa, Heterodera glycines
  misc_feature (51)..(51): Xaa can be any naturally occurring amino acid
  misc_feature (56)..(56): Xaa can be any naturally occurring amino acid
  misc_feature (59)..(59): Xaa can be any naturally occurring amino acid
  misc_feature (62)..(62): Xaa can be any naturally occurring amino acid
  misc_feature (65)..(65): Xaa can be any naturally occurring amino acid
  misc_feature (75)..(76): Xaa can be any naturally occurring amino acid
  Coding regions on vcDNA: vcDNA=SeqID_94588; Strand=-; Position=186-425
NALSHKYVSNNTKMVEGILRHHWPYQPLDSFPCVCCICWAFIFLRVGVWGXTTFSXCLXCFXLAXDLGLVSFIIXXEWQ

SEQ ID NO: 168166 - protein, 83 aa, Heterodera glycines
  misc_feature (44)..(44): Xaa can be any naturally occurring amino acid
  misc_feature (51)..(51): Xaa can be any naturally occurring amino acid
  misc_feature (55)..(55): Xaa can be any naturally occurring amino acid
  misc_feature (68)..(68): Xaa can be any naturally occurring amino acid
  misc_feature (78)..(78): Xaa can be any naturally occurring amino acid
  misc_feature (82)..(82): Xaa can be any naturally occurring amino acid
  Coding regions on vcDNA: vcDNA=SeqID_94589; Strand=+; Position=19-270
LQKPTVIYNKMGNLKPKGIIYTAAQKGKKGQKMSEANGKSPKGXKGTRRSXVSSXFILQGGRETEDKXVANSKKSGYXLAEXK

SEQ ID NO: 168167 - protein, 176 aa, Heterodera glycines
  Coding regions on vcDNA: vcDNA=SeqID_94590; Strand=-; Position=51-581
PKANPRKMNSIEFLYISIFNATLSQSVANLFFIIHPSAKRSMGIPLAVLLVPFWLFLLLFAFSICQGCASPVPVHPFCFPFPLHSDLMEFLCSSTGVDRGGAFPRHFDGKNARKNRRKRFACGDRQNLPAFRRLVVLLVLAHQRERIAAHLQPQSHRPGIGRRKVPKGRGTERSAS

SEQ ID NO: 168168 - protein, 134 aa, Heterodera glycines
  Coding regions on vcDNA: vcDNA=SeqID_94591; Strand=-; Position=3-404
HNVVTTWLILSLNNVKMSNNKKLFFGMPNVSSNGCDNESFHRRARHAPLRRAKAPRPSGHRRTWHVSKGQCGATRSASSRATFVLDSSSSCGPVHECLAFSSWRMCIITFPPSFFPSQKIGLLASSRFLRHPVP

SEQ ID NO: 168169 - protein, 93 aa, Heterodera glycines
  misc_feature (47)..(47): Xaa can be any naturally occurring amino acid
  misc_feature (50)..(50): Xaa can be any naturally occurring amino acid
  misc_feature (62)..(62): Xaa can be any naturally occurring amino acid
  misc_feature (69)..(69): Xaa can be any naturally occurring amino acid
  misc_feature (78)..(79): Xaa can be any naturally occurring amino acid
  Coding regions on vcDNA: vcDNA=SeqID_94592; Strand=+; Position=3-284
IPSIFLCPKPSSIKNNAFPPLASSPFRFASSSSSASVRVSLLRGGLXLRXRMKAPNSIGLAXSMGAAWXPASEGRMGXXAEDETVKGANQLIK

SEQ ID NO: 168170 - protein, 173 aa, Heterodera glycines
  Coding regions on vcDNA: vcDNA=SeqID_94593; Strand=+; Position=115-633
HTLLCPSILHSNSRKTAMAYATKYYDYQIAVVFAILLGGLLLLALVVTAIYYICVVNMRGKKGGITRVPSGRSTVRTRMNPQQYSPSAQPQIFHQQYPQYSPYGGMEGMSSQQTQQQQQQQHPFQAQNYEQAGVRVREMQPEYFQQQGPISYTNYPYDQQPPKLSADTQAAAT

SEQ ID NO: 168171 - protein, 58 aa, Heterodera glycines
  Coding regions on vcDNA: vcDNA=SeqID_94594; Strand=-; Position=1-174
FFFFYAKLYQSLSLIIIINSLSFLPFVLFLHSFIFSCFSSHFALCLFPNISSSSQFSP

SEQ ID NO: 168172 - protein, 58 aa, Heterodera glycines
  Coding regions on vcDNA: vcDNA=SeqID_94595; Strand=-; Position=1-174
NAARLFLWHSVRERIPNGGAKHLLKARCRVYFTHSFRCAPSKCRDEFDHISRRMDYAD

SEQ ID NO: 168173 - protein, 146 aa, Heterodera glycines
  Coding regions on vcDNA: vcDNA=SeqID_94596; Strand=+; Position=69-506
MRYPIFQIFLIMSFICRFKSAVIFRSDTMNQTDYGPMVLAHNGTSPSDQDKIRDEETDHWLTLTQTDQTTTDQNSTLSIDWMSNTIMKADHDATLSLGEDHGQTLEAKNDDEPNLENGHYGTTPTDYEPNEEKNAVDNADHNDMAV

SEQ ID NO: 168174 - protein, 181 aa, Heterodera glycines
  misc_feature (49)..(49): Xaa can be any naturally occurring amino acid
  misc_feature (54)..(54): Xaa can be any naturally occurring amino acid
  misc_feature (64)..(64): Xaa can be any naturally occurring amino acid
  misc_feature (115)..(115): Xaa can be any naturally occurring amino acid
  Homolog annotation: Hit_ID=NP_508412.1; Match level="QueryCoverage =100%, HitCoverage=52%, E-value=1e-52, Identity=47%"; Hit description= vacuolar atp synthase (54.2 kD) (XC857) [Caenorhabditis elegans] gb|AAA91266.1| Vacuolar h atpase protei
  Coding regions on vcDNA: vcDNA=SeqID_94597; Strand=+; Position=2-542
LRKEKYRRKFVEYDGVKSILLALNGRANFQLQYQLIFCLWSVGFFRTFXLKNNXWKKFVNLISXISFRNLLEKIDNREMVRESALQMVQCKTLKTLELMDAKKFDDPDLVDDIEXIKILIKILETSSDPLPLSVAAHDIGEYVRHYHRGKTIVEQYQGKQAVMKLLSAEDPNGRYHALLAI

SEQ ID NO: 168175 - protein, 79 aa, Heterodera glycines
  misc_feature (58)..(58): Xaa can be any naturally occurring amino acid
  Coding regions on vcDNA: vcDNA=SeqID_94598; Strand=+; Position=363-602
TLKVGISISFPFLYFLSPNVGFDRQRESNFAKSYTNRTFNSFGFSSVQQQIGEHRRNXQAQSFECSRCVGNLRQFAPRN

SEQ ID NO: 168176 - protein, 178 aa, Heterodera glycines
  Homolog annotation: Hit_ID=AAT02161.1; Match level="QueryCoverage =50%, HitCoverage=41%, E-value=3e-19, Identity=55%"; Hit description =hypothetical protein L3ni22 [Dictyocaulus viviparus]
  Coding regions on vcDNA: vcDNA=SeqID_94599; Strand=+; Position=3-539
LIGCRCDTNEEIIHCDDHVLRKTVPLPPHGTHLRGFTVLSLTNNNIDELPDEQLLMTKFPDLKSVDVEDNKNFDCDTLKLFTKLNVLSDCGKKNGKKDDDRVHVHGPNSDEPKHRGKNEWKKCDDLKRRRNDDQYVGCLWDQLHERLNEISEDYGLKTLIDDIGKMFNDVGERIKKIT

SEQ ID NO: 168177 - protein, 71 aa, Heterodera glycines
  misc_feature (45)..(45): Xaa can be any naturally occurring amino acid
  Coding regions on vcDNA: vcDNA=SeqID_94600; Strand=+; Position=2-217
IIASCDYDEADSEWSDRRRVAASEWLGPAIGDYKEEDMAIEEPTXVGDHYECWAGRPAINFSLSPHMHFLL

SEQ ID NO: 168178 - protein, 212 aa, Heterodera glycines
  misc_feature (206)..(206): Xaa can be any naturally occurring amino acid
  Homolog annotation: Hit_ID=CAE75501.1; Match level="QueryCoverage =95%, HitCoverage=26%, E-value=8e-35, Identity=35%"; Hit description =Hypothetical protein CBG23510 [Caenorhabditis briggsae]
  Coding regions on vcDNA: vcDNA=SeqID_94601; Strand=+; Position=89-724
MDIADEQKAEWETVGETAAMVSGPVPPPPLPSEEPTPAQVESPTPVKKTNVTTLQQKQVVPLSKLNGVFQEEEEDEVDTLHQIKKKIKPFEITREDRLQSMTPEERKKLIKDLITRIPTDKAKLFSFEVCWEFVDENLMERRVRPWVNKIICEYIGEEGQSLVAFICEKIANLSTADEILQDLSMGLDPRSRSFMVKLWEIIVYEXEAYRLG

SEQ ID NO: 168179 - protein, 132 aa, Heterodera glycines
  misc_feature (91)..(92): Xaa can be any naturally occurring amino acid
  Homolog annotation: Hit_ID=AAL78212.1; Match level="QueryCoverage =87%, HitCoverage=99%, E-value=2e-35, Identity=59%"; Hit description =putative esophageal gland cell secretory protein Hgg-25 [Heterodera glycines]
  Coding regions on vcDNA: vcDNA=SeqID_94602; Strand=+; Position=63-461
MRTFLFIAVVGLMLAVILENVNATGKNSPTKGKQSLDSPNHEKDHKNEHEKYEAAYFQTGSSGSPKKGKSPHADPKKAASHLVPVTPGKVXXASLKMVKKLCGAMMPTMNKPKAVEVDVEKKLWYHHAIIVV

SEQ ID NO: 168180 - protein, 41 aa, Heterodera glycines
  Coding regions on vcDNA: vcDNA=SeqID_94603; Strand=-; Position=1-123
LINSINDPPPFPSNIALLPNIRTVPNHRPLSVQSVCNGSEF

SEQ ID NO: 168181 - protein, 22 aa, Heterodera glycines
  Coding regions on vcDNA: vcDNA=SeqID_94604; Strand=-; Position=0-65
RELVSSSNSRRFSNSVSSYWRR

SEQ ID NO: 168182 - protein, 58 aa, Heterodera glycines
  Coding regions on vcDNA: vcDNA=SeqID_94605; Strand=-; Position=2-175
FVMNSTLVCSVRFVGQHAVAHWDDPAIPTCQNCVHLLERHRCDAEGAVGETLFHFIRP

SEQ ID NO: 168183 - protein, 88 aa, Heterodera glycines
  Homolog annotation: Hit_ID=CAE64797.1; Match level="QueryCoverage =98%, HitCoverage=17%, E-value=8e-24, Identity=59%"; Hit description =Hypothetical protein CBG09590 [Caenorhabditis briggsae]
  Gene Ontology: Mol. function=RNA binding; Cellular component =nucleolus; Biological process=rRNA processing
  Coding regions on vcDNA: vcDNA=SeqID_94606; Strand=+; Position=1-264
TSEAPNYALYEHAVGYTLFKINEYEDIGQIQPEVQSAMTDAQRFQTIVQVHAFDPFRNTEAALENANSIAEGIIHVDLLNFLEANLPK

SEQ ID NO: 168184 - protein, 44 aa, Heterodera glycines
  Coding regions on vcDNA: vcDNA=SeqID_94607; Strand=+; Position=3-137
QIVNLRPKQAVEVQLIVEESEERLTEEQVDELVETIINSLPRNY

SEQ ID NO: 168185 - protein, 47 aa, Heterodera glycines
  Coding regions on vcDNA: vcDNA=SeqID_94608; Strand=-; Position=51-194
RFIDLRVEDIVFDMIHKTKRDHHHDIPFKVTSTQKRHYIFASLRRSM

SEQ ID NO: 168186 - protein, 19 aa, Heterodera glycines
  Coding regions on vcDNA: vcDNA=SeqID_94609; Strand=-; Position=2-58
FLNLGIVNMGTILTNDTAN

SEQ ID NO: 168187 - protein, 20 aa, Heterodera glycines
  Coding regions on vcDNA: vcDNA=SeqID_94610; Strand=-; Position=1-60
FEYSHFTVYRFLFSFFSFLQ

SEQ ID NO: 168188 - protein, 67 aa, Heterodera glycines
  Coding regions on vcDNA: vcDNA=SeqID_94611; Strand=-; Position=3-203
FFVSNLSLNTLTTSASKRNISSRVKVKVSSAFSAVVPWLCDLSAFPFSFGGAAAPTKKIKNKTNCER

SEQ ID NO: 168189 - protein, 41 aa, Heterodera glycines
  Coding regions on vcDNA: vcDNA=SeqID_94612; Strand=-; Position=63-188
MLFDCQIFRIYEIRKCQDNFSINGIKWVVMDGSWNLCSHSW

SEQ ID NO: 168190 - protein, 34 aa, Heterodera glycines
  Coding regions on vcDNA: vcDNA=SeqID_94613; Strand=-; Position=1-102
FCSVCPHILSSFQEVHSDCREEFDRIKTVVSGQT

SEQ ID NO: 168191 - protein, 23 aa, Heterodera glycines
  Coding regions on vcDNA: vcDNA=SeqID_94614; Strand=-; Position=1-69
CIKKKVWGGEKEGRRKEEENVVV

SEQ ID NO: 168192 - protein, 32 aa, Heterodera glycines; identical to SEQ ID NO: 142079
  Coding regions on vcDNA: vcDNA=SeqID_94615; Strand=-; Position=68-166

SEQ ID NO: 168193 - protein, 84 aa, Heterodera glycines
  Coding regions on vcDNA: vcDNA=SeqID_94616; Strand=-; Position=5-259
FVLTRFIHQKKHEMNEVFEKRKAPAHKTISISETKAPNVSGKLSYLCSSDHASLPLSLSSDDDAPTRPSPSPSMLPLGAVDVLC

SEQ ID NO: 168194 - protein, 70 aa, Heterodera glycines
  Coding regions on vcDNA: vcDNA=SeqID_94617; Strand=-; Position=0-209
FFFFFLHLFRILSQKIMEKFVSIPMLSSVLNPAISANFRVRLAFLTHSLCFVRQFVHFYGRSFDQKMNSS

SEQ ID NO: 168195 - protein, 18 aa, Heterodera glycines
  Coding regions on vcDNA: vcDNA=SeqID_94618; Strand=+; Position=1-54
YYLPNSASEMFLYPMEIQ

SEQ ID NO: 168196 - protein, 40 aa, Heterodera glycines
  Coding regions on vcDNA: vcDNA=SeqID_94619; Strand=-; Position=2-121
FKVFHFYSIDAIEWRVKKMSFDGSCSHQRSYPLPPGGGGG

SEQ ID NO: 168197 - protein, 32 aa, Heterodera glycines
  Coding regions on vcDNA: vcDNA=SeqID_94620; Strand=-; Position=1-96
RELVSSFFFFFLNRSQNIQRMAQHPTNIGTPY

SEQ ID NO: 168198 - protein, 39 aa, Heterodera glycines
  Coding regions on vcDNA: vcDNA=SeqID_94621; Strand=-; Position=2-118
FPISFSHVALLMSYLSLQHSSTPQMSGAEAGIAVRHRGE

SEQ ID NO: 168199 - protein, 53 aa, Heterodera glycines
  Coding regions on vcDNA: vcDNA=SeqID_94622; Strand=-; Position=2-160
ERTSLEFFFFFFIFHMPNSAMVSSKNIRTLAKDPSVCPSVRSAFCLSPIPCDN

SEQ ID NO: 168200 - protein, 54 aa, Heterodera glycines
  Coding regions on vcDNA: vcDNA=SeqID_94623; Strand=+; Position=1-165
SKKTQESPLQRRWRKSSWKNVLNTLITPDHTKKAYVRLAADYDALDVANKIDII

SEQ ID NO: 168201 - protein, 70 aa, Heterodera glycines
  Coding regions on vcDNA: vcDNA=SeqID_94624; Strand=+; Position=2-214
NLSPEVLCLGRGRRSLCSFFGHRSSFEEQLIKLQSQIVLIMTIFVSHINDEIRMLLKRSLFKKKKKKTRD

SEQ ID NO: 168202 - protein, 19 aa, Heterodera glycines
  Coding regions on vcDNA: vcDNA=SeqID_94625; Strand=-; Position=8-67
RELVSSFFFFFSTGDSIKN

SEQ ID NO: 168203 - protein, 60 aa, Heterodera glycines
  Coding regions on vcDNA: vcDNA=SeqID_94626; Strand=+; Position=3-182
KAGTLLSLRRHFSQNHPLRYLLRLILLFDKFSKPFVVFPWFLNDELCFPKKKKKLETSSL

SEQ ID NO: 168204 - protein, 49 aa, Heterodera glycines
  Coding regions on vcDNA: vcDNA=SeqID_94627; Strand=-; Position=2-148
LIRQKRLPGVFGVADHEYDIHFDQFRPRIRIRTKSQNSTWVNETNLIPQ

SEQ ID NO: 168205 - protein, 32 aa, Heterodera glycines
  Coding regions on vcDNA: vcDNA=SeqID_94628; Strand=-; Position=4-102
FGIRRPRGCNPEFACCCIHVPFFEFGVKLVLL

SEQ ID NO: 168206 - protein, 30 aa, Heterodera glycines
  Coding regions on vcDNA: vcDNA=SeqID_94629; Strand=+; Position=35-124
EMTDHFELCNFVLLIHKNCFFIVEKGKSTK

SEQ ID NO: 168207 - protein, 36 aa, Heterodera glycines
  Coding regions on vcDNA: vcDNA=SeqID_94630; Strand=-; Position=2-109
FTQKSLFCQGKGECSTFFMEGKEQFAGVGAAESPFK

SEQ ID NO: 168208 - protein, 50 aa, Heterodera glycines
  Coding regions on vcDNA: vcDNA=SeqID_94631; Strand=-; Position=2-151
FYLNKLFLFIYIKNVPHFSICFFVHFRPFVVVTFCVFAADLDIPKIGRPL

SEQ ID NO: 168209 - protein, 22 aa, Heterodera glycines
  Coding regions on vcDNA: vcDNA=SeqID_94632; Strand=-; Position=2-67
ERTSLEFFFFFFSTAIPLRIKF

SEQ ID NO: 168210 - protein, 23 aa, Heterodera glycines
  Coding regions on vcDNA: vcDNA=SeqID_94633; Strand=-; Position=2-70
ELVSSFFFFFFNPVKYSQNAFIR

SEQ ID NO: 168211 - protein, 55 aa, Heterodera glycines
  Coding regions on vcDNA: vcDNA=SeqID_94634; Strand=-; Position=3-167
SRVKNANAHFRIIPFSQCQPSVVPGFRRFPQMILVGFAETVVDSPSLQECFDNCL

SEQ ID NO: 168212 - protein, 37 aa, Heterodera glycines
  Coding regions on vcDNA: vcDNA=SeqID_94635; Strand=-; Position=0-110
LNGWMGGRSRRLNFGLIHFEQIVFVESVDRRRSGEWV

SEQ ID NO: 168213 - protein, 60 aa, Heterodera glycines
  Coding regions on vcDNA: vcDNA=SeqID_94636; Strand=-; Position=2-181
FWNLCTSKSAADGQGAQHNKHQQMTTNSLVTKLFAAQLANVWRHPKANGTNAKAPSTRRS

SEQ ID NO: 168214 - protein, 52 aa, Heterodera glycines
  Coding regions on vcDNA: vcDNA=SeqID_94637; Strand=+; Position=2-157
WKMGSNGNPEEDLINLTDKLKKKLAKHGEDEEEEAKLKRRKSKKGIFDRTIQ

SEQ ID NO: 168215 - protein, 48 aa, Heterodera glycines
  Coding regions on vcDNA: vcDNA=SeqID_94638; Strand=+; Position=28-174
SFVTVPTRANNLLGYRCLNSNEAKRFFNISQPLQLILCSLILKKMKKD

SEQ ID NO: 168216 - protein, 47 aa, Heterodera glycines
  Coding regions on vcDNA: vcDNA=SeqID_94639; Strand=+; Position=3-143
MKIIFVKIFTAGTLLAMLTVAVIVTKFYFIEEREERRDGGGRHRNRQ

SEQ ID NO: 168217 - protein, 43 aa, Heterodera glycines
  Homolog annotation: Hit_ID=AAH77277.1; Match level="QueryCoverage =100%, HitCoverage=56%, E-value=3e-09, Identity=69%"; Hit description= MGC80050 protein [Xenopus laevis]
  Coding regions on vcDNA: vcDNA=SeqID_94640; Strand=+; Position=6-134
MARGHQKALSQQKNQQKQQQQKKGQGNDQRAAAAKALTFKCSV

SEQ ID NO: 168218 - protein, 64 aa, Heterodera glycines
  Homolog annotation: Hit_ID=NP_495750.1; Match level="QueryCoverage =68%, HitCoverage=8%, E-value=4e-09, Identity=68%"; Hit description =chaperonin Containing TCP-1 (58.4 kD) (cct-4) [Caenorhabditis elegans] emb|CAA88861.1| Hypothetical protei
  Coding regions on vcDNA: vcDNA=SeqID_94641; Strand=-; Position=1-192
MNCLLPKLWFSHYYDMFESFQGAITDIREENVVQPLLVSSFAVKQAAECVRSILKIDDIVSLTR

SEQ ID NO: 168219 - protein, 16 aa, Heterodera glycines
  Coding regions on vcDNA: vcDNA=SeqID_94642; Strand=+; Position=1-48
NAVISKKRKKLETSSL

SEQ ID NO: 168220 - protein, 17 aa, Heterodera glycines
  Coding regions on vcDNA: vcDNA=SeqID_94643; Strand=-; Position=0-50
FNSFLSFSQFVVISHRR

SEQ ID NO: 168221 - protein, 95 aa, Heterodera glycines
  Coding regions on vcDNA: vcDNA=SeqID_94644; Strand=-; Position=1-285
FCCSTRPRVASSPCFAPVPFVIRDSYPSSFVNFMYAIASSISSVCTEEFFVVFVLKIFSSCVCLISSSVFAKVPSKMKNSAKMTMGRTRRAILRH

SEQ ID NO: 168222 - protein, 54 aa, Heterodera glycines
  Coding regions on vcDNA: vcDNA=SeqID_94645; Strand=+; Position=39-203
LDSAEPYLQRFGGLDGESVLTWDRRKYLIVYRDIICCFIIVKISVQKKKKKTRD

SEQ ID NO: 168223 - protein, 68 aa, Heterodera glycines
  Coding regions on vcDNA: vcDNA=SeqID_94646; Strand=+; Position=2-208
GTACVVTPVGRILYIRQGNGRAGRMEDMQIPMPNSDEEPLNIMQRLYKAITDIYYGRQKREEWTRIVV

SEQ ID NO: 168224 - protein, 54 aa, Heterodera glycines
  Coding regions on vcDNA: vcDNA=SeqID_94647; Strand=+; Position=1-165
TATNCQKTTDGNASDQRKGNANRWWQNGDAFKAASPSDDRPHFVWRRNWAKTLL

SEQ ID NO: 168225 - protein, 81 aa, Heterodera glycines
  Homolog annotation: Hit_ID=NP_504664.1; Match level="QueryCoverage =97%, HitCoverage=21%, E-value=3e-11, Identity=41%"; Hit description =predicted CDS, reverse transcriptase family member (5H34) [Caenorhabditis elegans] pir||A89075 protein K0
  Coding regions on vcDNA: vcDNA=SeqID_94648; Strand=+; Position=3-245
KITDFIEANNVLPNCQHGFRRKHSVTTQLLEVIDDFSLALENKKSIDVIYFDLAKAFDTVPHERLVSKLKNVGINGTLLKK

SEQ ID NO: 168226 - protein, 15 aa, Heterodera glycines
  Coding regions on vcDNA: vcDNA=SeqID_94649; Strand=-; Position=80-127
ERTSLEFFFFFFFGK

SEQ ID NO: 168227 - protein, 32 aa, Heterodera glycines
  Coding regions on vcDNA: vcDNA=SeqID_94650; Strand=-; Position=2-97
MLRMEGQNEQINGKCTIKIVWSQLRQTHKGSR

SEQ ID NO: 168228 - protein, 64 aa, Heterodera glycines
  Homolog annotation: Hit_ID=NP_492097.1; Match level="QueryCoverage =87%, HitCoverage=4%, E-value=3e-11, Identity=64%"; Hit description =related kinase (1I38) [Caenorhabditis elegans] emb|CAA98148.1| Hypothetical protein ZK524.4 [Caenorhabditi
  Coding regions on vcDNA: vcDNA=SeqID_94651; Strand=+; Position=26-217
MSTSNKLRRKNSSSATPSSASLLHINDARIAGLYDLEHTIGKGHFAVVKLARHVFTGEKAMIPQ

SEQ ID NO: 168229 - protein, 34 aa, Heterodera glycines; identical to SEQ ID NO: 127577
  Coding regions on vcDNA: vcDNA=SeqID_94652; Strand=+; Position=2-106

SEQ ID NO: 168230 - protein, 84 aa, Heterodera glycines
  Coding regions on vcDNA: vcDNA=SeqID_94653; Strand=-; Position=157-411
LVTKIYLLVNNEFNKLSKCSPINQHDHSSPSRLCPFSSSSFASSSSPSDELDDESPPPFFLLAPFFRAFCLSRFFEKLPFLLIQ

SEQ ID NO: 168231 - protein, 89 aa, Heterodera glycines
  Coding regions on vcDNA: vcDNA=SeqID_94654; Strand=+; Position=1-270
TAIFVLFICFLFIVLPTIAQMNQPQGIALVRRDSDYDELLTEFRSKGSRMRFGKRSLGPSTDAIGLPSSDSFSNSADPNNLMSGHFNWN

SEQ ID NO: 168232 - protein, 115 aa, Heterodera glycines
  Coding regions on vcDNA: vcDNA=SeqID_94655; Strand=+; Position=20-367
MPEEQRTDFNMDRWLDAYDEDIGRCAEVIVDYLKNRSAVGFDDLESGGDFFARPSARHYCGVFTQSKLRKDWVNAYDNAIVFVETGVADPNMAARVTRTGDFLREFFVHCEFGWR

SEQ ID NO: 168233 - protein, 127 aa, Heterodera glycines
  Homolog annotation: Hit_ID=NP_500377.1; Match level="QueryCoverage =86%, HitCoverage=68%, E-value=3e-21, Identity=47%"; Hit description =putative protein, with a coiled coil domain, of bilaterial origin (17.4 kD) (4E346) [Caenorhabditis elega
  Coding regions on vcDNA: vcDNA=SeqID_94656; Strand=+; Position=16-399
MDPSTAALPPMRFSSTSLVPDPSVQFLLDLETNARSIACGIDMALRDLRGSLRGMSDLTCESANVFGSVVNSTCDSVDASIRSMYTMLAKTEELDESLRSIEKLLQQIKDTKRLLDKFEEHIVVGNQ

SEQ ID NO: 168234 - protein, 124 aa, Heterodera glycines
  Coding regions on vcDNA: vcDNA=SeqID_94657; Strand=-; Position=1-372
CFSLKIKINTQKFGIHFKWLICVFVVLVCFCVFSLIFCFSACLVPCRVHNSLRFVLLRPLILRSPLHNYSDVKCIREGIARHLTDRIAFLRIFIFVGVRFPIAVFLTEKENQIASRWVHFECKK

SEQ ID NO: 168235 - protein, 72 aa, Heterodera glycines
  Coding regions on vcDNA: vcDNA=SeqID_94658; Strand=+; Position=1-219
INDFNWQSTFHLKCFKVLLVQFRHDDTDLTSPFEAIAPVTATPSLTLFPSANDKNEMAAARPPLDPPLFDGF

SEQ ID NO: 168236 - protein, 168 aa, Heterodera glycines
  Coding regions on vcDNA: vcDNA=SeqID_94659; Strand=+; Position=2-508
LVTIKMCSCNSCTNKWMCCCGCHVTSGSLVIAWLYLVSSLLTLPSAFSALVSQYHLVAHNFMHLTLTLLFCFCAIPIIVGEMCTQRTHHMYLPYLIINPVALIVALFVAIFAPSTNIMSRVPNHQQHDVAAVFVATLMLFALILSLNIWMYSVVYRAYQFVKRYGQEE

SEQ ID NO: 168237 - protein, 107 aa, Heterodera glycines
  misc_feature (76)..(76): Xaa can be any naturally occurring amino acid
  misc_feature (81)..(81): Xaa can be any naturally occurring amino acid
  misc_feature (87)..(88): Xaa can be any naturally occurring amino acid
  misc_feature (97)..(98): Xaa can be any naturally occurring amino acid
  Coding regions on vcDNA: vcDNA=SeqID_94660; Strand=-; Position=143-466
LRQQFLSANKCNINGITSQQILHSENVKISSWSVEVFRFLCLLLLLLFSSYSGATVKRNFICGFVHVVHTPSPKQXIRWFXPFTVAXXICESYCYFXXSFHDRNVLL

SEQ ID NO: 168238 - protein, 150 aa, Heterodera glycines
  Coding regions on vcDNA: vcDNA=SeqID_94661; Strand=+; Position=53-505
MATPVGDLETEWETYETEFKKAETEHLSYTQRHNENGKELKRKLSELVRNIGRLLAGGGVSDDDKGRLEALKTKAEKAGLKLSEMFRDEAIEKLKTSYKEAKKNPFWNNTISTASLLVDDSVFRFLSDAVNLCEGEPVRFSSTRPVTGSL

SEQ ID NO: 168239 - protein, 162 aa, Heterodera glycines
  Coding regions on vcDNA: vcDNA=SeqID_94662; Strand=+; Position=7-495
MAFTVRRPLRECQANRAGLNLRLHLPRSRSNIDIPAFGCAGANYMPFTGFSAVKSDIYRVNPLYSLRNYMSDKYYHFSHRYKRTQFHRHYYHGQIDQYPYEWNFEGRGTATGQFYFARRMKFNPWQFGWNRFYDPYRRYYDPYHDAYIKLYDYRPRLIDGIY

SEQ ID NO: 168240 - protein, 90 aa, Heterodera glycines
  misc_feature (48)..(48): Xaa can be any naturally occurring amino acid
  Coding regions on vcDNA: vcDNA=SeqID_94663; Strand=+; Position=141-413
TIFAWTWSCSSTAEGDALDQLGLRHYCCLWMLLSHVDLIEKLPSKHNXETEIEVFLDLPGTTVATQNAFTLLREISEFYQLMACSSNQSY

SEQ ID NO: 168241 - protein, 83 aa, Heterodera glycines
  Homolog annotation: Hit_ID=AAG00551.1; Match level="QueryCoverage =98%, HitCoverage=52%, E-value=3e-11, Identity=47%"; Hit description =retinitis pigmentosa GTPase regulator [Homo sapiens]
  Coding regions on vcDNA: vcDNA=SeqID_94664; Strand=+; Position=417-665
GRRRGGEEESRREKGAEGGKREGREGEERRGQGKEGGGEEGGWEREEGEQREGRRGGEEGEGERGVEKRDGGEREERGEEEGR

SEQ ID NO: 168242 - protein, 74 aa, Heterodera glycines
  Coding regions on vcDNA: vcDNA=SeqID_94665; Strand=+; Position=3-227
IQMAFKLAFFFIAPVLCLSILMIGQMPCQTDAVAVHPAVRTAVRLANTKGGQIALGIVAPSALPAARMAKHFVR

SEQ ID NO: 168243 - protein, 91 aa, Heterodera glycines
  Coding regions on vcDNA: vcDNA=SeqID_94666; Strand=+; Position=29-304
MCRPLLLFVCFTVAFGILSIVAPNQALAEPVIGGPPPAPPIEGVAALAGAVDPADQPVASGVAPPKQPVVVEASQVEQAEVDQLPKSYGRK

SEQ ID NO: 168244 - protein, 125 aa, Heterodera glycines
  Coding regions on vcDNA: vcDNA=SeqID_94667; Strand=+; Position=3-377
ISFILFVKAFGGGSPKKNKKINDGLAQRMSKLLSTGAYADVQFVVEEGDKKELLLAHKAILSHASEEFALILGFDTQNSSHSNGKISAETIKTVLVTDVTIGAFKVMLSFIYTEGLKGDKLSVCK

SEQ ID NO: 168245 - protein, 41 aa, Heterodera glycines
  Coding regions on vcDNA: vcDNA=SeqID_94668; Strand=+; Position=13-138
NGCIGRIPKFYIEKLHEKLALNSRLPDPVITGRRSDHLRND

SEQ ID NO: 168246 - protein, 85 aa, Heterodera glycines
  Coding regions on vcDNA: vcDNA=SeqID_94669; Strand=+; Position=4-258
MSSSEDESNHYSKKEIREKERRQQKNKKKNESKKANKKNREETIITLGEEKVELPEAVNEIDSGFEAEGGTNETEEEKDVSEVVK

SEQ ID NO: 168247 - protein, 147 aa, Heterodera glycines
  Homolog annotation: Hit_ID=NP_499256.1; Match level="QueryCoverage =99%, HitCoverage=10%, E-value=1e-18, Identity=37%"; Hit description =PDZ domain-containing guanine nucleotide eXchange Factor (pxf-2) [Caenorhabditis elegans] emb|CAA83013.2|
  Coding regions on vcDNA: vcDNA=SeqID_94670; Strand=+; Position=20-460
MDRPLFRARALPQLSALSEYQLRTLLAHSDSQPEGISPNVILFQRGESLSCWYLLLSGQIQLYLDHCSAADYNQPSSSISQLKLIVPGTFFGELRNYADATHCCSAKVIQRADFVRIDLRHFMALYNKWAEQLQNCIMPMEDLVAET

SEQ ID NO: 168248 - protein, 66 aa, Heterodera glycines
  misc_feature (63)..(63): Xaa can be any naturally occurring amino acid
  Coding regions on vcDNA: vcDNA=SeqID_94671; Strand=+; Position=93-293
MSTKPPADNESNNEGQQKSSNSLARDGNYEDGNMKNRDKQKEFGGPAGPEPTRYGDWERKGRXSDF

SEQ ID NO: 168249 - protein, 104 aa, Heterodera glycines; identical to SEQ ID NO: 146850
  Coding regions on vcDNA: vcDNA=SeqID_94672; Strand=+; Position=27-341

SEQ ID NO: 168250 - protein, 146 aa, Heterodera glycines
  misc_feature (80)..(80): Xaa can be any naturally occurring amino acid
  Homolog annotation: Hit_ID=AAD48446.1; Match level="QueryCoverage =93%, HitCoverage=86%, E-value=7e-33, Identity=47%"; Hit description =nucleoside diphosphate kinase [Trypanosoma brucei]
  Gene Ontology: Mol. function=ATP binding; Cellular component=nucleus; Biological process=DNA metabolism
  Coding regions on vcDNA: vcDNA=SeqID_94673; Strand=+; Position=1-441
FVCIKPESVRRCLVGKIIERFEANGFRLIAIKMIVATRKQAMDHYVACAGQPFFPKVISYMTSGPVVAMIWEGVGVVRGXRKILGATPDKVPPPGTLRADYRNNSDVGKYHDTVCHGSDSAEDAQREFGIWFDKSEMPAPLSRVSG

SEQ ID NO: 168251 - protein, 62 aa, Heterodera glycines
  Coding regions on vcDNA: vcDNA=SeqID_94674; Strand=+; Position=89-274
MARHKNILRIHLIILSFANANASFLSLKVHFLLICPFFSFFCHYYFFETKNFNKILNRKKKK

SEQ ID NO: 168252 - protein, 112 aa, Heterodera glycines
  Coding regions on vcDNA: vcDNA=SeqID_94675; Strand=-; Position=76-414
MFEFVSEFRSWPNGCRICDQRPKLLNYIIFSQFLLILDLMSKLPPRVKLCKYKNGRRQDNFIYPNTKHFNKLFGIVVGRHSADARARPIIAQMRLHRVAHFHPVHSIYHFVK

SEQ ID NO: 168253 - protein, 25 aa, Heterodera glycines
  Coding regions on vcDNA: vcDNA=SeqID_94676; Strand=-; Position=1-75
FKPLGFILDKFRIFCFLCIYSIINI

SEQ ID NO: 168254 - protein, 169 aa, Heterodera glycines
  Homolog annotation: Hit_ID=AAM18866.1; Match level="QueryCoverage =94%, HitCoverage=56%, E-value=3e-09, Identity=31%"; Hit description =unknown [Branchiostoma floridae]
  Coding regions on vcDNA: vcDNA=SeqID_94677; Strand=+; Position=2-508
MIPNQLCTDWMRGEQLLTGYVERGDLVEIRRGSYMHWAVFIGHISGQPLVIHISTESSDMGISTKKEFVRKMAKGCAAIVMLLTSICSTLQRLVLSLRFSFLNLFKVRSDPFLNVISTDFCRVNNCLDANRRPFPPSIIVERALTKLGTGGYNLIKNNCEHLAKWCRYA

SEQ ID NO: 168255 - protein, 116 aa, Heterodera glycines
  Homolog annotation: Hit_ID=NP_501505.1; Match level="QueryCoverage =90%, HitCoverage=83%, E-value=2e-31, Identity=54%"; Hit description =ganglioside-induced differentiation associated protein 3 like (4J504) [Caenorhabditis elegans] emb|CAA910
  Coding regions on vcDNA: vcDNA=SeqID_94678; Strand=+; Position=1-351
ARPTNRVLNERTEYGKRMKRLSQRIFGEITRPTDIKSLRVAEIMASEPWEQQAKLSEKYYPNTPMLHYLVKMLKLHGLYFDEHLVWREVQNEIRISKGKIIYPPIGAGKQKMKAKI

SEQ ID NO: 168256 - protein, 157 aa, Heterodera glycines
  Homolog annotation: Hit_ID=NP_773992.1; Match level="QueryCoverage =80%, HitCoverage=84%, E-value=8e-14, Identity=37%"; Hit description =hypothetical protein bll7352 [Bradyrhizobium japonicum USDA 110] dbj|BAC52617.1| bll7352 [Bradyrhizobium
  Coding regions on vcDNA: vcDNA=SeqID_94679; Strand=+; Position=1-471
GTLRKGFPGEMAQKLSTEAEWIGKALLQNAQLYRVHWENFHFDYPALVLIDEKATDKSDNFVVGDLVHLKNAEQSIKWLDAYEECGEQFNQPNEYIRKEVTVQLMTDQEASQNFLASTYVYGWPIKDSDGNFVAPVREIVVAGDWLKFVQKILKTKK

SEQ ID NO: 168257 - protein, 116 aa, Heterodera glycines
  Coding regions on vcDNA: vcDNA=SeqID_94680; Strand=-; Position=0-347
EQLFILFKLKSVCDKIKFNLHSTTNSPSQISQKFFADRSHQMFMICQLGRIGWLRAFGEMYKRKSMNWSMSMPKSLKVTDGCCFSLISALSIRSITGEKQRSRAADNTTLLSPIST

SEQ ID NO: 168258 - protein, 117 aa, Heterodera glycines
  Homolog annotation: Hit_ID=CAE71208.1; Match level="QueryCoverage =93%, HitCoverage=82%, E-value=4e-40, Identity=67%"; Hit description =Hypothetical protein CBG18071 [Caenorhabditis briggsae]
  Coding regions on vcDNA: vcDNA=SeqID_94681; Strand=+; Position=16-369
MSRVIVSYFRQYSLKDWRDYFLSTHFWGPVANWGLPLAAIVDFRKDPEMISGPMSCALTIYSSVFMRFAWQVQPRNMLLFACHLTNFVAQQIQIVRFSNYHFLHLYTDPFAKTVKKL

SEQ ID NO: 168259 - protein, 125 aa, Heterodera glycines
  Coding regions on vcDNA: vcDNA=SeqID_94682; Strand=-; Position=0-374
KNLKFFLKIHGFSGSGLAQNSRSNDKFRFKDSICLAINLFLSIKESLTYALLSAGLMLCADVTILAHISHRNFLHMDSDETLLLQWHVVPSTDPLLIGTIFAALILCSVVYLVDVWVVYRQRRWR

SEQ ID NO: 168260 - protein, 115 aa, Heterodera glycines
  Homolog annotation: Hit_ID=EAL31098.1; Match level="QueryCoverage =90%, HitCoverage=39%, E-value=3e-40, Identity=71%"; Hit description =GA10883-PA [Drosophila pseudoobscura]
  Gene Ontology: Mol. function=structural constituent of ribosome; Cellular component=eukaryotic 48S initiation complex; Biological process=protein biosynthesis
  Coding regions on vcDNA: vcDNA=SeqID_94683; Strand=+; Position=1-348
FVIHRIQSREGQYKLCKVKKQAVGDKQVPYIVTHDARTIRFPDPHIKADDTVVIDIGTGKVTDYVKFDAGNICMITGGHNIGRVGIVGHRERHPGSFDIVHIKDKVVKGSTNCAR

SEQ ID NO: 168261 - protein, 48 aa, Heterodera glycines
  Coding regions on vcDNA: vcDNA=SeqID_94684; Strand=+; Position=1-147
LFKMSSHNTSVIDENRRWSDLRCLTDRASTFANSGFVPGIKVKFCVIV

SEQ ID NO: 168262 - protein, 68 aa, Heterodera glycines
  Homolog annotation: Hit_ID=NP_506192.1; Match level="QueryCoverage =97%, HitCoverage=10%, E-value=1e-19, Identity=69%"; Hit description =ATP-binding cassette sub-family F member like (69.2 kD) (5N242) [Caenorhabditis elegans] emb|CAA99835.1|
  Gene Ontology: Mol. function=translation factor activity, nucleic acid binding; Biological process=protein biosynthesis
  Coding regions on vcDNA: vcDNA=SeqID_94685; Strand=+; Position=2-208
ESIQALAEGIEDFSGGVVMVTHDERLIRATDCRLWVVEDQKIYQIDGDFDDYRKEVLDQVEKSLTSIG

SEQ ID NO: 168263 - protein, 129 aa, Heterodera glycines
  Coding regions on vcDNA: vcDNA=SeqID_94686; Strand=+; Position=3-392
LFRFHVGRLRWWLLRRLWLRWVLRFTDHFGRRSADRRLSLSHLRCRRPLAALFKTTERKGRSAATTAVLPPILHSQRRTIRNQRIEHRISLKMALISRHNWHFNRTNEGAKKLKIQKKISKKCAFIERQ

SEQ ID NO: 168264 - protein, 158 aa, Heterodera glycines
  Coding regions on vcDNA: vcDNA=SeqID_94687; Strand=-; Position=1-474
KWRLKRILSLARTARVLLSLPSFASALSLLSPLSECEISIISLCECEPSAGAAVRKSKAFFIPLGQFRRSFGKGKSPSPSVGISLRKSERSGAFGKGKVSRRSLILHKFGRDQIQKDCARLLGGWLLPLHRNTKCDEDSKERQKQRQKTTHGRGEPKN

SEQ ID NO: 168265 - protein, 133 aa, Heterodera glycines
  Coding regions on vcDNA: vcDNA=SeqID_94688; Strand=-; Position=3-401
MSEVGTQRPKLRQKWLMLATEANTDHGVIFAAIENRMQKQCTINVSHRGRCGIQFRTEQRIQIAHLLKWVVVFVNHNQNLKFEEIISRRVRFGDHKILGRNVQRVDRKKRETVGVKAQQNWPFLERVKKLTFV

SEQ ID NO: 168266 - protein, 112 aa, Heterodera glycines
  Coding regions on vcDNA: vcDNA=SeqID_94689; Strand=+; Position=31-369
MLSILMYSMLLYAALVLLISPATVVANEDVVGLAMRGTQQFFRRNAKWINLPSGGGSLVSGRGNFRPGFHSLHRSRTQLAEPLFITFKRSPTNLASMMVRLQKNPRHNDGTN

SEQ ID NO: 168267 - protein, 46 aa, Heterodera glycines
  Coding regions on vcDNA: vcDNA=SeqID_94690; Strand=+; Position=32-463
MASSGFSVYEVGIIPYNATEADIGNLFSQCGVVTNVRMVYDRKTNR

SEQ ID NO: 168268 - protein, 164 aa, Heterodera glycines
  Homolog annotation: Hit_ID=AAH78268.1; Match level="QueryCoverage =96%, HitCoverage=95%, E-value=2e-19, Identity=36%"; Hit description =Zgc:101038 protein [Danio rerio]
  Coding regions on vcDNA: vcDNA=SeqID_94691; Strand=+; Position=3-497
ESVEQSLTELEQNAMVRRQRLLEFRTQFVKKAQQQNGEKESSDGEEAMEEPISLFFRSYKPSKKAEEAPDVPNLGGTHKEMDTLEKHIPDQLEASEDTKMRDELDLKTLAPRKVDWDLRRGVQEKLDKLERRTKKAINQLIRQRVNEGAEDQLAAAVDSVGDGR

SEQ ID NO: 168269 - protein, 174 aa, Heterodera glycines
  Coding regions on vcDNA: vcDNA=SeqID_94692; Strand=+; Position=1-522
FPMALLLIVDAYSAAFAHPIHNGRPTTAIDGTKLLLVPSSANFAKVMMANEGTATKHFAYSPRQNGGEALFFRTAKASPQSASSAGIFPYPQSSFDFQNDGELMKNHRFARDVAADGSNGVFVRSGGGATKFAFAKRSGGTFAARANRWDDESAAAQGGQLFAVEPIEWSPLSS

SEQ ID NO: 168270 - protein, 129 aa, Heterodera glycines
  Coding regions on vcDNA: vcDNA=SeqID_94693; Strand=+; Position=2-391
VSMPIINFDRLPAAMRPQRRRLRAIQLFQLVLLSLFGILLFAKVIYKTEMDSEKGGIVFFAIFMFIIIILCIREVYKGSHGQKWHFHGLCALTLLLFLLYGWYYGLLKHEPAISAIWAGIMCELFAYIV

SEQ ID NO: 168271 - protein, 87 aa, Heterodera glycines
  Coding regions on vcDNA: vcDNA=SeqID_94694; Strand=+; Position=2-262
RDFYSIGAKRGMQMGTISANHDSSVKFELISSDLSLFPIEFICCPIPILLNCLAQLPLSNMKKSSFGQSVNFGEKKKKKKKLETSSL

SEQ ID NO: 168272 - protein, 56 aa, Heterodera glycines
  Coding regions on vcDNA: vcDNA=SeqID_94695; Strand=-; Position=1-168
FVLLLLFLAVSSAFAVLIGICLHQLSVTAPFGTSVGVVRQWLRRNNSRGFFVMRHF

SEQ ID NO: 168273 - protein, 45 aa, Heterodera glycines
  Coding regions on vcDNA: vcDNA=SeqID_94696; Strand=-; Position=6-143
FFFFFFFSIRNLSALISEHMKGNNHSLLCITLLYVFIFLLSHKGT

SEQ ID NO: 168274 - protein, 25 aa, Heterodera glycines
  Coding regions on vcDNA: vcDNA=SeqID_94697; Strand=-; Position=9-86
FWHTVHLVNGQCQNDHENELVSMKH

SEQ ID NO: 168275 - protein, 204 aa, Heterodera glycines
  misc_feature (75)..(75): Xaa can be any naturally occurring amino acid
  misc_feature (142)..(142): Xaa can be any naturally occurring amino acid
  misc_feature (175)..(176): Xaa can be any naturally occurring amino acid
  Homolog annotation: Hit_ID=CAG90751.1; Match level="QueryCoverage =96%, HitCoverage=52%, E-value=1e-41, Identity=47%"; Hit description =unnamed protein product [Debaryomyces hansenii CBS767] ref|XP _462255.1| unnamed protein product [Debaryomy
  Gene Ontology: Mol. function=purine-specific oxidized base lesion DNA N-glycosylase activity; Cellular component=mitochondrion; Biological process=base-excision repair
  Coding regions on vcDNA: vcDNA=SeqID_94698; Strand=+; Position=50-666
MLQGIRILRQEPVETLFAFICSANNNVPRISKMVEKLCQFYGDSVEVNAQRFYDFPSVTQMAAHLNCMEQTLRDXGFGYRAKSIVKTVEMLADGKLGNSAYLWLHSLRNLPYHEAKLALMKLPGVGPKVADCICLMALDKHXVVPVDRHVFNLATEIYTPTFLKGCKTLSTGIYXXIGAFFVDPHGDYAGWAHSRLVSTRGKPF

SEQ ID NO: 168276 - protein, 129 aa, Heterodera glycines
  Homolog annotation: Hit_ID=CAE64371.1; Match level="QueryCoverage =86%, HitCoverage=68%, E-value=5e-22, Identity=39%"; Hit description =Hypothetical protein CBG09058 [Caenorhabditis briggsae]
  Coding regions on vcDNA: vcDNA=SeqID_94699; Strand=+; Position=3-392
PLGLGDPESKTLSKVDQEIVIPDLMGKQVHKSECLQEFTAFVQCLRAENSIVGPQKCKPYINVYEDCKLMKFQDDEFRKKVIDEYMDERSKFIEVGLNQKQRKFYEYLNWKSAHIANQNESTDSVDQFG

SEQ ID NO: 168277 - protein, 81 aa, Heterodera glycines
  Coding regions on vcDNA: vcDNA=SeqID_94700; Strand=-; Position=54-299
SRSFFFFFFLTTNFFSANKCNKNDIRSGITNILFVVCSASFPFTVAISFRYTRIYRTFTSTITFFRETTTCVSARIFIIVF

SEQ ID NO: 168278 - protein, 62 aa, Heterodera glycines
  Homolog annotation: Hit_ID=CAE60497.1; Match level="QueryCoverage =96%, HitCoverage=32%, E-value=2e-10, Identity=51%"; Hit description =Hypothetical protein CBG04115 [Caenorhabditis briggsae]
  Coding regions on vcDNA: vcDNA=SeqID_94701; Strand=+; Position=2-187
SAQAHNVLSDIDKKLHENNALTNLLGKIETRTGLKRFHIFGALVGHHMLHLLHGRWAQLACN

SEQ ID NO: 168279 - protein, 181 aa, Heterodera glycines
  Homolog annotation: Hit_ID=CAE59722.1; Match level="QueryCoverage =23%, HitCoverage=29%, E-value=3e-10, Identity=64%"; Hit description =Hypothetical protein CBG03158 [Caenorhabditis briggsae]
  Coding regions on vcDNA: vcDNA=SeqID_94702; Strand=+; Position=4-546
MLSLFSKNDCLAPKIGRLKAMANGWRRRRRRNIMPMGTTTTIGTTMARMIVPFLVISAVTEAASAAAAEQTARAIRRADPGGFRAQRICYQCQMPMQCQSGFCYGDFCVKSMVAGKYVSKGCENRTISASNAAFYTSANPSKASQSHGPRKKFHIFLNFNYPPAPSPVLLSVRPFSRGDGR

SEQ ID NO: 168280 - protein, 217 aa, Heterodera glycines
  Homolog annotation: Hit_ID=NP_073731.1; Match level="QueryCoverage =90%, HitCoverage=37%, E-value=6e-20, Identity=30%"; Hit description =cytochrome P450, family 3, subfamily A, polypeptide 43 isoform 1 [Homo sapiens] gb|AAG33010.1| cytochrome
  Gene Ontology: Mol. function=cytochrome P450 activity; Cellular component=microsome; Biological process=steroid metabolism
  Coding regions on vcDNA: vcDNA=SeqID_94703; Strand=+; Position=2-652
GVGDRFLFALIISTFAYKILNFPQFFFCFIAVVAAWIFFQYHQKKHWHRLDVPGPNVNIFFGNTIKQIRNGSIDVDRENFSKYGNSFGSFLFDRREFCTKDPDMIRQIFIKEFAHFQNRFDFIPGRKEDAPKSLTRNMINMLRDDDWKRVRNRVTPAFTTGKLKKLIPILCECTERLCKVCEDEYASNKKEILLKDLYGRFLLDVISRCGLSLDLNT

SEQ ID NO: 168281 - protein, 159 aa, Heterodera glycines
  Homolog annotation: Hit_ID=NP_492323.1; Match level="QueryCoverage =98%, HitCoverage=91%, E-value=8e-27, Identity=40%"; Hit description =putative protein, with at least 2 transmembrane domains, of bilaterial origin (19.0 kD) (1J169) [Caenorha
  Coding regions on vcDNA: vcDNA=SeqID_94704; Strand=+; Position=2-521
AKRATRGQRRIYEENKQTLLCYVLASICSSVLVFSLNYFLFLPQKGAWIGLALSSASQAFSVILMSMMMKTVRNERNQLVDAGLDLNDPNAFGEYCKDIVILSVSAQLLSLIWTGFFFVLLSIPFFTLYKLWTNILGPWFFRPTLDDDEKEDKKKQKKP

SEQ ID NO: 168282 - protein, 146 aa, Heterodera glycines
  Homolog annotation: Hit_ID=NP_500152.1; Match level="QueryCoverage =93%, HitCoverage=90%, E-value=2e-32, Identity=49%"; Hit description =selenoprotein (17.6 kD) (4C739) [Caenorhabditis elegans] gb|AAF36064.2| Hypothetical protein Y76B12C.3 [C
  Gene Ontology: Mol. function=selenium binding
  Coding regions on vcDNA: vcDNA=SeqID_94705; Strand=+; Position=3-443
YSFVSFTFAEFIDEEKMTEGECRLTGLDSTNLKCSACRLLGQFNLEEILTDCLRCCEEIKIAEERFAYAEMHVCECNLHRFPQVAAFVRSEMKDQWGGKLKVKQVRGVLPTILLKSGDGQTHKTLSIEKWDTDTMTEFLNGALSLG

SEQ ID NO: 168283 - protein, 112 aa, Heterodera glycines
  misc_feature (18)..(18): Xaa can be any naturally occurring amino acid
  misc_feature (26)..(26): Xaa can be any naturally occurring amino acid
  misc_feature (46)..(46): Xaa can be any naturally occurring amino acid
  misc_feature (75)..(75): Xaa can be any naturally occurring amino acid
  Homolog annotation: Hit_ID=NP_503731.1; Match level="QueryCoverage =100%, HitCoverage=35%, E-value=2e-24, Identity=45%"; Hit description= zinc finger like protein 1 (34.8 kD) (5D177) [Caenorhabditis elegans] gb|AAF60574.1| Hypothetical protei
  Gene Ontology: Mol. function=zinc ion binding
  Coding regions on vcDNA: vcDNA=SeqID_94706; Strand=+; Position=1-334
LSNHESWVAQTHLSWLTXDRDYDANXLLCYESISSKETLTLRCIHXLHWDCLDSRAHHLPKTTAPADYRWPTCLXCLFPSDNESTPVVDKLRAKLQTVNWSSCGLGLPRIIE

SEQ ID NO: 168284 - protein, 75 aa, Heterodera glycines
  Coding regions on vcDNA: vcDNA=SeqID_94707; Strand=-; Position=1-225
ILRMKFQWCKMCFFKWQCTAIHPAPSHLFHPSVRLSSFLPFLRPSFQLRSVRPCLRPSFHTGYAGTFESGTSTGN

SEQ ID NO: 168285 - protein, 79 aa, Heterodera glycines
  Coding regions on vcDNA: vcDNA=SeqID_94708; Strand=-; Position=10-249
FFCVNLLKCSSSIEEGKLLGSNADNISGYRFDYNIFHLSRTDCKKQFAGQRQFSEHLMRFHREATKRSQRRRPEKAGEV

SEQ ID NO: 168286 - protein, 88 aa, Heterodera glycines
  misc_feature (51)..(51): Xaa can be any naturally occurring amino acid
  misc_feature (57)..(57): Xaa can be any naturally occurring amino acid
  misc_feature (68)..(68): Xaa can be any naturally occurring amino acid
  misc_feature (72)..(72): Xaa can be any naturally occurring amino acid
  Homolog annotation: Hit_ID=Q9UWE4; Match level="QueryCoverage=100%, HitCoverage=82%, E-value=4e-13, Identity=44%"; Hit description=60S ribosomal protein L44 (60S ribosomal protein L41) dbj|BAA83465.1| L41 ribosomal protein [Coprinopsis cine
  Gene Ontology: Cellular component=cytosolic ribosome (sensu Eukarya); Biological process=protein biosynthesis
  Coding regions on vcDNA: vcDNA=SeqID_94709; Strand=+; Position=2-265
RATLCPVNICRIHTILKVSQFKMGNESTFAQGILYVMTENKRGYGGHTNPXLIPKIXTTKNIVLRMEXLTAXHCVHIASKRCKHFELG

SEQ ID NO: 168287 - protein, 149 aa, Heterodera glycines
  Coding regions on vcDNA: vcDNA=SeqID_94710; Strand=-; Position=85-534
NYKSNCLAKQRRKVIAYAKVADDDYLTFASPPIHEGIRQFGLRKLRCLCAPTIPSASPPNRRCVRLSLRFGALSPPNPPLPTAFRGRRHFQPILWAAAKILNRRANGQLGSECRGFGPRPAQNGGPLCGALPPIRCCCSTRRSIALQTF

SEQ ID NO: 168288 - protein, 54 aa, Heterodera glycines
  Coding regions on vcDNA: vcDNA=SeqID_94711; Strand=+; Position=3-167
LNRRGRSSSSNTKRDLARKDHFFPHKFLIFCGVSNLEDRIFFIICGPKSRNFTQ

SEQ ID NO: 168289 - protein, 115 aa, Heterodera glycines
  Homolog annotation: Hit_ID=CAE65209.1; Match level="QueryCoverage =99%, HitCoverage=71%, E-value=4e-17, Identity=42%"; Hit description =Hypothetical protein CBG10084 [Caenorhabditis briggsae]
  Coding regions on vcDNA: vcDNA=SeqID_94712; Strand=+; Position=21-365
MSTSLKHRDFVGEPMGDKEITAVAGIGPVYGKKLEDKVKKFTEFSGSLISNFQPIQIPEKGSIPFWIFSGPKKVKVPPIVNFCFFFQGFDQAYVLFGQFLILKKDKELFTEWLKG

SEQ ID NO: 168290 - protein, 149 aa, Heterodera glycines
  Coding regions on vcDNA: vcDNA=SeqID_94713; Strand=-; Position=40-489
KATTIRCSADCRSFASVKLAATNLSTSKANCFKFFAPRAVAIFGPSFGILCPSSVVAQFFPFAPSHSFLIVQKEHCAFCVVSWCMSLCWSLQSVCYFVFPTAVVSKGQFRAVRPLSVVRLWLYPFLRMNGRLSKFRRSDVSRCSQISAD

SEQ ID NO: 168291 - protein, 137 aa, Heterodera glycines
  Coding regions on vcDNA: vcDNA=SeqID_94714; Strand=+; Position=3-416
LFLALLMKTMFSNGFVVQQQQQNFKDLNGFADNDKQLPPLPAVQLVRSPANSLDASHRLLFERLSSEAKDRFAHKQMAMGEAKEWDERRIPRPQRRWLMRTTELKEGSGGDKYVKRVVSESELNALLKNAWLGKKRR

SEQ ID NO: 168292 - protein, 18 aa, Heterodera glycines
  Coding regions on vcDNA: vcDNA=SeqID_94715; Strand=-; Position=1-54
RKCGRAEVFRLHSVDRAR

SEQ ID NO: 168293 - protein, 95 aa, Heterodera glycines
  Coding regions on vcDNA: vcDNA=SeqID_94716; Strand=-; Position=11-298
FQQVATFMSSYIVNFANTVDTDQKGQMCEKAIEDVHMIKRELFSLDRCQVGGGARISDQIDEQLHVTTTFWQINLNNIFVFPSFGAPFRCMFLRI

SEQ ID NO: 168294 - protein, 71 aa, Heterodera glycines
  Coding regions on vcDNA: vcDNA=SeqID_94717; Strand=-; Position=2-214
TRGSPKMILLTYLSSLSTPLLPSFFWCFWHSERGIYVRRRGRRSQWKGGQSKCIFIGRGRGRIDGRSHWEK

SEQ ID NO: 168295 - protein, 97 aa, Heterodera glycines
  Coding regions on vcDNA: vcDNA=SeqID_94718; Strand=-; Position=41-334
SDYHNIINHILAPASFQSRLSAHCSHKGTSVLLLLMNAHIVTFRVDIIQHEFVKNNLEDGRTRQDKAEHKSDQRHNCVIRLKVDARPKVRPIEQQIE

SEQ ID NO: 168296 - protein, 93 aa, Heterodera glycines
  Coding regions on vcDNA: vcDNA=SeqID_94719; Strand=+; Position=1-282
RWLSFKAALLWTFSRGVQQKNKSHGQWSVLISFLIYEIKDAYLAHIRTLRSNSLPHIVETYRLEFHRRKKSQAQNAKRAILKKKKIINQIEGK

SEQ ID NO: 168297 - protein, 130 aa, Heterodera glycines
  Homolog annotation: Hit_ID=XP_315412.1; Match level="QueryCoverage =83%, HitCoverage=64%, E-value=8e-11, Identity=31%"; Hit description =ENSANGP00000014276 [Anopheles gambiae]
  Coding regions on vcDNA: vcDNA=SeqID_94720; Strand=+; Position=232-621
MRLINPKCLFLHISLPFAIWRVIDKLRAAEDKIILRLNCELPTKSFSKQLDKQRICTDIQKSLFETRKMREHLLVRCLQENEATAERCKESAEKATEGKTAKANLRLIRTEMTVEEIVRNQADTALRERC

SEQ ID NO: 168298 - protein, 119 aa, Heterodera glycines
  Coding regions on vcDNA: vcDNA=SeqID_94721; Strand=+; Position=117-473
KKNNHNKKLIKICENWKVKAIAANAYVKSWVCQKKQLEQAEVGTSSSGAQNVEIQVYSCLCMKPNFQMVRQGELQMSSAMEVIKGVYRDLFGWGNGKWMQIKMGLERNNLWSMTTYLFD

SEQ ID NO: 168299 - protein, 121 aa, Heterodera glycines
  Coding regions on vcDNA: vcDNA=SeqID_94722; Strand=+; Position=12-377
MAFMALLVVQCSSAAAGDVSPALDNQEEKRVLSADESGPLQNFRTVLEGRHKRSLMGRYRNSTGRKRNSNGRNRNSTGRRRNSTGRKRNSYGRNRNSNGRNRNSFGRGKRSPMAFPPAADK

SEQ ID NO: 168300 - protein, 109 aa, Heterodera glycines
  Coding regions on vcDNA: vcDNA=SeqID_94723; Strand=-; Position=123-452
NIHWKENKRIFFLHLMRFRFGNLLPYITIIFRYRIKIQIATDRPFVLLVVQLLVFLCQPMVRTLQTVQHSSVPSDFVSVSPMANHFNALLFFIAAESRRKKRTSTRQLA

SEQ ID NO: 168301 - protein, 117 aa, Heterodera glycines
  Coding regions on vcDNA: vcDNA=SeqID_94724; Strand=-; Position=2-352
GAGPKNTVIRHCVFISVAQQRISEPAGFDPLYAQQSLHIKPKHPKLLHPLQHWLHMNWLHKLKWVLHEAYLFKRIPRVAFTAVIAKSPLFASAIISSLSFEVAKVTAANSRHIARNI

SEQ ID NO: 168302 - protein, 184 aa, Heterodera glycines
  Homolog annotation: Hit_ID=NP_496397.1; Match level="QueryCoverage =75%, HitCoverage=51%, E-value=2e-29, Identity=45%"; Hit description =interferon gamma inducible protein 30 like precursor (2L479) [Caenorhabditis elegans] emb|CAB04345.1| Hyp
  Gene Ontology: Biological process=regulation of protein activity, epigenetic
  Coding regions on vcDNA: vcDNA=SeqID_94725; Strand=+; Position=3-554
FLPTLVVVSAATVPILPQQLLSANDQNSNSLPNLTNVLADEISLSAIDCAALPPALWCTKFVRYKCGTSNLCTKHDDAVRYKPLHITLLYESLCPFCQRFIRDTLFNVYNRFRTHIKLELVPYGNAKTNGTHFTCQHGTEECRINKFESCAINYMNDPMPFVYCLETLLYENVKFDDATKLCFN

SEQ ID NO: 168303 - protein, 156 aa, Heterodera glycines
  Coding regions on vcDNA: vcDNA=SeqID_94726; Strand=+; Position=2-472
PIFLLWTCYIFLVHHLPHYAQAANENRLINNHHPPQITNERLIKKLCFGNCFKPFTVQAKKGQKFLLEFETQPEKETLKQCAYISTGWSGLEDSDIITFENKKEDILGRASVHLLREVGANATELEFPAGILRCYIINRISGAVKVTDFPYPHGLA

SEQ ID NO: 168304 - protein, 91 aa, Heterodera glycines
  Coding regions on vcDNA: vcDNA=SeqID_94727; Strand=+; Position=1-273
KGEEKRLSEHRRRIGGEIDATERSANSAGVSDSFSKDAEEEKAKDKEEAVKEMLGQLKKLGNVFLRPFGLSTDSFELVKQSDGGGFSVQMK

SEQ ID NO: 168305 - protein, 42 aa, Heterodera glycines
  Coding regions on vcDNA: vcDNA=SeqID_94728; Strand=-; Position=3-128
FYLYLFKRKSFHNDENAFIENEEMVGIISALLSIRAAQLTQV

SEQ ID NO: 168306 - protein, 160 aa, Heterodera glycines
  misc_feature (98)..(98): Xaa can be any naturally occurring amino acid
  misc_feature (109)..(109): Xaa can be any naturally occurring amino acid
  misc_feature (115)..(115): Xaa can be any naturally occurring amino acid
  Coding regions on vcDNA: vcDNA=SeqID_94729; Strand=+; Position=3-485
TLCRFVVVAPFVFQIVPSPSCFQMPWLSSVPVMIRMVVVVFVCAVLSAAAAGSDPSDVIDIESLELWRVSCAGRNCSRRCFGWENPVFCADSIQFCTXGVAWPIWMIAXSFGLNXVLIVLVLVHLAVVRVRRDLPFASIRVCDQCQRRVSVLSSRIVSSM

SEQ ID NO: 168307 - protein, 179 aa, Heterodera glycines
  Coding regions on vcDNA: vcDNA=SeqID_94730; Strand=+; Position=3-542
LATVIIGAVLPMFRTWKVLKSRKSRQLIPLSKYWIVFAAWVSFESVANLFSLPYFIPAYSFLKFSVVLYTYLVGYEHIYQKEYEPNREVLMASAQYYASKATQHALAYAWNTITSCSPRSKAITTQANGQRNAEFRSVVRIVELEEQEEDFVDIIEQDEQFEDLEADSDNEMTSNSPIH

SEQ ID NO: 168308 - protein, 118 aa, Heterodera glycines
  Homolog annotation: Hit_ID=CAE57492.1; Match level="QueryCoverage =94%, HitCoverage=93%, E-value=8e-39, Identity=60%"; Hit description =Hypothetical protein CBG00462 [Caenorhabditis briggsae]
  Gene Ontology: Mol. function=transcription factor activity; Cellular component=nucleus; Biological process=chromatin modeling
  Coding regions on vcDNA: vcDNA=SeqID_94731; Strand=+; Position=19-375
MTVETVPADLRNLRACLVCSLVKSEDQFMADGCDNCERFLNIKGDIDKCYECTSANFDGIIAVCEPNDSWVCKWQKINRKCPGIYAVSVSGNLPKHVVAELSHMGIKYKSGQRDKSAK

SEQ ID NO: 168309 - protein, 72 aa, Heterodera glycines
  Coding regions on vcDNA: vcDNA=SeqID_94732; Strand=+; Position=1-219
SVQKSDSASLAFGFIAGAGLELFKINFSCFGISFYKVFNEKQLSQELTEFEEKLANRNSMLRSRIDQFQDPK

SEQ ID NO: 168310 - protein, 90 aa, Heterodera glycines
  Homolog annotation: Hit_ID=XP_311435.1; Match level="QueryCoverage =100%, HitCoverage=91%, E-value=6e-16, Identity=42%"; Hit description= ENSANGP00000018599 [Anopheles gambiae]
  Gene Ontology: Biological process=positive regulation of growth rate
  Coding regions on vcDNA: vcDNA=SeqID_94733; Strand=+; Position=3-275
KCTKKLSKLATVHVEKSDQTAKRVTNENKLLSSKQKFKPASEEFKKCRICNKMTHHISAYYCQNCSYQKGICPMCGRKQIETAKYRQSLT

SEQ ID NO: 168311 - protein, 136 aa, Heterodera glycines
  Homolog annotation: Hit_ID=CAE62712.1; Match level="QueryCoverage =94%, HitCoverage=89%, E-value=3e-27, Identity=46%"; Hit description =Hypothetical protein CBG06866 [Caenorhabditis briggsae]
  Gene Ontology: Mol. function=electron transporter activity; Cellular component=mitochondrion; Biological process=cell cycle
  Coding regions on vcDNA: vcDNA=SeqID_94734; Strand=+; Position=3-413
TKDEVALHNSENLTWIIMNDKVYDVTKFLMEHPGGEEVLLQWAGYDATEAFNDVGHSADAKKMADDYLVGELKEDEGQTTAGVSLPEEAKRDEPTESWRQILSSPTWSNFRIPVALSLGVFCAYKLGTAIYRQMAS

SEQ ID NO: 168312 - protein, 117 aa, Heterodera glycines
  Coding regions on vcDNA: vcDNA=SeqID_94735; Strand=+; Position=1-354
MHQSDTGSSTPGDSPVDRIEITGLMSLAEFVETIEAEFPEQILLKLYADFRGHNLKMPVEVDEPDDPQFDRFDGQGHLLVEDIVFDMIHKTKRDHHHDIPFKAQYVNDFVANVSYRF

SEQ ID NO: 168313 - protein, 190 aa, Heterodera glycines
  Homolog annotation: Hit_ID=CAE63840.1; Match level="QueryCoverage =97%, HitCoverage=32%, E-value=2e-55, Identity=53%"; Hit description =Hypothetical protein CBG08396 [Caenorhabditis briggsae]
  Coding regions on vcDNA: vcDNA=SeqID_94736; Strand=+; Position=6-575
MRNFLLLLCFAIILQVLCDEHDHIYSPNAEVVLWMNTVGPYNNRQETYSYFSLPFCQGYKKTIEHYHETLGEALLGVELEFSGLDIRFTVDQPKTEYCNTKLTPTDIDALIFAVEHNYWYQMYIDELPLWALVGEKDKAITYIYTHKKFELGYNGKQIVVADVVAEGKRELKPNMVLYNWDFSTTKLLKA

SEQ ID NO: 168314 - protein, 213 aa, Heterodera glycines
  misc_feature (172)..(172): Xaa can be any naturally occurring amino acid
  Homolog annotation: Hit_ID=CAE58648.1; Match level="QueryCoverage =91%, HitCoverage=54%, E-value=6e-53, Identity=48%"; Hit description =Hypothetical protein CBG01816 [Caenorhabditis briggsae]
  Coding regions on vcDNA: vcDNA=SeqID_94737; Strand=+; Position=1-639
LRPSSSLPSRLTFLLFFLLVNLYYLVKSASNSLINDKCMTCKFLSKTFLGGLEKTEKLHFGGGNTDWEERNLGRFKTSETRFVEMLDYVCKRDSSAEIGFSGIKDLQFKCHSLLEAHEELLGQWFFEHQENGPTLGKYLCIENLKLCCDEGYFGSDCSPCPGMKLSGKPCFXNGQCQGNGTRNGNGTCSCHAGYGGKMCSHCDSSYFAVRKIV

SEQ ID NO: 168315 - protein, 90 aa, Heterodera glycines
  Coding regions on vcDNA: vcDNA=SeqID_94738; Strand=+; Position=45-317
INAQRQNSNTTARSTHAHGITYGRRQGEGSAAVIRPWKAAKICAVWGIQFKFLGQNHAARTHSRTIGHGGLARTLLVLNPATVVVQGLTG

SEQ ID NO: 168316 - protein, 146 aa, Heterodera glycines
  Coding regions on vcDNA: vcDNA=SeqID_94739; Strand=+; Position=1-441
WSPPTFCLNGSSLFLVIWKNRLSGGNIPINGQLPAVRQQQDRETLFPMSCVIILPGQRVTIDKMSEFISRELLSANTQPPARRYAAIEMTMKQIGATSSGFLANFGVRLSAESTVKIGVHQMPKIKFGNTVTSFQDRVRKKQTILN

SEQ ID NO: 168317 - protein, 51 aa, Heterodera glycines
  Coding regions on vcDNA: vcDNA=SeqID_94740; Strand=-; Position=1-153
EPKNEWEELKGMREGKRERMSKWERKMPKVKQKKVPKRAEERLEKKKRKRK

SEQ ID NO: 168318 - protein, 101 aa, Heterodera glycines
  Coding regions on vcDNA: vcDNA=SeqID_94741; Strand=+; Position=3-308
FGTGGEMDQKECAMCGEKISLTDRLMVDRETIHKNCFACCFCGANLKPGHAAMELSFYNRYGPRWYCSGSAGGCALTPVSEKDAKLKEKGMNTKKFKKAKK

SEQ ID NO: 168319 - protein, 139 aa, Heterodera glycines
  Homolog annotation: Hit_ID=NP_507920.1; Match level="QueryCoverage =25%, HitCoverage=17%, E-value=1e-10, Identity=66%"; Hit description =predicted CDS, putative mitochondrial protein (5U798) [Caenorhabditis elegans] emb|CAA21554.1| Hypothetic
  Coding regions on vcDNA: vcDNA=SeqID_94742; Strand=+; Position=2-421
ILPNVLPFAQLPNSSLRIALGLLVLILLIGFFPSTDAIQCYSGNQFSIVECPSLYCIKQTLGLDTVRYCDGTGFSSICSTYRTIDSCQTVPSLGYVCCCPDQLCNSAQKVPMNALFGITLLGIALASLNVAMRTTERMF

SEQ ID NO: 168320 - protein, 32 aa, Heterodera glycines
  Coding regions on vcDNA: vcDNA=SeqID_94743; Strand=+; Position=2-100
PGRVMITDQNSGNELIDWLLMRLCDPMLAFAI

SEQ ID NO: 168321 - protein, 62 aa, Heterodera glycines; identical to SEQ ID NO: 157009
  Coding regions on vcDNA: vcDNA=SeqID_94744; Strand=-; Position=0-185

SEQ ID NO: 168322 - protein, 66 aa, Heterodera glycines
  Homolog annotation: Hit_ID=AAQ19607.1; Match level="QueryCoverage =100%, HitCoverage=91%, E-value=2e-09, Identity=42%"; Hit description= heterotrimeric guanine nucleotide-binding protein gamma subunit [Sitobion avenae]
  Coding regions on vcDNA: vcDNA=SeqID_94745; Strand=+; Position=1-201
SVQQAKKVAEQLEREKRIRRLPMSETINDLIRYTQEMQKDDYLFNGFPTDKLNPYRPKSNFQCLVI

SEQ ID NO: 168323 - protein, 138 aa, Heterodera glycines
  Coding regions on vcDNA: vcDNA=SeqID_94746; Strand=+; Position=50-466
MNFMKKTITRIERQKKQNERERTKEQISAGKLEVLPPRHYPTVEHIDDDPNITLGGVMTEWRYSVLMDNLRFGRFSFKGQNPEVEKWMQFHERRRNGIEDEEEEEEEREEEGEKRRSREEGELSDEEGDGSIVKLVEK

SEQ ID NO: 168324 - protein, 109 aa, Heterodera glycines
  Homolog annotation: Hit_ID=NP_498776.1; Match level="QueryCoverage =92%, HitCoverage=91%, E-value=2e-25, Identity=49%"; Hit description =heat shock protein (hsp-12.2) [Caenorhabditis elegans] gb|AAA27953.1| Heat shock protein protein 12.2 [Ca
  Gene Ontology: Mol. function=chaperone activity; Cellular component =cytoplasm; Biological process=muscle contraction
  Coding regions on vcDNA: vcDNA=SeqID_94747; Strand=+; Position=1-330
QIKVDQEESTKLWDWPLQSHDELVSIYDGRDRWEVGLDTGFFTPNEIEVNRMGQNLFIHCKHDQREGMLGTTSREVQRNYKLPDDVDPKSIRSNITRAGILRITAQKKR

SEQ ID NO: 168325 - protein, 156 aa, Heterodera glycines
  misc_feature (19)..(19): Xaa can be any naturally occurring amino acid
  misc_feature (35)..(35): Xaa can be any naturally occurring amino acid
  Homolog annotation: Hit_ID=AAK95136.1; Match level="QueryCoverage =100%, HitCoverage=71%, E-value=1e-37, Identity=55%"; Hit description= ribosomal protein L10a [Ictalurus punctatus] sp|Q90YV8|R10A_ICTPU 60S ribosomal protein L10a
  Gene Ontology: Cellular component=cytosolic ribosome (sensu Eukarya); Biological process=protein biosynthesis
  Coding regions on vcDNA: vcDNA=SeqID_94748; Strand=+; Position=2-469
KKRLFRETIELPVALKTYXPTEETPCRNATVILKXTSPPPKTNVGILGKPEPSDHANACAISFVTGHDLKKLIKDSRLIGNLNKSYYAFLASESLIIQIPRILGPGLNKAGKFPSVVSHYDMLNAKVDEVNATVKFQMKEVLCRAGAIGHVEMSHD

SEQ ID NO: 168326 - protein, 98 aa, Heterodera glycines
  Coding regions on vcDNA: vcDNA=SeqID_94749; Strand=+; Position=1-297
GPTKKFCEVCRSWIDLFEDKIQVEKLMMHKRCFVCAICDCPLEPGNCSRDDGIIYCQFMCNDRVPVWFCSAHMMLGSGEKCQLLKEKWMKENEEKQEI

SEQ ID NO: 168327 - protein, 110 aa, Heterodera glycines
  misc_feature (20)..(20): Xaa can be any naturally occurring amino acid
  Homolog annotation: Hit_ID=NP_741446.1; Match level="QueryCoverage =80%, HitCoverage=48%, E-value=2e-29, Identity=69%"; Hit description =serine/aRginine rich pre-mRNA SPlicing factor, Serpin (20.5 kD) (rsp- 6) [Caenorhabditis elegans] gb|AAA82
  Gene Ontology: Mol. function=pre-mRNA splicing factor activity; Cellular component=nucleus; Biological process=mRNA splice site selection
  Coding regions on vcDNA: vcDNA=SeqID_94750; Strand=+; Position=3-335
SRRGGGNNVEGKVYVDGLPXDATSEELDDVFHKFGRIRKIWVARRPPGFAFVEFEDTRDAQDAVRSLDGTRICGVKARVELSTSRSRRDRDERGRGISRENEEKSRIREH

SEQ ID NO: 168328 - protein, 69 aa, Heterodera glycines
  Coding regions on vcDNA: vcDNA=SeqID_94751; Strand=-; Position=1-207
GISTGIPNGISICVQKNFNCESSNSTAQWASIRHYTMLNDVIHQIQLPKSVFFDAILRPFEHHNKIVLP

SEQ ID NO: 168329 - protein, 87 aa, Heterodera glycines
  Homolog annotation: Hit_ID=CAE62184.1; Match level="QueryCoverage =98%, HitCoverage=95%, E-value=1e-20, Identity=52%"; Hit description =Hypothetical protein CBG06231 [Caenorhabditis briggsae]
  Coding regions on vcDNA: vcDNA=SeqID_94752; Strand=+; Position=20-283
MEKIEVKETDMKSNLIDQTIEIVRDGLQKYGQDKDIASFVKDTMEQRFAGTWHCVVGRSFGSRVSYELESFTLFKVNQHTVLIFKCG

SEQ ID NO: 168330 - protein, 127 aa, Heterodera glycines
  Homolog annotation: Hit_ID=NP_524098.2; Match level="QueryCoverage =75%, HitCoverage=53%, E-value=1e-46, Identity=93%"; Hit description =CG6025-PA [Drosophila melanogaster] gb|AAF49556.2| CG6025-PA [Drosophila melanogaster] gb|AAN71215.1| GM2
  Gene Ontology: Mol. function=ARF small monomeric GTPase activity; Cellular component=cytosol; Biological process=protein-vacuolar targeting
  Coding regions on vcDNA: vcDNA=SeqID_94753; Strand=+; Position=1-384
TFLLFKSLFGHREMRILILGLDGAGKTTILYWLQVGEVVTTIPTIGFNVEQVTYKNLKFQVWDLGGQTSIRPYWRCYYSNTDAIIYVVDSADRDRVGISKHCAVFHRVEQPQVHSGGTACHFRWSSG

SEQ ID NO: 168331 - protein, 158 aa, Heterodera glycines
  Homolog annotation: Hit_ID=NP_498663.1; Match level="QueryCoverage =96%, HitCoverage=99%, E-value=2e-50, Identity=56%"; Hit description =deaminase (3I668) [Caenorhabditis elegans] gb|AAK84461.1| Hypothetical protein R13A5.10 [Caenorhabditis e
  Gene Ontology: Cellular component=mitochondrion
  Coding regions on vcDNA: vcDNA=SeqID_94754; Strand=+; Position=6-482
MSAQNEFMRAAVEEGIRGVQSGDGGPFGAVIVKNGKIIAQGHNMVLFSNDPTAHAEVMALRGASKVLDSFDLSGCILYTSCYPCPMCLGAVLWSRISNVFYAAAPTDAASVGFDDQNFHEFVSNPKKYEKLMALEHLPVEGHMKVFKMWEQRDEKRMY

SEQ ID NO: 168332 - protein, 49 aa, Heterodera glycines
  Coding regions on vcDNA: vcDNA=SeqID_94755; Strand=-; Position=14-163
IINSLIGLINHCSNARPFIRLIAHRCVTFESVQCVGSECHWDQILDARF

SEQ ID NO: 168333 - protein, 78 aa, Heterodera glycines
  Homolog annotation: Hit_ID=CAE65930.1; Match level="QueryCoverage =100%, HitCoverage=91%, E-value=2e-14, Identity=48%"; Hit description= Hypothetical protein CBG11103 [Caenorhabditis briggsae]
  Coding regions on vcDNA: vcDNA=SeqID_94756; Strand=+; Position=2-235
SLRRAPTKAKSIVASETQLTCHVFATTTMCAQERLDRQRIVWYIQCRVRMAHFQSNITSQSDPMDVYSDWIDTCEAAN

SEQ ID NO: 168334 - protein, 73 aa, Heterodera glycines
  Homolog annotation: Hit_ID=CAE65930.1; Match level="QueryCoverage =100%, HitCoverage=86%, E-value=6e-24, Identity=65%"; Hit description= Hypothetical protein CBG11103 [Caenorhabditis briggsae]
  Gene Ontology: Biological process=cell growth
  Coding regions on vcDNA: vcDNA=SeqID_94757; Strand=+; Position=2-220
APTKAKSIVASETQLTCPSCTHYNVCEVKLDLQRNVWYIHCRVCMEDFQSNITALSEPIDVYSDWIDTCEAVN

SEQ ID NO: 168335 - protein, 66 aa, Heterodera glycines
  Homolog annotation: Hit_ID=NP_492668.1; Match level="QueryCoverage =89%, HitCoverage=11%, E-value=5e-13, Identity=47%"; Hit description =kinase protein PROT family member (1K693) [Caenorhabditis elegans] pir||T26414 hypothetical protein Y106G
  Coding regions on vcDNA: vcDNA=SeqID_94758; Strand=+; Position=2-199
GDQTECKDDNEFCYNVTAEAGVIFKASKAGCSYYRCLISRNKCINTEISGVPVSFCCCNTEDLCYG

SEQ ID NO: 168336 - protein, 109 aa, Heterodera glycines
  Coding regions on vcDNA: vcDNA=SeqID_94759; Strand=-; Position=130-459
SIDRFEFRHSCALSDRDQRLEWHFSHDHWVHCQRSGHISPIAFFDAHQGQIERGDVLTAFRTDQHQLVDSGKRFVQIFDLADELVPVRVLLLLVELKLSVHSAQFDLTA

SEQ ID NO: 168337 - protein, 41 aa, Heterodera glycines
  Homolog annotation: Hit_ID=NP_509390.2; Match level="QueryCoverage =97%, HitCoverage=18%, E-value=1e-11, Identity=72%"; Hit description =putative protein family member, with at least 3 transmembrane domains (XI852) [Caenorhabditis elegans]
  Coding regions on vcDNA: vcDNA=SeqID_94760; Strand=+; Position=1-126
ICGFITCSLLCANWYGGKTCFFEGRLGYASGLNFVIVIINS

SEQ ID NO: 168338 - protein, 106 aa, Heterodera glycines
  Coding regions on vcDNA: vcDNA=SeqID_94761; Strand=-; Position=114-434
MLDIFTLLNICSKAMLFKFTYCWWSSKVRSGAKTDQQRLSCQCFRHRGRMALLLLCWHCHVERSDLCPKNGRRTKNAEKTIFAPSGVNDRRELIKLLFCCSLLTLQ

SEQ ID NO: 168339 - protein, 67 aa, Heterodera glycines
  Coding regions on vcDNA: vcDNA=SeqID_94762; Strand=+; Position=51-254
SNQSNVMTARSSLHLRPLGHVHCDQIKSPNRHRRHFPLLNLCAHFRICPHIFHQFHTLAFDLFSHFS

SEQ ID NO: 168340 - protein, 169 aa, Heterodera glycines
  Homolog annotation: Hit_ID=NP_505497.1; Match level="QueryCoverage =54%, HitCoverage=33%, E-value=4e-09, Identity=34%"; Hit description =C2H2 type zinc finger containing protein (5K172) [Caenorhabditis elegans] emb|CAA94802.1| Hypothetical pr
  Coding regions on vcDNA: vcDNA=SeqID_94763; Strand=+; Position=3-509
PKNIYKKFLCCLCGQHFDGVGPLESHLALVHVFYLAYECDLCKDALFPSDFALREHYVKIHNKTCFTIKYRVSPELEERRALLRRLVDQSMHKTGSGTIQQNKAPNLEPPNSYTSQLLMDCTSLLQTQLMASNHFLNSGIKKENVWEERNDGARVDHLEGEIEGPPIEG

SEQ ID NO: 168341 - protein, 119 aa, Heterodera glycines
  Coding regions on vcDNA: vcDNA=SeqID_94764; Strand=+; Position=1-360
LAKFTPFVGKSIRYELHNFLQNSSLLSKRVDFFHVYPKAFSVNGSSSGEHSNRVISQWLVGIELLPGKIVDSELRSELSQMLGNFDAKVKNAFNYFLFHAVDLFSEYVEKNELKLRRFD

SEQ ID NO: 168342 - protein, 147 aa, Heterodera glycines
  Homolog annotation: Hit_ID=EAL17339.1; Match level="QueryCoverage =67%, HitCoverage=25%, E-value=2e-15, Identity=43%"; Hit description =hypothetical protein CNBN1650 [Cryptococcus neoformans var. neoformans B-3501A]
  Gene Ontology: Mol. function=protein binding; Cellular component =filopodium; Biological process=signal transduction
  Coding regions on vcDNA: vcDNA=SeqID_94765; Strand=+; Position=21-464
ATDSLLNKWQGKTDIEQLTRLFVVMGTPTEQSWPGWELLPDANKVMFDVVEPANDWTKIVPSVSSEGLQLIRSLIQLNPCIRSSALRCLQHPFFTHHPQYDQIPYQPPLLEQMGGRRKVPEIVFNDSRRMEKMKPATNKKQAQWHKG

SEQ ID NO: 168343 - protein, 194 aa, Heterodera glycines
  Homolog annotation: Hit_ID=NP_509871.1; Match level="QueryCoverage =99%, HitCoverage=50%, E-value=1e-63, Identity=56%"; Hit description =heparan SulphoTransferase (hst-2) [Caenorhabditis elegans] pir||T19735 hypothetical protein C34F6.4 - Cae
  Gene Ontology: Mol. function=sulfotransferase activity; Cellular component=integral to membrane; Biological process=heparin metabolism
  Coding regions on vcDNA: vcDNA=SeqID_94766; Strand=+; Position=12-593
NAIAYDLSTVNGFHVAHLNLTKNRYQMNAIDQARLVQNLTNWQRMHPLFLHGHFAFFDFERFGLPPPIWINLLREPFDRFVSYFYFLRYGDNFRVGLRRSKAGNNETFDECFRRGGRECDPSAIWLQIPYFCGTAHFCSIPGNAQALQLAKRNLLDHFLLVGLTERIEETVLLLEQLLPAFFLGAGEHFRLLNG

SEQ ID NO: 168344 - protein, 175 aa, Heterodera glycines
  Coding regions on vcDNA: vcDNA=SeqID_94767; Strand=+; Position=5-532
MGKDKKGDYDPDIYGDWQDEKKPCACHCSYLRAKNFYRVECDFMNRGVKRLANVGRVALGLLSLPTMFIPGVNMLVAKPQVDSVGQDITHTALEVRYECGICGQIAYKTYEIVCKDVTSDRWGRYMKTYGDEPIFGIRTTEFDGIQRVFDGMWKNYDFINNNCKNWTRDMIGCLS

SEQ ID NO: 168345 - protein, 177 aa, Heterodera glycines
  Homolog annotation: Hit_ID=NP_956249.1; Match level="QueryCoverage =97%, HitCoverage=81%, E-value=3e-18, Identity=30%"; Hit description =Unknown (protein for MGC:64126) [Danio rerio] gb|AAH53266.1| Unknown (protein for MGC:64126) [Danio rerio
  Coding regions on vcDNA: vcDNA=SeqID_94768; Strand=+; Position=56-586
MDMDKILSDMRQHISNLQDKLHVANSAVSKGQIVNEKITLMKEYQDKIASLNSCWRARNRTQLVHNLQQESRQIIALEEENRQLRFALKEMEDGLHLIMNDYRKMFSGFMRGEELAEVANAQHKKVFLAGVSYEQYFGIARAAEKFMAISENKVAEDDQVITQLKLENQTLRALFHG

SEQ ID NO: 168346 - protein, 31 aa, Heterodera glycines
  Coding regions on vcDNA: vcDNA=SeqID_94769; Strand=-; Position=60-155
FFFFFSPLFIRRITGEIDGIMVNITLHYSIS

SEQ ID NO: 168347 - protein, 99 aa, Heterodera glycines
  Homolog annotation: Hit_ID=NP_872232.1; Match level="QueryCoverage =98%, HitCoverage=98%, E-value=2e-24, Identity=55%"; Hit description =predicted CDS, putative secreted or extracellular protein precursor (5U483) [Caenorhabditis elegans] emb|
  Coding regions on vcDNA: vcDNA=SeqID_94770; Strand=+; Position=2-301
LRLFGSTSFWYLLLLLELYDTAKLCYSGRNKMYSSKQCSGGSFDINYVCQKYTCEGGRSSFTLRTCAMKSTGCIAGTRTCRFSGGKGSCQRCEGDLCNL

SEQ ID NO: 168348 - protein, 148 aa, Heterodera glycines
  Homolog annotation: Hit_ID=NP_492733.1; Match level="QueryCoverage =72%, HitCoverage=95%, E-value=2e-15, Identity=36%"; Hit description =Y106G6H like (1L29) [Caenorhabditis elegans] emb|CAB63338.1| Hypothetical protein Y106G6H.8 [Caenorhabdit
  Coding regions on vcDNA: vcDNA=SeqID_94771; Strand=+; Position=32-478
MLYSIFAGWIGANAAVKSKSRVAIDRSTIGPFQCGPGLCTRMAGISGGIAVAMNAYGAHFVLANADINDERKRAMTYAINHHFINCIGMALAGVGAHYPTLTSSMFLISTVLFSVPSYLFAIRNDRRLRAVTPYGGVLAMLAWFSFVL

SEQ ID NO: 168349 - protein, 136 aa, Heterodera glycines
  Coding regions on vcDNA: vcDNA=SeqID_94772; Strand=+; Position=2-412
IRQNAVQLRARTLADLSRSFAVGDSSPSPNTALSYKMRSWSWRTFRQSRLDDVSYADDWFHFGTSYRTFPVLEKFDRRDYAAIPYTYWSRAYCTELYPSDRTEIYRRIYEPYRDEYSYKLWNASRRALLSRDNRLM

SEQ ID NO: 168350 - protein, 147 aa, Heterodera glycines
  Homolog annotation: Hit_ID=XP_392405.1; Match level="QueryCoverage =46%, HitCoverage=31%, E-value=2e-09, Identity=40%"; Hit description =similar to CG14207-PB [Apis mellifera]
  Coding regions on vcDNA: vcDNA=SeqID_94773; Strand=+; Position=19-462
MLSPFSYDPFYRRSLWPMATHVGNVLSPFRQLERELDHFFEGMQPMLRDHVAQLNVSDKGDLTYKVDVSGFRPEEINVEVIGNEIIVNGEHREQNDSESVHRQFSRRVLIPEGIQKESIKCELDGGRLFISGMKTADKGSSRKGRRK

SEQ ID NO: 168351 - protein, 132 aa, Heterodera glycines
  Coding regions on vcDNA: vcDNA=SeqID_94774; Strand=+; Position=1-399
ERFSVFASLFLSVVSLAFASSTFHTDFWILSDVMRRNGTESNKNQMNSGLFHGIRQLDWAFGPKRKHFSVLEELQSGVSFMDRNVWFALLLSIGLGFLWNIVDLSVTVKNCTKYGNGGKKIMPDVGTVIVGP

SEQ ID NO: 168352 - protein, 107 aa, Heterodera glycines
  Coding regions on vcDNA: vcDNA=SeqID_94775; Strand=+; Position=2-325
AKNWLAELFGTLSSFCWSIKFFALRSKIERKCSLNQSDTFVSVLPAVTQRHDNDGRRVTKHTTNQILIHQHSHHHHEHHSSRHITPFFPHQTTSFTHFTTSSTPFAG

SEQ ID NO: 168353 - protein, 104 aa, Heterodera glycines
  Coding regions on vcDNA: vcDNA=SeqID_94776; Strand=+; Position=49-363
MFRIFGRFVGTYPIAFLIFSLILASLSGDPLLTTVMLRARDRHSMHRLRWLDECVRMHDFLRLNISATVGGQLTNVVTFAIGALTPTPGKQFTILWLHKSQAEE

SEQ ID NO: 168354 - protein, 77 aa, Heterodera glycines
  Coding regions on vcDNA: vcDNA=SeqID_94777; Strand=+; Position=2-235
CYDNKQRHGDWLEAFDPRQQKKIDADYALFVAGHDPPPKCKKYREADERILRLTQNFNPLNIMEFLIGVSRNYQMDA

SEQ ID NO: 168355 - protein, 98 aa, Heterodera glycines
  Homolog annotation: Hit_ID=CAF94886.1; Match level="QueryCoverage =97%, HitCoverage=87%, E-value=2e-39, Identity=66%"; Hit description =unnamed protein product [Tetraodon nigroviridis]
  Gene Ontology: Mol. function=protein binding; Cellular component =ubiquitin ligase complex; Biological process=protein modification
  Coding regions on vcDNA: vcDNA=SeqID_94778; Strand=+; Position=29-325
METENAEETQQQRPFAIKRWNLVSTWSWDVECDTCAICRVHLMEACLRCQADSKAQECVVIWGECNHCFHLCCMSLWVKQINRCPLCQSDWAVQRVGK

SEQ ID NO: 168356 - protein, 123 aa, Heterodera glycines
  Coding regions on vcDNA: vcDNA=SeqID_94779; Strand=+; Position=1-369
EDPPNAEPIETVEKFESEEVEKVHMSMGAAKKRFDHCLLDSEGADFSDSVGVRRLKRGFKASEVFESETIGSEEEETLEQKFNRLNREIRNLAAEVEQSQNESPSVKKEDVAALDELLKTIAS

SEQ ID NO: 168357 - protein, 142 aa, Heterodera glycines
  Homolog annotation: Hit_ID=NP_386245.1; Match level="QueryCoverage =92%, HitCoverage=91%, E-value=3e-21, Identity=37%"; Hit description =HYPOTHETICAL TRANSMEMBRANE PROTEIN [Sinorhizobium meliloti 1021] emb|CAC46718.1| HYPOTHETICAL TRANSMEMBRA
  Coding regions on vcDNA: vcDNA=SeqID_94780; Strand=+; Position=2-430
LRYCIASSAAFTGAALYVSLVDHPTRLQLDTATALKQWKKCYSWSMPLQAGLALSSGILAFVNIVEHKQHIWTLGSALMLVNWPLTLIFILPLQKRLMAVNEASADEKTRADLERWGHLHGMCATLGLMATGVFLAGRFVLK

SEQ ID NO: 168358 - protein, 92 aa, Heterodera glycines
  Coding regions on vcDNA: vcDNA=SeqID_94781; Strand=+; Position=2-280
SSAHLQSHCSSGWFSHKGNCYTVIAGGWSAKSASANCSIANATLITPKIIESDEEEAFLRDLISFNAPKKNGQILVGENIDIFICRKAMGKY

SEQ ID NO: 168359 - protein, 123 aa, Heterodera glycines
  Homolog annotation: Hit_ID=CAE69536.1; Match level="QueryCoverage =100%, HitCoverage=88%, E-value=1e-15, Identity=33%"; Hit description= Hypothetical protein CBG15745 [Caenorhabditis briggsae]
  Coding regions on vcDNA: vcDNA=SeqID_94782; Strand=+; Position=3-371
LVSLISDKNYERRIHGYVSVLQDERWRRLYAVLKANLLFLFESSERLEIPVLLIVMEDFVVELADDNTMGRQNSFSIKFNTTGHNYIMAATDYDALQNWISVLTSCSFEFMEATRQSLESVEE

SEQ ID NO: 168360 - protein, 113 aa, Heterodera glycines
  misc_feature (39)..(39): Xaa can be any naturally occurring amino acid
  misc_feature (50)..(50): Xaa can be any naturally occurring amino acid
  misc_feature (78)..(78): Xaa can be any naturally occurring amino acid
  Homolog annotation: Hit_ID=NP_508642.1; Match level="QueryCoverage =100%, HitCoverage=61%, E-value=8e-26, Identity=45%"; Hit description= putative mitochondrial protein (24.4 kD) (XE350) [Caenorhabditis elegans] gb|AAA82434.1| Temporarily ass
  Coding regions on vcDNA: vcDNA=SeqID_94783; Strand=+; Position=2-340
HWVDRRFRARRFMNTDPNFWSRCKWYSDYWEPCNWRCDXYQHYDRPLWNXWKPDISDGKNQKPAIDMCRNGLLSFAYXDQRRITPGALGQKEKDWADIYPPDGKYGSLQYMYS

SEQ ID NO: 168361 - protein, 78 aa, Heterodera glycines
  Coding regions on vcDNA: vcDNA=SeqID_94784; Strand=+; Position=3-239
QFVRSTGAVGVACSVPKRRRFVPTTFCSDDVSADDVLGTQMSRFHASSSVKLPTLFRSPILPRLLKNQSPFHCPILSL

SEQ ID NO: 168362 - protein, 148 aa, Heterodera glycines
  Homolog annotation: Hit_ID=CAE68498.1; Match level="QueryCoverage =100%, HitCoverage=40%, E-value=3e-32, Identity=46%"; Hit description= Hypothetical protein CBG14305 [Caenorhabditis briggsae]
  Gene Ontology: Mol. function=cAMP-dependent protein kinase, intrinsic catalyst activity; Cellular component=cAMP-dependent protein kinase complex; Biological process=protein amino acid phosphorylation
  Coding regions on vcDNA: vcDNA=SeqID_94785; Strand=+; Position=2-445
PAYLAPEVFERVGHNQSVDYWALGVLIYELMAGDQPFWGKCPEDVYEHIQETKENGLRFPRRTFSPNAKDIIRGLLCIDPKQRLGCDQLKKHPWFSQYEWTELSNRNYKPPFVPTIYHEGDTGDFDSYQEVEHMAPAKQCYLDLLDEW

SEQ ID NO: 168363 - protein, 105 aa, Heterodera glycines
  Homolog annotation: Hit_ID=CAE69266.1; Match level="QueryCoverage =70%, HitCoverage=18%, E-value=2e-23, Identity=66%"; Hit description =Hypothetical protein CBG15319 [Caenorhabditis briggsae]
  Coding regions on vcDNA: vcDNA=SeqID_94786; Strand=+; Position=120-434
MNLSDEQLDELKWRPKRHTKLDGTQMINSSGQQNCSDENFILSTLLRDYDKFRIPGGGNVRVEVEIWVQEVSKIIEITSEFELDIYVTEMWTDPFLAFAHLNPCK

SEQ ID NO: 168364 - protein, 82 aa, Heterodera glycines
  Coding regions on vcDNA: vcDNA=SeqID_94787; Strand=+; Position=1-249
ITSITSLKMPLFSAGHPLPLKSLGPFPEFGPNYSSPYFTRTGTYSFPNHYHLQNDRFYSAFFRASYRSTDYSPESLYSSRIA

SEQ ID NO: 168365 - protein, 123 aa, Heterodera glycines
  Coding regions on vcDNA: vcDNA=SeqID_94788; Strand=+; Position=2-373
DRDHLQPSTIANIVHFLVNDLQRMQRMTDILTDFQVDWMEYNQLTWAVMFFIVEECHSLPISEGTIVMPTLSFLFAGFTNPFLTTFQDFFLHIVSDSFVDPRTPSWQKEVLTVGIESKKAISD

SEQ ID NO: 168366 - protein, 142 aa, Heterodera glycines
  Coding regions on vcDNA: vcDNA=SeqID_94789; Strand=+; Position=1-429
TEKAPSSELELSFLCEENEEIAAPNLTYDDNQSGKWILSFEIGDVLDTKWKMARDLYNSKKLDGIVGMKVSTNCPRTRRGNTGVIIMYCGPFYDRNKMLDIGNNILAKMQCTAPITYKADFQTLSGVEETLYTISPEGSSSS

SEQ ID NO: 168367 - protein, 53 aa, Heterodera glycines
  Coding regions on vcDNA: vcDNA=SeqID_94790; Strand=-; Position=45-206
FLNFKYYIFCNIIISQSIIANVLIFPISRLSPLGNLLVSRHQSMFFTPVSINL

SEQ ID NO: 168368 - protein, 175 aa, Heterodera glycines
  Homolog annotation: Hit_ID=NP_510605.2; Match level="QueryCoverage =65%, HitCoverage=22%, E-value=6e-30, Identity=50%"; Hit description =putative protein, with at least 2 transmembrane domains (XQ462) [Caenorhabditis elegans] emb|CAB03159.2|
  Coding regions on vcDNA: vcDNA=SeqID_94791; Strand=+; Position=41-565
MVNWCCFKFWFCFRLLLASIAHFNWFAAIYVNCIFFTLWKSYDILWFWTHLALCVCFPALRPNNNLIVFVKLVRAKCTDHSSKSFKEIYELIYSDTPDETNAERELRRIETQRKESKRRAHERIGKQKKHQKQMQLEEDESASSDSDDDSSTIVQMQGIYPILSYCQQMALCCRL

SEQ ID NO: 168369 - protein, 50 aa, Heterodera glycines
  Coding regions on vcDNA: vcDNA=SeqID_94792; Strand=+; Position=2-154
LKSWPVDHSQNFDEYLEAKGFGWFMRQAVNLACITKTFSNNYNCTYACKI

SEQ ID NO: 168370 - protein, 52 aa, Heterodera glycines
  Coding regions on vcDNA: vcDNA=SeqID_94793; Strand=-; Position=0-155
FFFFFSMQICTTLGNFIEVVKVSKGTIAVYRITYLPANVGTSHKCFSTSTSV

SEQ ID NO: 168371 - protein, 135 aa, Heterodera glycines
  Coding regions on vcDNA: vcDNA=SeqID_94794; Strand=-; Position=1-405
LPLSTENPHKLIHSSKHSHSTSSTTSSIHGQASAPSKLTLREESGVRGDESTELALFFFSLWLNVQKKNRGVFCTIFVAEVRRSMPISVVVFGIEEDDEIVVVVEVNIEEPMACDGVFEDKIGGDLAKRWAERRA

SEQ ID NO: 168372 - protein, 77 aa, Heterodera glycines; identical to SEQ ID NO: 146566
  Coding regions on vcDNA: vcDNA=SeqID_94795; Strand=+; Position=74-307

SEQ ID NO: 168373 - protein, 68 aa, Heterodera glycines
  Homolog annotation: Hit_ID=CAE69178.1; Match level="QueryCoverage =100%, HitCoverage=14%, E-value=1e-15, Identity=51%"; Hit description= Hypothetical protein CBG15211 [Caenorhabditis briggsae]
  Coding regions on vcDNA: vcDNA=SeqID_94796; Strand=+; Position=2-205
VRRVCPSLALARTEFSLQFDLCPEKSLLEQNYQCAECFSPIGFDDDSEKLPRICDFTGLFCCRRCHWN

SEQ ID NO: 168374 - protein, 49 aa, Heterodera glycines; identical to SEQ ID NO: 146915
  Coding regions on vcDNA: vcDNA=SeqID_94797; Strand=+; Position=70-219

SEQ ID NO: 168375 - protein, 125 aa, Heterodera glycines
  misc_feature (50)..(50): Xaa can be any naturally occurring amino acid
  Homolog annotation: Hit_ID=CAA82267.1; Match level="QueryCoverage =100%, HitCoverage=64%, E-value=2e-27, Identity=48%"; Hit description= TATA box binding protein [Acetabularia cliftonii] sp|P46272|TF2D _ACECL Transcription initiation factor TF
  Gene Ontology: Mol. function=general RNA polymerase II transcription factor activity; Cellular component=transcription factor TFIID complex; Biological process=transcription initiation from Pol II promoter
  Coding regions on vcDNA: vcDNA=SeqID_94798; Strand=+; Position=2-376
PKRMNAVIMNVYNPNATAIIFGTGKFVCTGAANEKECRQAAEQVTERIRXCGYYDAQIQEFKVRNLVATADVGFHIRLGPLSDFLGAKYCSFTPELFPGLVYRNQNPKISIIVFSSGKLNLTGSK

SEQ ID NO: 168376 - protein, 79 aa, Heterodera glycines
  Coding regions on vcDNA: vcDNA=SeqID_94799; Strand=-; Position=2-238
ITNNRLTYFSGLIPYNSCSSRTLQNISHLNLSCPRNLHKSSHFSFDPSLFNTEPKKSPQKKAKRISTTNMLINLRCSYS

SEQ ID NO: 168377 - protein, 182 aa, Heterodera glycines
  Homolog annotation: Hit_ID=CAE74209.1; Match level="QueryCoverage =92%, HitCoverage=80%, E-value=7e-59, Identity=63%"; Hit description =Hypothetical protein CBG21891 [Caenorhabditis briggsae]
  Gene Ontology: Mol. function=structural constituent of ribosome; Cellular component=mitochondrial large ribosomal subunit; Biological process=protein biosynthesis
  Coding regions on vcDNA: vcDNA=SeqID_94800; Strand=+; Position=2-550
RAFPSRAERVRQWMLFSRQWHAIDADRQDVWKLAKKVAKHLSGWSKPIHHPHTDCGDHVVVVNCSAVSMHAFDWKHTHFFFNRLYPKSKADIPAYQIHEYDPCRVVWMCIGRELAFLTRNRVVQRRCFERLHVFPDLEVPDSVRKNINNQLRQVQEVPKKSTEYSAEERAGFPLLFAQEKLS

SEQ ID NO: 168378 - protein, 133 aa, Heterodera glycines
  Coding regions on vcDNA: vcDNA=SeqID_94801; Strand=+; Position=2-403
FTKMSSFWNVSAVLMLITLISLLVNSSEAVPLPSKKSSSLWSKLFSNDRESAKKLGSPSSTSAAGGEFSVQSKMFIPYANNGNGGFFLPYPSEMDTVKRSNTEGHFLDPYDGGSSWLSLSDPSRLEWNFNRLR

SEQ ID NO: 168379 - protein, 150 aa, Heterodera glycines
  Coding regions on vcDNA: vcDNA=SeqID_94802; Strand=+; Position=2-454
AIPMPPPPTQDEKDQQKKSQWKPLEIGTTKIPDPEELPFGIVQTAFRASDRMRTTSEDSAESFDAYGPEWEGKGRGIGNRREFSSPNMTSSGRRMSITERLFGRPVPQERRNSLGEEQMGQEKPKSIAENKDFKELMKRQRKILGDDEWQ

SEQ ID NO: 168380 - protein, 84 aa, Heterodera glycines
  Coding regions on vcDNA: vcDNA=SeqID_94803; Strand=+; Position=131-385
FLCLNNQNPATFSQILLILWLIHLLLMAHFIHSLLCLSLVTKLRRILGPISNSIWQLSEGRINYSLMFSINLLFLIIFVSFFFN

SEQ ID NO: 168381 - protein, 119 aa, Heterodera glycines
  Coding regions on vcDNA: vcDNA=SeqID_94804; Strand=+; Position=1-360
SFYRNNQLPFRHQPDNSDSANRKDYENNSNKERNDNGNKNSYKEKQRKNESDGEENEEERTRRRIEQRHLGKGKEEGEKSWTREGEKGTERREEMAKSESILNALIEQVRHRSEVCHGF

SEQ ID NO: 168382 - protein, 123 aa, Heterodera glycines
  Coding regions on vcDNA: vcDNA=SeqID_94805; Strand=+; Position=68-439
SFPIRVAVSNCCRIWRLLISKSYVRDVGTTSKDGHADADILANADVVIMNNVFTFFADHAEQVSCWQHLRAYLRPDTLLLPLALAGVGHCPSLSVGTWLCLRRLVTSAAHWHCSDEHRCFCGN

SEQ ID NO: 168383 - protein, 176 aa, Heterodera glycines
  Coding regions on vcDNA: vcDNA=SeqID_94806; Strand=+; Position=3-530
APTLRLFVFVLLQFVVRPLVIHSMLFPPFVLLLAPIPLAFSIWPIVLAEPVFALDHLSLQNRATDEKHSSASTSPSLLSSVALTKCQSDYLSALIHRCMIRGVPTAMEGRICFADEVQLADVHKLVNYISEVCCLLRCQAKTLERLCCRHAQQQGRCRKANCLPIRDQKVLWEEAH

SEQ ID NO: 168384 - protein, 65 aa, Heterodera glycines
  Homolog annotation: Hit_ID=AAV90717.1; Match level="QueryCoverage =96%, HitCoverage=42%, E-value=5e-24, Identity=74%"; Hit description =60S ribosomal protein L27a [Aedes albopictus]
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_94807; Strand=+; Position=2-196
TGKKKTRKLRGHVSHVHRRVGKHRGHPGSRGNAGGQHHHRINFHKYHPGYFGMASMRNSYVLKNH

SEQ ID NO: 168385 - protein, 176 aa, Heterodera glycines
  misc_feature (165)..(165): Xaa can be any naturally occurring amino acid
  Coding regions on vcDNA: vcDNA=SeqID_94808; Strand=+; Position=1-528
IFLFIVMINALGCSNAQLKCRRDTVGTINGVGLKMNFSEEECESTYFWQSAYKYCYASHCLRGNEWLTHYGCAKSPEKGACSDNVEKEMKDLYGLAVSCSFCTIGRKMDDMSNKNFPLYNTTNVVMPPSGGADGDDFSFMSTTQQLTTSYNLSEIATIVPKKMNXHEMVTSTPTPN

SEQ ID NO: 168386 - protein, 103 aa, Heterodera glycines
  Coding regions on vcDNA: vcDNA=SeqID_94809; Strand=+; Position=3-314
HFSKNDQIFLHFFPNVFSTYSSSLSPFCALCAPSARFGQCADSKCHSVDHSDPRDQSRGCGQQIIGVVPRGVGPHGGTALERGAILWPTMKKRSEGTDGPFEE

SEQ ID NO: 168387 - protein, 82 aa, Heterodera glycines
  Coding regions on vcDNA: vcDNA=SeqID_94810; Strand=-; Position=1-246
YCLWNGFLGSDCTIRLPWFSSSFWRGFLVIGVVIFRPAPPPPPPNLLPGFCLLLLRFSDGVATAGEEVEETIFSLTIEKKEF

SEQ ID NO: 168388 - protein, 96 aa, Heterodera glycines
  Coding regions on vcDNA: vcDNA=SeqID_94811; Strand=+; Position=2-289
STQLLFHITTVSLVPTLIIGPKLTFFKNIGSSITKSISNSDQYQIEPKKHYKILFIIGPIDKPKKKMEFVTDEKGKIKWNFEKEILENKFTPKGFK

SEQ ID NO: 168389 - protein, 153 aa, Heterodera glycines
  Coding regions on vcDNA: vcDNA=SeqID_94812; Strand=+; Position=57-515
EFSIELSDCLLTVSARRRNYSPNGLFQLPFFCVCSLLILFNSNSVFTFILSLFQNFCSADAFAPKKVVSSFPMASTCWNCPNCSFRNFVTRRSCRRCDYSRTEEEINKNKTIWPCSECNSINYIDRKTCHKCGVSKPENVNSNRGETAADGSW

SEQ ID NO: 168390 - protein, 61 aa, Heterodera glycines
  Coding regions on vcDNA: vcDNA=SeqID_94813; Strand=+; Position=126-308
MSVVVERVNDDGTEGWSDNVPITKARMAELIRHFYNLGWMRDNGAGMAVHFKCPKTAELLI

SEQ ID NO: 168391 - protein, 125 aa, Heterodera glycines
  Homolog annotation: Hit_ID=NP_498867.1; Match level="QueryCoverage =100%, HitCoverage=45%, E-value=2e-11, Identity=32%"; Hit description= putative protein, with a coiled coil domain, of eukaryotic origin (37.4 kD) (3J530) [Caenorhabditis eleg
  Coding regions on vcDNA: vcDNA=SeqID_94814; Strand=+; Position=13-387
MDGLFFASIAFLTTVFSVIGIAIVKLWLDERNSRKSKETLVAMDDSATDGNMQNEVMDSDEDEQLTGNGAAEEAMLDQEGTTFSEKRIGKKKLAKLQAKAEAKALREQEQTEREERKQREKEIRK

SEQ ID NO: 168392 - protein, 75 aa, Heterodera glycines
  misc_feature (75)..(75): Xaa can be any naturally occurring amino acid
  Coding regions on vcDNA: vcDNA=SeqID_94815; Strand=-; Position=1-225
LDHCPLLIRIASLGRPLLILCSLIAFKRNRLGRRFLTQRKPMDEELDREIQMHNMLRNSPDLAQLHQVVADEQRX

SEQ ID NO: 168393 - protein, 129 aa, Heterodera glycines
  Coding regions on vcDNA: vcDNA=SeqID_94816; Strand=+; Position=1-390
PNFEMLFLSFPSFILRQIRPSFCRCFSFLLMLAMLFDLISIGRSLPLGSTNDRIYFSNALRDPKDIVLQLVTVPPPMLKFADFSNKFVRLEKRRRQFGPVQAKKYERNCFFSPVQCMLVFRDGSKLYGQ

SEQ ID NO: 168394 - protein, 106 aa, Heterodera glycines
  Coding regions on vcDNA: vcDNA=SeqID_94817; Strand=-; Position=3-320
FSTNFLFHSSDERCQIEVFINVNSLLPSKCLSTSASKRGEISANLRTVKMRENVHPNVVAIKCTHYKATSSLGSAQCPSRRQTRHLRHFQCTLFELGEVIRNSKIN

SEQ ID NO: 168395 - protein, 111 aa, Heterodera glycines
  Coding regions on vcDNA: vcDNA=SeqID_94818; Strand=+; Position=1-336
RFHDSVLEAVKNKLLQTREEADKAHNEVEHLKRELMEEREKRKLPDQKLKYAQKEAEEAKTELVLIRQRISEERAAREKAERELSVLKQILEDDTARRAQTDTLRNLYPRK

SEQ ID NO: 168396 - protein, 97 aa, Heterodera glycines
  misc_feature (75)..(75): Xaa can be any naturally occurring amino acid
  Coding regions on vcDNA: vcDNA=SeqID_94819; Strand=+; Position=3-296
ETLTAEQLQKMLLDAEKSGEYSYEELLPIREEAKGMIENEEQMVSLYTTFIYMSRRFAEREKSSPDYSRTEETLXRGFEFSSRKCFDKFFRMPAIRI

SEQ ID NO: 168397 - protein, 84 aa, Heterodera glycines
  Coding regions on vcDNA: vcDNA=SeqID_94820; Strand=+; Position=68-322
SQRFIKAMKDEEEYQNNRVRPFEIDQTRGIADRPRLKKYIENDSAIRQLVIAYDAKEEKNDDDLIRHIHALQYRVGMKGFEGWD

SEQ ID NO: 168398 - protein, 24 aa, Heterodera glycines
  Coding regions on vcDNA: vcDNA=SeqID_94821; Strand=+; Position=79-153
NNNNNNNNFLIFFLITHDIIPWLN

SEQ ID NO: 168399 - protein, 164 aa, Heterodera glycines
  Coding regions on vcDNA: vcDNA=SeqID_94822; Strand=+; Position=84-575
RVRNMNTIIIVFLIPICCIFLANFSQFVHAASKNVCFGYDHQFQVEAYYGHVMKHIFDTRECQVSGKQCVEINPRKWTGLAPNEEISFRLRNGTEVGRAIVAELTDCSVVLMMKKRIYFSWDIQTLHISAFLSSAIFYNDQTETENLNGWTYKQYLEIGPNMWV

SEQ ID NO: 168400 - protein, 76 aa, Heterodera glycines
  Homolog annotation: Hit_ID=CAE64705.1; Match level="QueryCoverage =84%, HitCoverage=59%, E-value=7e-15, Identity=56%"; Hit description =Hypothetical protein CBG09491 [Caenorhabditis briggsae]
  Coding regions on vcDNA: vcDNA=SeqID_94823; Strand=+; Position=54-284
RYKCSLKDIYLRYLIVRLASVISGTKQIWVRERAAAEAAAILYDPAIGKNVLFKEVEQVKGKDSFPDRVKKMYNIS

SEQ ID NO: 168401 - protein, 134 aa, Heterodera glycines
  Coding regions on vcDNA: vcDNA=SeqID_94824; Strand=+; Position=3-407
DLDELETSIDQFRTFLNDQPRMRTLLALKPEVHLLLNHFVPFARQHQFLALLDEQGDEALHSVWRRLEQLWKTMPDEEQMRQLLEHHFVSNWLLDTGKIDEMKRNKNKKLVTDVRRTKKAMEKNNSILNKHSWI

SEQ ID NO: 168402 - protein, 71 aa, Heterodera glycines
  Coding regions on vcDNA: vcDNA=SeqID_94825; Strand=+; Position=3-215
AKKSQITDFTCTFLQQVLETTAEQLPLPIRAHLSNMLYPDTKIIKSQIPNKLCSVCGFDLLKGLVVVAQKK

SEQ ID NO: 168403 - protein, 203 aa, Heterodera glycines
  Homolog annotation: Hit_ID=AAO19576.1; Match level="QueryCoverage =100%, HitCoverage=74%, E-value=1e-112, Identity=99%"; Hit description=chorismate mutase [Heterodera glycines]
  Coding regions on vcDNA: vcDNA=SeqID_94826; Strand=+; Position=3-611
VSFSLLLFGLFTIRTAKSQCEKHCTKSKPMGQCNEAEEVILRNSDCAFMKKTETAFEFVVGMNGQTEDKTAPGANANGAFLCCKATQGTATLFIVGVANKRLMLAKDVVNYKFHNNISIDDFVREKQVLESVSAQGQKAGIGDNYGEKFFQDQMDANKMIQKGYVKLWAANKSLLPQNVPDLQKDTRPKVTAATEEMILALKV

SEQ ID NO: 168404 - protein, 52 aa, Heterodera glycines
  Coding regions on vcDNA: vcDNA=SeqID_94827; Strand=-; Position=52-210
FFFFFFFFEENSFLSNLCQFIENITYRSPSPCNSAVVLRVCSLPSRRLPAIG

SEQ ID NO: 168405 - protein, 176 aa, Heterodera glycines
  Coding regions on vcDNA: vcDNA=SeqID_94828; Strand=+; Position=1-528
KNSSGVGRRLNDLHVSIFNLLQQWDKENQNCCELLESICQCRIQMMDRMKANGKADNEADLHRQMFITDVILRNSELLCTSIAKFDSFLLRLRKFGPKLAALSDLISSTSSNDTSTSPDDPHQLLQFRAKELLDLFPIVLEMYEQELSFKRDSVVDLAALDDKDLFTAIISAWKHG

SEQ ID NO: 168406 - protein, 47 aa, Heterodera glycines
  Coding regions on vcDNA: vcDNA=SeqID_94829; Strand=-; Position=2-142
INRKTNKRSVKFRMTFIFPSFHIGLSDKVDDHQMENYMGEDEIGKGP

SEQ ID NO: 168407 - protein, 59 aa, Heterodera glycines
  Coding regions on vcDNA: vcDNA=SeqID_94830; Strand=-; Position=95-274
IASECINKSVCSKKRMEYTRGDDREKLGHHFPDEIMNELSIKKLDQIKVKIPRSSSCII

SEQ ID NO: 168408 - protein, 138 aa, Heterodera glycines
  misc_feature (86)..(86): Xaa can be any naturally occurring amino acid
  Homolog annotation: Hit_ID=NP_496604.1; Match level="QueryCoverage =98%, HitCoverage=50%, E-value=3e-34, Identity=52%"; Hit description =failed axon connections (30.7 kD) (2M555) [Caenorhabditis elegans] emb|CAB55031.1| Hypothetical protein Y
  Gene Ontology: Cellular component=integral to membrane; Biological process=axonogenesis
  Coding regions on vcDNA: vcDNA=SeqID_94831; Strand=+; Position=2-416
IVRDWKPDVVYLVQFPRTHNVLSPSPFALKLETWLRINGLKYRNVNNEFTKASAKGQIPFIELNGRQFADSNLIIDHLRNHFKVSXIRASARTNRALGRAFTILIEESLFRCLQYDHSIDFGWLATENGWAVHMSGFK

SEQ ID NO: 168409 - protein, 84 aa, Heterodera glycines
  Homolog annotation: Hit_ID=AAD03339.1; Match level="QueryCoverage =67%, HitCoverage=6%, E-value=1e-23, Identity=96%"; Hit description =elongation factor [Caenorhabditis elegans] pir||A40411 translation elongation factor eEF-2 - Caenorhabditis
  Gene Ontology: Mol. function=translation elongation factor activity; Biological process=protein biosynthesis
  Coding regions on vcDNA: vcDNA=SeqID_94832; Strand=+; Position=39-293
MVNFTVDEIRALMDRKKNIRNMSVIAHVDHGKSTLTDSLVSKAGIIAGAKAGETRFTGQVVTETRERKGLKEGIPSLDNFYDKL

SEQ ID NO: 168410 - protein, 76 aa, Heterodera glycines
  Coding regions on vcDNA: vcDNA=SeqID_94833; Strand=-; Position=188-418
VCGPAELGSILKWRKKLVDEQKKEEKASKESVKSAEEMVEGDTGEELEENTEFKELEEIDDLIRTAKAEEKATLKK

SEQ ID NO: 168411 - protein, 99 aa, Heterodera glycines
  Coding regions on vcDNA: vcDNA=SeqID_94834; Strand=-; Position=28-327
MCLLSGPSKKPTSWSIWTSPLAFMITSLFGSSTHTARTFLGWPAASSASIISRTRTILIGLLIFGQIYALAERERFFVCIKSQKGIGHLHCSTRYKMSR

SEQ ID NO: 168412 - protein, 56 aa, Heterodera glycines
  Coding regions on vcDNA: vcDNA=SeqID_94835; Strand=+; Position=3-173
IAANVDNVIKFATWDMFYEARRILMADLEIVSTTVVTFWSDDSLKLKTQPYQFFEF

SEQ ID NO: 168413 - protein, 159 aa, Heterodera glycines
  Homolog annotation: Hit_ID=CAE64913.1; Match level="QueryCoverage =59%, HitCoverage=83%, E-value=2e-12, Identity=39%"; Hit description =Hypothetical protein CBG09733 [Caenorhabditis briggsae]
  Coding regions on vcDNA: vcDNA=SeqID_94836; Strand=+; Position=33-512
MHCVRGKKCKSVPGMGPLAVRSSAIPLATLCLLSVLFLDQMLGTTALRCYQTQSTLMQPVQGSPTDCPMMGLSCIKSVDYSQGLVTRACQSNNCTMMSGYSCQNTSSYPPQTFCCCYGDGCNSSLRLSSFGTFPLLLGSVLSATLAFGGAKWLKTFIGM

SEQ ID NO: 168414 - protein, 53 aa, Heterodera glycines
  Coding regions on vcDNA: vcDNA=SeqID_94837; Strand=+; Position=3-161
IIIKLIFVHEHAASADELLLKPYKKISAGETSHENYHTAKVKKKKKNSRLVLS

SEQ ID NO: 168415 - protein, 55 aa, Heterodera glycines
  Coding regions on vcDNA: vcDNA=SeqID_94838; Strand=+; Position=13-180
IFLVQSSDNTCFFIQNVHTGIQQQQHPNVQPGTKSVSYNPGERSERMSSSGSGTT

SEQ ID NO: 168416 - protein, 93 aa, Heterodera glycines
  Coding regions on vcDNA: vcDNA=SeqID_94839; Strand=-; Position=13-294
KVPMVNSSFQSSKSSFVSERRSFSVRRTAQILIINELKETVSLHSSRSSVDHNLLKQVDTLQNHNSSIHFRAFVVVATTHISWQNAQNAKSPN

SEQ ID NO: 168417 - protein, 80 aa, Heterodera glycines
  Homolog annotation: Hit_ID=CAE68013.1; Match level="QueryCoverage =98%, HitCoverage=97%, E-value=3e-15, Identity=58%"; Hit description =Hypothetical protein CBG13626 [Caenorhabditis briggsae]
  Coding regions on vcDNA: vcDNA=SeqID_94840; Strand=+; Position=4-246
MLSLYTMLEFSLLVLNGIAIINRERVLNKYLKNRQHSFGAESEQSVVFRLVNLIFAVQTVLRVPLIVMNIIVIIIKLLFG

SEQ ID NO: 168418 - protein, 98 aa, Heterodera glycines
  Coding regions on vcDNA: vcDNA=SeqID_94841; Strand=-; Position=48-344
RLNILRYSFHNFHCDVSSSSSSSLIHSFSNFFSLLDLALIFRLFFGRFLLGTMVQSFFDAGRRHCDGNARGRSDGGTFGQLFAGHSAFFTNYNWSSHQ

SEQ ID NO: 168419 - protein, 62 aa, Heterodera glycines
  Coding regions on vcDNA: vcDNA=SeqID_94842; Strand=+; Position=204-392
SVPLPLLSFPVCPCFCSILSRHFPFGAIKFQRQQRKRGILPTKITLCPIDTLSPPLPSLSLK

SEQ ID NO: 168420 - protein, 188 aa, Heterodera glycines
  misc_feature (90)..(90): Xaa can be any naturally occurring amino acid
  Coding regions on vcDNA: vcDNA=SeqID_94843; Strand=+; Position=1-564
VAKISRDELLEFVRNEVTCTIGSADAPVAIPVLITTFREDTNEDILQLAKKLGYPSIEAMLDSVELSDIVEPCFTDLAKGAGNENPKKVXSYRIKNIPMVTHILSSIEESAQHRDKKAEEQRHFEILIGDPKYNPKILAGKEQLLSLIYNLGGQERFVDLLELRKLYEHNYFKELNKAALKEFFPTGQ

SEQ ID NO: 168421 - protein, 90 aa, Heterodera glycines
  Homolog annotation: Hit_ID=NP_508785.2; Match level="QueryCoverage =67%, HitCoverage=21%, E-value=2e-10, Identity=50%"; Hit description =lysosomal-associated transmembrane protein (26.6 kD) (XF199) [Caenorhabditis elegans] gb|AAA96192.3| Hypo
  Coding regions on vcDNA: vcDNA=SeqID_94844; Strand=+; Position=158-427
MRATNGRLGNLVRSPLARNKYLNNGEAKMQRRHSSAGEEMPRAVQFDESSDQYRCLCGCFHVKTGTYLIASNLKMAPNLVPEKKFIPVYS

SEQ ID NO: 168422 - protein, 114 aa, Heterodera glycines
  Homolog annotation: Hit_ID=CAE59298.1; Match level="QueryCoverage =98%, HitCoverage=91%, E-value=2e-52, Identity=84%"; Hit description =Hypothetical protein CBG02633 [Caenorhabditis briggsae]
  Gene Ontology: Mol. function=tubulin binding; Cellular component =plasma membrane; Biological process=microtubule cytoskeleton organization and biogenesis
  Coding regions on vcDNA: vcDNA=SeqID_94845; Strand=+; Position=2-346
RTYKEENSFDKRRAEGEKIRRKYPDRIPVIVEKSPNSRLRDLDKKKYLVPAELTIGQFYFLIRKRIHLRPEESLFFFINSVIPQTMTTMGQLYQDRHEEDLFMYIAYSEENVYG

SEQ ID NO: 168423 - protein, 44 aa, Heterodera glycines
  Coding regions on vcDNA: vcDNA=SeqID_94846; Strand=-; Position=74-208
FFFFFFFLIFEPLNKRKGRKHTNKNKKTHPQSSSTKNTQHNGSI

SEQ ID NO: 168424 - protein, 92 aa, Heterodera glycines
  misc_feature (4)..(4): Xaa can be any naturally occurring amino acid
  Coding regions on vcDNA: vcDNA=SeqID_94847; Strand=-; Position=1-279
SILXTSGKNCSSAANISLSVSSVREQTVLITPQIWAEVIGGRVTVALTVVRCFKVPIIHQAVFVLVKSLAVSVEGRVRIVRPIVRNASVGFN

SEQ ID NO: 168425 - protein, 87 aa, Heterodera glycines
  Coding regions on vcDNA: vcDNA=SeqID_94848; Strand=+; Position=1-264
FQKPVVPICEKDVPPTDKIVVDRLTIHKSCFKCAICDKPLQQGSCNLERGLARYGTFWLCREHSLIPPGEKEDLIVKKGYQVKTKKK

SEQ ID NO: 168426 - protein, 159 aa, Heterodera glycines
  misc_feature (91)..(91): Xaa can be any naturally occurring amino acid
  misc_feature (96)..(96): Xaa can be any naturally occurring amino acid
  Homolog annotation: Hit_ID=CAE66876.1; Match level="QueryCoverage =88%, HitCoverage=47%, E-value=2e-34, Identity=52%"; Hit description =Hypothetical protein CBG12254 [Caenorhabditis briggsae]
  Gene Ontology: Mol. function=ubiquinone biosynthesis methyltransferase activity; Cellular component=mitochondrial inner membrane; Biological process=electron transport
  Coding regions on vcDNA: vcDNA=SeqID_94849; Strand=+; Position=2-477
SFVKFCFSRPFSLGNTRNVTTHFGFTKIDVADKQEKVRTVFANVATKYDLMNDAMSLGIHRLWKEYFVQQLNLSKDSTVLDMAGRTGDVAXELYKXMRRQPIGKGSITGADINDNMLETGKTRATRALSPSDRARLSWVRADAENLQFEHNTYDFYTIS

SEQ ID NO: 168427 - protein, 79 aa, Heterodera glycines
  Coding regions on vcDNA: vcDNA=SeqID_94850; Strand=+; Position=1-240
YEEKLKKFEELKKIAADLEVLDQKLDLWKYASRSLADLQRARKADEQKQKEKVLTVLFYGYLVIALSIIAYSVIRVITM

SEQ ID NO: 168428 - protein, 147 aa, Heterodera glycines
  Homolog annotation: Hit_ID=NP_506194.1; Match level="QueryCoverage =68%, HitCoverage=27%, E-value=2e-10, Identity=35%"; Hit description =putative protein family member, with at least 5 transmembrane domains (5N251) [Caenorhabditis elegans] em
  Coding regions on vcDNA: vcDNA=SeqID_94851; Strand=+; Position=3-446
TTVAVLSPSIYLVFIIKLLYDIQINRRQLSAVVTELSAVQRKTFLQVFLISSINTMTGSICLYMQYNEASQWMITLAEFAWFHVHGFPPVIYLTLNKTVRQDCLKLYMKLFNRNRVSHIGGVTVLRPNRPQPQQRQNHLSTESPGYT

SEQ ID NO: 168429 - protein, 88 aa, Heterodera glycines
  Homolog annotation: Hit_ID=AAK92156.1; Match level="QueryCoverage =95%, HitCoverage=41%, E-value=5e-31, Identity=72%"; Hit description =ribosomal protein L13A [Spodoptera frugiperda] sp|Q962U0|R13A_SPOFR 60S ribosomal protein L13A
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_94852; Strand=+; Position=1-267
GFSTKPIIIDGKDHLLGRLAAVTSKQLLLGQKIVIVRCESINISGNFHRSKLKFLAFLRKRCNVKPSRGPFHYRAPSRIFWRTVSFHI

SEQ ID NO: 168430 - protein, 99 aa, Heterodera glycines
  Coding regions on vcDNA: vcDNA=SeqID_94853; Strand=-; Position=194-493
NIQINKLSFPFQPFDPFRLSFPPMASFPLPSFSATHHRPKSFADPSLILTSLCSPRCFSASPAPFVPLPMRFFAPGAVHVHLSAMRCSFVSPNWSYMAN

SEQ ID NO: 168431 - protein, 77 aa, Heterodera glycines
  misc_feature (38)..(38): Xaa can be any naturally occurring amino acid
  Homolog annotation: Hit_ID=CAA70477.2; Match level="QueryCoverage =88%, HitCoverage=36%, E-value=5e-16, Identity=63%"; Hit description =SEC-2 protein [Globodera pallida]
  Coding regions on vcDNA: vcDNA=SeqID_94854; Strand=+; Position=2-232
LAVSPSPFSVLDGDRVPTVDISQNTAEYRELIPEEVTXFYHELTEDDKNALNEVAERHEEFRTEEQAMEALNEKSGK

SEQ ID NO: 168432 - protein, 70 aa, Heterodera glycines
  Coding regions on vcDNA: vcDNA=SeqID_94855; Strand=-; Position=34-246
SRVFFFFFFFFDDNFLYQQSIKMYESTATSQIIARRLPPVHLRLQLQFGSAPMTTFCVVTNSIARLHSNP

SEQ ID NO: 168433 - protein, 70 aa, Heterodera glycines
  misc_feature (8)..(8): Xaa can be any naturally occurring amino acid
  misc_feature (40)..(40): Xaa can be any naturally occurring amino acid
  Homolog annotation: Hit_ID=CAE71205.1; Match level="QueryCoverage =98%, HitCoverage=73%, E-value=6e-11, Identity=44%"; Hit description =Hypothetical protein CBG18067 [Caenorhabditis briggsae]
  Coding regions on vcDNA: vcDNA=SeqID_94856; Strand=+; Position=2-211
IPYLRDPXVKNLMKSLCAYSFLILSVPLGSMFLLKNCVFXSIFCWHSRDSMLYSAIVAAVMVHLVLFVWI

SEQ ID NO: 168434 - protein, 80 aa, Heterodera glycines; identical to SEQ ID NO: 140683
  Coding regions on vcDNA: vcDNA=SeqID_94857; Strand=-; Position=1-240

SEQ ID NO: 168435 - protein, 82 aa, Heterodera glycines; identical to SEQ ID NO: 124410
  Coding regions on vcDNA: vcDNA=SeqID_94858; Strand=+; Position=1-249

SEQ ID NO: 168436 - protein, 122 aa, Heterodera glycines
  misc_feature (75)..(75): Xaa can be any naturally occurring amino acid
  Homolog annotation: Hit_ID=AAF64527.1; Match level="QueryCoverage =83%, HitCoverage=38%, E-value=2e-18, Identity=45%"; Hit description =PUR-alpha-like protein [Schistosoma mansoni]
  Coding regions on vcDNA: vcDNA=SeqID_94859; Strand=+; Position=2-370
GLEKGNGRNGVRGEEEVKGGKEIASKTLNIQSKRFYLDVTQNDRGRFIKLAEVAMNGRKNRLIMSVRMCKNINEXSGKIDGHVPSVEEVNGKAENVTIQSESIVTDRRRYYIDLRENRRGSF

SEQ ID NO: 168437 - protein, 92 aa, Heterodera glycines
  Coding regions on vcDNA: vcDNA=SeqID_94860; Strand=-; Position=2-277
NQITHSLFNCFLRPMSFSVLSLLSNCFSIFLTQNVQKSVRFLHRLQLRILNGRLSPEQRSDQKPCGPSDRHRVGHLANDLFVEQKISKEPVD

SEQ ID NO: 168438 - protein, 24 aa, Heterodera glycines
  Coding regions on vcDNA: vcDNA=SeqID_94861; Strand=-; Position=0-71
RELVSSFFFFFCRFGFLLIICCCR

SEQ ID NO: 168439 - protein, 118 aa, Heterodera glycines
  Coding regions on vcDNA: vcDNA=SeqID_94862; Strand=+; Position=1-357
FLAGSIFFSALTVSWVLWDNRNQQHKRTSSVRSILASAQRQKNMEEGAAGPRPTSDLPIRGKTDHPSRRSFHPYDRSPFSPSPIVSPFVLFLIAPSPKCVSRLARMAAPSNSIKCIVC

SEQ ID NO: 168440 - protein, 85 aa, Heterodera glycines
  Coding regions on vcDNA: vcDNA=SeqID_94863; Strand=+; Position=3-260
AEILKNSSNCQKRRNSPPNPLRVDVIEGQLPKLFSAAQHAHLQVLLHKARISDGFALALNKRKCANGLARKRSECLMRLLISFNF

SEQ ID NO: 168441 - protein, 103 aa, Heterodera glycines
  Coding regions on vcDNA: vcDNA=SeqID_94864; Strand=-; Position=2-310
CIIIISINSFIFQFFSLLDLAVIIRLFISRFLLGTMVQRFVDAGRHHCGGNARGRSDGGTFGQLFAGHSAFLTNYNWSSHHHCWKHQSFNQQQNANYSEAIHF

SEQ ID NO: 168442 - protein, 106 aa, Heterodera glycines
  Coding regions on vcDNA: vcDNA=SeqID_94865; Strand=+; Position=2-322
ILSHSIFASTSNGLSNFWNVFNTDDQDCDEWSADAEDKEFSNNYQWLHWGPISATLLVVFAGFSTSLVHVPWWDISTISGALVFMLFLLWNYLVLRYLYLACLLGP

SEQ ID NO: 168443 - protein, 94 aa, Heterodera glycines
  Coding regions on vcDNA: vcDNA=SeqID_94866; Strand=-; Position=34-318
TNILPIISIFASNCFIVASAFLRASSSSVFPSVNFSHFSISSWAYARNVFSFRNVIRYFVPQLMVPRERYAVIGLRPTLMAPNFEPWTFGHKFG

SEQ ID NO: 168444 - protein, 90 aa, Heterodera glycines
  misc_feature (62)..(62): Xaa can be any naturally occurring amino acid
  Homolog annotation: Hit_ID=NP_573176.1; Match level="QueryCoverage =88%, HitCoverage=33%, E-value=2e-11, Identity=50%"; Hit description =CG9099-PA [Drosophila melanogaster] gb|AAF48679.3| CG9099-PA [Drosophila melanogaster] gb|AAL28305.1| GH2
  Coding regions on vcDNA: vcDNA=SeqID_94867; Strand=+; Position=71-343
MDNYNNGFDLTKGVDLKTASKFFANRFACGCSVTVDSADELVIQGDFKVKVCSPSHTLPFCXLKDKLFVEIPKKWGVDEEVIEDLDDQKK

SEQ ID NO: 168445 - protein, 105 aa, Heterodera glycines
  Homolog annotation: Hit_ID=NP_492382.2; Match level="QueryCoverage =94%, HitCoverage=73%, E-value=2e-19, Identity=47%"; Hit description =Janus/Ocnus (13.2 kD) (1J389) [Caenorhabditis elegans] emb|CAB03070.2| Hypothetical protein F36A2.8 [Caen
  Gene Ontology: Mol. function=phosphohistidine phosphatase activity; Cellular component=cytosol; Biological process=dephosphorylation
  Coding regions on vcDNA: vcDNA=SeqID_94868; Strand=+; Position=97-411
ASDGAIERFLVRGYGRCKFHADILEEVQASEGEKAIEFSCVGGGRIKHEPEAKRIFVYGYSQVQNSQKDFYRLFKGFGRADHAKSVEILRERYPNYTIEWSNEGY

SEQ ID NO: 168446 - protein, 96 aa, Heterodera glycines
  misc_feature (92)..(92): Xaa can be any naturally occurring amino acid
  Homolog annotation: Hit_ID=NP_741519.1; Match level="QueryCoverage =98%, HitCoverage=21%, E-value=2e-24, Identity=55%"; Hit description =putative N-myristoylated protein of bilaterial origin (50.4 kD) (5E179) [Caenorhabditis elegans] gb|AAL65
  Coding regions on vcDNA: vcDNA=SeqID_94869; Strand=+; Position=1-291
IFKVVLTGGPCSGKTTGQARLLSFFESIGWKVYTVPETASFFLGPGRIRFPDLSSEQAAQFQTDLLKALIQNEDVFFNQAEFSEAEKIMIIXDRGR

SEQ ID NO: 168447 - protein, 120 aa, Heterodera glycines
  Homolog annotation: Hit_ID=NP_506003.1; Match level="QueryCoverage =95%, HitCoverage=94%, E-value=2e-12, Identity=36%"; Hit description =macrophage Migration Inhibitory Factor related (12.8 kD) (mif-2) [Caenorhabditis elegans] emb|CAB01412.1|
  Coding regions on vcDNA: vcDNA=SeqID_94870; Strand=+; Position=2-437
PSINLWTNLPELKLDNEFRRTFLATVANSMQKPVESTALIVQSGPNCCQIGSDPAEPAMILQIKSIGCVSADENVIHCKNISEFVQSRLGIPPDRVMIHFQSLEKHEVGKGGTTVEKMCQ

SEQ ID NO: 168448 - protein, 75 aa, Heterodera glycines
  Coding regions on vcDNA: vcDNA=SeqID_94871; Strand=-; Position=52-279
LIAIFNIAICSFILSTVCQCVDSVQLSLTELGVPSVVESPYSGEVHVASVGPISAICHLLFSDLCVHKNNATGGQ

SEQ ID NO: 168449 - protein, 84 aa, Heterodera glycines; identical to SEQ ID NO: 156507
  Coding regions on vcDNA: vcDNA=SeqID_94872; Strand=+; Position=84-338

SEQ ID NO: 168450 - protein, 101 aa, Heterodera glycines
  misc_feature (54)..(54): Xaa can be any naturally occurring amino acid
  misc_feature (69)..(69): Xaa can be any naturally occurring amino acid
  misc_feature (86)..(86): Xaa can be any naturally occurring amino acid
  Homolog annotation: Hit_ID=CAG06679.1; Match level="QueryCoverage =79%, HitCoverage=11%, E-value=1e-12, Identity=53%"; Hit description =unnamed protein product [Tetraodon nigroviridis]
  Coding regions on vcDNA: vcDNA=SeqID_94873; Strand=+; Position=380-682
CGGESEGDGDWGEKCGHVCVGDGEEEGESGEEEWSRERRRERGGAESGERWREXERERERWRVESEREXEKEWMEERRERWGRERXERERESEREKSERER

SEQ ID NO: 168451 - protein, 155 aa, Heterodera glycines
  misc_feature (42)..(42): Xaa can be any naturally occurring amino acid
  Homolog annotation: Hit_ID=NP_690845.1; Match level="QueryCoverage =47%, HitCoverage=58%, E-value=9e-10, Identity=49%"; Hit description =Mitochondrial protein of unknown function, overexpression suppresses an rpo41 mutation affecting mitochon
  Coding regions on vcDNA: vcDNA=SeqID_94874; Strand=+; Position=276-744
MPHSPLNRRTANPSLEASSPTYSNKRVNADQIRQLCPFPPHXFTSSLTLSSKCFATFPHGTCSLSDSWPYLVLDEVYHLIWAAIPNNPTPRHVKMDRHRQLDRSCTFSGAPVKGNLNKRANPSSRSIRYTSQPQRSCDSALDSSQFTRRYYGNPR

SEQ ID NO: 168452 - protein, 272 aa, Heterodera glycines
  Coding regions on vcDNA: vcDNA=SeqID_94875; Strand=+; Position=1-816
MSRNRLPPELLLEIVLCVRRGHNTPNICFSSRILRTFMEPRVALWRRVWISMLRKLSDAYLKALLTSIWNYVPLDENCQMFFGTLNGVFRQLEDREIAANCLISGRGGIKGQIRLAQGAEKVLSVSGQIHSPSIEPDRMEVHDLGNVTAGSSSTGRSLHTLCTFASVGAANDYVPAGVVTAPLALSGSKINCIGRSLVVFQEGRSALGSGVIGYAKDTRIFSDEFDEIFRNLITQYRNVNVSDCWLVLRDGTSSNPDCRAFFDMLDEILATE

SEQ ID NO: 168453 - protein, 214 aa, Heterodera glycines
  Coding regions on vcDNA: vcDNA=SeqID_94876; Strand=+; Position=3-644
FEMLRKLSDAYQKALLTPIWNLVQQILDENCRVFFGTLNGVFRQLEDREIAANCLISGRGGIKGQIRLAQGAEKVLSVSGQIHSPSIEPDRMEVHDLGNVTAGSSSTGRSLHTLCTFASVGAANDYVPAGVVTAPLALSGSKINCIGRSLVVFQEGRSALGSGVIGYAKDTRIFSDEFDEIFRNLITQYRNVNVSDCWLVLRDGTSSNPDCRAF

SEQ ID NO: 168454 - protein, 156 aa, Heterodera glycines
  Homolog annotation: Hit_ID=CAE61486.1; Match level="QueryCoverage =83%, HitCoverage=14%, E-value=2e-38, Identity=56%"; Hit description =Hypothetical protein CBG05381 [Caenorhabditis briggsae]
  Gene Ontology: Mol. function=ubiquitin-specific protease activity; Biological process=protein modification
  Coding regions on vcDNA: vcDNA=SeqID_94877; Strand=+; Position=9-476
MQKIYERPEKYNGGGRVATIPFSNGALPTNHSLYSLPVRYPKGLCGLANLGNTCFMNSALQCLSNIPELATFFINGEYSEQINTQNPLGTQGKLAQEFAELLKNMWSGRYCTFRPFRLKCVVGMFATRFNGFAQQDSHEFIAFLLDGLHEDLNRRI

SEQ ID NO: 168455 - protein, 355 aa, Heterodera glycines
  Homolog annotation: Hit_ID=AAO92288.2; Match level="QueryCoverage =100%, HitCoverage=100%, E-value=0.0, Identity=99%"; Hit description =peptidylglycine alpha-hydroxylating monooxygenase [Heterodera glycines]
  Gene Ontology: Mol. function=peptidyl-glycine monooxygenase activity; Cellular component=integral to plasma membrane; Biological process =peptide metabolism
  Coding regions on vcDNA: vcDNA=SeqID_94878; Strand=+; Position=17-1084
MGHFFPGTVSFPIFLFMLGSARCWWHFGAKQPRVFASSHAQLTPPEGIESADLRMPGVSPQMNESYLCSAFPLDSERDHFIVGFEPVLSSRHIHHVIVYGCEMPGSEDKAWDCGEMASPRGSYSHSPVCASQPDIVYAWAHNAPELLLPDGVAFRVGGSSAVQFLVLQVHYMRAEEDDTSGIRIIHTDRPQPRQAATLLLATDGRIGPKRKEQLEVACVVDESVVLHPFAFRVHTHRHGRKVGGWAVREEPKSGTDKWTLLGQRDPQLPQMLQLVANQSVTITQGDVLAARCSMENEEKREIKIGPTGEDEMCNFYLMYWTKNGQTLEQDMCFSPGPPIYRWTKSAGLNHTPKRK

SEQ ID NO: 168456 - protein, 63 aa, Heterodera glycines; identical to SEQ ID NO: 157419
  Coding regions on vcDNA: vcDNA=SeqID_94879; Strand=-; Position=124-315

SEQ ID NO: 168457 - protein, 190 aa, Heterodera glycines; identical to SEQ ID NO: 163867
  Homolog annotation: Hit_ID=CAG08516.1; Match level="QueryCoverage =91%, HitCoverage=14%, E-value=2e-17, Identity=35%"; Hit description =unnamed protein product [Tetraodon nigroviridis]
  Coding regions on vcDNA: vcDNA=SeqID_94880; Strand=+; Position=81-650

SEQ ID NO: 168458 - protein, 57 aa, Heterodera glycines; identical to SEQ ID NO: 163441
  Coding regions on vcDNA: vcDNA=SeqID_94881; Strand=+; Position=842 -1012

SEQ ID NO: 168459 - protein, 438 aa, Heterodera glycines
  misc_feature (274)..(274): Xaa can be any naturally occurring amino acid
  Homolog annotation: Hit_ID=AAK26375.1; Match level="QueryCoverage =100%, HitCoverage=100%, E-value=0.0, Identity=99%"; Hit description =class V aminotransferase [Heterodera glycines]
  Gene Ontology: Mol. function=alanine-glyoxylate aminotransferase activity; Cellular component=peroxisome; Biological process =glyoxylate cycle
  Coding regions on vcDNA: vcDNA=SeqID_94882; Strand=+; Position=46-1360
MLSRMLSSAVAVPRMCESNKKLLRKGATFVGLLCGRMANSTFTATVTPPHRLLRPLHINEKKLFGPGPNNMPPLVQEGLVQPLLGHMHPEFFEIMDDVKAGIKYIFQTENALTFAVSGTGHAGMECAILNLLEPGQTILVVQNGVWGLRAANLAERLGIKVHRLVVPEGEVINLDDFAEAVDNYRPQVAFVCHGESSTGVVHPLERFGDICNAYDVLFLVDTVASICGAPFHADALKVDCVYAATQKVLNCPPGLAPISFSEKALEKITKRKTXRVPSFYFDALELGNYWGCFDEPRRYHHTAPISLVYALREGLSAVAQEGIGHMVNRHKINAKLLYDAFDQLGLELFVQKENNRLPCLTTVRVPEGVDWKAVQDKLMAQGFEIAGGLGPTAGKIWRIGTFGINSNPEDIESLKQALKGALYEQEEKGQSDHFKAAI

SEQ ID NO: 168460 - protein, 198 aa, Heterodera glycines
  Homolog annotation: Hit_ID=CAE71263.1; Match level="QueryCoverage =98%, HitCoverage=43%, E-value=2e-19, Identity=29%"; Hit description =Hypothetical protein CBG18145 [Caenorhabditis briggsae]
  Gene Ontology: Cellular component=extracellular space
  Coding regions on vcDNA: vcDNA=SeqID_94883; Strand=+; Position=64-657
MEWYSGDVTTALNIYQEKKGILIVYVFSDDVNSTKFDQIWDSFDHSILDRVPYVAIRLAKDTEGANQFAQFFPTPVFPVCYFLGLNAQPLEVLTAVEQMTIERLNSSLAKAFSLYNDQMKEQGFATDAVSFQSKSSENDSGKNTSENVPEPLNATSNDEKLEYYRKRLEEKHKEDAMKKEQEEREKEIMRRNEGKALA

SEQ ID NO: 168461 - protein, 99 aa, Heterodera glycines
  misc_feature (67)..(67): Xaa can be any naturally occurring amino acid
  Homolog annotation: Hit_ID=EAA16547.1; Match level="QueryCoverage =97%, HitCoverage=83%, E-value=4e-17, Identity=49%"; Hit description =hypothetical protein [Plasmodium yoelii yoelii]
  Coding regions on vcDNA: vcDNA=SeqID_94884; Strand=-; Position=52-352
TAGRWPWKSESAKECVTTHLPNQLALKMDGAGAGHLYSTVIGLYTCLSRSLAMTCRRVVVVALKALXWARPELPPVQILVVVANIQVRSLKTEVEKGST

SEQ ID NO: 168462 - protein, 232 aa, Heterodera glycines
  misc_feature (36)..(36): Xaa can be any naturally occurring amino acid
  misc_feature (50)..(50): Xaa can be any naturally occurring amino acid
  misc_feature (62)..(62): Xaa can be any naturally occurring amino acid
  misc_feature (100)..(100): Xaa can be any naturally occurring amino acid
  misc_feature (158)..(158): Xaa can be any naturally occurring amino acid
  Homolog annotation: Hit_ID=T02995; Match level="QueryCoverage=83%, HitCoverage=37%, E-value=2e-41, Identity=51%"; Hit description =unspecific monooxygenase (EC 1.14.14.1) - common tobacco dbj|BAA10929.1| cytochrome P450 like_TBP [Nicotiana t
  Coding regions on vcDNA: vcDNA=SeqID_94885; Strand=+; Position=27-767
KILHKVRLESSSTGCCFPARFAKPVPLAVVSLDSRXTVGISLIHSCASVXPTRHLGTLRESXTPAVYPRLIKFPWLNIQSTGQKSDTVNVHKDHPSPLFXLDSRIPRVRASSKLVVQRQPNAPQAALTTSPRTIPERTARSHGQKPPVSRNSPADPTXSQFFSRSYESNLPTSLTYIILSTRGCSPWRPAADIGTIRQEIQIASLAFSRAVWSARDTTGTAVLYGRNIPISG

SEQ ID NO: 168463 - protein, 52 aa, Heterodera glycines
  Coding regions on vcDNA: vcDNA=SeqID_94886; Strand=-; Position=93-251
GYRMIPRMSNLFDFDKSYGQFLVEICRGVLKLAIFRSFVQDLVFMNFLSDWR

SEQ ID NO: 168464 - protein, 46 aa, Heterodera glycines
  Coding regions on vcDNA: vcDNA=SeqID_94887; Strand=+; Position=38-178
RGGIVIQSHQIISKIQILVDWKLKQLLNLYNFKSFKFHQIFSCLII

SEQ ID NO: 168465 - protein, 311 aa, Heterodera glycines; identical to SEQ ID NO: 163043
  Homolog annotation: Hit_ID=NP_494721.1; Match level="QueryCoverage =100%, HitCoverage=61%, E-value=1e-123, Identity=67%"; Hit description=glycerol kinase (55.2 kD) (2E383) [Caenorhabditis elegans] gb|AAA79749.1| Hypothetical protein R11F4.1
  Gene Ontology: Mol. function=glycerol kinase activity; Cellular component=mitochondrial outer membrane; Biological process=glycerol metabolism
  Coding regions on vcDNA: vcDNA=SeqID_94888; Strand=+; Position=58-990

SEQ ID NO: 168466 - protein, 231 aa, Heterodera glycines
  misc_feature (179)..(179): Xaa can be any naturally occurring amino acid
  Homolog annotation: Hit_ID=AAK70645.1; Match level="QueryCoverage =91%, HitCoverage=45%, E-value=7e-38, Identity=42%"; Hit description =Protein with tau-like repeats protein 1, isoform a [Caenorhabditis elegans] ref|NP_497253.2| protein with
  Gene Ontology: Mol. function=cytoskeletal regulatory protein binding; Cellular component=plasma membrane; Biological process=apoptosis
  Coding regions on vcDNA: vcDNA=SeqID_94889; Strand=+; Position=39-729
MISSTAVPRPLRSSNQQKQQPNALTKQNGAHQQKTPIKAREDSRNRNDALGAQKPNGHSPRTPSVPPVNKRYAHVKSKVGSITEYTPSPSRVKIFHESVRVSATPKVGSLQNASHVPAGGNVTIENRKLNFREAAKPRVEDKSEVPIPKSEKKIATQKLEWKAQPKVGSLDNVKHKPAXGGNLKIFHESVRVKCESKVGSLDNIGHVPGGGNVKISDYARSVSRSGDGCRR

SEQ ID NO: 168467 - protein, 71 aa, Heterodera glycines; identical to SEQ ID NO: 162404
  Coding regions on vcDNA: vcDNA=SeqID_94890; Strand=+; Position=57-272

SEQ ID NO: 168468 - protein, 183 aa, Heterodera glycines; identical to SEQ ID NO: 162255
  Homolog annotation: Hit_ID=CAE73340.1; Match level="QueryCoverage =83%, HitCoverage=86%, E-value=2e-26, Identity=41%"; Hit description =Hypothetical protein CBG20771 [Caenorhabditis briggsae]
  Coding regions on vcDNA: vcDNA=SeqID_94891; Strand=+; Position=49-600

SEQ ID NO: 168469 - protein, 134 aa, Heterodera glycines; identical to SEQ ID NO: 163887
  Coding regions on vcDNA: vcDNA=SeqID_94892; Strand=-; Position=68-472

SEQ ID NO: 168470 - protein, 53 aa, Heterodera glycines
  Coding regions on vcDNA: vcDNA=SeqID_94893; Strand=-; Position=2-160
KFSQLKGSLLCVTPFLVLALGVDDAYLMLIAWQRLRIRRALAFLAQFAQILVH

SEQ ID NO: 168471 - protein, 118 aa, Heterodera glycines; identical to SEQ ID NO: 163983
  Homolog annotation: Hit_ID=NP_508656.1; Match level="QueryCoverage =38%, HitCoverage=69%, E-value=7e-09, Identity=54%"; Hit description =putative endoplasmic reticulum protein, with a transmembrane domain (XE407) [Caenorhabditis elegans] gb|A
  Coding regions on vcDNA: vcDNA=SeqID_94894; Strand=+; Position=74-430

SEQ ID NO: 168472 - protein, 148 aa, Heterodera glycines; identical to SEQ ID NO: 162932
  Coding regions on vcDNA: vcDNA=SeqID_94895; Strand=+; Position=1-447

SEQ ID NO: 168473 - protein, 129 aa, Heterodera glycines
  Coding regions on vcDNA: vcDNA=SeqID_94896; Strand=+; Position=1-387
RRSVLSAPANFCSSLSFCDICNRKFISPRGVALHKGKAHKGESSSKLVKPKNMAKCPIATRAVKRGRPRKVGVVPPTFVDTAKKGRAHSIAAVPPIGHQNLLSGRHRTKPTNAATAQQQPNGNVQIPKL

SEQ ID NO: 168474 - protein, 93 aa, Heterodera glycines; identical to SEQ ID NO: 162242
  Coding regions on vcDNA: vcDNA=SeqID_94897; Strand=-; Position=2-280

SEQ ID NO: 168475 - protein, 160 aa, Heterodera glycines
  Coding regions on vcDNA: vcDNA=SeqID_94898; Strand=+; Position=3-482
MFNNHANHFMPNFCIPPPPPPQLPQPLNSARVFFPPVPHHHHPAYYLQPQHAHPHMNPQFFNLSVPPPPITQNISSLIAANINNYPTRHPLNGTHQITTSERFSKTFHTGHANGFTSKGNGAPLSRSRKRFLEQITNEEGTSGELRIELDTAPKNRQLSG

SEQ ID NO: 168476 - protein, 80 aa, Heterodera glycines; identical to SEQ ID NO: 162332
  Coding regions on vcDNA: vcDNA=SeqID_94899; Strand=+; Position=48-290

SEQ ID NO: 168477 - protein, 143 aa, Heterodera glycines
  Homolog annotation: Hit_ID=CAE58969.1; Match level="QueryCoverage =84%, HitCoverage=38%, E-value=5e-18, Identity=43%"; Hit description =Hypothetical protein CBG02241 [Caenorhabditis briggsae]
  Gene Ontology: Mol. function=protein binding; Cellular component =interleukin-1 receptor complex; Biological process=intracellular signaling cascade
  Coding regions on vcDNA: vcDNA=SeqID_94900; Strand=+; Position=38-466
MATSSNSTTTVAEPLPTKTSMKIAELRSRVLIGDLPADFLRIPPVSSSVNLSSAPDQIVAQQPQQIVVPYGHPYAFVNPAEHFYSFVPPHTRGRIAVKIVEAKLTKSYGLPGVRMDPYVRLRIGNTLFETPTCVNGGKSPHWN

SEQ ID NO: 168478 - protein, 328 aa, Heterodera glycines
  misc_feature (109)..(109): Xaa can be any naturally occurring amino acid
  misc_feature (203)..(203): Xaa can be any naturally occurring amino acid
  Homolog annotation: Hit_ID=CAC33829.1; Match level="QueryCoverage =99%, HitCoverage=100%, E-value=1e-139, Identity=75%"; Hit description=annexin 2 [Globodera pallida]
  Gene Ontology: Mol. function=phospholipase inhibitor activity; Cellular component=plasma membrane; Biological process=skeletal development
  Coding regions on vcDNA: vcDNA=SeqID_94901; Strand=+; Position=82-1067
MMSNATKNILGTPTIVDNVSFDPKVSANFLHKAIEEKRKDEIIHLLCTISNQQRQELAREFKQLFGEDLSAKLKKALSGDFEELILALLEPPAVYDAQQMHRAMSGLGXSEGSVLIEILVTHSNRQIDEMKRVYEQLYGHPLEKDIVGDTSGAFQRLLVSLCNDSRDESWSSDPIRANMTARALFKESEVESGVNDVLFNQVXLANENFIQLHLIFEEYQKVSGHPIEQAIQQQFSGDTRDGYLAVVECVHNRHAFFAKVLQNSTKSFLGIGRRDSDLIRLIVTRAECDMVEIKEQFMQMFNTPLEKAIESNCSGPYKDGLLTLVKGN

SEQ ID NO: 168479 - protein, 200 aa, Heterodera glycines
  Homolog annotation: Hit_ID=1NEX; Match level="QueryCoverage=76%, HitCoverage=88%, E-value=1e-17, Identity=32%"; Hit description=Chain C, Crystal Structure Of Scskp1-Sccdc4-Cpd Peptide Complex pdb|1NEX|A Chain A, Crystal Structure Of Scskp1-
  Gene Ontology: Mol. function=protein binding; Cellular component=SCF ubiquitin ligase complex; Biological process=mitotic spindle orientation
  Coding regions on vcDNA: vcDNA=SeqID_94902; Strand=+; Position=38-637
MADEKNMVVEKNTSSSTSATDSSPDGGNYIKEEMLQREVFCECLGGERVSVRASLMFQSQTFANMWKSLNVDTNELPDDFVFPMTSVAVPVFKKIINWMESHVGQQVPEFEEDPNTRERKWFVQTDFEKDFFKVEVEELVDFLNASNFLNLQSLYRHSCQAMAALLKDRSPEEIRDLLGIEDDLTEEHKAEIRPQNVWCN

SEQ ID NO: 168480 - protein, 111 aa, Heterodera glycines
  Coding regions on vcDNA: vcDNA=SeqID_94903; Strand=-; Position=23-358
SYQFITLSEPSFAAAFFSVLISAWGKAQTDAEQVENWHTKLPARTISIACACRTTAAPVFKLSSSTTADRSFSFEFQHISSIGRAEGERSQKQAAEDDWKKAWQPFLEIEF

SEQ ID NO: 168481 - protein, 119 aa, Heterodera glycines; identical to SEQ ID NO: 163686
  Coding regions on vcDNA: vcDNA=SeqID_94904; Strand=-; Position=3-362

SEQ ID NO: 168482 - protein, 148 aa, Heterodera glycines; identical to SEQ ID NO: 162402
  Homolog annotation: Hit_ID=NP_783594.1; Match level="QueryCoverage =71%, HitCoverage=83%, E-value=7e-22, Identity=47%"; Hit description =histone 1, H2ba [Mus musculus] emb|CAI35973.1| OTTMUSP00000000673 [Mus musculus] gb|AAO06249.1| histone p
  Gene Ontology: Mol. function=DNA binding; Cellular component =nucleosome; Biological process=nucleosome assembly
  Coding regions on vcDNA: vcDNA=SeqID_94905; Strand=+; Position=114-560

SEQ ID NO: 168483 - protein, 93 aa, Heterodera glycines; identical to SEQ ID NO: 133075
  Coding regions on vcDNA: vcDNA=SeqID_94906; Strand=+; Position=6-287

SEQ ID NO: 168484 - protein, 54 aa, Heterodera glycines
  Coding regions on vcDNA: vcDNA=SeqID_94907; Strand=-; Position=0-161
FDIITSLVSISFLNTDIWAHIFSFCRGTIPSHSRMNSHKSAQCKSPASDCHNLA

SEQ ID NO: 168485 - protein, 134 aa, Heterodera glycines
  Coding regions on vcDNA: vcDNA=SeqID_94908; Strand=-; Position=21-425
LNKYLFCKIKNSANSSNKRKTKKATRITKTATAIDQWVGHRSHGSATARTFLEMFKHQCFCVQNPTDTIGNARLSPSVQFTRKTRIGDAKVETSIIHFQNLFLQSLLLNFCLELLDKMVELMVTAGHFHDAITK

SEQ ID NO: 168486 - protein, 87 aa, Heterodera glycines; identical to SEQ ID NO: 163817
  Coding regions on vcDNA: vcDNA=SeqID_94909; Strand=-; Position=55-318

SEQ ID NO: 168487 - protein, 157 aa, Heterodera glycines
  Coding regions on vcDNA: vcDNA=SeqID_94910; Strand=+; Position=20-490
TLKMTDIQAYAGPFIVNDVVSYFLKDGVWYYRNAFIPINLECKQPPPAEIVKEWIDKYGSAAPKSTKQAKQKVATPLKKSSHKPKLSSADKDSEMLKRKRKHEQMLSNSSTSSSSTSKPLPVSAQKVVSSSALPTPGAPSPNIPKQKQPAKPSSAPT

SEQ ID NO: 168488 - protein, 163 aa, Heterodera glycines
  Homolog annotation: Hit_ID=AAM20116.1; Match level="QueryCoverage =100%, HitCoverage=90%, E-value=5e-84, Identity=100%"; Hit description=unknown protein [Arabidopsis thaliana] gb|AAL59970.1| unknown protein [Arabidopsis thaliana] gb|AAG52640
  Coding regions on vcDNA: vcDNA=SeqID_94911; Strand=+; Position=32-520
MAETAETINTTISSPPPESESSTTISAMTDPTSQEAASKDTDLTKEAESEKKPGGISLRIWPPTQKTRDAVLNRLIETLSTESILSKRYGTLKSDDATTVAKLIEEEAYGVASNAVSSDDDGIKILELYSKEISKRMLESVKARSNASVGNGSVEDANTDASE

SEQ ID NO: 168489 - protein, 51 aa, Heterodera glycines; identical to SEQ ID NO: 163642
  Coding regions on vcDNA: vcDNA=SeqID_94912; Strand=+; Position=3-158

SEQ ID NO: 168490 - protein, 323 aa, Heterodera glycines
  misc_feature (275)..(275): Xaa can be any naturally occurring amino acid
  Homolog annotation: Hit_ID=CAE58522.1; Match level="QueryCoverage =99%, HitCoverage=100%, E-value=1e-117, Identity=66%"; Hit description=Hypothetical protein CBG01674 [Caenorhabditis briggsae]
  Gene Ontology: Mol. function=transaldolase activity; Cellular component=cytoplasm; Biological process=carbohydrate metabolism
  Coding regions on vcDNA: vcDNA=SeqID_94913; Strand=+; Position=30-1003
MSLSVLDQIKQHSTIVADTGDFHAIEVFKPTDATTNPSLILAAAKIEKYKELILKAVKYAKERAAGQSKEAVIELASNKLFVLFGKEILNIVPGRVSTEVDARLSFDKEGSIAKALSLIKLYEEEGIEKERILIKLSSTWEGIEAAKVLESQHGIHCNMTLLFNFYQAVACAQAKVTLISPFVGRILDWFVKNSDKKEFDRITDPGVQSVKRIFNYYKKFGHKTQVMAASFRNTEEIKGLVGCDLMTISPALLGELAKDSDGGWTDDDRAKCRQXELEQIEVDEKIFRWQMNEDAMADEKLADGIRRFAVDAIKLEELIRSNL

SEQ ID NO: 168491 - protein, 202 aa, Heterodera glycines
  Homolog annotation: Hit_ID=NP_001002481.1; Match level="QueryCoverage= 97%, HitCoverage=88%, E-value=2e-49, Identity=51%"; Hit description =zgc:92869 [Danio rerio] gb|AAH76329.1| Zgc:92869 [Danio rerio]
  Gene Ontology: Mol. function=maleylacetoacetate isomerase activity; Biological process=tyrosine catabolism
  Coding regions on vcDNA: vcDNA=SeqID_94914; Strand=+; Position=36-641
MATKPLLYCYWRSSCSWRVRIALHLKGIEFDQRIVNLLNGDQNKDEFLSKLPFAKVPVFVHDNLVLSESMAIIEYLDEKFPEPNPLFPKSAEDRAHVRALALQIVANTQPLQNLGVLKHLSEEPAKRNAWARHWIEQSFNVFEKALAKTAGKYAYGDQISLADICIPPQVYNAKRFGVDMAQFPIIARLDETLAEVPAFKVP

SEQ ID NO: 168492 - protein, 60 aa, Heterodera glycines
  Homolog annotation: Hit_ID=CAE62810.1; Match level="QueryCoverage =100%, HitCoverage=18%, E-value=2e-19, Identity=69%"; Hit description= Hypothetical protein CBG06986 [Caenorhabditis briggsae]
  Gene Ontology: Mol. function=structural constituent of cuticle; Cellular component=extracellular; Biological process=cuticle biosynthesis (sensu Nematoda)
  Coding regions on vcDNA: vcDNA=SeqID_94915; Strand=+; Position=2-184
GENGQPGQPGNPGPQGYPGDGGSPGQPGNPGGSGEPGQPGAQGSSGQCYHCPPPRTAPGY

SEQ ID NO: 168493 - protein, 178 aa, Heterodera glycines
  misc_feature (105)..(105): Xaa can be any naturally occurring amino acid
  Homolog annotation: Hit_ID=CAA65506.1; Match level="QueryCoverage =100%, HitCoverage=64%, E-value=3e-55, Identity=55%"; Hit description= cuticular collagen [Teladorsagia circumcincta]
  Gene Ontology: Mol. function=structural constituent of cuticle; Cellular component=extracellular; Biological process=cuticle biosynthesis (sensu Nematoda)
  Coding regions on vcDNA: vcDNA=SeqID_94916; Strand=+; Position=3-540
PGGDGQPGGSGQPGAPGQAAPRPYPPSGGCVPQCEAAQPGLPGPPGPPGPEGQNGQPGQSAPPASPGRPGPQGPPGPDGQPGNPGESGQPGQPGKLTQGPPVVGXPGPSGPPGQPGQPGENGQPGQPGNPGPQGYPGDGGSPGQPGNPGGSGEPGQPGAQGSSGQCYHCPPPRTAPGY

SEQ ID NO: 168494 - protein, 248 aa, Heterodera glycines
  Homolog annotation: Hit_ID=CAB88203.1; Match level="QueryCoverage =100%, HitCoverage=82%, E-value=1e-127, Identity=83%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_94917; Strand=+; Position=2-745
QETHIVLGIASVCSLLAIIATVVTLPSLYSEMSQMNSKVRNGVEAFRVNTDSAWTDLMDVQVVVTPPSKPRANPFNSIFRAKRQLPGHCQCAGLQQPSCPPGPPGPAGPPGQPGQPGSAGQPGQAGQPGQPAAPCPPQNIPCPRCPAGPPGRPGGQGPPGQQGAPGQPGTPAQGGGPGTPGAPGPQGQPGQPGRPGASGQPGQPGANGVVSRPIPGPKGPPGAPGQNGNPGGQGQPGQPGGQGPPGPP

SEQ ID NO: 168495 - protein, 275 aa, Heterodera glycines
  misc_feature (8)..(8): Xaa can be any naturally occurring amino acid
  misc_feature (15)..(15): Xaa can be any naturally occurring amino acid
  misc_feature (28)..(28): Xaa can be any naturally occurring amino acid
  misc_feature (84)..(84): Xaa can be any naturally occurring amino acid
  misc_feature (105)..(105): Xaa can be any naturally occurring amino acid
  misc_feature (122)..(122): Xaa can be any naturally occurring amino acid
  misc_feature (169)..(169): Xaa can be any naturally occurring amino acid
  misc_feature (199)..(199): Xaa can be any naturally occurring amino acid
  misc_feature (211)..(211): Xaa can be any naturally occurring amino acid
  misc_feature (242)..(242): Xaa can be any naturally occurring amino acid
  misc_feature (264)..(264): Xaa can be any naturally occurring amino acid
  Homolog annotation: Hit_ID=CAB88203.1; Match level="QueryCoverage =100%, HitCoverage=90%, E-value=1e-132, Identity=80%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_94918; Strand=+; Position=19-845
MQETHIVXLGIASVXSLLAIIATVVTLXSLYSEMSQMNSKVRDGVEAFRVNTDSAWTDLMDVQVVVTPPSKPRDNPFNSIFRVXGQLPGHCQCAGLQQPSCPPGXPPGPSGPPGQPGQPGGXQGQPGQPGQPGQPAPPCPPQNIPCPRCPAGPPGRPGGQGPARTARSXGQPGTPAQGGGPGTPGAPGPQGQPGQPGRXGAAGQPGQPGAXGVVSRPIPGPKGPPGAPGQNGNPGSQGQPGXQPGGQGPPGPPGAPGQPGQPGXSGQPGQPGAPG

SEQ ID NO: 168496 - protein, 170 aa, Heterodera glycines
  misc_feature (120)..(120): Xaa can be any naturally occurring amino acid
  Homolog annotation: Hit_ID=AAR06361.1; Match level="QueryCoverage =94%, HitCoverage=98%, E-value=6e-32, Identity=54%"; Hit description =histone H3.2 protein [Oryza sativa (japonica cultivar-group)] ref|XP_ 493701.1| histone H3 [Oryza sativa (j
  Gene Ontology: Mol. function=DNA binding; Cellular component =nucleosome; Biological process=embryogenesis and morphogenesis
  Coding regions on vcDNA: vcDNA=SeqID_94919; Strand=+; Position=6-519
MARTKQTARKTQSQKGFSSSSGSQHMQSQLHNLRKQLATKRPNPKRGIGYKELPPVKIAQKRHHKKGALALKEIRKYQKSVNLLIPRRPFMRLVREVTQDMSQSTDLRWQGLALLAIQVXEAAELYLVSLFDDTNLCAIHASRVTIMPKDMQLVRKIRGETFLKPLSSQY

SEQ ID NO: 168497 - protein, 159 aa, Heterodera glycines
  Coding regions on vcDNA: vcDNA=SeqID_94920; Strand=+; Position=1-477
HSFCHFLWLNYTKALVTTHSLITQMLCFATSKCFPQSFDQYKSRSVSLIFIFLLTIHLLFAEIASEKSSKETFKDSLVQNSPKSDLNFLFQQRSTQKTAFIRHHYASSVANGQSGQHSRHRRRIPTGIIGKLIAKLSGKTGKIAATASKSDDIFVGTAK

SEQ ID NO: 168498 - protein, 65 aa, Heterodera glycines
  Coding regions on vcDNA: vcDNA=SeqID_94921; Strand=-; Position=2-196
NLLLFAPRIHYMRTQAKEQLTHQITSIFLLLSNPIALSIAGSTFFSSFQHFVLKFLHRAESNMSN

SEQ ID NO: 168499 - protein, 153 aa, Heterodera glycines; identical to SEQ ID NO: 163972
  Homolog annotation: Hit_ID=NP_477414.1; Match level="QueryCoverage =99%, HitCoverage=98%, E-value=5e-53, Identity=62%"; Hit description =CG5788-PA [Drosophila melanogaster] gb|AAF57787.1| CG5788-PA [Drosophila melanogaster] gb|AAS93730.1| RE4
  Gene Ontology: Mol. function=ubiquitin-protein ligase activity; Cellular component=proteasome complex (sensu Eukarya); Biological process=protein modification
  Coding regions on vcDNA: vcDNA=SeqID_94922; Strand=+; Position=108-569

SEQ ID NO: 168500 - protein, 122 aa, Heterodera glycines
  Homolog annotation: Hit_ID=CAE67660.1; Match level="QueryCoverage =86%, HitCoverage=78%, E-value=2e-11, Identity=36%"; Hit description =Hypothetical protein CBG13223 [Caenorhabditis briggsae]
  Coding regions on vcDNA: vcDNA=SeqID_94923; Strand=+; Position=17-382
MKTALELAKKIVCGVFIAHVFRQKVGRILTGVGDSMLPTIHDGDILWARVWDPNDALRPGDVVCLVDPLDAEEYVIKRISAVHKDCIEVRGDNAKKSLDSRKYGPVPAGLVRYRVSLRLLPL

SEQ ID NO: 168501 - protein, 152 aa, Heterodera glycines
  Homolog annotation: Hit_ID=CAE58634.1; Match level="QueryCoverage =86%, HitCoverage=95%, E-value=2e-51, Identity=68%"; Hit description =Hypothetical protein CBG01802 [Caenorhabditis briggsae]
  Coding regions on vcDNA: vcDNA=SeqID_94924; Strand=+; Position=51-509
MPLVHNCIACTRHSLLIVLGLIMIMANCGQAMRQQAVAVRGQLRCGNRPASGVKVKLWDEDDGPDPDDVLDEAFTDSSGSFQMRGSTRELTNIDPVLKIYHDCDDGIMPGQRKVKLRIPSQYITNGGLARRTFEVGVLNLETVFAGEERDFI

SEQ ID NO: 168502 - protein, 234 aa, Heterodera glycines
  Coding regions on vcDNA: vcDNA=SeqID_94925; Strand=-; Position=15-719
LFSQIFNQMACSVRLDHHILLPSHFFPKFPPHGPPPPIPPPYGEPYIPRLARRAAGSLSTLSSCAVISAEKAHKTTKRKAMIKRRGDILRAISARVLKASCRIRHEGMANFLYIYSSLRILPQSVSSAFSIVHCQRNISIDNKCHQQNQAFAKGNNFQLPKQQKDAREREALERQLRAAPRGRFSLPNVDRVYNSDEVYEELCKPAKDRAKALFLLSIVVITVCFITDLEHSRK

SEQ ID NO: 168503 - protein, 263 aa, Heterodera glycines
  misc_feature (145)..(145): Xaa can be any naturally occurring amino acid
  Homolog annotation: Hit_ID=NP_510634.1; Match level="QueryCoverage =80%, HitCoverage=63%, E-value=2e-46, Identity=45%"; Hit description =misexpression suppressor of KSR (35.6 kD) (XQ738) [Caenorhabditis elegans] emb|CAA92227.1| Hypothetical p
  Gene Ontology: Cellular component=cytoplasm; Biological process=cell differentiation
  Coding regions on vcDNA: vcDNA=SeqID_94926; Strand=+; Position=138-927
MSNLNFEDNLQRVQVEIQWKQCLYNPIVAPFADVGSYPIFTDEFKGTRKCTLDVYVQGNLEHLDDKVVFLTVHDVGKTYLSCVDLANSPTLSPLVGQRAVFLHVSVPGQAPGAENFVGDFPSMEQLGDGLSQVMEQFNLSKCIAXGESAGADIVCRFAMSFPQLVVGAVLVHCISTTHGIIASIKELFTNLLLNDGEMTHSAWNWLLVHKFGNHEMDKEKRNYVDAIKAGGMNEYNLSRYLYAFSHRDELTDRLKDQLGKVDV

SEQ ID NO: 168504 - protein, 136 aa, Heterodera glycines
  Homolog annotation: Hit_ID=CAE64747.1; Match level="QueryCoverage =70%, HitCoverage=17%, E-value=3e-23, Identity=54%"; Hit description =Hypothetical protein CBG09535 [Caenorhabditis briggsae]
  Gene Ontology: Mol. function=sodium dependent multivitamin transporter activity; Cellular component=integral to membrane; Biological process=molecular hydrogen transport
  Coding regions on vcDNA: vcDNA=SeqID_94927; Strand=+; Position=109-516
MICPNESEPDTANGEQHKNSAAMNGHGFVPSGNAETEGKADKRHQQQRKLYKADENPPFLLTFLFGFQQVMVSLSVLVSIPFLISDEVCPGRDRDQLRVRLIAATFVTCGIGTILQTAFGMRLALLQGVAFAYIPS

SEQ ID NO: 168505 - protein, 121 aa, Heterodera glycines
  Homolog annotation: Hit_ID=CAE72119.1; Match level="QueryCoverage =90%, HitCoverage=27%, E-value=2e-12, Identity=35%"; Hit description =Hypothetical protein CBG19214 [Caenorhabditis briggsae]
  Coding regions on vcDNA: vcDNA=SeqID_94928; Strand=+; Position=3-368
KKEVPTNEILHCEGGQVDFSIDDSHIIKSEKGEGEKGDEELIPIGSPVCKKPRDAGHRCHGRAGGPIAAKNLKWYFDTETFLCLAFSYNGCGGNGNHFDSPADCWDKCKLGKAETNFLFID

SEQ ID NO: 168506 - protein, 74 aa, Heterodera glycines
  Coding regions on vcDNA: vcDNA=SeqID_94929; Strand=+; Position=15-239
IIKFYFFKNAPFFARRLCAPLSHQSVHFDGRRAKVSFVGLGEAGHTVSKRLRDINISKDQMLDVRKDVGEPVTD

SEQ ID NO: 168507 - protein, 103 aa, Heterodera glycines
  Coding regions on vcDNA: vcDNA=SeqID_94930; Strand=-; Position=74-385
LSSYFIETLFDLRVQHFFFYHKLFFLVFHRLSLLPFSIFHYLSHHFLQPQWPPPPWPQRRSRIIGDAMFGPPSTEFSTVPWVPAKIAKVIRKRATKKRRGDIL

SEQ ID NO: 168508 - protein, 190 aa, Heterodera glycines
  Homolog annotation: Hit_ID=AAR01198.1; Match level="QueryCoverage =46%, HitCoverage=68%, E-value=2e-13, Identity=42%"; Hit description =cellulase binding protein [Heterodera glycines] gb|AAN32887.1| cellulose binding protein [Heterodera glyci
  Coding regions on vcDNA: vcDNA=SeqID_94931; Strand=+; Position=25-597
MTKFVCVLLLLFAWTLQIVHPSVVPSDQIYIIEFNRDNSNNQQDNDLKSANGVEDSKMTNGVISQDSAQVVTTNGTTELETDPLTVSVELQRGGRAVGNQFNINFTDISYVLVCSARFRISLPSDTTLRSHSKMTAVPNTSDQFTLPDGVHLYPGLSHTAEVILSGNGQPEVTILDTLTVLTTEKCPNDV

SEQ ID NO: 168509 - protein, 133 aa, Heterodera glycines
  Coding regions on vcDNA: vcDNA=SeqID_94932; Strand=+; Position=204-605
RMFRPTELIFYTNNSTSNSSNTEEQLLTLIIFKEYIRKKQHQFWNGTTARKRKTTANEEATSNRTEDQRKERETKEQFIRTLDQHQQQQNEQQNGDKRLRLLTKQKHKHRQVQQQNNNNRRRSYCLLLRLIRQ

SEQ ID NO: 168510 - protein, 165 aa, Heterodera glycines
  Homolog annotation: Hit_ID=NP_990258.1; Match level="QueryCoverage =88%, HitCoverage=19%, E-value=2e-10, Identity=32%"; Hit description =KU70 protein [Gallus gallus] dbj|BAA32018.1| Ku70 [Gallus gallus] sp|O93257|KU70_CHICK ATP-dependent DNA
  Coding regions on vcDNA: vcDNA=SeqID_94933; Strand=+; Position=3-497
KTNTPPKLCALVPQSADRIPSGCTLAREYFYDGFHLVEIPFAEKSRSMEKRLLPPDGGVGTWQLANPDQVEAAKQFVKKLTNTKFSPDDFANPVLQQHYKAVEMVALDLPFDSEQFKKEAAENDKLIPYFKNPTFEQRVAKELEEFAGICETIAETREKGKRKSA

SEQ ID NO: 168511 - protein, 116 aa, Heterodera glycines; identical to SEQ ID NO: 163670
  Homolog annotation: Hit_ID=CAE59298.1; Match level="QueryCoverage =100%, HitCoverage=94%, E-value=6e-55, Identity=84%"; Hit description= Hypothetical protein CBG02633 [Caenorhabditis briggsae]
  Gene Ontology: Mol. function=tubulin binding; Cellular component =plasma membrane; Biological process=microtubule cytoskeleton organization and biogenesis
  Coding regions on vcDNA: vcDNA=SeqID_94934; Strand=+; Position=64-414

SEQ ID NO: 168512 - protein, 340 aa, Heterodera glycines
  Homolog annotation: Hit_ID=NP_501972.1; Match level="QueryCoverage =98%, HitCoverage=62%, E-value=3e-46, Identity=32%"; Hit description =flavin-containing monooxygenase (60.1 kD) (fmo-12) [Caenorhabditis elegans] emb|CAA94290.1| Hypothetical
  Gene Ontology: Mol. function=monooxygenase activity; Cellular component=integral to membrane; Biological process=oxygen and reactive oxygen species metabolism
  Coding regions on vcDNA: vcDNA=SeqID_94935; Strand=+; Position=48-1170
MLSSPHNFKVAIVGAGPSGLTAARQALLYGYKVRIFEKEQNFGGVWRLAISENAQRRPVPLQSVMDCSKQLCAFSELAVAEHFPTFLRPSDAVAYLESYVRTFELARHMKLGTEVKTIRRSDEQPNNGPSEGQRLVEELFDAVLICSGARLRRWRPPEYRMERAFKGTVIHSEQFTHSSDFRGQTVCVVGLGNSAVAISIALAHTAKQVFLCTRRGEWILPLLQSDGQKPWDWPFSSRWHFWGRRWVPKCLRNFCWEMSAQSVSPDCSQNNGIGRPMHRLLSANLTFGAEQLCPLLASGRIRIRPNILSLSDSNLVEFADRTVEQHVDALVICTGFEFDF

SEQ ID NO: 168513 - protein, 179 aa, Heterodera glycines; identical to SEQ ID NO: 162465
  Homolog annotation: Hit_ID=CAE60497.1; Match level="QueryCoverage =93%, HitCoverage=91%, E-value=6e-47, Identity=56%"; Hit description =Hypothetical protein CBG04115 [Caenorhabditis briggsae]
  Gene Ontology: Cellular component=integral to membrane; Biological process=membrane organization and biogenesis
  Coding regions on vcDNA: vcDNA=SeqID_94936; Strand=+; Position=38-577

SEQ ID NO: 168514 - protein, 145 aa, Heterodera glycines
  Homolog annotation: Hit_ID=EAL25833.1; Match level="QueryCoverage =64%, HitCoverage=14%, E-value=2e-15, Identity=41%"; Hit description =GA21511-PA [Drosophila pseudoobscura]
  Coding regions on vcDNA: vcDNA=SeqID_94937; Strand=+; Position=125-559
MQPQSKRKIQVSFLIRNGSVESKHRGFVNALQFDPTTRSLFSAGSDSVIRQWDTSAPSGSAAFLRSLEHHCDWVNDKRQIVTRDSDGNVELWDVMQCGRVNTFPMGTNMEEVIKDNVRKVWIPSWFGVDAKCGVLEITLDESDAF

SEQ ID NO: 168515 - protein, 232 aa, Heterodera glycines
  misc_feature (215)..(215): Xaa can be any naturally occurring amino acid
  Homolog annotation: Hit_ID=NP_508993.2; Match level="QueryCoverage =94%, HitCoverage=30%, E-value=2e-38, Identity=39%"; Hit description =fatty ligase long (79.9 kD) (XG556) [Caenorhabditis elegans] gb|AAA80409.2| Hypothetical protein C46F4.2
  Gene Ontology: Mol. function=long-chain-fatty-acid-CoA-ligase activity; Biological process=gametogenesis
  Coding regions on vcDNA: vcDNA=SeqID_94938; Strand=+; Position=3-698
MSDRKDSVTGGKRIEQELAEDGRPVYIVVLTIFLKGFFFLYDLLVFIPFKLFADPELKKERSREQKAVPIDGNPASPWRHVDTIGTALYTELFEDCPTLGKIWDKAAELHRGHNCMGTRDILEVIQERQSDGKTFQKLALGKYSWMDYEHVDEVIVEVASGLDNLGIEQGQKVVIYAENRKGRDDLRHPLASNCALPIVPVNSTLGDEAIAFALXECDAVLAFTSRPLLSKV

SEQ ID NO: 168516 - protein, 629 aa, Heterodera glycines
  Homolog annotation: Hit_ID=NP_508993.2; Match level="QueryCoverage =85%, HitCoverage=73%, E-value=1e-147, Identity=48%"; Hit description= fatty ligase long (79.9 kD) (XG556) [Caenorhabditis elegans] gb|AAA80409.2| Hypothetical protein C46F4.2
  Gene Ontology: Mol. function=long-chain-fatty-acid-CoA-ligase activity; Cellular component=lipid particle; Biological process =gametogenesis
  Coding regions on vcDNA: vcDNA=SeqID_94939; Strand=+; Position=73-1959
MVNILTIRWTICTTLRNGAWPCARVLMLWQPYRLLLLKRMLVKMEMTTQQHPTTYWRGMAVFYWKQKAVSYRSNFYKKFKMPNQKDGVTGGKRIEQELAVFDLPFYIVALAFFLKAFFRLYDLLVFVPFKLFADPELEKERSRERKAMPIDGKPTSSWRHVDTIGTALYTELFEGCPTLGKIWDKAAQLHRGHNCMGTRDILNVVEEQQPDGKAFQKLALGKCNWMNYEHVDEVIVEVASGLSNLGIVQGQKVVIFSETRKEWMISAIACFKLGLPIVTVYPTLGDEAIAFALAECDAVLAFTSRPLLSKVFSSVKDCPQLKRVVYFSELHALAEVAEKAPDAIKEAFKSIGRELYSFNALKALGHSQAKLERNVQPDDLAMIMYPSGTPGKPKGGLLSHRNIIPTASGQSAVISVSTSDTIIGYLPLAHILEVCAEIICLSKGCRVGYSSPSTLHDRAVKIKRGTTGDCVELKPTLIACVPAVMDKIFKAVLDEVKEKSPIQREIFRICYERKRNRFEGGYKSLVMDSLAFAKISKMLGGNLRFVISGGAPLNPETQRFMNICFCCPVVQGYGLTETCGGATLADEHDLSTGSVGPPLRSCEIRLREWEEAGYLPTNSPPQGEVLIHG

SEQ ID NO: 168517 - protein, 152 aa, Heterodera glycines
  Homolog annotation: Hit_ID=NP_740965.1; Match level="QueryCoverage =98%, HitCoverage=66%, E-value=5e-12, Identity=32%"; Hit description =protein -interacting (2A570) [Caenorhabditis elegans] gb|AAB37893.2| Hypothetical protein B0432.13 [Caeno
  Gene Ontology: Mol. function=receptor signaling protein activity; Biological process=signal transduction
  Coding regions on vcDNA: vcDNA=SeqID_94940; Strand=+; Position=30-485
MNLGRCSICTLSFDLNDVSALKCGHTYHYQCIDKWIANSKTCPNCRTSNLKRDILKLFFDEGEKSFSQLVQEPANAELLAQLKEAQDVKCFLEKTIKEQHERLTLLEFKLKQQKTKGNELNMQIQRKAQHIATLESQLFDQKVLKETNEKYK

SEQ ID NO: 168518 - protein, 69 aa, Heterodera glycines; identical to SEQ ID NO: 163354
  Homolog annotation: Hit_ID=Q8I7D9; Match level="QueryCoverage=97%, HitCoverage=98%, E-value=2e-26, Identity=86%"; Hit description =Protein transport protein SEC61 gamma subunit emb|CAC82549.1| putative transport protein sec61 gamma subunit [
  Coding regions on vcDNA: vcDNA=SeqID_94941; Strand=+; Position=25-234

SEQ ID NO: 168519 - protein, 78 aa, Heterodera glycines; identical to SEQ ID NO: 166794
  Coding regions on vcDNA: vcDNA=SeqID_94942; Strand=+; Position=91-324

SEQ ID NO: 168520 - protein, 136 aa, Heterodera glycines; identical to SEQ ID NO: 163377
  Homolog annotation: Hit_ID=P48817; Match level="QueryCoverage=94%, HitCoverage=90%, E-value=7e-25, Identity=42%"; Hit description =Nucleoside diphosphate kinase (NDK) (NDP kinase) gb|AAA90988.1| nucleoside diphosphate kinase pir||JC4359 nucl
  Gene Ontology: Mol. function=ATP binding; Cellular component=nucleus; Biological process=negative regulation of cell proliferation
  Coding regions on vcDNA: vcDNA=SeqID_94943; Strand=+; Position=26-436

SEQ ID NO: 168521 - protein, 123 aa, Heterodera glycines; identical to SEQ ID NO: 163277
  Coding regions on vcDNA: vcDNA=SeqID_94944; Strand=+; Position=27-398

SEQ ID NO: 168522 - protein, 191 aa, Heterodera glycines
  Coding regions on vcDNA: vcDNA=SeqID_94945; Strand=+; Position=1-573
ARQEAHQIRGRIRLLIGDRDLELAANPSPTTNEDVNYGFRFISENNLNADDNQQIPNIIAFGRENGEADDDQNENNSEEGREIEQTQNTTGEEEEEDNATDDNVGMSSTESDGQDKMKANNGKGTCKNEDESKPSPTVETEQNKVHQSASETVISQKANANNSEECKESNGENGTRISMKRQRRSHSVDSS

SEQ ID NO: 168523 - protein, 70 aa, Heterodera glycines; identical to SEQ ID NO: 163634
  Coding regions on vcDNA: vcDNA=SeqID_94946; Strand=+; Position=1-213

SEQ ID NO: 168524 - protein, 219 aa, Heterodera glycines
  Homolog annotation: Hit_ID=CAE59693.1; Match level="QueryCoverage =82%, HitCoverage=18%, E-value=4e-32, Identity=46%"; Hit description =Hypothetical protein CBG03117 [Caenorhabditis briggsae]
  Gene Ontology: Mol. function=voltage-gated chloride channel activity; Cellular component=integral to membrane; Biological process=transport
  Coding regions on vcDNA: vcDNA=SeqID_94947; Strand=+; Position=39-695
MSGFSEGTFHRNSTPNNTLATTAVPANYKMSMINDRNLFGNTLLSISPLHDDQSKSGRLVPLLMRHQKEAKSINQQQAFLGRSTSVRDRAAQLRKPIDLDEVAIDAAPFQLVIGTSLYRVHTLFALLGLNHAYVTNRGRLVGVVALRELRAALAHIYTRGALPTAQSMSRLRLNSLNFGLCSTDRSRANSGVEGNSDNLNGSSLRTAMSPTSLSGPLTQ

SEQ ID NO: 168525 - protein, 205 aa, Heterodera glycines
  Homolog annotation: Hit_ID=AAC47437.1; Match level="QueryCoverage =96%, HitCoverage=69%, E-value=3e-81, Identity=64%"; Hit description =COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_94948; Strand=+; Position=19-633
MADFEGRVKAYRFVAYTTVSFSIISLLSVCLTLPMLKSYVSNVGMKMDSELSSCQHNAKDIWSEVSQLKGLPLLVAGNRTARSAYGSCQECCSGGAQGQPGQPGQPGRPGNPGAPGSPGQPGQTPQTPCEQVHPPPCTPCPGGQPGNNGPPGPPGAPGSPGQPGTGGGQPQPGEPGPPGPNGQPGQPGQPGAPGQPGQPASPPQT

SEQ ID NO: 168526 - protein, 252 aa, Heterodera glycines
  misc_feature (147)..(147): Xaa can be any naturally occurring amino acid
  Homolog annotation: Hit_ID=AAC47437.1; Match level="QueryCoverage =98%, HitCoverage=86%, E-value=1e-105, Identity=65%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_94949; Strand=+; Position=31-787
MADFEGRVKAYRFVAYTTVSFSIISLLSVCLTLPMLKSYVSNVGMKMDSELSSCQHNAKDIWSEVSQLKGLPLLVSGNRTARSAYGSCQECCSGGAQGQPGQPGQPGRPGNPGAPGSPGQPGQTPQTPCEQVHPPPCTPCPGGQPGXMAPPGPPGAPGSPGQPGTGGGQPQPGEPGPPGPNGQPGQPGQPGAPGQPGQPASPPQTEPPPPGPPGEAGAPGQPGQPGAPGQPGASGQPGPKGPPGGPGQPGNG

SEQ ID NO: 168527 - protein, 291 aa, Heterodera glycines
  misc_feature (166)..(166): Xaa can be any naturally occurring amino acid
  misc_feature (215)..(215): Xaa can be any naturally occurring amino acid
  Homolog annotation: Hit_ID=AAC47437.1; Match level="QueryCoverage =99%, HitCoverage=99%, E-value=1e-127, Identity=68%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_94950; Strand=+; Position=16-890
MADFEGRVKAYRFVAYTTVSFSIISLLSVCLTLPMLKSYVSNVGMKMDSELSSCQHNAKDIWSEVSQLKGMPLLVAGNRTARSAYGSCQECCSGGAQGQPGQPGQPGRPGNPGAPGSPGQPGQTPQTPCEQVHPPPCTPCPGGQPGNNGPPGPPGAPGAPGQPGHXGGQPQPGEPGPPGPNGQPGQPGQPGAPGQPGQPASPPPTEPAPAGPPGXAGAPGQPGQPGAPGQPGAAGQPGPKGPPGGPGQPGNGGAPGQPGQPGQPGNPGERGICPKYCAVDGGVFFEDGTRR

SEQ ID NO: 168528 - protein, 143 aa, Heterodera glycines
  Coding regions on vcDNA: vcDNA=SeqID_94951; Strand=+; Position=599 -1027
AAKRERRALFQRPRRRHGAGSRKNSAQITFPLNWSNGRHSVRRAKAWISADLHRDNQKQENILLSVLRNWAFLRRVLYYAVCAVAMGLDMIHTIKIFGRIHITETALNALNSACRVEVGSGPEHSRHLVEKGIKQTSLVVSEE

SEQ ID NO: 168529 - protein, 149 aa, Heterodera glycines
  Coding regions on vcDNA: vcDNA=SeqID_94952; Strand=-; Position=43-492
FFSVKCFISQPKNGETRAEVGCHNWSWSGKRLYWIFGSFPWRALCWIYSLKCRAVVAHWWRMFPAYYQSMLVVGRTNCSMKRKAKVAIGRNDSQHWHPSSSFVVWSFANPEVVSDFFHFDQSRGLTRSFLCFSINPCEKCAKAIGKLYI

SEQ ID NO: 168530 - protein, 40 aa, Heterodera glycines
  Coding regions on vcDNA: vcDNA=SeqID_94953; Strand=-; Position=2-121
MIKRVANPINQSNANDQSSSDRFFRRSIPFDQSQKSVFVR

SEQ ID NO: 168531 - protein, 206 aa, Heterodera glycines
  Homolog annotation: Hit_ID=CAF90384.1; Match level="QueryCoverage =75%, HitCoverage=88%, E-value=6e-16, Identity=35%"; Hit description =unnamed protein product [Tetraodon nigroviridis]
  Gene Ontology: Mol. function=lamin/chromatin binding; Cellular component=nuclear heterochromatin
  Coding regions on vcDNA: vcDNA=SeqID_94954; Strand=+; Position=52-669
MSAANDVAATANDPSTVVCEEKKSSAAEEELIDVVTVGENNPTGSAGTKTGESDEVFVVEQIKNKRSVNGTDEYLIKWKGYDDEQDDTWEPLENLHCPELLKEFETNYCPAKTKRRKKSSGKVAKKRKISSDSTLPTIPLVLKDRYHIGEDGAVPEHIIGVMKHEESGKMMALLTYTDDREATEFVPTEILLENKLTAKMILNFYQ

SEQ ID NO: 168532 - protein, 282 aa, Heterodera glycines
  Homolog annotation: Hit_ID=CAE59009.1; Match level="QueryCoverage =94%, HitCoverage=94%, E-value=2e-62, Identity=40%"; Hit description =Hypothetical protein CBG02285 [Caenorhabditis briggsae]
  Gene Ontology: Mol. function=protein binding; Cellular component =lateral plasma membrane; Biological process=intercellular junction assembly
  Coding regions on vcDNA: vcDNA=SeqID_94955; Strand=+; Position=62-910
MGNEHSNRSKGHPSSSSSSKKDSPATRLQKALPSALKFGSNDLSSSALRRLLEQSKKSRSLQLKGAGIKRVPSGIVEEVHSLLRILELSSNKLRELPSTIGTFSMLKQLYIANNRLTNLPDEIGCLKTLELLDVSGNQLTELPDPLAACNSLTQMNASNNKFSTFPSVVTRLLRLEVIDLSENSITELPDEIAILRATELIIRRNQLALLNASNLTKCEHLKILRVEENCLPREAFTAELLEKSELTLITHEGNLFAEKEFQALPGYDAYEQRFTATRRRLF

SEQ ID NO: 168533 - protein, 193 aa, Heterodera glycines; identical to SEQ ID NO: 163190
  Homolog annotation: Hit_ID=YP_062940.1; Match level="QueryCoverage =83%, HitCoverage=47%, E-value=6e-33, Identity=46%"; Hit description =pantoate--beta-alanine ligase [Leifsonia xyli subsp. xyli str. CTCB07] gb|AAT89835.1| pantoate--beta-alan
  Gene Ontology: Biological process=coenzymes and prosthetic group metabolism
  Coding regions on vcDNA: vcDNA=SeqID_94956; Strand=+; Position=39-617

SEQ ID NO: 168534 - protein, 85 aa, Heterodera glycines
  Homolog annotation: Hit_ID=NP_495514.1; Match level="QueryCoverage =88%, HitCoverage=48%, E-value=6e-11, Identity=54%"; Hit description =u6 snRNA-associated Sm-like protein (lsm-2) [Caenorhabditis elegans] gb|AAC46661.1| Lsm sm-like protein p
  Coding regions on vcDNA: vcDNA=SeqID_94957; Strand=+; Position=1-258
RGSTIKYLRIPDEVVDLVKDEVKEVRRQQKDNQRMKKQFAKGTKGAGGPSAGGGRPQQGGRPGGGPSRGAYRGGAHPSGGQPRRN

SEQ ID NO: 168535 - protein, 284 aa, Heterodera glycines; identical to SEQ ID NO: 162492
  Homolog annotation: Hit_ID=CAH73825.1; Match level="QueryCoverage =66%, HitCoverage=74%, E-value=2e-15, Identity=31%"; Hit description =OTTHUMP00000062121 [Homo sapiens]
  Coding regions on vcDNA: vcDNA=SeqID_94958; Strand=+; Position=18-872

SEQ ID NO: 168536 - protein, 158 aa, Heterodera glycines
  Coding regions on vcDNA: vcDNA=SeqID_94959; Strand=+; Position=3-476
KRKKMLFYDHHTRTCCFFNVQKCAFTFALIGFVLNLVALVPIFLPYSPTSQEKPSIYIGKCLHILFSAMLFLSIMLAYKLRKAWLYTPYLIYTGISLALAVFGCLTYLYFLITDPQSLLDDNWRKAHPGKATNDSEARAIASAWLALMLVYLLFSGWI

SEQ ID NO: 168537 - protein, 123 aa, Heterodera glycines
  Coding regions on vcDNA: vcDNA=SeqID_94960; Strand=-; Position=60-431
FDEDVHPIQFMRKTHWSPAKRRCIDAKFFESNNRGEWNFNGNHARRLLCGRGNFKLENMFKRFFSIAPQFHRAQSDCEALLQVCLSYGMDFVKFVDRNCSYFPDCFYTSSKKTQTLNSLNTDL

SEQ ID NO: 168538 - protein, 57 aa, Heterodera glycines; identical to SEQ ID NO: 162506
  Coding regions on vcDNA: vcDNA=SeqID_94961; Strand=+; Position=52-225

SEQ ID NO: 168539 - protein, 173 aa, Heterodera glycines; identical to SEQ ID NO: 126813
  Homolog annotation: Hit_ID=NP_501962.1; Match level="QueryCoverage =63%, HitCoverage=89%, E-value=9e-18, Identity=37%"; Hit description =transthyretin (4L369) [Caenorhabditis elegans] pir||T24096 hypothetical protein R09H10.3 - Caenorhabditis
  Coding regions on vcDNA: vcDNA=SeqID_94962; Strand=+; Position=30-551

SEQ ID NO: 168540 - protein, 125 aa, Heterodera glycines; identical to SEQ ID NO: 163336
  Coding regions on vcDNA: vcDNA=SeqID_94963; Strand=-; Position=72-449

SEQ ID NO: 168541 - protein, 243 aa, Heterodera glycines
  Homolog annotation: Hit_ID=CAE57516.1; Match level="QueryCoverage =100%, HitCoverage=49%, E-value=2e-76, Identity=58%"; Hit description= Hypothetical protein CBG00491 [Caenorhabditis briggsae]
  Gene Ontology: Mol. function=translation elongation factor activity; Cellular component=mitochondrion; Biological process=gametogenesis
  Coding regions on vcDNA: vcDNA=SeqID_94964; Strand=+; Position=3-731
DEPWMPAEKVYTIKGRGTVITGKLEQGTLKKNDKVTIVGLGKKLDTTIAGLETFRKTVDQAEPGDQLGVLLKGLGPKDVRRGSVLLKQGQDAHFTDKVRAQIYLLKPEEGGSKMPLAHMFKEHMFSLTWDSAATVMLQGRDFVMPGETVELEFLFNTPQFVRPQQRFTLRHDKTTIACGVFLEALPESEGEIPDKKWRKMQMRGVMERVGFNPFGNRSFERACKPDYTNSPKDNPAEALFKSE

SEQ ID NO: 168542 - protein, 132 aa, Heterodera glycines
  Homolog annotation: Hit_ID=CAE56474.1; Match level="QueryCoverage =81%, HitCoverage=51%, E-value=4e-17, Identity=42%"; Hit description =Hypothetical protein CBG24188 [Caenorhabditis briggsae]
  Coding regions on vcDNA: vcDNA=SeqID_94965; Strand=+; Position=3-401
TFGEEVFGNFRLVALQLRDFVSSRSVQEKLGVVNSSLAPIRDAANATEQFILDEQRKVLPRAVAISMGGMAGFVAAMRKGGRMRRTFYPLIGLLTMTAFCYPNETVHSVRVGIAHSQSAWHNFKQAPEPKSS

SEQ ID NO: 168543 - protein, 171 aa, Heterodera glycines
  Homolog annotation: Hit_ID=CAE56474.1; Match level="QueryCoverage =92%, HitCoverage=75%, E-value=7e-20, Identity=35%"; Hit description =Hypothetical protein CBG24188 [Caenorhabditis briggsae]
  Coding regions on vcDNA: vcDNA=SeqID_94966; Strand=+; Position=42-557
MGSSASESPPPPKLVAIQDLPIYKAESVPAARAARPVDTIGRPATFGEEVFGNFRLVALQLRDFVSEKLGVVNSSLAPIRDAANATEQFILDEQRKVLPRAVAISMGGMAGFVAAMRKGGRMRRTFYPLIGLLTMTAFCYPNETVHSVRVGIAHSQSAWHNFKQAPEPKSS

SEQ ID NO: 168544 - protein, 207 aa, Heterodera glycines
  misc_feature (15)..(15): Xaa can be any naturally occurring amino acid
  Homolog annotation: Hit_ID=CAE73617.1; Match level="QueryCoverage =100%, HitCoverage=26%, E-value=1e-44, Identity=45%"; Hit description= Hypothetical protein CBG21107 [Caenorhabditis briggsae]
  Coding regions on vcDNA: vcDNA=SeqID_94967; Strand=+; Position=1-622
EQKTKEHAMQSKQQXPRELKAKETIIRKQFRQAVKIQTRQFKAYQSQMLQMAPREEHRELLNRLKEEQSRKIASLADQYEATIETMVTEQTIKLDAQQEEDLRQLTEKLNRELSMLTEYQEKQRVELSAQIERERVQLQDRVNLRLAVLKQKMNEEKVHFERNRERQLAQLHDRQAQALSAFSVDERRKKSSMGSDGGRNDASSTNL

SEQ ID NO: 168545 - protein, 161 aa, Heterodera glycines; identical to SEQ ID NO: 160985
  Homolog annotation: Hit_ID=CAA48632.1; Match level="QueryCoverage =66%, HitCoverage=62%, E-value=5e-11, Identity=35%"; Hit description =OV25-1 protein [Onchocerca volvulus] pir||S29692 OV25-1 protein - nematode (Onchocerca volvulus)
  Coding regions on vcDNA: vcDNA=SeqID_94968; Strand=+; Position=40-525

SEQ ID NO: 168546 - protein, 60 aa, Heterodera glycines; identical to SEQ ID NO: 166781
  Coding regions on vcDNA: vcDNA=SeqID_94969; Strand=+; Position=6-188

SEQ ID NO: 168547 - protein, 137 aa, Heterodera glycines; identical to SEQ ID NO: 166780
  Coding regions on vcDNA: vcDNA=SeqID_94970; Strand=+; Position=67-477

SEQ ID NO: 168548 - protein, 145 aa, Heterodera glycines
  Coding regions on vcDNA: vcDNA=SeqID_94971; Strand=+; Position=1-435
PTAKSAVPTVGELFRAQLGHFYAQIGDIKFEDPPSSVNFYASICLLLVGHVLQGHRPTLLRRVGPAWLGRVREQLADWRAMDEADKAAQQQKQSHKNPQKRDEHVDDDDGMSAELRRRMAQSVEQQQLFRMNMFTFQLDEAERRV

SEQ ID NO: 168549 - protein, 128 aa, Heterodera glycines
  Coding regions on vcDNA: vcDNA=SeqID_94972; Strand=+; Position=37-420
MVVEMSSGAATTASAAAVAGTAPSAGPVPSCICSSTSQLLTAAGMDGIPPAKTPANSGPDANFLADSLGVSPLYRQEDTKRWQTAAKVYQSSRSQMHSPTSGTCAPQHFHFGESLTAEGHLTQKIRQC

SEQ ID NO: 168550 - protein, 417 aa, Heterodera glycines
  Homolog annotation: Hit_ID=XP_468248.1; Match level="QueryCoverage =88%, HitCoverage=35%, E-value=7e-16, Identity=26%"; Hit description =diaphanous homologue-like [Oryza sativa (japonica cultivar-group)] dbj|BAD19266.1| diaphanous homologue-l
  Gene Ontology: Mol. function=actin binding; Cellular component=actin cortical patch (sensu Saccharomyces); Biological process=signal transduction
  Coding regions on vcDNA: vcDNA=SeqID_94973; Strand=+; Position=28-1278
MDDLCRRGLLTTEQTPHEPSSADKFDGADEAVLALVDKYRRTCGLPTAKRSAPSPLNSLLSPGKLPPAGKPPTPYIPTPGGSAGYAPAALLKQQQRNASFGYHSNSSSSNQDDWQALLQPPPPPPPPMPSLSSVQTALSGGTPRGILSHASSAAAAAHKRDTLRSPGTEARRPKNQTLFKNALEQIRKINEESKSGSGTVPSATSVSDPFPSSSIPPLKTPSPLRPLISTISATSTEQQHLPAPPVPPNLPRDPRLLKHGNATAAAVVVVVDKPNQQQQVRCATIPVDARPNSVLSPPCDPRLKRISAEALPVSSPSVLPPLPKFKATVPVLNVRPVSSAAAVVVPPPPPSPPPNVSVFKQLVPSAASVSTTAPAPPNLGFKRAYGLVGMVSSGIDIPPPPPPPELAPPEEKKMMLQ

SEQ ID NO: 168551 - protein, 157 aa, Heterodera glycines
  Coding regions on vcDNA: vcDNA=SeqID_94974; Strand=+; Position=2-472
DNHRKLIRVTAPPPQRQQQQLINGVVMSHNQHLHVPNTAIGGRTTTVDMAIPQRQQLSDSEVLPVHHHCLYRIDHPQILSSGTATDFSVLQNFPAAKPRNAVNLNNNNMQQFVPTTESFSSPSSSSAPNTAIELTLMNGELSMDSSATISQFHPIVL

SEQ ID NO: 168552 - protein, 117 aa, Heterodera glycines
  Homolog annotation: Hit_ID=AAQ83632.1; Match level="QueryCoverage =79%, HitCoverage=8%, E-value=1e-14, Identity=40%"; Hit description =solute carrier family 4 sodium bicarbonate cotransporter-like member 10 [Homo sapiens]
  Gene Ontology: Mol. function=sodium:bicarbonate symporter activity; Cellular component=integral to membrane; Biological process =bicarbonate transport
  Coding regions on vcDNA: vcDNA=SeqID_94975; Strand=-; Position=35-388
YGTVRWIKLEQCVEGAGTRLSKPYISLLSIYPLLQLKHCFRRGVVLLESGANSFIRLCDLLVDEWTHSGQLGEDMANLVKDIIYAPKLHLNQGKLRKVNESNGKLKQMEGEERVWKT

SEQ ID NO: 168553 - protein, 301 aa, Heterodera glycines
  misc_feature (43)..(43): Xaa can be any naturally occurring amino acid
  Homolog annotation: Hit_ID=CAE73582.1; Match level="QueryCoverage =61%, HitCoverage=46%, E-value=1e-41, Identity=43%"; Hit description =Hypothetical protein CBG21056 [Caenorhabditis briggsae]
  Gene Ontology: Mol. function=structural constituent of cuticle; Cellular component=secretory vesicle; Biological process=cell-matrix adhesion
  Coding regions on vcDNA: vcDNA=SeqID_94976; Strand=+; Position=1-906
PPGPSTETPGPPGPSTETPGPPGPSTETPGPPGPSTETPGPPXPSTETPGPPGPSTETPGPPGPSTVFPGPPGPSTETPGPSGPSTETPGPSGPSTETPGPPGPSTETPGPPGPSTETPGPPGPSTETPGPPGPSTETPGPPGPSTETPGPPGPSTETPGPPGPSTAGTSSTKTYTVPTTPKPPPCCYGCDYPVDCHTSGKDCDYSPLQPPYQSDPYPVGKCVFKNVTCAAPNTGKVLFMKLNNDPNSVVSSSVSPFNKVTVILQCTCKPYFAPYWVQVGVDGNPAKQVNVKSATCGRHCY

SEQ ID NO: 168554 - protein, 229 aa, Heterodera glycines
  Homolog annotation: Hit_ID=CAE56451.1; Match level="QueryCoverage =99%, HitCoverage=94%, E-value=9e-48, Identity=42%"; Hit description =Hypothetical protein CBG24156 [Caenorhabditis briggsae]
  Coding regions on vcDNA: vcDNA=SeqID_94977; Strand=+; Position=10-696
MASTITHVVFDLDGVLIDTERHYTTANERTLEKFGAKFTREMKLKMMGRKKTEAVTVLLKDAGIADRVTMDQYIAEYDKHVLQIMRALTEELPGATKLIDHLYAHNIPMAICTGSDNEEFASKMLKFDEWLKKIPLRVLCGSDPEVRIGKPNPDAYEVTIGRFAAKPTSPKNVLVFEDSINGVESALGAGCTVVMVPQREFLPNDWPEKELRSRPNFAALLDSLDNFCP

SEQ ID NO: 168555 - protein, 117 aa, Heterodera glycines
  Coding regions on vcDNA: vcDNA=SeqID_94978; Strand=-; Position=2-352
KSLADNQSIFPLLICRRWWRPRISSKHHSSPCANGRRPCPTFSREVFQPFRHSTVQKSDWQTKREWIPWHMSLSPSSVGSAPLPSPTKRIRHIFHRVLLVRHHFLLQQKRIRHIFLR

SEQ ID NO: 168556 - protein, 167 aa, Heterodera glycines; identical to SEQ ID NO: 163158
  Coding regions on vcDNA: vcDNA=SeqID_94979; Strand=-; Position=2-502

SEQ ID NO: 168557 - protein, 135 aa, Heterodera glycines; identical to SEQ ID NO: 166777
  Coding regions on vcDNA: vcDNA=SeqID_94980; Strand=+; Position=6-413

SEQ ID NO: 168558 - protein, 206 aa, Heterodera glycines
  Homolog annotation: Hit_ID=CAE70385.1; Match level="QueryCoverage =98%, HitCoverage=36%, E-value=2e-79, Identity=72%"; Hit description =Hypothetical protein CBG16947 [Caenorhabditis briggsae]
  Gene Ontology: Mol. function=pyruvate kinase activity; Cellular component=cytosol; Biological process=glycolysis
  Coding regions on vcDNA: vcDNA=SeqID_94981; Strand=+; Position=1-618
EKYPARNNLEHLAMLTCTEEPHIVRKTGIICTIGPVCRSVEMLVQMIENGMDVARMNFSHGDHEYHGGTIKNVREAAAKCTKKRNVAIALDTKGPEIRTGLLAGGGSAEILLEKDASIRLTTDSAFEKSGTAINLYVDYKNITKVVTKGSRVYIDDGLLSLIVEEIFDDAILCKVENGGKLGSRKGVNLPGTPVDLPAVSEKDIKD

SEQ ID NO: 168559 - protein, 519 aa, Heterodera glycines
  misc_feature (367)..(367): Xaa can be any naturally occurring amino acid
  Homolog annotation: Hit_ID=NP_492458.1; Match level="QueryCoverage =100%, HitCoverage=91%, E-value=0.0, Identity=68%"; Hit description =pyruvate kinase (60.7 kD) (1J753) [Caenorhabditis elegans] emb|CAB02984.1| Hypothetical protein F25H5.3a [
  Gene Ontology: Mol. function=pyruvate kinase activity; Biological process=glycolysis
  Coding regions on vcDNA: vcDNA=SeqID_94982; Strand=+; Position=3-1563
FRQEQIMEKYPARNNLEHLAMLKCTEKPHIVRKTGIICTIGPVCRSVDMLVQMIENGMNVARMNFSHGDHEYHGGTIKNVREAAAKCTKKYNVAIALDTKGPEIRTGLLAGGGSAEILLAKDASIRLTTDPAFEKSGTAVNLYVDYKNITKVVTKGSRVYIDDGLLSLIVEEILGDDAAILCKVENGGKLGSRKGVNLPGISVDLPAVSEKDIKDLRFGVEQGVDIIFASFIRNANGIRTIREVLGEAGKNIKIIAKIENQEGEDNVDEIIAASDGVMVARGDLGIEIPAQKVFLAQKMMIAKCNMAGKPVITATHMLESMVNKPRPTRAEVNDVANAVLDSSDCVMLSGESTKGDYPGGSLKTMQXICLEAETAFFHSRYFEELLQNTPSPTGPGETIASAAANAARRCRASAIIVLTTTGKSAQECSRFRVPIPVLAITRYEQVARQLQLCRGLFPLYYPHMERDTEWTEDVNKRIAYGIGVGKERGFIHNGDFVVIVTGWQAGAGSTNTIRLQKVE

SEQ ID NO: 168560 - protein, 303 aa, Heterodera glycines
  misc_feature (283)..(283): Xaa can be any naturally occurring amino acid
  Homolog annotation: Hit_ID=NP_503146.1; Match level="QueryCoverage =99%, HitCoverage=98%, E-value=1e-131, Identity=76%"; Hit description= TFII(Two)B general transcription factor (33.1 kD) (ttb-1) [Caenorhabditis elegans] gb|AAG24202.2| Tfii(t
  Gene Ontology: Mol. function=general RNA polymerase II transcription factor activity; Cellular component=transcription factor complex; Biological process=transcription from Pol II promoter
  Coding regions on vcDNA: vcDNA=SeqID_94983; Strand=+; Position=49-961
MNIVCPSHPEADLVEDARAGDLICTRCGLVVGERLIDVGTEWRSFSNESSGKDPSRVGAPENPLLSGSDLSTSIAVSFGSDSDRALANAQRKLLSSTDRQMTQAMMVIREMSEKINLTRTIQDRAAKLYKEVLESKALRGKNNEAQAAACLYIACRQEGVPRTFKEICAVSKVSKKEIGRCFKLIQKTMETNLDHITSADFMSRFCGNLSLPYPVQVAATRIAKKSVEHDLVAGRSPISIAAAAIYMASQASNDKRTAKEIGEIAGAAEVTVRQTYRLLLPKXLELFPPDFRFETPIDQLPTS

SEQ ID NO: 168561 - protein, 90 aa, Heterodera glycines
  Coding regions on vcDNA: vcDNA=SeqID_94984; Strand=+; Position=22-294
SINWSVPLTMLFSTPMPLFLVSSVFLFVFLLVAMFLANPSDARPQFGSFADSMTSGTILSNMWGKKAMRSGQQQTEKERKLKKTEENNWK

SEQ ID NO: 168562 - protein, 387 aa, Heterodera glycines
  Homolog annotation: Hit_ID=NP_509045.1; Match level="QueryCoverage =94%, HitCoverage=95%, E-value=1e-75, Identity=44%"; Hit description =heat shock protein (43.2 kD) (hsp-43) [Caenorhabditis elegans] gb|AAA80366.1| Heat shock protein protein
  Gene Ontology: Mol. function=chaperone activity; Cellular component =cytoplasm; Biological process=muscle contraction
  Coding regions on vcDNA: vcDNA=SeqID_94985; Strand=+; Position=81-1244
MALVSKWRSDPFGRSDWPSLWRDRFSRDWDDWPRDWPRPGELMERFRSRDFDRDRWWRDWPTDWPRMDAIVPRFSSHLDRFDRNWRDDPFWRDLYPRWAEPIFKDGIDVKTNITNDSNRFAVEMDTYQFRPEELQVKTMDDTLLIEGRHEDVRDRDNYTKMYFVRKYQLPADVESHSISSHIDSSGRLSVEAQKRWQAVEGERSIPIESGSRRQGGGYGSRSSSYSPRDRYYADSGRGSANDYYRAESRLNGAANGGGGYLSPNPRSDGYRTEFEKRETDANGMRHEARREEFREEFRRSGSAANVLPPASPMLRTESRLSGAVGANASSGEERRESSHFRRTASAASREYRSGGAFAGGENLLRPAEELGGRSSAFGTRNVPIHRG

SEQ ID NO: 168563 - protein, 148 aa, Heterodera glycines; identical to SEQ ID NO: 163353
  Coding regions on vcDNA: vcDNA=SeqID_94986; Strand=+; Position=20-466

SEQ ID NO: 168564 - protein, 160 aa, Heterodera glycines
  Homolog annotation: Hit_ID=CAE57892.1; Match level="QueryCoverage =75%, HitCoverage=23%, E-value=8e-22, Identity=50%"; Hit description =Hypothetical protein CBG00938 [Caenorhabditis briggsae]
  Coding regions on vcDNA: vcDNA=SeqID_94987; Strand=+; Position=1-480
PRAEFGTRLGFAAAFDDHFQHFPWLFSALFAWLLLLFLLLELFPSFSANLSLQLVSPRRALIALFRAPNPTEHYLAFLDIFRIGAICWVISNHLGSEGRLDVLLGLPHGEHFKQSVHSLPIFGPIFGNSALGVEVFLVLSGFLAARSWHRRWQSDLGFWP

SEQ ID NO: 168565 - protein, 265 aa, Heterodera glycines; identical to SEQ ID NO: 163907
  Homolog annotation: Hit_ID=NP_608376.1; Match level="QueryCoverage =89%, HitCoverage=45%, E-value=1e-21, Identity=29%"; Hit description =CG9581-PA [Drosophila melanogaster] gb|AAF45368.1| CG9581-PA [Drosophila melanogaster] gb|AAL39309.1| GH1
  Coding regions on vcDNA: vcDNA=SeqID_94988; Strand=+; Position=23-817

SEQ ID NO: 168566 - protein, 254 aa, Heterodera glycines
  misc_feature (150)..(150): Xaa can be any naturally occurring amino acid
  misc_feature (248)..(248): Xaa can be any naturally occurring amino acid
  Homolog annotation: Hit_ID=NP_001002618.1; Match level="QueryCoverage= 95%, HitCoverage=83%, E-value=2e-59, Identity=50%"; Hit description =zgc:92263 [Danio rerio] gb|AAH75969.1| Zgc:92263 [Danio rerio]
  Coding regions on vcDNA: vcDNA=SeqID_94989; Strand=+; Position=45-804
MSVFLNSVRRLSVISSAMKFLRQQEAIDIDRELFTSCGFSVDQLMELAGLACAQAIGETFEKGNVLILSGPGNNGGDGLVCARHLKHFGFSPSILCPKPSQNDLMQRLMLQLECLGIPFVESFPDPNSIEKFNFLVDAIFGFSFRPPIRXEPFNKILKQMESVQNRVPIVSIDIPSGQPKGWDVEKGPPDEKSGLPILSPLALISLTAPKQCAQFFKGEYHFLGGRFVPPALVQKFGLENMPPYEGSXQFMRLN

SEQ ID NO: 168567 - protein, 278 aa, Heterodera glycines
  Coding regions on vcDNA: vcDNA=SeqID_94990; Strand=+; Position=38-874
MHGSSPLTEANLCMKFESSFSWKDWVRLRDTWNAVVTSQSQIHRHSEQLDKIVSEESSYRNYASDIQNRQIMIQIVERNVNKARELVRTARYQLNAFNSALSQMSAMFKSQEENDSQTEHGILELNNQNAEMRLELSRLRNELVFRRRHMLKSLYEVFFLPKLKRSSIAAPLVFRRQCFCSNFDAIRSLHFPSVPARLGHNDAELSSAAGFIVQLLLAISHILDIPLKHLLLFNGSRSAIFSRSSLERFGPLFHFLCKESKESAGPNDVPAQRRHRPT

SEQ ID NO: 168568 - protein, 97 aa, Heterodera glycines; identical to SEQ ID NO: 166771
  misc_feature (46)..(46): Xaa can be any naturally occurring amino acid
  Homolog annotation: Hit_ID=NP_497802.2; Match level="QueryCoverage =82%, HitCoverage=31%, E-value=1e-15, Identity=48%"; Hit description =putative N-myristoylated protein (28.3 kD) (3F80) [Caenorhabditis elegans] emb|CAA84649.2| Hypothetical p
  Coding regions on vcDNA: vcDNA=SeqID_94991; Strand=+; Position=3-295

SEQ ID NO: 168569 - protein, 140 aa, Heterodera glycines; identical to SEQ ID NO: 163716
  Homolog annotation: Hit_ID=NP_872192.1; Match level="QueryCoverage =100%, HitCoverage=99%, E-value=5e-42, Identity=58%"; Hit description= transthyretin-like family member (15.7 kD) (5I318) [Caenorhabditis elegans] gb|AAN84848.1| Hypothetical
  Coding regions on vcDNA: vcDNA=SeqID_94992; Strand=+; Position=31-453

SEQ ID NO: 168570 - protein, 167 aa, Heterodera glycines
  Homolog annotation: Hit_ID=NP_509363.1; Match level="QueryCoverage =89%, HitCoverage=75%, E-value=1e-33, Identity=47%"; Hit description =mammalian VEntral Midline antigen related (vem-1) [Caenorhabditis elegans] gb|AAD31555.1| Vema (mammalian
  Gene Ontology: Mol. function=steroid binding; Cellular component =integral to membrane; Biological process=signal transduction
  Coding regions on vcDNA: vcDNA=SeqID_94993; Strand=+; Position=67-570
MPTFAELFELSATDVVLVVLFVYVVYKLFFARRHIPPPPDVPQVEPLEKQDMTVEQLRRYDGVQDEHICMAICGKIYDVTKGRDYYGPEGAYGALAGHDATRALGTMDVKQIKDEFDDHAGIDPSDLEEAKEWQQRLSLKYPFVGRLLAPGEQHTEYETVADNREGN

SEQ ID NO: 168571 - protein, 196 aa, Heterodera glycines; identical to SEQ ID NO: 163621
  Homolog annotation: Hit_ID=CAG13211.1; Match level="QueryCoverage =99%, HitCoverage=23%, E-value=1e-45, Identity=46%"; Hit description =unnamed protein product [Tetraodon nigroviridis]
  Gene Ontology: Cellular component=mitochondrion
  Coding regions on vcDNA: vcDNA=SeqID_94994; Strand=+; Position=37-624

SEQ ID NO: 168572 - protein, 278 aa, Heterodera glycines; identical to SEQ ID NO: 163271
  Homolog annotation: Hit_ID=NP_496416.1; Match level="QueryCoverage =62%, HitCoverage=29%, E-value=5e-10, Identity=28%"; Hit description =putative protein, with at least 5 transmembrane domains, of bilaterial origin (66.3 kD) (2L595) [Caenorha
  Coding regions on vcDNA: vcDNA=SeqID_94995; Strand=+; Position=29-865

SEQ ID NO: 168573 - protein, 178 aa, Heterodera glycines; identical to SEQ ID NO: 162986
  Homolog annotation: Hit_ID=CAD38524.1; Match level="QueryCoverage =100%, HitCoverage=100%, E-value=7e-78, Identity=79%"; Hit description=putative glutathione peroxidase [Globodera rostochiensis]
  Gene Ontology: Mol. function=glutathione peroxidase activity; Cellular component=nucleus; Biological process=establishment and/or maintenance of chromatin architecture
  Coding regions on vcDNA: vcDNA=SeqID_94996; Strand=+; Position=60-596

SEQ ID NO: 168574 - protein, 157 aa, Heterodera glycines
  Coding regions on vcDNA: vcDNA=SeqID_94997; Strand=-; Position=3-476
FHRQSAGHIGTPCDVLTIVRVQCQLENVFGIASVVVLAKLVHKRKSPWNAPKFVDIRHNFGPFFFRLSLLLLSFPVAFLVTAAADRLRRNVQIGGAQNDGTDVDALKTLLQCFGQPPFLLLLFFVFRRFFVITFLGNPFSWRSQHFPRKFWHFITKT

SEQ ID NO: 168575 - protein, 187 aa, Heterodera glycines; identical to SEQ ID NO: 163235
  Homolog annotation: Hit_ID=CAE63854.1; Match level="QueryCoverage =89%, HitCoverage=98%, E-value=2e-55, Identity=58%"; Hit description =Hypothetical protein CBG08414 [Caenorhabditis briggsae]
  Gene Ontology: Mol. function=structural constituent of ribosome; Cellular component=mitochondrial small ribosomal subunit; Biological process=protein biosynthesis
  Coding regions on vcDNA: vcDNA=SeqID_94998; Strand=+; Position=47-610

SEQ ID NO: 168576 - protein, 159 aa, Heterodera glycines
  Coding regions on vcDNA: vcDNA=SeqID_94999; Strand=+; Position=3-479
ELKSPDIKPPEELLQVFSNPSRRSIRLADEARQCAYQNEMSRLARIIQSQQWTISSQQRTIESQQRTIEMLVSRLPRNDGAAAPPNGDERRDMGGAPNEQQHGQPPILQIDNRPHIAPEPNGRGGQNGGGHGQRPNGNANIVRGQNVVPVAPPPFVAQR

SEQ ID NO: 168577 - protein, 149 aa, Heterodera glycines; identical to SEQ ID NO: 162412
  Homolog annotation: Hit_ID=AAS78778.1; Match level="QueryCoverage =99%, HitCoverage=98%, E-value=8e-45, Identity=58%"; Hit description =thioredoxin [Ascaris suum]
  Gene Ontology: Mol. function=thioredoxin reductase (NADPH) activity; Cellular component=nucleus
  Coding regions on vcDNA: vcDNA=SeqID_95000; Strand=+; Position=8-457

SEQ ID NO: 168578 - protein, 177 aa, Heterodera glycines
  Coding regions on vcDNA: vcDNA=SeqID_95001; Strand=+; Position=3-533
SCRIRHEALIYRMYIRELESPGELPLVWLNALSRSCFRPTKDDQLVSLVELRQAAERIAVENAQLNRVNAMLLILIQRPAGVLPHQAVPVAGAFGQQQNQQPANAFPIPPVVPVVPVNANNRLHTDELQLEISRHARTLNELSVEYARLMHTNRTLVEQLFAGGAPPYVHQQFEPVD

SEQ ID NO: 168579 - protein, 202 aa, Heterodera glycines
  Homolog annotation: Hit_ID=XP_318627.1; Match level="QueryCoverage =98%, HitCoverage=18%, E-value=1e-60, Identity=60%"; Hit description =ENSANGP00000020973 [Anopheles gambiae]
  Gene Ontology: Mol. function=ATP dependent RNA helicase activity; Cellular component=nucleolus; Biological process=RNA localization
  Coding regions on vcDNA: vcDNA=SeqID_95002; Strand=+; Position=1-609
DNGKKLSGLVELGYRKRVLQRLGYATEEDTITEKGRVACELSSADELLLTEMIFTGAFTDLSPADAAALLSCFVFQERAPIGKLSDSLSEHLRTMQGMAKKIAKISIECKLELDEEKYVESFCPAMMTVVSKWCSGATFAEILETSDIFEGSIIRCMRRLEELLQEMVNAARSMGDRPLEQKFEQARSLLKRDIVFSASLYL

SEQ ID NO: 168580 - protein, 109 aa, Heterodera glycines; identical to SEQ ID NO: 166767
  Homolog annotation: Hit_ID=NP_509131.1; Match level="QueryCoverage =74%, HitCoverage=17%, E-value=2e-25, Identity=65%"; Hit description =yeast SMF (divalent cation transporter) homolog (smf-2) [Caenorhabditis elegans] gb|AAC46568.1| Yeast smf
  Gene Ontology: Mol. function=transporter activity; Cellular component= integral to plasma membrane; Biological process=transport
  Coding regions on vcDNA: vcDNA=SeqID_95003; Strand=+; Position=3-332

SEQ ID NO: 168581 - protein, 139 aa, Heterodera glycines
  Homolog annotation: Hit_ID=CAE58867.1; Match level="QueryCoverage =100%, HitCoverage=60%, E-value=3e-64, Identity=82%"; Hit description= Hypothetical protein CBG02097 [Caenorhabditis briggsae]
  Gene Ontology: Mol. function=RAB small monomeric GTPase activity; Cellular component=endoplasmic reticulum membrane; Biological process=protein transport
  Coding regions on vcDNA: vcDNA=SeqID_95004; Strand=+; Position=30-477
MSYNYLFKIVVVGDHNCGKSCILLRFSENSFRSDHVSTLGVDFKLKTIKIGRDKIRLELWYFNVLTLRMERYRTIYNSYYHSAHGVMCVYDLTNEKSFQNLENYWLRQVKEHAPQNAVLLMVGNKADLDSERKVDFDRA

SEQ ID NO: 168582 - protein, 111 aa, Heterodera glycines; identical to SEQ ID NO: 138785
  Coding regions on vcDNA: vcDNA=SeqID_95005; Strand=+; Position=84-419

SEQ ID NO: 168583 - protein, 239 aa, Heterodera glycines
  Homolog annotation: Hit_ID=AAP80689.1; Match level="QueryCoverage =98%, HitCoverage=95%, E-value=1e-120, Identity=93%"; Hit description= polyubiquitin [Griffithsia japonica]
  Coding regions on vcDNA: vcDNA=SeqID_95006; Strand=+; Position=1-717
GLSEYSLFIIMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLALRPRGGMQIFVKTLTGKTITLEVEASDTIENVKAKIQDKEGIPPDQQRLIFAGKQLEDGRTLADYNIQKESTLHLVLRLRGGK

SEQ ID NO: 168584 - protein, 247 aa, Heterodera glycines
  Coding regions on vcDNA: vcDNA=SeqID_95007; Strand=+; Position=3-743
IEMPIFFARPLAAEKKLPILNKTPEPTESQKDTLSDDGQDNQDSGASTSSQTNLIKNVRILRKEAAETSLEPYIQFQCFAHFAISRKCVNELCADVSSDGVDVHIFFEDDFPRLPRIGFSCLSLQELYEDRALLSEKNATPDQLSFIQLVRFVDNGLNEIPNWLLVAPKRGQIFTISLDLADGNGVRVRFSFGSVSPTPWYSVRYPPYKSDFSLVIEVDKKAVLRRSYEESSTLSILSSFGLLERKL

SEQ ID NO: 168585 - protein, 111 aa, Heterodera glycines
  Homolog annotation: Hit_ID=NP_506146.1; Match level="QueryCoverage =63%, HitCoverage=16%, E-value=1e-11, Identity=53%"; Hit description =putative protein, with 2 coiled coil-4 domains (5N52) [Caenorhabditis elegans] emb|CAB02877.1| Hypothetic
  Coding regions on vcDNA: vcDNA=SeqID_95008; Strand=+; Position=16-351
MRTSLLIPFSLFSLITLLFIVSFSEADIEVDSLMPRTKRQCCGGCGYSGGYGGYGNDGGGQCCDACGQCGSGGYGSGAIIITTGGGGYGYGGYGDGYCYSCGGGGCYGCCG

SEQ ID NO: 168586 - protein, 292 aa, Heterodera glycines
  misc_feature (42)..(42): Xaa can be any naturally occurring amino acid
  misc_feature (54)..(54): Xaa can be any naturally occurring amino acid
  misc_feature (65)..(65): Xaa can be any naturally occurring amino acid
  misc_feature (142)..(142): Xaa can be any naturally occurring amino acid
  misc_feature (158)..(158): Xaa can be any naturally occurring amino acid
  misc_feature (174)..(174): Xaa can be any naturally occurring amino acid
  misc_feature (233)..(233): Xaa can be any naturally occurring amino acid
  misc_feature (268)..(268): Xaa can be any naturally occurring amino acid
  misc_feature (286)..(286): Xaa can be any naturally occurring amino acid
  Homolog annotation: Hit_ID=BAB33421.1; Match level="QueryCoverage =94%, HitCoverage=96%, E-value=3e-85, Identity=63%"; Hit description =putative senescence-associated protein [Pisum sativum]
  Coding regions on vcDNA: vcDNA=SeqID_95009; Strand=+; Position=518 -1393
CLPTPGSKNIAILPRRDSDLEAFSHNPSDGSFAPLVYRPSTXTKCLNLRFLSYXQDYYHSNRSLXGKTNLSHDGLNPAHVPYWWVNNPTLGEFCFAMIGRADIEGSKSDVAMDAWPPQASYPCGNFSDTSCWKLYTFKRIDXATLSRSVFVLKIRIKXAFAFLLYERFPSSLSXALGHLRYALTDVPPQSNSPPDTVIGAGSPGHRVARLNTKMDTLSGALPFYRLSKESMKXSGISLAPCGSHLCYTSHDSSQSQTRVKLNRVFFPXAKFAKPVPLAVVSLDSRXGQWESR

SEQ ID NO: 168587 - protein, 194 aa, Heterodera glycines
  Homolog annotation: Hit_ID=NP_505582.2; Match level="QueryCoverage =91%, HitCoverage=51%, E-value=1e-31, Identity=44%"; Hit description =yip1 interacting factor homolog (39.1 kD) (5K530) [Caenorhabditis elegans] emb|CAA94831.2| Hypothetical p
  Coding regions on vcDNA: vcDNA=SeqID_95010; Strand=+; Position=38-619
MTTPNLPYGAREGSGQFSTGTNFSPPPPPYDAGASSPFEQPHQQHQSPSPYGMMYSGGNVPSPPPPSSPYHQYQQQAPPQMSPPFQAPIGDPQQQFMYDPLLNTARHLGGQFAEQQKQKFTQYLSSTSFNLKYYFAVDTNYVRRKLGIILFPLFHRDWANKCEGDAPVLPCQDVNAPDLYISMMEYIAYVLVTG

SEQ ID NO: 168588 - protein, 86 aa, Heterodera glycines
  Coding regions on vcDNA: vcDNA=SeqID_95011; Strand=-; Position=3-260
SVGHSFVINQITTQNLSHCFASLPPLAHLRHQLKSPPPPGCKIVPLEKPSVKLNWRFSRGDKAAKDKNGRRRSRNRKRKKRRMGEG

SEQ ID NO: 168589 - protein, 103 aa, Heterodera glycines
  Coding regions on vcDNA: vcDNA=SeqID_95012; Strand=+; Position=2-310
LHTTRLPRTPSRLCTAFRFPFAWLCQGESALCGPSWPHRTAAELAVHACRVSFVLMSVISQPIAVISVSHGQAKASRLAESIVTTQLLATTPSFAFPIVDAPH

SEQ ID NO: 168590 - protein, 69 aa, Heterodera glycines; identical to SEQ ID NO: 162394
  Coding regions on vcDNA: vcDNA=SeqID_95013; Strand=+; Position=46-255

SEQ ID NO: 168591 - protein, 151 aa, Heterodera glycines; identical to SEQ ID NO: 164438
  Homolog annotation: Hit_ID=NP_505304.1; Match level="QueryCoverage =92%, HitCoverage=91%, E-value=3e-19, Identity=37%"; Hit description =esophageal gland cell secretory protein 11 like precursor family member (17.3 kD) (5J403) [Caenorhabditis
  Coding regions on vcDNA: vcDNA=SeqID_95014; Strand=+; Position=3-458

SEQ ID NO: 168592 - protein, 186 aa, Heterodera glycines
  Coding regions on vcDNA: vcDNA=SeqID_95015; Strand=-; Position=70-630
FFSDRQFIHKEKTREYADRLQEKQNTKFSKTNTKFSMVYRIVTLFSNGGGAVVQMEFVTTFLFVADETDHHNDNEQNGGDGQKNEHQTKGIFAIVQLATIFRSRTVRFVVAGFEGFVSEKRSRLIVRWRMERIGHAVDVGDTVRLVRLKLLRIAVQLLTIHNLCRANETKMDEQKDEEEKTERIHW

SEQ ID NO: 168593 - protein, 157 aa, Heterodera glycines
  Homolog annotation: Hit_ID=CAA60012.1; Match level="QueryCoverage =97%, HitCoverage=69%, E-value=1e-50, Identity=70%"; Hit description =H+ ATP synthase; subunit beta [Drosophila virilis] sp|Q24751|ATPB _DROVI ATP synthase beta chain, mitochond
  Gene Ontology: Mol. function=hydrogen-transporting ATP synthase activity, rotational mechanism; Cellular component=soluble fraction; Biological process=energy pathways
  Coding regions on vcDNA: vcDNA=SeqID_95016; Strand=+; Position=80-550
MLNATRSAVRAVAQRMPLARTMASAAPAGAVAAGQIKSVIGAVVDVQFDGPLPPILNALEVQDHNIRLVLEVAQHLGENTVRTIAMDGTEGLVRGQKVLDTGAPIMIPVGRECLGRIMNVIGEPIDERGPINAKNKLPIHADPPEFVDMTTTPEILE

SEQ ID NO: 168594 - protein, 213 aa, Heterodera glycines
  Homolog annotation: Hit_ID=XP_309756.1; Match level="QueryCoverage =96%, HitCoverage=76%, E-value=3e-36, Identity=39%"; Hit description =ENSANGP00000012467 [Anopheles gambiae]
  Gene Ontology: Cellular component=cytoplasm; Biological process =autophagy
  Coding regions on vcDNA: vcDNA=SeqID_95017; Strand=+; Position=17-655
MDSKSNDFEARRTVWDSKVPVEFTLDNSESVLASHQSCFMMLSRVSYFPVYLDKALKVLTSGDASEEQLLNVWLQFDGQILRWHYPIGVLYDIYHGNAGDGQTTPWPITVHLKNFPDELIRCRTKETLKFCFLQSLKEACQLKLRSNIAASMTKDEHGRLFDGLCNDRFNDFWMVNDKLMGLRSSSGEEQFSTIPARFYESSYSFRQLLLHSK

SEQ ID NO: 168595 - protein, 102 aa, Heterodera glycines
  Coding regions on vcDNA: vcDNA=SeqID_95018; Strand=+; Position=81-389
CRTVLEECYQSVRTKCRQRDKWTKDKAQKGIGREAELDLPKVGLRAQVTCPRQSDRTPKKSLKMSLRPLKKRAFRGWAVSVGRRDKRQTNDSNGPAFVFLLK

SEQ ID NO: 168596 - protein, 324 aa, Heterodera glycines
  Coding regions on vcDNA: vcDNA=SeqID_95019; Strand=+; Position=74-1045
MSVEESPLLREFKTFLQATLVAFGSDGAPFSLVNQRFSEDWVGSPSLKEYATKLGYVHPNGIFKLLQSIPDQVTMMVNPTGEVILKPVPMEETRDNLEKIDATNKELKAERKRRQQYQQGPLPASVIAQLAAGICWPPPVPAQPLSSVFNASIERTAPLATSSIATISRPPPPPPMTKKFNPNLIPLGTPRFARCASTSNIAADSSADSGPSASGGPTPSPMVFHPPHQQPQQQPQRSKVFFGQRKKPPPPVAVPRNDFGDLAPPVAVSRNDFGDLAPPVAVPRNDFCDMPPPAAVSRNDVAQTLSSVFKRNEGYYEEDFHALA

SEQ ID NO: 168597 - protein, 148 aa, Heterodera glycines
  Homolog annotation: Hit_ID=NP_593680.1; Match level="QueryCoverage =95%, HitCoverage=89%, E-value=3e-32, Identity=39%"; Hit description =cellular nucleic acid binding protein homolog [Schizosaccharomyces pombe] emb|CAA93542.1| byr3 [Schizosac
  Gene Ontology: Mol. function=transcription factor activity; Biological process=cell cycle
  Coding regions on vcDNA: vcDNA=SeqID_95020; Strand=+; Position=52-495
MSYGDYQQRPRGCFNCGSADHQARDCDQGVKCYNCGGTGHTSRDCSEPRKAKTCNNCNQEGHIARDCPDAPAQSARSCYKCGEVGHISRDCTQGRFAGGDRMAGRNCYKCGEAGHISRECPQNAGGDSSWGGNSGGSSRACYKCGPEG

SEQ ID NO: 168598 - protein, 315 aa, Heterodera glycines
  Homolog annotation: Hit_ID=NP_955005.1; Match level="QueryCoverage =78%, HitCoverage=73%, E-value=1e-51, Identity=42%"; Hit description =shadow of prion protein [Mus musculus] gb|AAH27306.1| Gene model 169 [Mus musculus]
  Gene Ontology: Mol. function=GTPase activity; Cellular component =mitochondrial inner membrane; Biological process=G-protein coupled receptor protein signaling pathway
  Coding regions on vcDNA: vcDNA=SeqID_95021; Strand=+; Position=18-962
MTFPRNSLLRSPRIRPNLLNFSACFSSPSDGSAPRLEGSSPPPLASSIRFPHFVSRQKFTLSSTYEKQDWFPKHMVVQLKVMEGKLRTVDLVIEVHDARVALTGRNPSFGAKLYSVRPHILVFNKMDLINMKRYKEPIEEYYRNEQNITNICWTNCKNLTNKTQFQNLMDKMLDLLRNEHRFNRTVKTEYQVMVVGIPNTGKSSLINALRNVNLDFGKAVKEGARPGVTIRVQNRVRILDRPPTYLMDTPGVLNPWANNIDAAMKLAICNLVLDTTTRPNFVADYLLYFMNKYRDFSYVDFLRIREPSDDIKQVL

SEQ ID NO: 168599 - protein, 190 aa, Heterodera glycines
  misc_feature (162)..(162): Xaa can be any naturally occurring amino acid
  Homolog annotation: Hit_ID=CAE71307.1; Match level="QueryCoverage =98%, HitCoverage=56%, E-value=4e-55, Identity=54%"; Hit description =Hypothetical protein CBG18196 [Caenorhabditis briggsae]
  Coding regions on vcDNA: vcDNA=SeqID_95022; Strand=+; Position=112-681
MDPPDLSETQPTIPKRGHHHRRRVDISASRLPRAVLVRIFGHLSVAELGAVSLVCCSWKFIVDSNDFDLWARHARAQLPESALSDPYLFVNISSHREMLRAFKHAWNPSDCSRNAFVRTNGFTVHRQPIAQSTDGIRGKVGVSSGAHCWEFCWEGPLGTTAXVGVATKHAALHCPGYLPVIGSDDPSWGW

SEQ ID NO: 168600 - protein, 245 aa, Heterodera glycines; identical to SEQ ID NO: 163131
  Homolog annotation: Hit_ID=AAF21097.1; Match level="QueryCoverage =95%, HitCoverage=97%, E-value=7e-71, Identity=57%"; Hit description =thioredoxin peroxidase [Dirofilaria immitis]
  Gene Ontology: Mol. function=thioredoxin peroxidase activity; Cellular component=mitochondrion; Biological process=phospholipid catabolism
  Coding regions on vcDNA: vcDNA=SeqID_95023; Strand=+; Position=10-747

SEQ ID NO: 168601 - protein, 239 aa, Heterodera glycines
  Coding regions on vcDNA: vcDNA=SeqID_95024; Strand=+; Position=76-795
MAPKCLPLELLFEIVPFIPAEKAVPNALSSCRLLHKLLLPRVIKWKEQLLTDLMSFSAIVNNLSAKVDNLSGVVNNHSVKLDNLSGVVNNLSGVVNNLSAKVETIEKKMGETTGKAPNEQKERGNGHKAVMGAYNENNGTIEVPLHGYNVGKAIVERILNTENGTVHLHGMREPMSLAKAVEIGFFDNLSLTVVDPNTFSKAVFGRSIGTESAGLKWPIAAPAPATDIGRSESAKTCAS

SEQ ID NO: 168602 - protein, 84 aa, Heterodera glycines; identical to SEQ ID NO: 163611
  Homolog annotation: Hit_ID=CAE59446.1; Match level="QueryCoverage =100%, HitCoverage=100%, E-value=2e-24, Identity=64%"; Hit description=Hypothetical protein CBG02821 [Caenorhabditis briggsae]
  Coding regions on vcDNA: vcDNA=SeqID_95025; Strand=+; Position=48-302

SEQ ID NO: 168603 - protein, 161 aa, Heterodera glycines
  Homolog annotation: Hit_ID=CAE68470.1; Match level="QueryCoverage =71%, HitCoverage=41%, E-value=9e-11, Identity=33%"; Hit description =Hypothetical protein CBG14269 [Caenorhabditis briggsae]
  Coding regions on vcDNA: vcDNA=SeqID_95026; Strand=+; Position=49-531
MSQREEPRPQIKAKLKNSLIAFHLFLLVSGVVLFSFALWLQFDPAREFLLRLVHFSESTPFFEIAVYLMLGTSLFIFIAVGIGFSGIWKLERCLLSGFSVLLLLLIHCKLLILFLLVAYRFKFPDDTVMTEYLCKMAQHHYHRDKWATPLMDSVQFYHKCC

SEQ ID NO: 168604 - protein, 160 aa, Heterodera glycines
  Homolog annotation: Hit_ID=NP_502554.2; Match level="QueryCoverage =63%, HitCoverage=18%, E-value=1e-11, Identity=37%"; Hit description =kelch repeat containing protein (4O56) [Caenorhabditis elegans] emb|CAC44304.2| Hypothetical protein Y67H
  Coding regions on vcDNA: vcDNA=SeqID_95027; Strand=+; Position=2-481
SQKCSQSRTLSAFEIVPVRGCKLSKSSSRRPEFCECCPIPRSGHRVFADSDFIYVFGGYNPFHSPDSTYTDFWRFNRLTHLWQKCGLSSSDPTTQLPNSLASFALASSSRPSECFIFGGTGIPFGLAASNELHRIRIDLLGNVNVRTEPKQSYEQRQNTA

SEQ ID NO: 168605 - protein, 118 aa, Heterodera glycines; identical to SEQ ID NO: 166759
  Homolog annotation: Hit_ID=EAA16792.1; Match level="QueryCoverage =98%, HitCoverage=17%, E-value=3e-16, Identity=47%"; Hit description =ookinete protein-related [Plasmodium yoelii yoelii]
  Gene Ontology: Mol. function=RNA helicase activity; Cellular component=cytoplasm; Biological process=post-embryonic development
  Coding regions on vcDNA: vcDNA=SeqID_95028; Strand=-; Position=1-354

SEQ ID NO: 168606 - protein, 96 aa, Heterodera glycines; identical to SEQ ID NO: 162347
  misc_feature (23)..(23): Xaa can be any naturally occurring amino acid
  Homolog annotation: Hit_ID=CAE61561.1; Match level="QueryCoverage =97%, HitCoverage=94%, E-value=7e-27, Identity=58%"; Hit description =Hypothetical protein CBG05470 [Caenorhabditis briggsae]
  Coding regions on vcDNA: vcDNA=SeqID_95029; Strand=+; Position=11-300

SEQ ID NO: 168607 - protein, 160 aa, Heterodera glycines
  Homolog annotation: Hit_ID=XP_317369.1; Match level="QueryCoverage =96%, HitCoverage=56%, E-value=9e-24, Identity=38%"; Hit description =ENSANGP00000011612 [Anopheles gambiae]
  Gene Ontology: Mol. function=ribonuclease H activity; Cellular component=cell; Biological process=nucleobase, nucleoside, nucleotide and nucleic acid metabolism
  Coding regions on vcDNA: vcDNA=SeqID_95030; Strand=+; Position=34-513
MRQASFYAVARGRAVGVFNTWQKCNDSINGFSGAKFKKFPTLEQANDFIGKHRETLNSGGKVISKKGPPVRTMIVKSAATTFAERRLTRNTAMFGVEASNSLAASNLVSVDDGFTTVVYTDGACSRNGFVGAKAGFGVFWSDGHPDNVSAPVNGPATNNR

SEQ ID NO: 168608 - protein, 38 aa, Heterodera glycines
  Coding regions on vcDNA: vcDNA=SeqID_95031; Strand=+; Position=7-123
MRIERARFDEVLVSQKKSKHLKIYKKFKNENSCEIFWK

SEQ ID NO: 168609 - protein, 223 aa, Heterodera glycines
  Coding regions on vcDNA: vcDNA=SeqID_95032; Strand=+; Position=3-671
TMAVSHPQQKQNGRHSGGGTVPKHIGIGRLPTEDNGTTSGENPSHQLDDGDDVHQFQLPLAFRSSLVHPSTTTAQNVHHHQLLQQPQLNIIVPSMECVSVIHPKREQQFSASVDQFLDGEDDLFKTEPLDLSLSSARTKANENGTMVGNGATVAGGIQRRKRTTNKRQMVEEMCETAATGRKVTPTEAEKRTSPPSAVGISLPPSVVPPSGTLFTPLASPSAV

SEQ ID NO: 168610 - protein, 207 aa, Heterodera glycines; identical to SEQ ID NO: 163608
  misc_feature (197)..(197): Xaa can be any naturally occurring amino acid
  Homolog annotation: Hit_ID=AAK94486.1; Match level="QueryCoverage =100%, HitCoverage=98%, E-value=1e-114, Identity=98%"; Hit description=putative gluthathione reductase [Heterodera glycines]
  Gene Ontology: Mol. function=thioredoxin reductase (NADPH) activity; Cellular component=mitochondrion; Biological process=response to oxidative stress
  Coding regions on vcDNA: vcDNA=SeqID_95033; Strand=+; Position=22-641

SEQ ID NO: 168611 - protein, 229 aa, Heterodera glycines; identical to SEQ ID NO: 162813
  Coding regions on vcDNA: vcDNA=SeqID_95034; Strand=-; Position=226-915

SEQ ID NO: 168612 - protein, 50 aa, Heterodera glycines
  Coding regions on vcDNA: vcDNA=SeqID_95035; Strand=+; Position=331-480
FVHSFVFLCRKVCVHCKCDRNEHEPSSNQALSVYERLGLKPSSDMAKVLQ

SEQ ID NO: 168613 - protein, 164 aa, Heterodera glycines
  Homolog annotation: Hit_ID=NP_501713.1; Match level="QueryCoverage =82%, HitCoverage=87%, E-value=2e-21, Identity=39%"; Hit description =predicted CDS, ctr copper transporter family member (4K417) [Caenorhabditis elegans] emb|CAA92470.2| Hypo
  Gene Ontology: Mol. function=copper ion transporter activity; Cellular component=integral to plasma membrane; Biological process =copper ion transport
  Coding regions on vcDNA: vcDNA=SeqID_95036; Strand=+; Position=33-527
MMWMFFHTQIKDTVLFKWWKVETVGSLLITCLVMYFGAICFEAIKWLRLMLEQKSRQPNSANSAGLNMTDQNKTVPMTNRRYAESLLSRVHLLQSVLFTVQLLLSYLLMLCFMTFSVWIGMAICAGAATGFWLFGRRVPMLAFASSGAAGSGQGYASTGRTELH

SEQ ID NO: 168614 - protein, 163 aa, Heterodera glycines
  Coding regions on vcDNA: vcDNA=SeqID_95037; Strand=+; Position=1-489
VRYLAIFAKMNNAMDSVPARIVIIGTSKMRLSERFNKLQKAPPPPLPQAQQQKVFLKREGINGVAIGPVISRPRVIDERDRPDNRIQSSKSFLHDDYMDNDLYGDFVEPFLRRPQMGGFRSANLYEGFQPAPDPLKLTLDAYDQYSRFRPSHRRSIHSRITET

SEQ ID NO: 168615 - protein, 143 aa, Heterodera glycines
  Homolog annotation: Hit_ID=NP_499693.1; Match level="QueryCoverage =78%, HitCoverage=23%, E-value=1e-23, Identity=47%"; Hit description =dehydrogenase, E1 component (3O58) [Caenorhabditis elegans] pir||T26758 hypothetical protein Y39E4A.3 - C
  Gene Ontology: Mol. function=3-methyl-2-oxobutanoate dehydrogenase (lipoamide) activity; Cellular component=alpha-ketoglutarate dehydrogenase complex (sensu Eukarya)
  Coding regions on vcDNA: vcDNA=SeqID_95038; Strand=+; Position=54-482
MMNLFKFRDIVLLRTIAFPPNFVLNRGINYRENSTIGSKQSIGNADEFKLREFGQKYLGKREVKFTEKLEFRSSANEVPMPIYQCINSRGEFVDGSEECPLPKEIAVKIYKEMVKLNTMDKILYESQRQGRISFYMTNFGEEA

SEQ ID NO: 168616 - protein, 154 aa, Heterodera glycines; identical to SEQ ID NO: 163605
  Homolog annotation: Hit_ID=EAA05601.2; Match level="QueryCoverage =77%, HitCoverage=29%, E-value=1e-10, Identity=33%"; Hit description =ENSANGP00000012577 [Anopheles gambiae str. PEST]
  Gene Ontology: Mol. function=transcription factor activity; Biological process=cell proliferation
  Coding regions on vcDNA: vcDNA=SeqID_95039; Strand=+; Position=24-488

SEQ ID NO: 168617 - protein, 150 aa, Heterodera glycines
  Homolog annotation: Hit_ID=CAF88681.1; Match level="QueryCoverage =66%, HitCoverage=47%, E-value=5e-09, Identity=33%"; Hit description =unnamed protein product [Tetraodon nigroviridis]
  Coding regions on vcDNA: vcDNA=SeqID_95040; Strand=+; Position=53-505
MDHLIALIDGACLRMQSSALHWVSDSIKSKSEPKKPEKFKTQLCHHYSQNGFCRFGSSCWFAHGENELRSVSAGSSFSSPIGSRKPRSLLPRPPPPLMFGSSCWFAHGENELRSVSAGSSFSSPIGSRKPRSLLPRPPPSLLFNIFPKNP

SEQ ID NO: 168618 - protein, 61 aa, Heterodera glycines; identical to SEQ ID NO: 162315
  Homolog annotation: Hit_ID=NP_498706.1; Match level="QueryCoverage =73%, HitCoverage=77%, E-value=6e-10, Identity=60%"; Hit description =putative cytoplasmic protein of bilaterial origin (6.3 kD) (3I951) [Caenorhabditis elegans] gb|AAA28213.1
  Coding regions on vcDNA: vcDNA=SeqID_95041; Strand=+; Position=82-267

SEQ ID NO: 168619 - protein, 101 aa, Heterodera glycines; identical to SEQ ID NO: 163512
  Homolog annotation: Hit_ID=NP_496970.1; Match level="QueryCoverage =85%, HitCoverage=88%, E-value=9e-25, Identity=61%"; Hit description =high Mobility Group protein (10.6 kD) (hmg-1.1) [Caenorhabditis elegans] emb|CAB54448.2| Hypothetical pro
  Gene Ontology: Mol. function=DNA binding; Cellular component=nucleus; Biological process=regulation of transcription, DNA-dependent
  Coding regions on vcDNA: vcDNA=SeqID_95042; Strand=+; Position=2-307

SEQ ID NO: 168620 - protein, 142 aa, Heterodera glycines
  misc_feature (67)..(67): Xaa can be any naturally occurring amino acid
  Homolog annotation: Hit_ID=NP_497276.2; Match level="QueryCoverage =100%, HitCoverage=55%, E-value=7e-25, Identity=44%"; Hit description= RNA-binding protein S1 serine-rich domain like (rnp-4) [Caenorhabditis elegans] gb|AAK21429.2| Rnp (rrm
  Gene Ontology: Mol. function=RNA binding; Cellular component=nucleus; Biological process=RNA splicing
  Coding regions on vcDNA: vcDNA=SeqID_95043; Strand=+; Position=1-425
RRRSSSSSSSGSSSSTGSSSSGSSSSSSTTASRSPSPKKQRAAARPSARDDRTTRRSPRRSRSPHRXPTENREKHCQLSPRHERAAPSPPPVKRERTPEPPPRRLCVRNLSRNITKAHMEEIFALFGALKSCELPMDRVHVH

SEQ ID NO: 168621 - protein, 340 aa, Heterodera glycines
  misc_feature (165)..(165): Xaa can be any naturally occurring amino acid
  Homolog annotation: Hit_ID=CAE60538.1; Match level="QueryCoverage =99%, HitCoverage=99%, E-value=1e-134, Identity=72%"; Hit description= Hypothetical protein CBG04165 [Caenorhabditis briggsae]
  Gene Ontology: Mol. function=fructose-bisphosphatase activity; Cellular component=cytosol; Biological process=gluconeogenesis
  Coding regions on vcDNA: vcDNA=SeqID_95044; Strand=+; Position=55-1075
MPSEYGIETDSVTLQRFVLNEQKKFPDATGDLTTLLTSLLTAVKAISSAVRKAGLAQLYGVAGNVNVQGEDVKKLDVLSNELMINMLKSSYTVSTLVSEENEQVIEVEVSGTQGKYIVTFDPLDGSSNIDCLVSIGTIFGIFRKASNTSTKEEDTLQTGRKMVAXAGYALYGSATMVVLSTPGRVDGFTLDPSIGEFILTNPAMRVPKKGKIYSINEGYAKKWSKGITEYIRSRKFPEEGKSAYGQRYVGSMVADVHRTLLYGGIFMYPATTDAPNGKLRLLYECNPMAFVMENAGGKAHSGKCPILDIQPKSIHQRAPIFLGSKEDVEELLEYIRKHDQ

SEQ ID NO: 168622 - protein, 167 aa, Heterodera glycines
  Coding regions on vcDNA: vcDNA=SeqID_95045; Strand=+; Position=3-506
PIKVMQCQKDCEEARRQRDREVNKKRTIQQFEEEERRARAIASAAFADPVPLTADERGHAELMKRISPMPMRRIMVSATQNQQKTEAAARVVAAYDRTAMAAPAPQFVQQPRGRTFPTALSVFGECVPNNCRRVGAMPSKNIVGVRLTQQTNSVANASQLKRTFPGK

SEQ ID NO: 168623 - protein, 202 aa, Heterodera glycines
  Homolog annotation: Hit_ID=CAE73733.1; Match level="QueryCoverage =95%, HitCoverage=70%, E-value=3e-54, Identity=55%"; Hit description =Hypothetical protein CBG21259 [Caenorhabditis briggsae]
  Coding regions on vcDNA: vcDNA=SeqID_95046; Strand=+; Position=30-635
MLSRLFLQPNNLPSIRYLATSAFSKARYGFRPSGGAGQYAFRFKEAFAARQVAPTLRERLLGPTTGKPFIVGTYALAGASVFGIGMLCYYGLTTTVDSAAVRSNLWPDYVRQRLQSTYAYLAGSLALTAGAGVAAARSPGILALTSAPSLLVWFGSLAAIIGSGIVVQKIDYHGNSAAKHLAWLAHCGILGAVLAPLCFVGG

SEQ ID NO: 168624 - protein, 212 aa, Heterodera glycines
  Homolog annotation: Hit_ID=CAE75456.1; Match level="QueryCoverage =74%, HitCoverage=85%, E-value=2e-24, Identity=35%"; Hit description =Hypothetical protein CBG23451 [Caenorhabditis briggsae]
  Coding regions on vcDNA: vcDNA=SeqID_95047; Strand=+; Position=25-660
MSSFFMHHQQKRSHQQAAAVTLADIRWMEPMAATESAATSSTPAKRLLTRLGTTRVGRYVQQLAIDYAASFRDIVVGMRQRPLRAVACGAALASLVFTLKSNPDEIALRARLAQLRQQMVLIPASIHSTRADERLEQYTVLLNGNRLELVDFLLFSVLVERPFDKKNDFYAAHDKTLRGWPWTELWRNAWDIGALGRFWALERSFDNCDVRH

SEQ ID NO: 168625 - protein, 186 aa, Heterodera glycines
  misc_feature (114)..(114): Xaa can be any naturally occurring amino acid
  Homolog annotation: Hit_ID=NP_493230.1; Match level="QueryCoverage =94%, HitCoverage=96%, E-value=5e-50, Identity=48%"; Hit description =DNA segment Chr 11 Wayne State University 68 expressed (21.5 kD) (1N326) [Caenorhabditis elegans] emb|CAB
  Gene Ontology: Cellular component=endosome; Biological process =conjugation with cellular fusion
  Coding regions on vcDNA: vcDNA=SeqID_95048; Strand=+; Position=10-570
AYFINFDVKLAMSFQWPWHFDFPPFFTIQPNLSTRDKQLKAWGRLLLDYCQANRIYTTDLDEISKSDLFNNRRLNRHLDLSGIRAVFDFLELQKHVEWKDKDKTRCNIYWRRPXEWGQLLYEWANSIGLLNTVVTLYELTQGEYVAKESFYGLDKDVLLKGLQHLENQGKAVLIDIDGEKGGVKFL

SEQ ID NO: 168626 - protein, 145 aa, Heterodera glycines; identical to SEQ ID NO: 162442
  Homolog annotation: Hit_ID=NP_497826.1; Match level="QueryCoverage =98%, HitCoverage=99%, E-value=2e-34, Identity=53%"; Hit description =ethanol induced 6 like (15.4 kD) (3F241) [Caenorhabditis elegans] emb|CAA86749.1| Hypothetical protein C1
  Coding regions on vcDNA: vcDNA=SeqID_95049; Strand=+; Position=45-482

SEQ ID NO: 168627 - protein, 303 aa, Heterodera glycines; identical to SEQ ID NO: 162409
  misc_feature (213)..(213): Xaa can be any naturally occurring amino acid
  Homolog annotation: Hit_ID=AAH76913.1; Match level="QueryCoverage =87%, HitCoverage=77%, E-value=1e-33, Identity=31%"; Hit description =MGC89088 protein [Xenopus tropicalis] ref|NP_001005045.1| MGC89088 protein [Xenopus tropicalis]
  Gene Ontology: Mol. function=NAD(P)+ transhydrogenase activity; Biological process=carbohydrate metabolism
  Coding regions on vcDNA: vcDNA=SeqID_95050; Strand=+; Position=36-945

SEQ ID NO: 168628 - protein, 104 aa, Heterodera glycines
  Homolog annotation: Hit_ID=AAH79755.1; Match level="QueryCoverage =77%, HitCoverage=84%, E-value=2e-20, Identity=60%"; Hit description =Unknown (protein for IMAGE:6951677) [Xenopus laevis]
  Gene Ontology: Mol. function=structural constituent of cytoskeleton; Cellular component=intermediate filament; Biological process =cellular morphogenesis
  Coding regions on vcDNA: vcDNA=SeqID_95051; Strand=+; Position=41-355
MNSATMFTLLLIIGTVLALTIGMPAPGGSDESVSSMRQKRGYGMSNGGGMGNGFGGGMGNGFGGGMGNGFGGGMGNGFGGGMGNGFGGGMGGGSGGGYGYGKRR

SEQ ID NO: 168629 - protein, 127 aa, Heterodera glycines
  Coding regions on vcDNA: vcDNA=SeqID_95052; Strand=+; Position=72-455
MAEETSKTSENIAEDNGIKALDSLFAAVAHASKCLASAAGTPNFCLATPAFLAFMVWCCFLMPPVAVLFRSYRRDGNAFTVQAAYNVILCFFLWVPGMLHALWFCFGETVRMFRRRVPPSDDAQKNE

SEQ ID NO: 168630 - protein, 152 aa, Heterodera glycines
  Homolog annotation: Hit_ID=XP_414703.1; Match level="QueryCoverage =79%, HitCoverage=5%, E-value=5e-16, Identity=34%"; Hit description =PREDICTED: similar to c407A10.1 (GPI1 (N-acetylglucosaminyl transferase component)) [Gallus gallus]
  Coding regions on vcDNA: vcDNA=SeqID_95053; Strand=+; Position=18-473
MSAIHQFLEWSALSAELTFKFENLRRLLYLFVDSLFGLIILTFATSQWTNISTNFWAAIHLYIEQLETLITWLTNNPAGLKLNDALNTFLANFFFYHIHLWKTYVTVFEHSLTNWLLIVAFGALGFSVLVAFLSDFLRVLTVHIFCFHIYTH

SEQ ID NO: 168631 - protein, 322 aa, Heterodera glycines
  misc_feature (81)..(81): Xaa can be any naturally occurring amino acid
  Homolog annotation: Hit_ID=NP_496723.2; Match level="QueryCoverage =96%, HitCoverage=99%, E-value=1e-115, Identity=63%"; Hit description= spermidine synthase (35.0 kD) (2N99) [Caenorhabditis elegans] emb|CAB60361.2| Hypothetical protein Y46G5
  Gene Ontology: Mol. function=spermidine synthase activity; Biological process=pantothenate biosynthesis
  Coding regions on vcDNA: vcDNA=SeqID_95054; Strand=+; Position=8-976
MNLLHKEWYTEFSPDDAQRIAGTGDGCSKMMKLDGAELSGAWTGQAFSLNVDKILFSERSKFQDVLVFKSKTFGNVLVLDXAIQTTDRDEFAYQEMLAHLPMCSHPDPKQVLIIGGGDGGILREVLKHPSVERVVMCEIDEMVVQVAKKFLHGLATSFDSPKLQLHIGDGFEFLKGHEAEFDVIITDSSDPIGPAESLFGKSYYQLVRNALKEDGVLASQAESIWLHLPLISKLMNCARDLFPSVAYASATVPTYPSGTIGYLLASKRQMHVLSVPLRPLNDSECQSMGLKFYNRLLHSASFVLPNFAEEALNQQQNSGRDQ

SEQ ID NO: 168632 - protein, 112 aa, Heterodera glycines
  Coding regions on vcDNA: vcDNA=SeqID_95055; Strand=+; Position=42-380
MIRRNFWEKSVNWRKNRNSCRRKTSIRHAFVISIRQLRLAIEIGDPVLISRCFLYISLAFAQKGQFLTALKIVRQEWIRGIELKSAFLLNCTRGVWSTIKWLMMNRKVMMLK

SEQ ID NO: 168633 - protein, 206 aa, Heterodera glycines
  Homolog annotation: Hit_ID=CAE68901.1; Match level="QueryCoverage =94%, HitCoverage=67%, E-value=8e-61, Identity=60%"; Hit description =Hypothetical protein CBG14873 [Caenorhabditis briggsae]
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_95056; Strand=+; Position=24-641
MHLSVCSLLLKRLPSTRLATTLANVRAKNVKQPSTERINAISLDDFPIAYPDFLRSEVLDRRDPLFEQLVQADMFERRMVIDIPEFYVGSVLAVTMSDPNTVSKQHRFVGICIRREKQGLQHTFTLRNVIDGLGIEIMYEIYNPTILRIETLLLEKRLDEDLTYLADALPEYTTFKFNMEPVSHTAGKPVPVNPLKVKLKPPPWTL

SEQ ID NO: 168634 - protein, 97 aa, Heterodera glycines; identical to SEQ ID NO: 163309
  Homolog annotation: Hit_ID=NP_996661.1; Match level="QueryCoverage =89%, HitCoverage=42%, E-value=9e-30, Identity=72%"; Hit description =Unknown (protein for MGC:77145) [Danio rerio] gb|AAH65318.1| Unknown (protein for MGC:77145) [Danio rerio
  Gene Ontology: Mol. function=ATP binding; Cellular component=Golgi apparatus; Biological process=negative regulation of FGF receptor signaling pathway
  Coding regions on vcDNA: vcDNA=SeqID_95057; Strand=+; Position=2-295

SEQ ID NO: 168635 - protein, 92 aa, Heterodera glycines; identical to SEQ ID NO: 148997
  Coding regions on vcDNA: vcDNA=SeqID_95058; Strand=+; Position=67-345

SEQ ID NO: 168636 - protein, 52 aa, Heterodera glycines
  Coding regions on vcDNA: vcDNA=SeqID_95059; Strand=-; Position=18-176
WSGVRGLAANSEYWSNRPKRRLSRCLMSDFVFNGSQSFFIICLFNAMAQNPS

SEQ ID NO: 168637 - protein, 51 aa, Heterodera glycines; identical to SEQ ID NO: 166750
  Coding regions on vcDNA: vcDNA=SeqID_95060; Strand=+; Position=3-158

SEQ ID NO: 168638 - protein, 155 aa, Heterodera glycines; identical to SEQ ID NO: 163602
  Homolog annotation: Hit_ID=CAE73776.1; Match level="QueryCoverage =94%, HitCoverage=19%, E-value=1e-49, Identity=64%"; Hit description =Hypothetical protein CBG21320 [Caenorhabditis briggsae]
  Gene Ontology: Mol. function=glycine-tRNA ligase activity; Cellular component=mitochondrion; Biological process=tRNA modification
  Coding regions on vcDNA: vcDNA=SeqID_95061; Strand=+; Position=2-469

SEQ ID NO: 168639 - protein, 261 aa, Heterodera glycines
  misc_feature (143)..(143): Xaa can be any naturally occurring amino acid
  Homolog annotation: Hit_ID=CAE56933.1; Match level="QueryCoverage =95%, HitCoverage=94%, E-value=7e-53, Identity=43%"; Hit description =Hypothetical protein CBG24778 [Caenorhabditis briggsae]
  Gene Ontology: Mol. function=endopeptidase activity; Cellular component=proteasome core complex (sensu Eukarya); Biological process=proteolysis and peptidolysis
  Coding regions on vcDNA: vcDNA=SeqID_95062; Strand=+; Position=62-845
MNNYEFAMNSPHMEMAKFKEFMDDSSEEFVALSPMIQNQRDWSPYSNQGGTVCVLVGDDFVVVANDTRLTGDAEIEILSRKCEKTHILTNKIIMTSCGFYGDVLQLRRILELRINHFEFIYQRPMSLDQCGEMLSRTLYSRRXFFPYFTGTIICGITSDGRGDLYSYDPVGCIETKLFEASGNGGSTLSTFFENQWAYSTVAPEERKNMPKRTLERALSVIRDAFRGLSERETTTGDSLNVYWLQAGDEKVHQETYRLRGD

SEQ ID NO: 168640 - protein, 71 aa, Heterodera glycines; identical to SEQ ID NO: 162404
  Coding regions on vcDNA: vcDNA=SeqID_95063; Strand=+; Position=526-741

SEQ ID NO: 168641 - protein, 100 aa, Heterodera glycines
  Coding regions on vcDNA: vcDNA=SeqID_95064; Strand=+; Position=1-303
YHFIPKMSFLRLITFVLLITLCSLPSLVESGLIGIVGTPVEAAWCGVLGKESSHCPTAGGGQHGGGGGGGGGGNYGGGAPGGNYGGSSGSYNGHRARRFA

SEQ ID NO: 168642 - protein, 68 aa, Heterodera glycines; identical to SEQ ID NO: 163192
  Coding regions on vcDNA: vcDNA=SeqID_95065; Strand=+; Position=3-209

SEQ ID NO: 168643 - protein, 274 aa, Heterodera glycines
  Coding regions on vcDNA: vcDNA=SeqID_95066; Strand=+; Position=19-840
RIWLRPKIPYHNNDNLITFTHFDVDMALLVFSEAVDATSVMSLIGTTAHSLLAISPFSMAPQSSKWCRAKVWLASGGISFSPSAGVFRAGSPRFVNTDFLTKYFSSSPSCTRTLPRKALTSLVSMCEELIAEENNPWEVSALTSARLALDGITQETFKLTEQNCEKLKQFDPQRSAMYDEMFDKVRIIHELTKNTSDTPEQSQLDLLMEAKSDRLNLNGIGLISLLHLRPLSGLVQELNLQNNRVTSDQITQLCSFAALTSLTLDGNPIDRLPL

SEQ ID NO: 168644 - protein, 102 aa, Heterodera glycines
  Homolog annotation: Hit_ID=EAL31098.1; Match level="QueryCoverage =97%, HitCoverage=37%, E-value=2e-37, Identity=74%"; Hit description =GA10883-PA [Drosophila pseudoobscura]
  Gene Ontology: Mol. function=structural constituent of ribosome; Cellular component=eukaryotic 48S initiation complex; Biological process=protein biosynthesis
  Coding regions on vcDNA: vcDNA=SeqID_95067; Strand=+; Position=3-311
DIGTGKVTDYVKFDAGNICMITGGHNIGRVGIVGHRERHPGSFDIVHIKDSAGHGHSFATRMTNVFIIGKGATPLISLPASKGIRLSIAEERDRRLAQKQKV

SEQ ID NO: 168645 - protein, 262 aa, Heterodera glycines
  Homolog annotation: Hit_ID=EAL31098.1; Match level="QueryCoverage =98%, HitCoverage=99%, E-value=1e-108, Identity=72%"; Hit description= GA10883-PA [Drosophila pseudoobscura]
  Gene Ontology: Mol. function=structural constituent of ribosome; Cellular component=eukaryotic 48S initiation complex; Biological process=protein biosynthesis
  Coding regions on vcDNA: vcDNA=SeqID_95068; Strand=+; Position=52-840
MARGPKKHLKRLAAPKKWMLDKLGGVFAPRPMCGPHKLRESLPLILFLRNRLKYAQSYNEARMICKQRLIKVDGKVRTEMRFPCGIMDVISIEKTNETFRLLNDVKGRFVIHRIQSREGQYKLCKVKKQAVGDKQVPYIVTHDARTIRYPDPHIKADDTVVIDIGTGKVTDYVKFDAGNICMITGGHNIGRVGIVRHRERHPGSFDIVHIKDAAGHSFATRMTNVFIIGKGATPLISLPASKGIRLSIAEERDRRLAQKQKV

SEQ ID NO: 168646 - protein, 157 aa, Heterodera glycines
  Homolog annotation: Hit_ID=CAE60152.1; Match level="QueryCoverage =88%, HitCoverage=85%, E-value=1e-50, Identity=66%"; Hit description =Hypothetical protein CBG03702 [Caenorhabditis briggsae]
  Gene Ontology: Cellular component=nucleolus; Biological process =ribosomal large subunit biogenesis
  Coding regions on vcDNA: vcDNA=SeqID_95069; Strand=+; Position=9-479
MRLEKCWFCSSTIYPGHGIQFVRNDATVFKFCRSKCNKLFKKKKNPRKLKWTKASRRIRGKELVNDVTQAMEIRRNEPTKYDRNLWETAVEAVKEIHSIRHRRYGEHIKSTLKPGKQAVKRAMVEKARKKVHLIRAPVAMGEDDEKLEVVEDGEQKT

SEQ ID NO: 168647 - protein, 222 aa, Heterodera glycines
  Homolog annotation: Hit_ID=NP_509584.1; Match level="QueryCoverage =94%, HitCoverage=68%, E-value=7e-69, Identity=63%"; Hit description =short dehydrogenase (33.4 kD) (XK51) [Caenorhabditis elegans] emb|CAA86312.1| Hypothetical protein B0272.
  Gene Ontology: Mol. function=enoyl-CoA hydratase activity; Cellular component=mitochondrion; Biological process=growth
  Coding regions on vcDNA: vcDNA=SeqID_95070; Strand=+; Position=29-694
KCTHRFYSTEPLVKKLTVIGSGLMGAGIAQVSAQANVKVVLVDQSQSIVEKAKSGIENSIKRVAKKQFEDPGKQNELVTRALSNISLSTDISQAVSGADLVIEAISENLDVKRKLFAEVESALPQNGKMATNTSSLTLADIAANLKRKDSFGGLHFFNPVPIMKLLEVVRFDGTSEETFNVLMDFGKTIGKTTVVCKDTPGFIVNRLLVPFMLEAMRMFDRG

SEQ ID NO: 168648 - protein, 150 aa, Heterodera glycines; identical to SEQ ID NO: 163662
  Homolog annotation: Hit_ID=NP_506690.1; Match level="QueryCoverage =92%, HitCoverage=96%, E-value=3e-58, Identity=79%"; Hit description =ribosomal Protein, Small subunit (16.3 kD) (rps-16) [Caenorhabditis elegans] emb|CAB01658.1| Hypothetical
  Gene Ontology: Cellular component=eukaryotic 48S initiation complex; Biological process=protein biosynthesis
  Coding regions on vcDNA: vcDNA=SeqID_95071; Strand=+; Position=34-486

SEQ ID NO: 168649 - protein, 183 aa, Heterodera glycines
  Homolog annotation: Hit_ID=NP_871815.1; Match level="QueryCoverage =91%, HitCoverage=48%, E-value=3e-34, Identity=48%"; Hit description =DeHydrogenase, Short chain (dhs-2) [Caenorhabditis elegans] gb|AAO38639.1| Dehydrogenases, short chain pr
  Gene Ontology: Mol. function=steroid dehydrogenase activity; Cellular component=mitochondrion; Biological process=steroid metabolism
  Coding regions on vcDNA: vcDNA=SeqID_95072; Strand=+; Position=21-569
MGPAALLLLLPSLLLLFLLIRALLELIPVSRLDKRSVLITGCDSGFGFDLALRCLGAGMRVFAGCLTQTGIQSLKKSAQEKGIAVELLEPIELDVTSDESVAKALEFVERKLGPGKGLHALVNNAGISGNESWDDWLIPKDYEDVFQVNTLGTIRVTHAFKRLVKRERESRIVIMASSCGRVA

SEQ ID NO: 168650 - protein, 148 aa, Heterodera glycines
  Homolog annotation: Hit_ID=NP_498265.1; Match level="QueryCoverage =87%, HitCoverage=27%, E-value=6e-34, Identity=52%"; Hit description =aspartyl aminopeptidase (51.2 kD) (3G952) [Caenorhabditis elegans] gb|AAC46643.1| Hypothetical protein F0
  Gene Ontology: Mol. function=aminopeptidase activity; Cellular component=cytoplasm; Biological process=peptide metabolism
  Coding regions on vcDNA: vcDNA=SeqID_95073; Strand=+; Position=35-478
MSSHSSSVVVDNCCPPSQMTTSSSPAAFRSSALAFLQFLNKSVTPFHAVESVEAILKSANFVQKSEYDKLQIQPKDRFYVKKSETSIFAFAAGGAFKPSEAGVSIVVAHTDSPCLRIKPVSKKTSEQFLQVGVSLYGGGLWRTWFDRD

SEQ ID NO: 168651 - protein, 205 aa, Heterodera glycines
  Homolog annotation: Hit_ID=XP_456171.1; Match level="QueryCoverage =42%, HitCoverage=38%, E-value=3e-14, Identity=47%"; Hit description =unnamed protein product [Kluyveromyces lactis] emb|CAG98879.1| unnamed protein product [Kluyveromyces lac
  Gene Ontology: Mol. function=protein binding; Cellular component=DNA -directed RNA polymerase II, core complex; Biological process =regulation of transcription, DNA-dependent
  Coding regions on vcDNA: vcDNA=SeqID_95074; Strand=+; Position=13-630
MVAANLKLSLIFVAGFCLLFIADSDAGKSCKPGEKGPPGPPGKPGNKGKPGVCKPKYETTSKYGTTTSKYDTTTSKYGTTTPEYDTTTSKYDTTTSKYDTTTSDYGTTTSKYDTTTSKYDTTTSKYDTTTSKYGTTTQKYRGKRFADAVLVRAARAEYDADCPAGPPGDAGIAGPPGPPRRAGQMLWQRVQRVQRKGVQTQQAQH

SEQ ID NO: 168652 - protein, 47 aa, Heterodera glycines
  Coding regions on vcDNA: vcDNA=SeqID_95075; Strand=+; Position=1-144
EITNSGKWDCIILHDVDLVPEHDHNLYRCFKDHPTHFFRRFDENNYA

SEQ ID NO: 168653 - protein, 104 aa, Heterodera glycines
  Coding regions on vcDNA: vcDNA=SeqID_95076; Strand=+; Position=36-350
MCCINSKMLLLVAAFVVLLCLLNQNVGAEKIIVLYNGKKYDLTEFHKSHPGGEEVLKKVNGKDVKEVKIMYLEGKKGVKTDHLVQHKHSKHTINEFLPTFEIKH

SEQ ID NO: 168654 - protein, 170 aa, Heterodera glycines
  Coding regions on vcDNA: vcDNA=SeqID_95077; Strand=+; Position=26-535
MRSVKHGGKKGMRFRYKLSAVKRQNKKQKKKQRNIAGCSLIKKAWQTQLSSRQNLSAMGLVYDPNEALKKNPEFAMEMDQSEIEVIGLPEAKALGSVKEQKKATKSKKACPKLNKSEAESSKVVLELQQIALEGAQQMAEQKQRKRERAKLQQSDIEFCQKMLQRHGENY

SEQ ID NO: 168655 - protein, 199 aa, Heterodera glycines; identical to SEQ ID NO: 164379
  Homolog annotation: Hit_ID=NP_502672.1; Match level="QueryCoverage =93%, HitCoverage=91%, E-value=2e-28, Identity=35%"; Hit description =putative protein, with 2 coiled coil-4 domains, of bilaterial origin (24.4 kD) (4O649) [Caenorhabditis el
  Coding regions on vcDNA: vcDNA=SeqID_95078; Strand=+; Position=1-600

SEQ ID NO: 168656 - protein, 172 aa, Heterodera glycines; identical to SEQ ID NO: 163598
  Homolog annotation: Hit_ID=CAE60358.1; Match level="QueryCoverage =97%, HitCoverage=96%, E-value=4e-71, Identity=76%"; Hit description =Hypothetical protein CBG03955 [Caenorhabditis briggsae]
  Gene Ontology: Mol. function=calcium ion binding; Cellular component =plasma membrane; Biological process=regulation of action potential
  Coding regions on vcDNA: vcDNA=SeqID_95079; Strand=+; Position=33-551

SEQ ID NO: 168657 - protein, 152 aa, Heterodera glycines; identical to SEQ ID NO: 163840
  Coding regions on vcDNA: vcDNA=SeqID_95080; Strand=+; Position=123-581

SEQ ID NO: 168658 - protein, 158 aa, Heterodera glycines
  Coding regions on vcDNA: vcDNA=SeqID_95081; Strand=+; Position=3-476
SLSCPFRFLLLFLALVIKFHPLRSFWPSLPQMTEVPPNARQWTLHFGGLVEAVNGAHIDPSGRTDLLKVLDRAKRDGSLQLDGGEITLLECDCDAVRVSSAKVDESSKPLAFIPLHQLSSVGFVHEPPQNILALKVGDVDENKPDQFDLIILYTSTEE

SEQ ID NO: 168659 - protein, 238 aa, Heterodera glycines; identical to SEQ ID NO: 163456
  Coding regions on vcDNA: vcDNA=SeqID_95082; Strand=+; Position=27-743

SEQ ID NO: 168660 - protein, 223 aa, Heterodera glycines; identical to SEQ ID NO: 163957
  Homolog annotation: Hit_ID=NP_741361.1; Match level="QueryCoverage =99%, HitCoverage=59%, E-value=4e-46, Identity=42%"; Hit description =cytoplasmic protein of ancient origin precursor family member (4E502) [Caenorhabditis elegans] gb|AAM9796
  Coding regions on vcDNA: vcDNA=SeqID_95083; Strand=+; Position=22-690

SEQ ID NO: 168661 - protein, 156 aa, Heterodera glycines
  Homolog annotation: Hit_ID=CAE64340.1; Match level="QueryCoverage =99%, HitCoverage=15%, E-value=4e-68, Identity=81%"; Hit description =Hypothetical protein CBG09023 [Caenorhabditis briggsae]
  Gene Ontology: Mol. function=ATP binding; Cellular component=snRNP U6; Biological process=signal transduction
  Coding regions on vcDNA: vcDNA=SeqID_95084; Strand=+; Position=3-470
LVLMEGIDQPVTKTCTIVEKDYDQDELFIFRPLKFNTCSVVKLSIEPINPSELPKMLDSLRKVNKSYPLLTTRVEESGEHVMLGTGELYMDCVMHDMRKVFSEIDIKVADPVVSFCETVVETSSLKCFAQTPNQKNKITMIAEPLEKGLAEDIEGE

SEQ ID NO: 168662 - protein, 183 aa, Heterodera glycines
  Homolog annotation: Hit_ID=CAE70921.1; Match level="QueryCoverage =93%, HitCoverage=16%, E-value=4e-18, Identity=31%"; Hit description =Hypothetical protein CBG17720 [Caenorhabditis briggsae]
  Gene Ontology: Mol. function=translation initiation factor activity; Biological process=embryonic development
  Coding regions on vcDNA: vcDNA=SeqID_95085; Strand=+; Position=36-584
MLRKLKANRERPPSLIFIIRDGLDEGKVDNALSSEIGLFRESCSQISQSWKPKFVYCLADKRHNRRFFEVEERLPDAAQPRNVCNPQPGSAVDRKLTRSGVLNLYVQAHHPVRGTAKIPEFIFPCNEVCATKEELEAFINGLCHSWQIVKAATSLPVPVYQAHELAKRGRSNYMELRRMAPER

SEQ ID NO: 168663 - protein, 84 aa, Heterodera glycines; identical to SEQ ID NO: 163684
  Homolog annotation: Hit_ID=CAE71709.1; Match level="QueryCoverage =100%, HitCoverage=100%, E-value=1e-25, Identity=65%"; Hit description=Hypothetical protein CBG18686 [Caenorhabditis briggsae]
  Gene Ontology: Mol. function=RNA binding; Cellular component=nucleus; Biological process=mRNA cleavage
  Coding regions on vcDNA: vcDNA=SeqID_95086; Strand=+; Position=65-319

SEQ ID NO: 168664 - protein, 78 aa, Heterodera glycines
  Coding regions on vcDNA: vcDNA=SeqID_95087; Strand=-; Position=1-234
HGINIWTFRYFLYGSLLTVQPCANKQNDTQQSRRTHNAQQHFPLNIFLLILRFQFGNAFRQLDKSPPHHLQLLQRVLV

SEQ ID NO: 168665 - protein, 105 aa, Heterodera glycines
  Coding regions on vcDNA: vcDNA=SeqID_95088; Strand=-; Position=46-363
AHLSLTYFMKRVKTFIRHKSKLHQNLVIRLAQFDGWFWADFAFLPLAMCPLFVEAGPGIGQSSPGPTKSIERLREKRTNRFILRNNAEQPTSKKRGDKRKAFKAK

SEQ ID NO: 168666 - protein, 212 aa, Heterodera glycines; identical to SEQ ID NO: 163593
  Coding regions on vcDNA: vcDNA=SeqID_95089; Strand=+; Position=3-641

SEQ ID NO: 168667 - protein, 208 aa, Heterodera glycines
  Homolog annotation: Hit_ID=CAE56710.1; Match level="QueryCoverage =93%, HitCoverage=43%, E-value=8e-48, Identity=50%"; Hit description =Hypothetical protein CBG24496 [Caenorhabditis briggsae]
  Gene Ontology: Mol. function=protein binding; Cellular component =synaptic junction; Biological process=muscle contraction
  Coding regions on vcDNA: vcDNA=SeqID_95090; Strand=+; Position=1-624
LQLKNIKYLPFSKIFPGMSADKTGALFVGDIILAVNGESLLNARHDEAVRALKQAGKMVNLQVQYRRDLHLRRENMLHRLSWEESRVGASSAGPTVNGQSAGEALRSFGLKLAFVTRNPLEEEDPENRTIEIRSHSARHILTLRCSSATEADAWFEAIHSCADTLLTQALATVNLILGQSPQVLRMGWMAEQDAAIGWRAVFVALTVN

SEQ ID NO: 168668 - protein, 400 aa, Heterodera glycines
  Homolog annotation: Hit_ID=NP_506610.1; Match level="QueryCoverage =98%, HitCoverage=83%, E-value=1e-142, Identity=62%"; Hit description= glutamate carboxypeptidase-like protein 1 (52.6 kD) (5P76) [Caenorhabditis elegans] emb|CAB07646.1| Hypo
  Gene Ontology: Mol. function=dipeptidase activity; Cellular component= mitochondrion; Biological process=proteolysis and peptidolysis
  Coding regions on vcDNA: vcDNA=SeqID_95091; Strand=+; Position=3-1205
TTLPLPPMLCDTLGTDKNKRTLLVYGHLDVQPAAFEDGWNTEPFQLIEKDGKLFGRGSTDDKGPVLGWLNVIETMQGLGIDMPINIKFVFEGMEECGSDGLDECLEQRKDFLSGVDFVCISDNYWLGKQKPCITYGLRGLSPFAIEISGPNQDLHSGVYGGTIHEPMNDLCWLLSQLTDTRANSLIKNIDKMVAKLTEEERNTYTKIDFDLNGFKKDVGVEKLTSEDPKQILMRRWREPALSIHGIEGAFSGKGFKTVIPSKVTGKFSIRIVPDMVPEEVDKIVVDFVSEVWKGRGSPNKMKILPLGGTLAWLGDFKQPHFQAGVKAIKKVYGVEPDFTREGGSIPVTLTFQNLTGKSVMLLPMGASDDMAHSQNEKLNVTNYVNGMKMFAAYIFECAKI

SEQ ID NO: 168669 - protein, 32 aa, Heterodera glycines
  Coding regions on vcDNA: vcDNA=SeqID_95092; Strand=-; Position=21-119
FLVKNFPKHFLSKKGIKKFIYIIILFLFGLIF

SEQ ID NO: 168670 - protein, 152 aa, Heterodera glycines
  Homolog annotation: Hit_ID=XP_448490.1; Match level="QueryCoverage =85%, HitCoverage=97%, E-value=3e-43, Identity=66%"; Hit description =unnamed protein product [Candida glabrata] emb|CAG61451.1| unnamed protein product [Candida glabrata CBS1
  Gene Ontology: Mol. function=structural constituent of ribosome; Cellular component=cytosolic small ribosomal subunit (sensu Eukarya); Biological process=ribosomal small subunit assembly and maintenance
  Coding regions on vcDNA: vcDNA=SeqID_95093; Strand=+; Position=25-480
MGRVRTKTVKKASRVMIEKYYPRLTLDFQSNKKVASEVASISSKRLRNKIAGFTTHLMRRIQKGPVRGISFKLQEEERERKDNYVPDVSALEQNELVVDTETAALLSSLDIKLPQIRTVAVTAQGERQGRNAVVGANFRGDRGDRPRRPKTQ

SEQ ID NO: 168671 - protein, 153 aa, Heterodera glycines
  Homolog annotation: Hit_ID=CAG13211.1; Match level="QueryCoverage =94%, HitCoverage=19%, E-value=5e-31, Identity=42%"; Hit description =unnamed protein product [Tetraodon nigroviridis]
  Coding regions on vcDNA: vcDNA=SeqID_95094; Strand=+; Position=14-472
MIDCHCHLADESFNEDISQDDFERILELAHQFPDFIFPCLGMHPVQRGHISCSEEMYKNFEVDKWIRTHSDQLIAVGEVGLDFKPQHLKNGDADKEEQRKVFRAQIELAKELQLPLNVHSRSAGTPVIEWLAAHGAQNVLLHAFSGNVKNAQK

SEQ ID NO: 168672 - protein, 157 aa, Heterodera glycines
  Homolog annotation: Hit_ID=NP_498939.1; Match level="QueryCoverage =84%, HitCoverage=24%, E-value=4e-21, Identity=44%"; Hit description =putative Nipsnap protein (3J865) [Caenorhabditis elegans]
  Gene Ontology: Biological process=phosphate metabolism
  Coding regions on vcDNA: vcDNA=SeqID_95095; Strand=+; Position=8-478
MASPLRLPQRIGAHHFWHNFDNFLFDADGVLWREQQPLEGAVELIGTLLKAGKKVVVVTNNSTQSCAEYVKKCQRIGFTDLDEQNIVSSGMVLAHQLNKMKRSAEFGSTAHLPVYLFGSVGLQRLLKESGIDSFGTGPDPIPADTATFVSDLPNLDL

SEQ ID NO: 168673 - protein, 60 aa, Heterodera glycines; identical to SEQ ID NO: 166742
  Coding regions on vcDNA: vcDNA=SeqID_95096; Strand=-; Position=1-180

SEQ ID NO: 168674 - protein, 251 aa, Heterodera glycines
  Homolog annotation: Hit_ID=CAE72273.1; Match level="QueryCoverage =99%, HitCoverage=35%, E-value=3e-25, Identity=30%"; Hit description =Hypothetical protein CBG19393 [Caenorhabditis briggsae]
  Gene Ontology: Mol. function=calpain activity
  Coding regions on vcDNA: vcDNA=SeqID_95097; Strand=+; Position=19-774
MIRLIIDEPTELCATLFQQHARTMLDQVDIMLLLHRQDGEATPGELICRSSRRVLPCVRIDDTFLPRGEYLLCAHSFSKFGEQMVSGTIVIHSSREIQTMKLRTTTLDDLRQSMCSLLLKEGVLQNSSPGIATRYLTNEFAGLVLMVDNYSSDNCLKVHSDCQNSTNVLSTRSSLLAFDSIPPLHRQVVTLLTHFEPSQSFMVTHRWVYHQTKFPQLRDFVPCTEFASAQNFPPLQTETIGYLHGPFPVYK

SEQ ID NO: 168675 - protein, 156 aa, Heterodera glycines
  Coding regions on vcDNA: vcDNA=SeqID_95098; Strand=+; Position=1-468
ANLQQQTHGPIAGTDYDSADEYVVIEQEEETDLEKNSTLPETVATNTNSTPSDVQSVAASVGTLDAVADIGNGLDGAKLSVSSVFPQNAMSGSNYSQNGFNSSIFGSFVMEDQLRDLVRSENEQNRLMLDSIKNAIGELTKQKSNNNELNALISQQ

SEQ ID NO: 168676 - protein, 293 aa, Heterodera glycines
  Homolog annotation: Hit_ID=AAN15806.1; Match level="QueryCoverage =78%, HitCoverage=89%, E-value=4e-70, Identity=55%"; Hit description =putative esophageal gland cell secretory protein 26 [Meloidogyne incognita]
  Coding regions on vcDNA: vcDNA=SeqID_95099; Strand=+; Position=106-984
MLFLPPSLFLLLFLLHRPFANALGCMSAVCAAGGPSPSSHAVNRIIRCASDSFCGHFRALRRNDQFVEAVDLSCPEFAVVRAPFDGEISAYRPMGGSRAQEGTKGECVPDQGVRIDGRGQWQGYHALISSVQLFRFGGEVNAGQRIGVARDLECAGTRPKPRGDENFVRMELFREDKPIDPTHHLIDCMCTGQICETNRANALEGLPFKFDSRFNGVRGWEIVCPNVRPEEPNSSGESPEQSDNRQTMSPKIYSPIEGEVIGRVRLSASSNSQSYSGCANEGIFVVGTGKWTD

SEQ ID NO: 168677 - protein, 271 aa, Heterodera glycines
  Coding regions on vcDNA: vcDNA=SeqID_95100; Strand=-; Position=92-907
MYTPPAARARPPNPKNPKNSQPTVHGTKKKQKKLVGTALSRPRFSSLSLSPTHQINQSTIKRHDQTIVLLRRVRDGSREEAAGAEEIHEARFRRTGGGGCLWHFVTTSRHGQALVLRNCREMVGRRAMLWRTAVQCRRTGGRLAQQTVRRGRGDGGTITHHSDGTFALGQLLIGRGERVIVTITFCRIMVVDRIGAVHGECGAFVEQAGQHTVKRVDAFLILQKVWHNVQVRFRHGTAAEQRRFLLLWWKRGGGSEYGGRGRRAGLLVGHF

SEQ ID NO: 168678 - protein, 264 aa, Heterodera glycines; identical to SEQ ID NO: 162992
  misc_feature (258)..(258): Xaa can be any naturally occurring amino acid
  Homolog annotation: Hit_ID=NP_501065.1; Match level="QueryCoverage =85%, HitCoverage=36%, E-value=2e-41, Identity=41%"; Hit description =ribophorin I (4H677) [Caenorhabditis elegans] pir||T32708 hypothetical protein T22D1.4 - Caenorhabditis e
  Gene Ontology: Mol. function=oligosaccharyl transferase activity; Cellular component=oligosaccharyl transferase complex; Biological process=protein modification
  Coding regions on vcDNA: vcDNA=SeqID_95101; Strand=+; Position=36-827

SEQ ID NO: 168679 - protein, 129 aa, Heterodera glycines; identical to SEQ ID NO: 163586
  Homolog annotation: Hit_ID=CAE62128.1; Match level="QueryCoverage =74%, HitCoverage=40%, E-value=2e-22, Identity=53%"; Hit description =Hypothetical protein CBG06172 [Caenorhabditis briggsae]
  Coding regions on vcDNA: vcDNA=SeqID_95102; Strand=+; Position=21-410

SEQ ID NO: 168680 - protein, 81 aa, Heterodera glycines
  Coding regions on vcDNA: vcDNA=SeqID_95103; Strand=-; Position=3-248
PGDTPQITPIQIEGTVHMSQFVTEFYRSNLELIKGRFLPGDGIGEKEQPMEQSEARTLKEEANRPRICLATRPSSNNSRTR

SEQ ID NO: 168681 - protein, 144 aa, Heterodera glycines
  Coding regions on vcDNA: vcDNA=SeqID_95104; Strand=+; Position=64-495
MKDIATEESIAQRRLNLKANFMRQLQIRRGVLPSEIPPVGVATNAVPTMGRKFRKPLESRFPPAKPRFGLGMTAADFEDKTDNCSSLAKGPSLTETNAPKGRNVRPKAINCYINPSQSVSTWPTSNDTDSDGQSPSPTSSASVT

SEQ ID NO: 168682 - protein, 169 aa, Heterodera glycines
  Homolog annotation: Hit_ID=NP_491991.1; Match level="QueryCoverage =96%, HitCoverage=39%, E-value=3e-17, Identity=32%"; Hit description =putative membrane protein (1H568) [Caenorhabditis elegans] gb|AAK85451.1| Hypothetical protein C30F12.5 [
  Coding regions on vcDNA: vcDNA=SeqID_95105; Strand=+; Position=193-699
MECVRHLLHLLLLLTFSGQLLVTLADLYDDYEQCKSSGHFGAEDGSPSLVCDSEGRLTPQALAQLNGILTDMGRDAGCQCADGCDGKPFSVRLLVTSGERVEQSGGTTALNETAGRIWESERMGTEQCDNGMLMLYIRDQKRMVTFQGHRRLQIYSDRDIDNLHELTSR

SEQ ID NO: 168683 - protein, 334 aa, Heterodera glycines; identical to SEQ ID NO: 163589
  Homolog annotation: Hit_ID=NP_493547.1; Match level="QueryCoverage =98%, HitCoverage=61%, E-value=1e-112, Identity=59%"; Hit description= endoplasmic Reticulum Oxidase (59.3 kD) (ero-1) [Caenorhabditis elegans]
  Gene Ontology: Mol. function=electron carrier activity; Cellular component=endoplasmic reticulum; Biological process=protein folding
  Coding regions on vcDNA: vcDNA=SeqID_95106; Strand=+; Position=3-1007

SEQ ID NO: 168684 - protein, 135 aa, Heterodera glycines; identical to SEQ ID NO: 163588
  Homolog annotation: Hit_ID=XP_326638.1; Match level="QueryCoverage =95%, HitCoverage=73%, E-value=4e-13, Identity=37%"; Hit description =predicted protein [Neurospora crassa] emb|CAD21384.1| related to high mobility group protein i/y (hmga) [
  Coding regions on vcDNA: vcDNA=SeqID_95107; Strand=+; Position=59-466

SEQ ID NO: 168685 - protein, 157 aa, Heterodera glycines
  Coding regions on vcDNA: vcDNA=SeqID_95108; Strand=+; Position=1-471
LSFLFAQKGHVAISTKGSVRVARLSLRFIGAAHTEWHDKCTGAPFESVDRVLDEYRDLTSELSSLCDGSTELSPGEHSVAFHFKLPMDSVSTIAKDGHGVVKYFCVASLDLPDDGGDNEIVAEKEFAVTAYLNLDAPHFREPAHSSEQITKGGVFCG

SEQ ID NO: 168686 - protein, 59 aa, Heterodera glycines; identical to SEQ ID NO: 166735
  Coding regions on vcDNA: vcDNA=SeqID_95109; Strand=+; Position=190-369

SEQ ID NO: 168687 - protein, 77 aa, Heterodera glycines
  misc_feature (9)..(10): Xaa can be any naturally occurring amino acid
  Homolog annotation: Hit_ID=CAA07704.1; Match level="QueryCoverage =75%, HitCoverage=48%, E-value=2e-27, Identity=98%"; Hit description =lacZ' [Cloning vector pGreen]
  Coding regions on vcDNA: vcDNA=SeqID_95110; Strand=+; Position=251-481
LIEIFIYKXXKKKKKKKKNSRGGPVPNSPYSESYYNSLAVVLQRRDWENPGVTQLNRLAAHPPFASWGNSEEARTDR

SEQ ID NO: 168688 - protein, 66 aa, Heterodera glycines; identical to SEQ ID NO: 152131
  Homolog annotation: Hit_ID=NP_509897.1; Match level="QueryCoverage =60%, HitCoverage=4%, E-value=2e-11, Identity=73%"; Hit description =guanylyl cyclase (gcy-9) [Caenorhabditis elegans] emb|CAA91488.1| Hypothetical protein ZK455.2 [Caenorhabd
  Coding regions on vcDNA: vcDNA=SeqID_95111; Strand=-; Position=163-363

SEQ ID NO: 168689 - protein, 68 aa, Heterodera glycines
  Coding regions on vcDNA: vcDNA=SeqID_95112; Strand=+; Position=87-290
CIFLQSLTISKISPPTLVTFPIVLFASFLSLFISFRFKAFSVFSLSLHSLRVFLFNYLFSYIIVDYTA

SEQ ID NO: 168690 - protein, 253 aa, Heterodera glycines
  Homolog annotation: Hit_ID=CAE72019.1; Match level="QueryCoverage =67%, HitCoverage=52%, E-value=5e-22, Identity=34%"; Hit description =Hypothetical protein CBG19101 [Caenorhabditis briggsae]
  Coding regions on vcDNA: vcDNA=SeqID_95113; Strand=+; Position=67-828
MAHMAKKASNFLIGDFNSVDFDNMADQLGNHGYVSPCNMLTALVYIMRLKESNERDFLAFNPTELFVSSLVLATKYLNDGTLQEFVWNDEWASVSGLALPKLNELEIRLLTSLRWDVSIQSEDFEKVLARLEGFVASEMAQQNGVMSYNELCILSNTHGFNRSILCLLTVLLKFLFVLLAFHLALLAGLSVLNMAVSRKQELAASDACIYHHGWDDCSHPPILLANERKIDANLTKVVHKDDFFAFVHAFSIS

SEQ ID NO: 168691 - protein, 258 aa, Heterodera glycines
  Homolog annotation: Hit_ID=AAV34698.1; Match level="QueryCoverage =78%, HitCoverage=67%, E-value=1e-16, Identity=33%"; Hit description =IC5 [Globodera pallida]
  Gene Ontology: Biological process=signal transduction
  Coding regions on vcDNA: vcDNA=SeqID_95114; Strand=+; Position=85-861
MGEFRVKFRQLEADIEELKGKNEAIQKRLVEFEQKLSTSANYTRIVSGQEMIRILAKNNWNQTDSHKELFLFKPNLLKVVCLGAEKVPRTVRAKDRAPKNLEIVYYEVKILSAEQKDFDGTQNDSIGIGFAPKSMPLGTKVGTHPGTFAYFNDGNVRGHRIVGSTKQNLAKFDAGDVIGCGLNLTSKEIILTKNGERLGKKEQPYHRFISSHYGSELFDSNFFFASKETDDLYPAISLNNPGDEVEANFGPNFKYTLN

SEQ ID NO: 168692 - protein, 496 aa, Heterodera glycines
  Homolog annotation: Hit_ID=CAE62199.1; Match level="QueryCoverage =95%, HitCoverage=74%, E-value=7e-63, Identity=32%"; Hit description =Hypothetical protein CBG06249 [Caenorhabditis briggsae]
  Gene Ontology: Biological process=regulation of cell cycle
  Coding regions on vcDNA: vcDNA=SeqID_95115; Strand=+; Position=43-1562
MLAATGRWPSSSSNSGLRIAMAICAILACCSLPNSTEAALAEVGQQPKGNNPLLYSVDDPIVHLDADTFEDTVLRPNRDRAYIVEFYKDWCGYCRRFAPYFKVLSESIKSWPFVQVAAINCADAYNVKICKANDIPTVPKLKYFPRNARSFEEGQVIEHSYESAMEMREQVHKKIMEEFNAETGKGNADFYLQKMEAQRQHNNENSQPEPWRDMPNSTQFLAQLFEKDAKDGLPFSLDLLLYKPSVEVRQVLVGSADEVPRNVPKPAKGKATEAAAFKLPYVRAMERGKTEPILAESLNDQTLAKLRELVKPMMVELNKTEQAKAHHKEPVQVVDCAQSPEKCKQMFFVSETDMLKAIHTALLDEVISSGGDEINGDRFAALRKFVELLIQRFPKKTFERNPQLSAHPKGTALSSIGKPLLRSQRAFKVFEQMKRFLDAKAGDGKVSMDEWRAEFDQAKAFENAKFKQNGDPFPVTAEWEHCKGTRTIFRGFTCGL

SEQ ID NO: 168693 - protein, 202 aa, Heterodera glycines
  Coding regions on vcDNA: vcDNA=SeqID_95116; Strand=+; Position=41-646
KKIDCHPPMANSGEHSSRRQQQQQRHPNTTAENNSDIEGTAHRVASVTLNTESDSRTSADLPAYPFRSKRRKKLPRRDKQQGADMDVDEHQPPWKKLSVNTVDNLTLPSCKVQMDWEHGHGQALSTANDSTQNQSSSTTRQASDMENSVSDQFSHSQSESEASTSNIDADDEQSDWPGNELARHPQLSSSSSVIVPFQLAPP

SEQ ID NO: 168694 - protein, 257 aa, Heterodera glycines
  Coding regions on vcDNA: vcDNA=SeqID_95117; Strand=+; Position=3-773
SLSQMPFLSLFSSVSAFALLSLLSFSSSVHHFHHNHHSDSSKGHNGHHQQKDHQTAQEIPSNSFPCACGGHSSGGENARWMNGMPANGVPLFLFPDNVLRLVGVVLRSENAFHRDNNELARHLFHLLAHQFPRKWFIVGIGTMPSNGANEPKMWAREGIDALNGTVQLQSPPGYGSFPFLDGRRFQRENGSKIWYFVYAVEPMTDKAKDGLPKQSLAKCLSEGCPSRDNFASLCANNRRQLGTVVEFDQSSEMSIFA

SEQ ID NO: 168695 - protein, 36 aa, Heterodera glycines
  Coding regions on vcDNA: vcDNA=SeqID_95118; Strand=-; Position=103-213
EWKNSKIFHYFLFCFLKFKNPFKTLEKFVATLSIFS

SEQ ID NO: 168696 - protein, 139 aa, Heterodera glycines
  Homolog annotation: Hit_ID=CAE62158.1; Match level="QueryCoverage =81%, HitCoverage=1%, E-value=3e-13, Identity=39%"; Hit description =Hypothetical protein CBG06205 [Caenorhabditis briggsae]
  Coding regions on vcDNA: vcDNA=SeqID_95119; Strand=+; Position=3-419
EGNPAPTIVWKKGGRKMPLTDDRVRCQTDGDTGHVSLIISKCRPQDGDEYTLMVKNAHGKHKVGAKLLVTPAAESNLDIRAKQKKRGTGFSNSEQEKQRQRSDAEPKSKAERRKRQVYVVEEPRDTFVVPLNSQHANEK

SEQ ID NO: 168697 - protein, 106 aa, Heterodera glycines
  Homolog annotation: Hit_ID=CAE60076.1; Match level="QueryCoverage =98%, HitCoverage=33%, E-value=8e-16, Identity=39%"; Hit description =Hypothetical protein CBG03596 [Caenorhabditis briggsae]
  Coding regions on vcDNA: vcDNA=SeqID_95120; Strand=+; Position=3-323
NHYSRPGSYTRVYGQQSLYTPSVMAPEAKLATERRTYSGYNYVAGEHSFNLSTKPWSQSNYRFLRVSHISSVPWYFHGQTSNVRHYNSYRPPSFTPRLSTYWKSYF

SEQ ID NO: 168698 - protein, 73 aa, Heterodera glycines
  Coding regions on vcDNA: vcDNA=SeqID_95121; Strand=-; Position=287-508
VRSNVYFLGAKHQKKQNKTFHIKEKSTNFFLPVSRILSEASLSLSVQTIYHWPPPPCCCCSAGAGNGTPSPLI

SEQ ID NO: 168699 - protein, 67 aa, Heterodera glycines
  Homolog annotation: Hit_ID=NP_492343.2; Match level="QueryCoverage =98%, HitCoverage=15%, E-value=2e-20, Identity=71%"; Hit description =CYcloPhilin (cyp-14) [Caenorhabditis elegans] emb|CAB10726.2| Hypothetical protein F39H2.2a [Caenorhabdit
  Gene Ontology: Mol. function=neurotransmitter:sodium symporter activity; Cellular component=integral to plasma membrane; Biological process=cell organization and biogenesis
  Coding regions on vcDNA: vcDNA=SeqID_95122; Strand=+; Position=2-202
AVLIETTLGDLVIDLFVDERPNACKNFLKLCKNKYYNLCQFFTIEPKYIAPTGDPTNSGRMGESIYG

SEQ ID NO: 168700 - protein, 193 aa, Heterodera glycines
  Coding regions on vcDNA: vcDNA=SeqID_95123; Strand=+; Position=26-604
MISSSKFCTNFDQLFNHLRLLCSNDAGAAHYGTELMPIIKENPFFGALCSVMAEEKQKIRAMTAEISCAAMALAFSLDSPTDDAKDKNCAVDQTLSECKKYYLEENELDGETKDKMKQTLEEHEQFGQLIEQNSVACLHTSRRLFAVHAQLRPVTLGDVQQFGIVLKLSTKKWQNELKDAVCSQLLLIKSRAG

SEQ ID NO: 168701 - protein, 46 aa, Heterodera glycines; identical to SEQ ID NO: 162666
  Coding regions on vcDNA: vcDNA=SeqID_95124; Strand=+; Position=563-703

SEQ ID NO: 168702 - protein, 316 aa, Heterodera glycines
  Coding regions on vcDNA: vcDNA=SeqID_95125; Strand=+; Position=76-1023
MATACKLEMSLDEIIKANKSKTNQASINGRKTQMTGKRLIRGNIAKGKPFIRKQINGQNQTKKFGLKRVGINVRRGRPLRKSNRVVVMRKNFAAKNRAVISATKNLVNKLVKKALNKSNVSPRGKRFIANSARRVRTIMLNKVSPRSRVITRQRQRIVAVQPQQQPVFVQRVVRGRGPIRYASDAALVPQTMKMVPKRRFRINPMQQQQPVLLVQNQSPKRRLPSFSSMSVRQHVNALRRATTVQQLQTQFVNQQLPIRQQFRGRQAITTPVVPNRSRGKQQFILDQPVQAGPQFMKFSPRRQRRQTASTNTSSFN

SEQ ID NO: 168703 - protein, 176 aa, Heterodera glycines; identical to SEQ ID NO: 163953
  Homolog annotation: Hit_ID=CAE56164.1; Match level="QueryCoverage =58%, HitCoverage=53%, E-value=1e-18, Identity=40%"; Hit description =Hypothetical protein CBG23784 [Caenorhabditis briggsae]
  Coding regions on vcDNA: vcDNA=SeqID_95126; Strand=+; Position=33-563

SEQ ID NO: 168704 - protein, 86 aa, Heterodera glycines; identical to SEQ ID NO: 163944
  Homolog annotation: Hit_ID=CAE71709.1; Match level="QueryCoverage =96%, HitCoverage=98%, E-value=1e-25, Identity=66%"; Hit description =Hypothetical protein CBG18686 [Caenorhabditis briggsae]
  Gene Ontology: Mol. function=RNA binding; Cellular component=nucleus; Biological process=mRNA cleavage
  Coding regions on vcDNA: vcDNA=SeqID_95127; Strand=+; Position=62-322

SEQ ID NO: 168705 - protein, 257 aa, Heterodera glycines; identical to SEQ ID NO: 163532
  Homolog annotation: Hit_ID=NP_490973.2; Match level="QueryCoverage =100%, HitCoverage=99%, E-value=6e-89, Identity=65%"; Hit description= electron transfer flavoprotein (27.6 kD) (1C986) [Caenorhabditis elegans] gb|AAD03129.2| Hypothetical pr
  Gene Ontology: Mol. function=electron transfer flavoprotein; Cellular component=mitochondrial matrix
  Coding regions on vcDNA: vcDNA=SeqID_95128; Strand=+; Position=67-884

SEQ ID NO: 168706 - protein, 113 aa, Heterodera glycines
  Homolog annotation: Hit_ID=CAE56164.1; Match level="QueryCoverage =91%, HitCoverage=53%, E-value=1e-14, Identity=34%"; Hit description =Hypothetical protein CBG23784 [Caenorhabditis briggsae]
  Coding regions on vcDNA: vcDNA=SeqID_95129; Strand=+; Position=177-515
MEHMWSCATKWQWEKPGVSMKWEITDTLTEAAVDTDCPSRKNRMNNCCYLQTECYNKQIGQKSCDNQFCECMERATAGKKRCSIWEGPGFCRHYRLYGESGYRAAAPPFWSSC

SEQ ID NO: 168707 - protein, 131 aa, Heterodera glycines; identical to SEQ ID NO: 130337
  Coding regions on vcDNA: vcDNA=SeqID_95130; Strand=+; Position=22-417

SEQ ID NO: 168708 - protein, 41 aa, Heterodera glycines
  Coding regions on vcDNA: vcDNA=SeqID_95131; Strand=-; Position=3-125
HQNLIELPCEERRKGQISEEKEGQKSLVKWAESAETKNNEL

SEQ ID NO: 168709 - protein, 203 aa, Heterodera glycines
  Homolog annotation: Hit_ID=AAM12418.1; Match level="QueryCoverage =87%, HitCoverage=64%, E-value=3e-13, Identity=29%"; Hit description =spliced leader 30 kDa protein [Ascaris suum]
  Coding regions on vcDNA: vcDNA=SeqID_95132; Strand=+; Position=2-610
SDIQKAIQALEREYAEQKELFEKWKEENASEADTEPYNAYVEQFRGWEKDVMDNLKELRASIARQPVAPEPELPMVDLDTQLNNLLDRVDTPQFIMAFMSMSQQDPTFLAKAFEVVMEECRTTGFSNPILPQSATIPSLRPVHRLPTPLHQQPPGVPSASSSARHQSARSPGSLYLPPPLQPKAYVQGSSLLGPSRPTSTVSY

SEQ ID NO: 168710 - protein, 104 aa, Heterodera glycines
  Coding regions on vcDNA: vcDNA=SeqID_95133; Strand=+; Position=164-475
CRFFLKISGGFLCDVKRNLQNFQENPHKRTPSKNKLFENLAMPPATWFPLARFSLNMAQFLGPRDAETSKGSPKINLGSPILSFRSILPDTSSNAVDSWVPLKQ

SEQ ID NO: 168711 - protein, 286 aa, Heterodera glycines; identical to SEQ ID NO: 163182
  misc_feature (18)..(18): Xaa can be any naturally occurring amino acid
  misc_feature (278)..(278): Xaa can be any naturally occurring amino acid
  Homolog annotation: Hit_ID=AAL78215.1; Match level="QueryCoverage =97%, HitCoverage=96%, E-value=1e-160, Identity=96%"; Hit description= probable polyprotein allergen Hgg-14 [Heterodera glycines]
  Coding regions on vcDNA: vcDNA=SeqID_95134; Strand=+; Position=4-862

SEQ ID NO: 168712 - protein, 170 aa, Heterodera glycines
  Homolog annotation: Hit_ID=NP_500247.1; Match level="QueryCoverage =87%, HitCoverage=79%, E-value=1e-49, Identity=56%"; Hit description =putative cytoplasmic protein of ancient origin (4D482) [Caenorhabditis elegans] gb|AAF60889.1| Hypothetic
  Coding regions on vcDNA: vcDNA=SeqID_95135; Strand=+; Position=36-548
LFSFPEVSCERTATESIMPPGFKEYFFLDKLAKAFNIVKQTGGIRAAIKQRYLMDTNRAGTLIGEDQFGNRYFEDNTYFVPRNRYVVYAERVWLDYDASQIPPEWHRWLHHICDKPPTVEPPPERKTWMLEHEPNNSIVMSKKYVPYSTTRPKVEGWVPGRKRSEEGTTH

SEQ ID NO: 168713 - protein, 188 aa, Heterodera glycines; identical to SEQ ID NO: 162441
  Homolog annotation: Hit_ID=NP_498935.1; Match level="QueryCoverage =89%, HitCoverage=90%, E-value=4e-19, Identity=32%"; Hit description =single-strand binding protein like (3J859) [Caenorhabditis elegans] gb|AAA50616.1| Hypothetical protein P
  Coding regions on vcDNA: vcDNA=SeqID_95136; Strand=+; Position=50-616

SEQ ID NO: 168714 - protein, 83 aa, Heterodera glycines; identical to SEQ ID NO: 163578
  Coding regions on vcDNA: vcDNA=SeqID_95137; Strand=+; Position=65-316

SEQ ID NO: 168715 - protein, 257 aa, Heterodera glycines
  misc_feature (251)..(251): Xaa can be any naturally occurring amino acid
  Coding regions on vcDNA: vcDNA=SeqID_95138; Strand=+; Position=1-774
ILRHNLAAIRDIVYTVEFALGELVESLGRISLDVREVRQQNQLRQLARPVKTTLAMLKRVRHSLDSTGWSLSTLSRSAGTYAGQDALDQFVAMLPQLPKDCYKLVQWVYSLSVWRDLPRGGATSVFLPPSSGTVPFHAKMHPPPPPPAPFPQQRPSSPSSSLLNYYSSESIEDEQNNNNEDSFRNWATVPMNGSLTDRHGGQAKGGRMFVEQQQWHPQNGGALANDVMDGGESTSSTSSILTAEERTGGGXRRKKQW

SEQ ID NO: 168716 - protein, 280 aa, Heterodera glycines
  Coding regions on vcDNA: vcDNA=SeqID_95139; Strand=+; Position=18-857
LAGKTLIGFFLPQMIILFFSPFVLHKFCVFRWNSKGTHWRREIIPKSERELPTRDNGSIVDYNKFELWRREYEEGVAQLEQEHVKKLKELEESFFKELDEQNRSLDSEVNALDIAIPPLGNGEESLANCATQLGQCQHHPNPLSANHGITTAISGKKFLRSRQNDVIPSSSVGAESALHLGAIGLTDAAGTAKRRTQTKKSGSPFGFLGFGRTEGAVGGFAGAIGGGPTIGGTSTSSLMLPYLLSESAISEDVHSLGSDSANHCHLAERSSAGCGGLSQD

SEQ ID NO: 168717 - protein, 96 aa, Heterodera glycines; identical to SEQ ID NO: 163681
  Coding regions on vcDNA: vcDNA=SeqID_95140; Strand=-; Position=0-287

SEQ ID NO: 168718 - protein, 330 aa, Heterodera glycines
  Homolog annotation: Hit_ID=CAE66637.1; Match level="QueryCoverage =100%, HitCoverage=79%, E-value=1e-120, Identity=66%"; Hit description=Hypothetical protein CBG11974 [Caenorhabditis briggsae]
  Gene Ontology: Mol. function=phosphoglycerate kinase activity; Cellular component=cytosol; Biological process=glycolysis
  Coding regions on vcDNA: vcDNA=SeqID_95141; Strand=+; Position=58-1047
MGSFSKLAIDQLELKGKRVLMRVDFNVPIKDGKVTSNQRIVAALSTIKYAIDHEAKSVVLMSHLGRPDGQAQAKYSMKPVHEELERLLGKTVVFLTDCVGTEIENATADPKPGTIILLENLRFHVEEEGKGKNSAGETVKASKEAVNAFRASLSKHGNLYVNDAFGTAHRAHSSMVGCAMEKRASGFLMKKELEYFAKALESPTRPFLAILGGAKVADKIQLINNLLDKVDEMVICGGMAFTFYKVLTGKSIGKSLFDEEGSKIINDLMAKAKDKNVKIHQPVDFVVGDEFKEGTPFANVDAKDGIPNGKMGLDIGQETLKQFAEVIGRA

SEQ ID NO: 168719 - protein, 120 aa, Heterodera glycines; identical to SEQ ID NO: 163484
  Coding regions on vcDNA: vcDNA=SeqID_95142; Strand=-; Position=24-386

SEQ ID NO: 168720 - protein, 145 aa, Heterodera glycines
  Homolog annotation: Hit_ID=NP_496925.1; Match level="QueryCoverage =95%, HitCoverage=43%, E-value=1e-39, Identity=57%"; Hit description =aldo-keto reductase family 1 member (35.2 kD) (2O262) [Caenorhabditis elegans] emb|CAB54385.1| Hypothetic
  Gene Ontology: Mol. function=bile acid transporter activity; Cellular component=cytoplasm; Biological process=xenobiotic metabolism
  Coding regions on vcDNA: vcDNA=SeqID_95143; Strand=+; Position=46-480
MSSASSPVPSLILNSGFPMSQIGFGTWMCKPTEVNEIVKSAIRNGYRHLDCAFIYQNQSEIGAALKDMLQHGEIKREDLFITSKVWNTFHSFDAALANVQKSLEQLGLDYLDLCLIHWPMGYKEGTELFPKDAEGQKVFLSDVDF

SEQ ID NO: 168721 - protein, 146 aa, Heterodera glycines
  Coding regions on vcDNA: vcDNA=SeqID_95144; Strand=+; Position=45-482
MSLYDDIGIESSTSVQVKEENLEKKADDFPTPNSAQKPQNVTVSAVSAVNKMNLSFLKSQLEAKKAILQNAAAAASQNKSAPGVAFAQPLPATLPNMPQLLNKKGGTFKLKPHKAIPLPIDSTGAFTLVPKSLKEDKVFLFGELMV

SEQ ID NO: 168722 - protein, 208 aa, Heterodera glycines
  Coding regions on vcDNA: vcDNA=SeqID_95145; Strand=+; Position=81-704
MQSVQSSATAAVTAASTVPLSIQNEILWIKQDALQVRNAVILLEQEKDSLRKAIRKLKLENGRLKTKVKTLNEKVAKISNEEMDDEEGKLAPESELDYDELNRGDFYLIGGVHDPISLRFEAAIRDQNAVEHKSAERYYWYKMAEFFGDEEAMKSILHAQNVQQAEEAMKNIKGFDVAEWDKVKLKHWEDGQRLKLEQVRWIENLLVL

SEQ ID NO: 168723 - protein, 218 aa, Heterodera glycines; identical to SEQ ID NO: 163812
  Homolog annotation: Hit_ID=CAE60592.1; Match level="QueryCoverage =98%, HitCoverage=99%, E-value=2e-92, Identity=78%"; Hit description =Hypothetical protein CBG04228 [Caenorhabditis briggsae]
  Gene Ontology: Cellular component=cytosolic ribosome (sensu Eukarya); Biological process=protein biosynthesis
  Coding regions on vcDNA: vcDNA=SeqID_95146; Strand=+; Position=58-714

SEQ ID NO: 168724 - protein, 160 aa, Heterodera glycines
  Coding regions on vcDNA: vcDNA=SeqID_95147; Strand=+; Position=7-486
VTFFLMLATVRFHSVTNNRIDCCQQTLFSLDDSENLPGTDFSVGKAKSKLLSDGRREQQKMAKKTNGGKTEGIGKTAAGGSRGSDSLLTDEVQLDGGAADGASDDESGDFLPIALGTKCAAGHAEENGRANWAANWRLSGRRCLKRASVVLGCCFPWAVG

SEQ ID NO: 168725 - protein, 140 aa, Heterodera glycines
  Homolog annotation: Hit_ID=CAE69858.1; Match level="QueryCoverage =89%, HitCoverage=26%, E-value=1e-14, Identity=34%"; Hit description =Hypothetical protein CBG16187 [Caenorhabditis briggsae]
  Coding regions on vcDNA: vcDNA=SeqID_95148; Strand=+; Position=41-463
MLRALLSPEIFVEIVNCYQELMVVEGCLQIPCCVEFPPLRKFVAANAIRSRQLRQEHLERKWHLELARDACVSKLALSELSWDASLSFKTVRVCMEKLRRIGPEKSAQFARLSIHLSNSPKLFVMFNGRLSVPIDWVKEL

SEQ ID NO: 168726 - protein, 62 aa, Heterodera glycines
  Coding regions on vcDNA: vcDNA=SeqID_95149; Strand=-; Position=1-186
FKQIYFYATVRHSAAAKETKKKNSKNNKSAKFHVKKDKVNQIFLGADFSPRFSASLFYCRVQ

SEQ ID NO: 168727 - protein, 213 aa, Heterodera glycines
  Homolog annotation: Hit_ID=CAA74206.1; Match level="QueryCoverage =97%, HitCoverage=61%, E-value=3e-37, Identity=37%"; Hit description =serine proteinase [Heterodera glycines]
  Gene Ontology: Biological process=antifungal polypeptide induction
  Coding regions on vcDNA: vcDNA=SeqID_95150; Strand=+; Position=6-644
MVKFWLTLFFVFTGNNLYSIFAHKPNFSQCGISDFEPDLDNVPNVKIGTNHIYKGQPVENANSMPWMVTLLSLQGLCTGTIISHKYILTAYHCVSGIISVPSSIQISYGTVNVANEKHKTNARNIIIHPNASLSEMRVKINGSEFGTDSVSNDLAIIEVENALKFSPNVGPICLFGLDASGNDKFGTFSPLINSQFIIAGWGLTQPMCQKYPT

SEQ ID NO: 168728 - protein, 210 aa, Heterodera glycines
  misc_feature (178)..(178): Xaa can be any naturally occurring amino acid
  misc_feature (187)..(187): Xaa can be any naturally occurring amino acid
  Homolog annotation: Hit_ID=NP_741554.1; Match level="QueryCoverage =98%, HitCoverage=41%, E-value=5e-55, Identity=52%"; Hit description =ALDH3C1, ALdehyde deHydrogenase (55.6 kD) (alh-4) [Caenorhabditis elegans] gb|AAM45357.1| Aldehyde dehydr
  Gene Ontology: Mol. function=aldehyde dehydrogenase activity; Cellular component=cytoplasm; Biological process=epidermal differentiation
  Coding regions on vcDNA: vcDNA=SeqID_95151; Strand=+; Position=61-689
MTSPFHSLVESQREFFRTGKTAELAHRRQQLKKLRKTILDNSEFLCEAVQKDLKRDAKLNYPLEISSVIIEIEYVLDNLERWTAPLNVEKTFTTLLDSPQIVREPKGVVLLIGPWNYPLNTLLMPLVDVLAAGNTAILKPSEVASNTAAAVDEIISKAFDRNYLAVVQGGVEQTGELXLKEKFDHIXFTGSALVARHISRAAAEHLTPCT

SEQ ID NO: 168729 - protein, 85 aa, Heterodera glycines
  Coding regions on vcDNA: vcDNA=SeqID_95152; Strand=+; Position=3-257
NSSSDAPAAFGRAFALCWRANTNSKNSQTRNCRSYRWECSKSKEVEECDPSADGRNSSLFALHIVKQISYLLFYNNLNRIKRKSA

SEQ ID NO: 168730 - protein, 154 aa, Heterodera glycines
  Homolog annotation: Hit_ID=NP_495599.1; Match level="QueryCoverage =96%, HitCoverage=42%, E-value=2e-16, Identity=34%"; Hit description =protein BM-009 (38.0 kD) (2H910) [Caenorhabditis elegans] gb|AAK31548.1| Hypothetical protein R07G3.8 [Ca
  Coding regions on vcDNA: vcDNA=SeqID_95153; Strand=+; Position=31-492
MTRSRSGSRCGDVVRYVLGQNTHQQSYNQHIYDDIDVFLDFSHCRPSDQERALFFELEAVLQFAQRSADCLAIYGAGASAEVRAALQNCDDADIQNASFAIVRQFVRRIRKYFETAQRIEKVVPELLWELCSGPLPPVEQLDSAQALCKQLARL

SEQ ID NO: 168731 - protein, 197 aa, Heterodera glycines; identical to SEQ ID NO: 163050
  Homolog annotation: Hit_ID=CAB88203.1; Match level="QueryCoverage =100%, HitCoverage=94%, E-value=7e-99, Identity=70%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_95154; Strand=+; Position=8-598

SEQ ID NO: 168732 - protein, 218 aa, Heterodera glycines
  misc_feature (187)..(187): Xaa can be any naturally occurring amino acid
  misc_feature (193)..(193): Xaa can be any naturally occurring amino acid
  Homolog annotation: Hit_ID=CAB88203.1; Match level="QueryCoverage =100%, HitCoverage=93%, E-value=1e-104, Identity=68%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_95155; Strand=+; Position=3-658
ETHIVLGIGTVCSLLAIIATVVTLPSLYSEMNQLSNKVRDGVEAFRVNTDSAWTDLMDVQVVVAPPSKARDNPFSSIFRAKRQLPGHCHCGPPQRPNCPPGPPGPAGPPGQPGQPGSAGLQGQPGAPGQPAPPCPPQNIPCPLCPAGPPGSPGTQGPPGQQGAPGQPGAPAPGGGQGPPGASGPQGXPGQPGXSGTPGQPGQPGNNAVIYNTIPGPEG

SEQ ID NO: 168733 - protein, 250 aa, Heterodera glycines
  Homolog annotation: Hit_ID=CAB88203.1; Match level="QueryCoverage =100%, HitCoverage=95%, E-value=1e-125, Identity=76%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_95156; Strand=+; Position=13-762
MQETHIVLGIASLCSLLAIIATVVTLPSLYSEMNQLNNKVRDGVEAFRVNTDSAWTDLMDVQVVVAPPSKARDNPFNSIFRAKRQLPGHCHCGPPQRPNCPPGPPGPSGPPGQPGQPGGAGLPGQPGAPGQPAPPCPPQNIPCPRCPAGPPGSPGGQGPPGQQGAPGQPGAPAPGGGQGPPGASGPQGQPGQPGRSGTPGQPGQPGNNAVIFNTIPGPSGAPGAPGQPGSPGSQGQPGQAGGEGPPGPTG

SEQ ID NO: 168734 - protein, 130 aa, Heterodera glycines; identical to SEQ ID NO: 166716
  Homolog annotation: Hit_ID=CAE66815.1; Match level="QueryCoverage =76%, HitCoverage=54%, E-value=1e-09, Identity=34%"; Hit description =Hypothetical protein CBG12180 [Caenorhabditis briggsae]
  Coding regions on vcDNA: vcDNA=SeqID_95157; Strand=+; Position=37-429

SEQ ID NO: 168735 - protein, 154 aa, Heterodera glycines
  Homolog annotation: Hit_ID=NP_496981.1; Match level="QueryCoverage =61%, HitCoverage=46%, E-value=7e-25, Identity=58%"; Hit description =HesB YadR YfhF family protein like precursor (2O630) [Caenorhabditis elegans]
  Gene Ontology: Cellular component=mitochondrial intermembrane space; Biological process=cell ion homeostasis
  Coding regions on vcDNA: vcDNA=SeqID_95158; Strand=+; Position=16-480
MNFVVRLSSKSRFLRLFPSSYSPFSSPFSSSPSTASSSVSSTPLLIITQRAADQLRRIAPPGEHLRICVDSGGCSGFEYKLTLDKRLDEAEDEVIKASEGAIVVVDKLSLQFLRGSKLDFAEDLMRSAFRITDNPLATLGCSCGASFAPKNQIE

SEQ ID NO: 168736 - protein, 350 aa, Heterodera glycines
  Homolog annotation: Hit_ID=CAE58761.1; Match level="QueryCoverage =95%, HitCoverage=96%, E-value=1e-125, Identity=67%"; Hit description= Hypothetical protein CBG01953 [Caenorhabditis briggsae]
  Gene Ontology: Cellular component=mitochondrion
  Coding regions on vcDNA: vcDNA=SeqID_95159; Strand=+; Position=2-1054
LKIIIPKMASRDEIGQTVCDLVGNTPMVYLNKITDGCAAKIAVKVEWMNPAGSVKDRIGIAMVEEAERQGKIKPGITTIIEPTSGNTGIALAFVAVARGYRFIATMPSTMSGERRTLLRAFNAELVLTDPALGIKGCVERAEQLAAAIPNSFIPMQFANEANPEIHYRTTGPEIWRQTQGKVDACVFGIGTGGTITGSGRFLREKNPAIKFYAVEPVESPVLSGGKPNPHKIQGIGAGIVPPILDTKMYEEVVLVHSDEAIAMAKRLAREEGLLSGISSGANVVAALRVAQKPEMAGKLIVTVLPSSGERYLTSALYSDIRAEMEAMSHGETLEDNLKRLLKVEDANSKQ

SEQ ID NO: 168737 - protein, 160 aa, Heterodera glycines
  Homolog annotation: Hit_ID=CAE57332.1; Match level="QueryCoverage =93%, HitCoverage=54%, E-value=2e-18, Identity=35%"; Hit description =Hypothetical protein CBG00261 [Caenorhabditis briggsae]
  Coding regions on vcDNA: vcDNA=SeqID_95160; Strand=+; Position=1-480
LSSPSLLSSSSSSADAVKEYRLVLLGTQHKKPLFEKMCSAAQKFEQHIQYADIWYLTFQFKDSEEPVVVEITDPGTEKTGERQMAIQQKSDAIILCYSAFNPGSFLALESVTEDFQTFNGKPPATLLLCNEDQLAEEGFEDGHETDTADDGYGTNSGGGS

SEQ ID NO: 168738 - protein, 125 aa, Heterodera glycines
  Homolog annotation: Hit_ID=CAE72607.1; Match level="QueryCoverage =64%, HitCoverage=20%, E-value=2e-23, Identity=61%"; Hit description =Hypothetical protein CBG19798 [Caenorhabditis briggsae]
  Coding regions on vcDNA: vcDNA=SeqID_95161; Strand=+; Position=45-419
MYYSLSQIENHLFLNSRDLNPNMAAGASTSRNLLNVASVEIAAQNECFTVWEPLQLRQEWTISNFAKALDLATPGICMRSKNFRDESMPEICWQLCLYPGGKREENSGNVSLFLKMSTTQSQREF

SEQ ID NO: 168739 - protein, 423 aa, Heterodera glycines
  Homolog annotation: Hit_ID=AAH68338.1; Match level="QueryCoverage =76%, HitCoverage=87%, E-value=8e-22, Identity=26%"; Hit description =Unknown (protein for MGC:85638) [Danio rerio]
  Gene Ontology: Cellular component=nucleus; Biological process=DNA damage response, signal transduction resulting in cell cycle arrest
  Coding regions on vcDNA: vcDNA=SeqID_95162; Strand=+; Position=1-1269
PSPTPEVTFKDRSVHEIHLENGYTYVIEQNLKHFASVITVLAKFSEQILLQPTEDGLMLSASSSARSAYAKVKLCRQFFDRLRARENLGPDGEVFCRLATKSLMHIFKSAAQSSVGPVPSCSLELDPQSDFAYVHLQCLSGIRRCFVLSLREYAMVCDNVFNERQRLKNRVTAHAKMLATLLSPLDCSDLELVALADRFTACRYIPREEYGKVRRTEVQIPVDHCEQYRIEVPTRVVVNLRELRPILQFADLCGMSVSLHFDRAGRPLIVAVEENVDFAAEFVLGTLDEQLPLNEQQQQPTPQQQQEQQPVVQQREEQPPQHRHNQMLRHHSPAPAAVAERVEEEHNETPPNRDQMLMVQQEEDVQLSIRSTPILPIAALRQEEHNETAPNHGQMSIGPTPILAVAATVQQQQEAHNEISQND

SEQ ID NO: 168740 - protein, 153 aa, Heterodera glycines
  Homolog annotation: Hit_ID=NP_491614.1; Match level="QueryCoverage =64%, HitCoverage=30%, E-value=1e-25, Identity=58%"; Hit description =zinc transporter ZIP (34.2 kD) (1G76) [Caenorhabditis elegans] gb|AAB37816.1| Hypothetical protein F59A3.
  Coding regions on vcDNA: vcDNA=SeqID_95163; Strand=+; Position=30-488
MLFSLSHFSPIVQSLFASLFTWAVTALGAAVVFVFPSSNRVFLDASLGFSSGVMLAASFWSLLSPAIEISERQMAKLAFVPVAVGFALGAFFVYLSDRLTQNFNGSALSDQINQLENWHSANQQNGIHSENAPFDFETDRQRSENPENAGELA

SEQ ID NO: 168741 - protein, 88 aa, Heterodera glycines; identical to SEQ ID NO: 157977
  Homolog annotation: Hit_ID=NP_497455.1; Match level="QueryCoverage =54%, HitCoverage=51%, E-value=1e-10, Identity=63%"; Hit description =putative secreted or extracellular protein precursor (3C853) [Caenorhabditis elegans] gb|AAF60614.2| Caen
  Coding regions on vcDNA: vcDNA=SeqID_95164; Strand=+; Position=30-296

SEQ ID NO: 168742 - protein, 93 aa, Heterodera glycines; identical to SEQ ID NO: 163567
  Coding regions on vcDNA: vcDNA=SeqID_95165; Strand=+; Position=95-376

SEQ ID NO: 168743 - protein, 119 aa, Heterodera glycines
  Coding regions on vcDNA: vcDNA=SeqID_95166; Strand=-; Position=0-356
FWTDLTGSEVKSTGEGPKGGEVAAVETLCPSRHSQPHISPCPSSLGSPCPLREPLNQIIQYFVCLFPMPSYPSSLSNAVPWKNSSSSSCTSSSLTFTTLSFPAPFRLHKERSIGKLKLG

SEQ ID NO: 168744 - protein, 174 aa, Heterodera glycines; identical to SEQ ID NO: 163565
  Homolog annotation: Hit_ID=NP_496065.1; Match level="QueryCoverage =97%, HitCoverage=92%, E-value=3e-49, Identity=51%"; Hit description =adrenal gland protein ad-004 like (21.0 kD) (2J887) [Caenorhabditis elegans] emb|CAA87383.2| Hypothetical
  Gene Ontology: Cellular component=nucleus; Biological process =response to oxidative stress
  Coding regions on vcDNA: vcDNA=SeqID_95167; Strand=+; Position=19-543

SEQ ID NO: 168745 - protein, 373 aa, Heterodera glycines; identical to SEQ ID NO: 163564
  Homolog annotation: Hit_ID=EAL31058.1; Match level="QueryCoverage =58%, HitCoverage=54%, E-value=1e-17, Identity=29%"; Hit description =GA20281-PA [Drosophila pseudoobscura]
  Gene Ontology: Mol. function=transcription factor activity; Cellular component=nucleus; Biological process=transcription from Pol II promoter
  Coding regions on vcDNA: vcDNA=SeqID_95168; Strand=+; Position=39-1160

SEQ ID NO: 168746 - protein, 159 aa, Heterodera glycines
  Homolog annotation: Hit_ID=NP_503728.1; Match level="QueryCoverage =98%, HitCoverage=47%, E-value=8e-12, Identity=29%"; Hit description =THUMP domain containing protein (5D165) [Caenorhabditis elegans] gb|AAC17683.1| Hypothetical protein W02G
  Coding regions on vcDNA: vcDNA=SeqID_95169; Strand=+; Position=2-478
TVDGDEKRAVRGAFNVIDRFISVEECSTDKFDDECAKKEGALTDGQKDVSDSLASECQQIRQNKRQFASNAVRQYMTGARCSLFFASPMIRPYNVYKIAEQMVDQSQKESLTRFLARVIPVEETCHANLDEIKTLLSEMVVKHLKGEKKDTPPTYAVEF

SEQ ID NO: 168747 - protein, 146 aa, Heterodera glycines
  misc_feature (70)..(70): Xaa can be any naturally occurring amino acid
  Homolog annotation: Hit_ID=CAE60543.1; Match level="QueryCoverage =97%, HitCoverage=51%, E-value=7e-33, Identity=48%"; Hit description =Hypothetical protein CBG04170 [Caenorhabditis briggsae]
  Gene Ontology: Mol. function=rRNA binding; Cellular component =nucleolus; Biological process=ribosome biogenesis
  Coding regions on vcDNA: vcDNA=SeqID_95170; Strand=+; Position=42-478
MKVEKIKTRRGKKFLEDRAPKLVENDKVTLFVKGKKCSVMLNKILGELYQLKKPLANRLQRLNWPFFNDXSHKFDASLFVFGSSTKKRPNSLLFGRMYDHQMLDMVELQVENFVSSDEFKQVKSVTLGSKPCIILQGHLFESNGIL

SEQ ID NO: 168748 - protein, 109 aa, Heterodera glycines; identical to SEQ ID NO: 162453
  Coding regions on vcDNA: vcDNA=SeqID_95171; Strand=+; Position=7-336

SEQ ID NO: 168749 - protein, 123 aa, Heterodera glycines
  Homolog annotation: Hit_ID=CAE63795.1; Match level="QueryCoverage =65%, HitCoverage=17%, E-value=7e-12, Identity=41%"; Hit description =Hypothetical protein CBG08337 [Caenorhabditis briggsae]
  Gene Ontology: Mol. function=carboxypeptidase activity; Cellular component=mitochondrial inner membrane; Biological process=transport
  Coding regions on vcDNA: vcDNA=SeqID_95172; Strand=+; Position=17-388
MKFMASMVTSFPVSFFLFFSTALIHGTMGGLFWSKKPADSADDSLWSRYHDQNAMEELLEKVHSKCPNVTRLYSVGRSVQGRDLAVIEFSLHPGRHQICNSMSPFVSRGLSELQMTNHRQITS

SEQ ID NO: 168750 - protein, 158 aa, Heterodera glycines
  Homolog annotation: Hit_ID=NP_509949.1; Match level="QueryCoverage =91%, HitCoverage=44%, E-value=2e-52, Identity=64%"; Hit description =sideroflexin 1 (35.5 kD) (XM278) [Caenorhabditis elegans] emb|CAA91477.1| Hypothetical protein T04F8.1 [C
  Gene Ontology: Cellular component=integral to membrane; Biological process=erythrocyte differentiation
  Coding regions on vcDNA: vcDNA=SeqID_95173; Strand=+; Position=6-479
MSEMNINSSSLSSSMLVRDLTLKPDVSKPRWDQSTYQGRARHFFAVLNPLNLFTSNQGLEESRNIVLDYRKGIFSPELTVERLWKAKHLYESAYHPMSDQKMLPFGRMCAQVPCNMVLIGGMLSFYKSPLAVVFWQWTNQSFNAVVNYTNRSGDSVST

SEQ ID NO: 168751 - protein, 139 aa, Heterodera glycines
  Homolog annotation: Hit_ID=AAG21334.2; Match level="QueryCoverage =100%, HitCoverage=35%, E-value=3e-72, Identity=100%"; Hit description=hypothetical esophageal gland cell secretory protein 4 [Heterodera glycines]
  Coding regions on vcDNA: vcDNA=SeqID_95174; Strand=+; Position=2-418
PERDTKMDTTNAEVMDTKKEANAAAAAPVAASDNTAPAPMTWMMDGIVPRDVNVMVDRTTKELRKTTETDGFYDMSQRAQERVMLETAGKQGEIVKTKLKEAIEEARKMIERALGTVISYSEAPMESKMQLEQVFMTLT

SEQ ID NO: 168752 - protein, 176 aa, Heterodera glycines
  Homolog annotation: Hit_ID=NP_511045.1; Match level="QueryCoverage =97%, HitCoverage=80%, E-value=1e-48, Identity=57%"; Hit description =CG4528-PA [Drosophila melanogaster] gb|AAF46017.1| CG4528-PA [Drosophila melanogaster] gb|AAL29039.1| LD4
  Gene Ontology: Cellular component=snRNP U1; Biological process =primary sex determination, soma
  Coding regions on vcDNA: vcDNA=SeqID_95175; Strand=+; Position=93-620
MLSPTILCTSTNEKVKKEELKKALYAIFSQFGQIIDILAFKHLKMRGQSHVIFKEINSAATALRSMQGFPFYDKPMRIQFSREDSDVISKAKGTFVERPKKNIAVPKKKKKLAEGPTKKSKTSGKEGQQRSTAPPNKILFITNLPPECTEEMLRVVFQPLPGLRDILQVSNRTDIA

SEQ ID NO: 168753 - protein, 195 aa, Heterodera glycines
  Homolog annotation: Hit_ID=CAE65688.1; Match level="QueryCoverage =82%, HitCoverage=37%, E-value=2e-15, Identity=29%"; Hit description =Hypothetical protein CBG10763 [Caenorhabditis briggsae]
  Coding regions on vcDNA: vcDNA=SeqID_95176; Strand=+; Position=3-590
LSKCIVLVDYARQRQEWTFNKVSQLSTSVVELRNKIETEATRTRKNPGEVLLKIIRFYSSKLNVLMSKLRDRSSEVLLSSSMQKQILTLTAYVQQLDDNFVKAKDIDEVKQEVLEEAKQKLFDIARWSASLSLRGPPKTSTADDVENENLSSNIETEPKQEETKGEEEETLQQSMKEDEEEKGEEEEDEEEEEED

SEQ ID NO: 168754 - protein, 150 aa, Heterodera glycines
  Homolog annotation: Hit_ID=AAD27589.1; Match level="QueryCoverage =96%, HitCoverage=24%, E-value=2e-61, Identity=81%"; Hit description =chaperonine protein HSP60 [Onchocerca volvulus]
  Gene Ontology: Mol. function=heat shock protein activity; Cellular component=mitochondrion; Biological process=cell organization and biogenesis
  Coding regions on vcDNA: vcDNA=SeqID_95177; Strand=+; Position=60-509
TNNFLKMLSRFSKITVRGYAKDLKFGSEGRKAMLSGVDMLADAVAVTMGPKGRNVVIEQSWGSPKITKDGVTVAKAIDFKDKFQNMGAKLVQDVANKTNEEAGDGTTCATVLARAIAKEGFENISKGANPVEVRKGLMNAVDQLVKELKA

SEQ ID NO: 168755 - protein, 177 aa, Heterodera glycines
  Coding regions on vcDNA: vcDNA=SeqID_95178; Strand=+; Position=15-548
LNYLNLFLLHMATPATIKKLEEKKLLAQQRKQMQQKDGSNGNAGAQLLSLSEQSDAPSSHLLVRTEPVEGAPPRHIDLRPLSGNYSNFRERRGEDFSTDVSAERPYGLSNYTNFDANSGPTAYAWPPQNYQPAFGPPPPLLTQQQNILQPLSRPSTFNTYRRPRTAANFSGKLKKQI

SEQ ID NO: 168756 - protein, 53 aa, Heterodera glycines
  misc_feature (1)..(1): Xaa can be any naturally occurring amino acid
  Coding regions on vcDNA: vcDNA=SeqID_95179; Strand=-; Position=1-159
XKRPLPISQKSIKGKFGGMASTHPNKYIRPSQGLIQCTEVRKMDNIRRKDRRN

SEQ ID NO: 168757 - protein, 176 aa, Heterodera glycines
  Homolog annotation: Hit_ID=CAE60565.1; Match level="QueryCoverage =100%, HitCoverage=96%, E-value=1e-79, Identity=79%"; Hit description= Hypothetical protein CBG04194 [Caenorhabditis briggsae]
  Gene Ontology: Mol. function=signal peptidase activity; Cellular component=signal peptidase complex; Biological process=proteolysis and peptidolysis
  Coding regions on vcDNA: vcDNA=SeqID_95180; Strand=+; Position=2-532
LSIFDEFRRMDGRQILYQFLNFAMIVSSALMIWKGLMVVTGSESPIVVVLSGSMEPAFYRGDLLMLTNDLDDPIRAGDITVFKIEGRDIPIVHRVIKVHEKNDEETKFLTKGDNNMVDDRGLYAPGQYWLQRKDVVGRAKGFVPYVGMVTIIMNDYPKLKYTVLALLGLFVLLHRE

SEQ ID NO: 168758 - protein, 143 aa, Heterodera glycines
  Homolog annotation: Hit_ID=AAR01198.1; Match level="QueryCoverage =77%, HitCoverage=82%, E-value=3e-10, Identity=35%"; Hit description =cellulase binding protein [Heterodera glycines] gb|AAN32887.1| cellulose binding protein [Heterodera glyci
  Coding regions on vcDNA: vcDNA=SeqID_95181; Strand=+; Position=13-444
MNKLFGLLMLFAALMAHFIDCRPIRSSKRLVKVGVQLDNSEKTASASGNTYKLEFTNLSYKLVCQVKFRIELPQTATLDEYWNINPIGPADDHLFTLPVEQMYPGRSFTSARVKLNGVGEPKVTIMDTVDVLSTKPCPTVPNF

SEQ ID NO: 168759 - protein, 189 aa, Heterodera glycines
  Homolog annotation: Hit_ID=NP_510484.1; Match level="QueryCoverage =86%, HitCoverage=95%, E-value=4e-59, Identity=67%"; Hit description =putative N-myristoylated protein, with a transmembrane domain, of bilaterial origin (17.6 kD) (XP588) [Ca
  Coding regions on vcDNA: vcDNA=SeqID_95182; Strand=+; Position=116-685
MQNLFPGKFGQAAQAANTAQMQMKAEHDPSAGFPWWVRFLAKGLGIVGGFVAIFFGVLALFTIHPMCMVAALLQLAAGFLTIALEAPFCCAFVDFIERIAQFSESRAYWQKAALYGGMGIVPILLCAGTETILGAGMICASGVAYGFMALGKKADRTTMLGGANTAGQDPAWSPQLNQPFPRPAGFFQP

SEQ ID NO: 168760 - protein, 139 aa, Heterodera glycines
  Homolog annotation: Hit_ID=CAE72493.1; Match level="QueryCoverage =81%, HitCoverage=11%, E-value=5e-23, Identity=43%"; Hit description =Hypothetical protein CBG19672 [Caenorhabditis briggsae]
  Coding regions on vcDNA: vcDNA=SeqID_95183; Strand=+; Position=1-417
ASQWAFLEQPIHQLLQCPADYGASEAQFGQSRAIVVGGADSAFLLQKTRFDDDWNGPSTMSTLLLAQYLQQSEGPLWNAVRGTGLAYGVSLYVMPDRKALSLDLYRCSELTKAYEQTRDTTLAVLNLDRLDTNLLESAK

SEQ ID NO: 168761 - protein, 156 aa, Heterodera glycines
  Homolog annotation: Hit_ID=NP_871644.1; Match level="QueryCoverage =95%, HitCoverage=16%, E-value=1e-16, Identity=33%"; Hit description =putative cytoplasmic protein of ancient origin (3H529) [Caenorhabditis elegans]
  Coding regions on vcDNA: vcDNA=SeqID_95184; Strand=+; Position=8-475
MESGRSDEVLARLEAVRRRVLAAPMNVHFGGDPSQIRLGTCSSSASSPPITDIASQWAFLEQPIHQLLQCPADYGASEAQFGQSRAIVVGGADSAFLLQKTRFDDDWNGPSTMSTLLLAQYLQQSEGPLWNAVRGPGYAYGVSLYVMPDRKALSLD

SEQ ID NO: 168762 - protein, 102 aa, Heterodera glycines
  Coding regions on vcDNA: vcDNA=SeqID_95185; Strand=+; Position=2-310
LSVLRQTHCSFVTALSFLPQRSCDVKDLGHIGETISHNLPSKRCFLPGICADFRCALVSVSVDRTIQVHQFPFPTQSSFSAFLFRLSILTSVLYVLLWTLFA

SEQ ID NO: 168763 - protein, 137 aa, Heterodera glycines
  misc_feature (13)..(13): Xaa can be any naturally occurring amino acid
  Homolog annotation: Hit_ID=NP_492638.1; Match level="QueryCoverage =98%, HitCoverage=15%, E-value=8e-45, Identity=59%"; Hit description =eukaryotic Initiation Factor (103.8 kD) (eif-3.C) [Caenorhabditis elegans] emb|CAB03403.1| Hypothetical p
  Gene Ontology: Mol. function=translation initiation factor activity; Cellular component=eukaryotic 48S initiation complex; Biological process=regulation of translational initiation
  Coding regions on vcDNA: vcDNA=SeqID_95186; Strand=+; Position=1-458
AICALIERAQNYXDTRRQSGAIDQAEILIIYGLRIEHLYYKYSSNEVEDEQLMDSLCKIVYAIGNAPLARQRAMLCQIYHHALHDRWHKAKNLLLMSHLQALVDHSDASTQILYNRTICQLGLCAFRHGFVREAHQN

SEQ ID NO: 168764 - protein, 158 aa, Heterodera glycines
  Coding regions on vcDNA: vcDNA=SeqID_95187; Strand=+; Position=2-475
LMLVGLDHLLPVRPVGLCLIEYSSTLSPSFLFVHFISNFSKSSSSAGTSDHHITFVSLHTTLGLLRMVMGKMAQRLNLDTFHFVSVSDFLGDSLLFDCDRLFSWITKEVLRSVLPDRPQLVVLDDLFLSHPSIRPAKLLQFLLALFVRLPDRSFFIMA

SEQ ID NO: 168765 - protein, 262 aa, Heterodera glycines; identical to SEQ ID NO: 163558
  Homolog annotation: Hit_ID=XP_394833.1; Match level="QueryCoverage =45%, HitCoverage=24%, E-value=5e-17, Identity=39%"; Hit description =similar to CG5504-PC [Apis mellifera]
  Gene Ontology: Mol. function=co-chaperone activity; Cellular component=mitochondrial inner membrane; Biological process =embryogenesis and morphogenesis
  Coding regions on vcDNA: vcDNA=SeqID_95188; Strand=+; Position=6-791

SEQ ID NO: 168766 - protein, 97 aa, Heterodera glycines
  Homolog annotation: Hit_ID=CAE74333.1; Match level="QueryCoverage =72%, HitCoverage=96%, E-value=1e-15, Identity=59%"; Hit description =Hypothetical protein CBG22046 [Caenorhabditis briggsae]
  Coding regions on vcDNA: vcDNA=SeqID_95189; Strand=+; Position=1-294
VPFKPINYSCTCTLHFLDFFTTRTFRGNQRDLARERNLKKQQQQKKQEQGTSTEKRMERDAEAMRLKQQKAAAKKAEEEKANAQAPKVVKVDPLKGL

SEQ ID NO: 168767 - protein, 74 aa, Heterodera glycines
  misc_feature (28)..(28): Xaa can be any naturally occurring amino acid
  Homolog annotation: Hit_ID=CAE74333.1; Match level="QueryCoverage =97%, HitCoverage=98%, E-value=2e-16, Identity=59%"; Hit description =Hypothetical protein CBG22046 [Caenorhabditis briggsae]
  Coding regions on vcDNA: vcDNA=SeqID_95190; Strand=+; Position=74-299
MTRGNQRDLARERNLKKQQQQKKQEQGXATEKRMERDAEAMRLKQQKAAAKKAEEEKANAQAPKVVKVDPLKGL

SEQ ID NO: 168768 - protein, 106 aa, Heterodera glycines; identical to SEQ ID NO: 166702
  Coding regions on vcDNA: vcDNA=SeqID_95191; Strand=+; Position=1-321

SEQ ID NO: 168769 - protein, 186 aa, Heterodera glycines
  misc_feature (157)..(157): Xaa can be any naturally occurring amino acid
  Homolog annotation: Hit_ID=AAH85400.1; Match level="QueryCoverage =73%, HitCoverage=29%, E-value=5e-31, Identity=45%"; Hit description =Zgc:101647 [Danio rerio] ref|NP_001007443.1| zgc:101647 [Danio rerio]
  Gene Ontology: Mol. function=protein binding; Cellular component =mitochondrial inner membrane; Biological process=proteolysis and peptidolysis
  Coding regions on vcDNA: vcDNA=SeqID_95192; Strand=+; Position=3-561
TPIIKSSASLKFWSKFFDTRLNWHCRRNSTAKVVPKKVLRDNCYQSTSLDSGLRIATLPAYGQFTTIGVAIYAGSRNEVHYPPGTAHFLEKISFLSSQQFPDKAHTLDLLEKFGALIDCQSTRDTFVYAASCRVENAFDVLSIIADAVLRPNILDNXQPECEPLLTDWIHQAAFRSNTGGLSRQYY

SEQ ID NO: 168770 - protein, 157 aa, Heterodera glycines
  Homolog annotation: Hit_ID=AAN32892.1; Match level="QueryCoverage =100%, HitCoverage=74%, E-value=4e-74, Identity=87%"; Hit description= secretory protein 4D06 [Heterodera glycines]
  Coding regions on vcDNA: vcDNA=SeqID_95193; Strand=+; Position=3-473
IVFLVCCNAMPNFPCCPGSQQVVAVMSNYIGTFTSEDKSTVCSTAKNTVDGIKSELSSRGGCPSGGEAQIVNEIDRQLTNIAKMKINYEDGCPYNLGFARAMFDLAAAAAGHAGNGTEWQTMKGQFEQESQAIKAIGQEMNIEVTDVHFGHPSKGFS

SEQ ID NO: 168771 - protein, 121 aa, Heterodera glycines
  misc_feature (49)..(49): Xaa can be any naturally occurring amino acid
  Homolog annotation: Hit_ID=AAP30755.1; Match level="QueryCoverage =100%, HitCoverage=53%, E-value=2e-60, Identity=95%"; Hit description= putative gland protein 29D09 [Heterodera glycines]
  Coding regions on vcDNA: vcDNA=SeqID_95194; Strand=+; Position=30-392
MSSLLLSIFPIVFLVCCNAMPNFPCCPGSQQVVAVMSKYIDTFSSAADXSTVCSTAKSTVDGIKNELSSRGGCQNGGEAQIVDGIDRQLKNIAKMEINYEDECPYNLGFARAMFDLAAAAA

SEQ ID NO: 168772 - protein, 234 aa, Heterodera glycines
  Coding regions on vcDNA: vcDNA=SeqID_95195; Strand=+; Position=1-702
TKPKFTTMSIIRRQFFATKLFSPQLASNKMAVLPVRHCVSVATPTQNDVPYNPSPTTAQTLDTLGIGTTVQPPEPKWQKAGLRIELNCADEQIFQSIVQEIVDRFGWDNSAYDYAMWRKAFGPNNFGMFFALDEDRLPMASTSMAVYPKIAHWSMYYVKERYRGHQLGRALTRRAMEMAGDRHIFGYGVAEMWAKYAEEYGMCHFLDWQLWSLLVKSADVRPERLDNDSSVVLK

SEQ ID NO: 168773 - protein, 282 aa, Heterodera glycines; identical to SEQ ID NO: 162860
  Homolog annotation: Hit_ID=NP_499162.1; Match level="QueryCoverage =100%, HitCoverage=70%, E-value=1e-101, Identity=63%"; Hit description=ubiquitin-specific protease, possibly N-myristoylated (46.6 kD) (3K867) [Caenorhabditis elegans] emb|CA
  Gene Ontology: Mol. function=ubiquitin-specific protease activity; Cellular component=cytoplasm; Biological process=protein modification
  Coding regions on vcDNA: vcDNA=SeqID_95196; Strand=+; Position=68-913

SEQ ID NO: 168774 - protein, 69 aa, Heterodera glycines; identical to SEQ ID NO: 166696
  Coding regions on vcDNA: vcDNA=SeqID_95197; Strand=+; Position=77-283

SEQ ID NO: 168775 - protein, 46 aa, Heterodera glycines
  Coding regions on vcDNA: vcDNA=SeqID_95198; Strand=+; Position=23-160
GKTSHEPYDAKFTSMKYFISRKLVFPLVHQWTSAYLITLHSTFSEN

SEQ ID NO: 168776 - protein, 151 aa, Heterodera glycines
  misc_feature (48)..(48): Xaa can be any naturally occurring amino acid
  Homolog annotation: Hit_ID=CAE68398.1; Match level="QueryCoverage =96%, HitCoverage=86%, E-value=8e-34, Identity=46%"; Hit description =Hypothetical protein CBG14167 [Caenorhabditis briggsae]
  Coding regions on vcDNA: vcDNA=SeqID_95199; Strand=+; Position=23-477
MASENEIPDKFLGKFKLEKNEKFDEYLASKGVSWILRKMICFTTVTKXFEKSEAEKSKYNAYNQSSKHNTNWEGWKIGETFEGIGLDGKQHKITFDLSDNGDTLTEKHLRMDNPSDVGEVYRYSVDTDSGHLILTLSNESLTARRFFKRIQ

SEQ ID NO: 168777 - protein, 22 aa, Heterodera glycines
  Coding regions on vcDNA: vcDNA=SeqID_95200; Strand=+; Position=1-66
KGQLLLLLPHQMLTQPRLKQPN

SEQ ID NO: 168778 - protein, 163 aa, Heterodera glycines
  Homolog annotation: Hit_ID=NP_494763.1; Match level="QueryCoverage =100%, HitCoverage=64%, E-value=1e-51, Identity=58%"; Hit description= u2 snrnp-specific A' protein (28.9 kD) (2E615) [Caenorhabditis elegans] gb|AAK31542.1| Hypothetical prot
  Gene Ontology: Mol. function=pre-mRNA splicing factor activity; Cellular component=cytoplasm; Biological process=mRNA splicing
  Coding regions on vcDNA: vcDNA=SeqID_95201; Strand=+; Position=3-491
MVRISVDVVNDAYQFINPCKQREISLRNLQIPTIENLGVTRDQFDVIDLTDNNIRKLDNLPRLKRLETLLLHNNRVDFISKEIGDQLTKLSTLVLTNNNLAQLGDIDVLASCPRLEYLSLQGNPLTHLPKYRQYVIYKLKNVRVLDYKRIRLAERQAAKKLFK

SEQ ID NO: 168779 - protein, 48 aa, Heterodera glycines; identical to SEQ ID NO: 166694
  Coding regions on vcDNA: vcDNA=SeqID_95202; Strand=-; Position=31-177

SEQ ID NO: 168780 - protein, 123 aa, Heterodera glycines
  misc_feature (95)..(95): Xaa can be any naturally occurring amino acid
  Homolog annotation: Hit_ID=NP_496066.2; Match level="QueryCoverage =94%, HitCoverage=23%, E-value=2e-26, Identity=53%"; Hit description =nuclear Hormone Receptor (nhr-19) [Caenorhabditis elegans] emb|CAD27185.1| Hypothetical protein E02H1.7 [
  Gene Ontology: Mol. function=copper ion binding; Cellular component =nucleus; Biological process=electron transport
  Coding regions on vcDNA: vcDNA=SeqID_95203; Strand=+; Position=364-733
MCFSREKMAPRMPLTAVGGIPKSNAIGLCLICKELSFGKHYGCISCLGCKTFFRRAVMHNQDTVCKKPGFCEFEVSARRLCRSCRFRVSTMGMSXEALQPKRDLIGRQRRRRYQAVASSVTPP

SEQ ID NO: 168781 - protein, 154 aa, Heterodera glycines
  Homolog annotation: Hit_ID=NP_505118.1; Match level="QueryCoverage =82%, HitCoverage=19%, E-value=3e-13, Identity=35%"; Hit description =component oligomeric golgi complex 6 (73.6 kD) (5I700) [Caenorhabditis elegans] gb|AAA96179.1| Hypothetic
  Coding regions on vcDNA: vcDNA=SeqID_95204; Strand=+; Position=42-503
MTLEGERGGLDALLTARLDEDEQFIATINYLNDNLRLDAETTEQKLRMVLEDRELELNQQYLEQLEKMNDRVQGFVQQIRSMNSICCELTERIQTNKEKTRELLKRTAVLQTEKRELGAKNAFLDEFFAKYSLNEEEETALALPNQQGSPSDAF

SEQ ID NO: 168782 - protein, 167 aa, Heterodera glycines
  Homolog annotation: Hit_ID=NP_495408.1; Match level="QueryCoverage =98%, HitCoverage=24%, E-value=2e-63, Identity=69%"; Hit description =ATP-binding cassette sub-family D member 3 like (74.9 kD) (2H174) [Caenorhabditis elegans] gb|AAA68340.1|
  Gene Ontology: Mol. function=ATP-binding cassette (ABC) transporter activity; Cellular component=integral peroxisomal membrane; Biological process=peroxisomal long-chain fatty acid import
  Coding regions on vcDNA: vcDNA=SeqID_95205; Strand=+; Position=3-503
AAGFRERLTHHFYAQYLDGFTFYKMTNLDNRIANADQLLTQDVDRFCEGIVELYSNLSKPFVDVLLYVSRIGASIGWQAPIQLFVYLLFSGTALTYLRRPIGRMTVMEQQLEGDYRFVNSRLIVNSEEIAFYQGNERERVSVLNAFQRMISHLRSLILFRFSIAFMD

SEQ ID NO: 168783 - protein, 244 aa, Heterodera glycines
  misc_feature (68)..(68): Xaa can be any naturally occurring amino acid
  Homolog annotation: Hit_ID=CAE63437.1; Match level="QueryCoverage =81%, HitCoverage=85%, E-value=6e-46, Identity=49%"; Hit description =Hypothetical protein CBG07885 [Caenorhabditis briggsae]
  Coding regions on vcDNA: vcDNA=SeqID_95206; Strand=+; Position=3-738
FVRHFCSQNITKPTTKCDEQENSSAPSCSSSSAALVHVQNRGQWPVEVLAKFLADCFVLGDFVSEYLXTQLLDEVWPHMNRMRWEDEHWDGQIQRYREREQMLENWLPENQALIRRIWHTSFPAPFEPSPYVHILDLHQDGFISPHLDKSRYCGRVISGLSLLSASVMRMRHKSAELGQLCVADLLLSRLSLYWLSGSARYDFTHALLGAEESRFGTQTVPRERRIALICREVVVPTAKSDQID

SEQ ID NO: 168784 - protein, 304 aa, Heterodera glycines
  Homolog annotation: Hit_ID=AAS38911.1; Match level="QueryCoverage =91%, HitCoverage=85%, E-value=2e-16, Identity=24%"; Hit description =similar to Leishmania major. Ppg3 [Dictyostelium discoideum]
  Coding regions on vcDNA: vcDNA=SeqID_95207; Strand=+; Position=30-941
MSPNTLCSIVCLLLVCNFIWADDEHRSFAEELVRRLRRSHGYSVGYGGNCACSSSAYPATASHTSYTAPKQTSYSSYSCSGSGCGHQAYQPPQKTSYHWCTGTACNKAQAVAHPVPVSSNSYKSSCTTCGSSSHQQHYSTVTETKTVYPVKTYSWCTGTACGAQAQPVQPVAPAASGGGTSISTGSSCSSGTCGQQKQQVQPVAPVQPAAPASTSSCSGGSSCGAAAQEVQPAAESSSGSSSSGGYDTQETQPSGSDSSSGACSGASCGEAAQPGASSSSSCSGASCGQAAQPAASSSSSCSGG

SEQ ID NO: 168785 - protein, 94 aa, Heterodera glycines; identical to SEQ ID NO: 158271
  Coding regions on vcDNA: vcDNA=SeqID_95208; Strand=+; Position=3-287

SEQ ID NO: 168786 - protein, 224 aa, Heterodera glycines
  Homolog annotation: Hit_ID=NP_500267.1; Match level="QueryCoverage =100%, HitCoverage=100%, E-value=4e-52, Identity=51%"; Hit description=protein similar to B-cell receptor-associated protein 31 (24.0 kD) (4D656) [Caenorhabditis elegans] gb|
  Gene Ontology: Mol. function=receptor-associated protein activity; Cellular component=integral to plasma membrane; Biological process =immune response
  Coding regions on vcDNA: vcDNA=SeqID_95209; Strand=+; Position=166-840
MTLQWTVVAFILYAEIATIIVLLLPWVRPTMWKKVFNSRVVHKLKQFSNVYAYAFIFVLILLFVDATREVRKYSHVDTTREMVGRVAEADAVVHMRLFRAQRNLYLSGFSLLMALIISRIVTLLARCAHLELAAEAAMKQAEGAGKAAQTLLGKEGDVNSLSGEEAKKLRNRIGKNWERSLKKSGRRDRDAMKAQAENLQEEYERVSQQLRTAEASHNGNKKSD

SEQ ID NO: 168787 - protein, 147 aa, Heterodera glycines
  Coding regions on vcDNA: vcDNA=SeqID_95210; Strand=-; Position=0-440
GVNAGLCATTTVKTKQILNTVKKLLQEWTSSHFTDNSTDVNQLSSIDSFGLLPDAFGDFDGPNATAGQVLSKWLHIPRKDGLPTQLRCKDFNEQADFGWVNIFKEVATSDGPCHHFFRLIPIHFTVHAPSMPIMPFEFNWQLTLRFL

SEQ ID NO: 168788 - protein, 148 aa, Heterodera glycines
  Coding regions on vcDNA: vcDNA=SeqID_95211; Strand=-; Position=2-445
EWTSSHFTDNSTDLNQLSSIDSFGLLPDAFGDFDGPNATAGQVLSKWLHIPRKDGLPKQLRCKDFNEQADFGWVNIFKEVATRDGPCHHFFRLIPIHFTVHAPSMPIIPFEFNWQLTLRFLSNPRAEFLQPGGSTSWRAAATAGSSSF

SEQ ID NO: 168789 - protein, 72 aa, Heterodera glycines
  Coding regions on vcDNA: vcDNA=SeqID_95212; Strand=-; Position=2-217
VVRTRKCLSPISCGVIHPSVSPFICCFSLGLLLDSDGGRRRLFHVLLSDAEGVEVQPVQLGASDGQLTAKRL

SEQ ID NO: 168790 - protein, 123 aa, Heterodera glycines
  Homolog annotation: Hit_ID=NP_499535.1; Match level="QueryCoverage =100%, HitCoverage=23%, E-value=6e-54, Identity=82%"; Hit description= NOT-like, component of CCR4/NOT complex, CCR4-associated Factor family (ntl-3) [Caenorhabditis elegans]
  Gene Ontology: Mol. function=3'-5' exoribonuclease activity; Cellular component=cytoplasm; Biological process=regulation of transcription, DNA-dependent
  Coding regions on vcDNA: vcDNA=SeqID_95213; Strand=+; Position=184-552
MAEKRKLLNEIDKCYKKIDEGFEIFDDIMEKMNEANSDNQREKFQDDLKKEIKKLQRLRDQIKGWQNSSEIKDKDSLSKFRKLIEQRMEIFKDVERENKTKPHSKQGLSAEDKLDPREKEKCE

SEQ ID NO: 168791 - protein, 327 aa, Heterodera glycines
  Coding regions on vcDNA: vcDNA=SeqID_95214; Strand=+; Position=92-1072
MSSLTSFDWHPTISDRLALLPVQEKPMAFAHSIASTKRIAIIKLRDDVNSVIGPSGDFCISAGPQLNFENGEKLLAKPNCTSDIDTETLFKRRVLAGYGYGNSLNALATLLEYSKKAIERDQFASDDLRFCWDWLWMQFQSADANEIKKNYGTMFAGVKHILKGTKSNSTIKQDEITYRNRIFVNEKRLKILRMCNWPNCAVRDECKARFDEIAAQNGVFGITRAAALALFSVHGMLSKEYLTHLSEFTHSREFAETWCRSPSFVTNYQRMADTVLNILQKYDGVRVPNYESVCEGLTGDDYLLAIVKFLARRDKIYNRIYNEIFES

SEQ ID NO: 168792 - protein, 168 aa, Heterodera glycines
  Coding regions on vcDNA: vcDNA=SeqID_95215; Strand=+; Position=99-602
MDRSKTNKGRRERQSLADISQEVISQILRLFPFSSSSLRVHFSPFSSSLLFRAKSTSSVQQLKKQQNIPSQSLCRAVINDNANVQIMDRIRRVASNLSLTAKGQRERRQNLALLWGRGEAKKAKNGEQKERTKEEGALSKLCKMSVDTMAITALPLDCWLKERLKNWV

SEQ ID NO: 168793 - protein, 195 aa, Heterodera glycines
  Homolog annotation: Hit_ID=CAE59092.1; Match level="QueryCoverage =93%, HitCoverage=71%, E-value=2e-43, Identity=50%"; Hit description =Hypothetical protein CBG02384 [Caenorhabditis briggsae]
  Gene Ontology: Mol. function=calcium channel activity; Cellular component=integral to plasma membrane; Biological process=cation transport
  Coding regions on vcDNA: vcDNA=SeqID_95216; Strand=+; Position=51-635
MSSGIIEFAVARGLHVKCRETAVPYLRSSIRRFPVDEQRVPWNVPLVDYSPCDYTADSVHGKPWVFPSEPSRCKFNSMDDGVNRVSFHGSYNLDTDGRPLNPFGRTGLRGRGLFGRWGPNHAADAIVSRRLANGQLQFVAIERRDTGELALPGGMLNKGEPPTEAAVREFSEEAMGGHRREDKLGHFWKKGKTVY

SEQ ID NO: 168794 - protein, 98 aa, Heterodera glycines; identical to SEQ ID NO: 163171
  Coding regions on vcDNA: vcDNA=SeqID_95217; Strand=+; Position=2-298

SEQ ID NO: 168795 - protein, 176 aa, Heterodera glycines
  Coding regions on vcDNA: vcDNA=SeqID_95218; Strand=+; Position=1-528
GTPRQLSAFFGIAMAFPLLPFFFLFPLALVPLQRTAAVHPPLFNRIVPTSERTVNLTLTRDFGEAKAGNDESANNSNLTASPVEAKIHRLKELRNEMRALTAMIKEERRRSKSKDIRHRHRSIAEKMRTEISRQFRKWRKKVLSKIHLVMQRLDQLEGEMHRTKDNLQKVMHDNGR

SEQ ID NO: 168796 - protein, 154 aa, Heterodera glycines
  Coding regions on vcDNA: vcDNA=SeqID_95219; Strand=+; Position=13-474
MFYRRIFALFLCIFVILFTLQFLPVIDGMQFDVVQCGHSKRCEFGGCAPGKAQNAASCAYLFSMEPEGPDSVRMEMYTLRNVPDVKYVAVAFSDDTQMGDDAVTYCVLTGNGRVEARLSVNPANTKNNVPAPAGAENGFLELLEGKADDNGIYC

SEQ ID NO: 168797 - protein, 104 aa, Heterodera glycines
  Coding regions on vcDNA: vcDNA=SeqID_95220; Strand=+; Position=59-373
MLIETGHMYAQAARNNSEAARNNSVTAQESVRAMVNKDRLVADKELLLAQQKIELDEKDRLIATLRDTIQNKDQRIVYLEGYINGLGVPLPAPAEQQQQDGGGQ

SEQ ID NO: 168798 - protein, 154 aa, Heterodera glycines
  Homolog annotation: Hit_ID=NP_499157.1; Match level="QueryCoverage =100%, HitCoverage=18%, E-value=6e-33, Identity=47%"; Hit description= vps53-like, N-terminal (3K844) [Caenorhabditis elegans] emb|CAA81595.1| Hypothetical protein T05G5.8 [Ca
  Coding regions on vcDNA: vcDNA=SeqID_95221; Strand=+; Position=4-465
DFSDECALRIRSGEEKPQRETHATAIPLPSAANLFLLVKKIITESTKLFADPNAVLSKLVELFRQCLRQFAHGCLSAFLPQALPGVSPGAGGIIGASTSILQNLMRDDSVVRLDADQTFFTCCVLATADWSAETTMQLQDKLRQKIADGDFGQE

SEQ ID NO: 168799 - protein, 272 aa, Heterodera glycines
  misc_feature (184)..(184): Xaa can be any naturally occurring amino acid
  Homolog annotation: Hit_ID=NP_508395.1; Match level="QueryCoverage =84%, HitCoverage=58%, E-value=1e-20, Identity=32%"; Hit description =DumPY : shorter than wild-type DPY-3, collagen family member (29.6 kD) (dpy-3) [Caenorhabditis elegans] g
  Gene Ontology: Mol. function=ATP binding; Cellular component =intercellular junction; Biological process=cell-matrix adhesion
  Coding regions on vcDNA: vcDNA=SeqID_95222; Strand=+; Position=51-870
MPPTWALVPLLLLFFVHFIDVGFARRYKASTKYNPPAEETTTETTELTTPTECPAPVCPCECPTEETSETPPSTGGGGGTDDDIVTSPEGEETTTPVSGCVPGPPGPPGPPGPAGQKGPQGKCGDNASKRKREAAAVPKEFMTNLEPNVPVKRAKEGEAVAKTHFARGHVKGGCPPGPPGEPGXPGPPGPPGDPAPCPKHMKSEAQSVDGKQLANRNKRGETVLNAAKEGTEVKRQIVRHGIGPPGPAGPPGEAGEDGEPGPCECYKDQKSQ

SEQ ID NO: 168800 - protein, 206 aa, Heterodera glycines
  Coding regions on vcDNA: vcDNA=SeqID_95223; Strand=+; Position=28-648
IFVLLKMLSLAIRRFIVQHSNGTFMSTNFVATSSNFLLMDQENDKETKKDFRKIVKLLERSPTQKRKKEQEKAEENAKRDKREENGREEERTNWKEHISKSLHKSYDEYATRKSMESWKRRARRDTFCYMRDRNLPDLVTYTHRYIEGLTELNGKNNQRSFEDNELVVVVLKFVMNELLKGNNVQSARNERIEKTEMILIVINSEY

SEQ ID NO: 168801 - protein, 70 aa, Heterodera glycines
  Coding regions on vcDNA: vcDNA=SeqID_95224; Strand=-; Position=7-219
DCPVQSPTTNQQSTSTKLSTSPPPPPSPPSSASGRYPFGYLGQYAPLAALLNQFVQRSFHLFPARNLTEP

SEQ ID NO: 168802 - protein, 372 aa, Heterodera glycines
  Homolog annotation: Hit_ID=AAN15386.1; Match level="QueryCoverage =56%, HitCoverage=35%, E-value=6e-18, Identity=27%"; Hit description =unknown protein [Arabidopsis thaliana] gb|AAF79711.1| T1N15.19 [Arabidopsis thaliana] gb|AAL38346.1| unkno
  Coding regions on vcDNA: vcDNA=SeqID_95225; Strand=+; Position=3-1118
MPLPIRFFVLKICQQNGRNGKFVSLLTAALHRELSPPHFRRFFASTTSASSDDGFVVEKVENGNAKNYESIDGAWKCTNCAHLNWPQQRICKHCTIGIPTEAQMAILKQLLWVCPNCTARNTGDHCGNCALARCSVYKGFWVCSRCTWRNIPVNFSCRKCKKGKQTEEQRQLIQQQRWVCGECKHHNFKEECFSCGAPESKRLPDGVGGESLPDGSWYCVGCGFLNFPNYSKCRHCRREEPTDEQLGVIHSSRWQCAECHFDNYESNLTCHHCDAPRPTEGQLPATSDCQYWVCSSCLWRNFPTHLSCQKCIKGRAPEENRQQIQQLRWVCGICRHHNFKEDCFKCGAPKSKGFSCGIGGESLDDGSWYCVS

SEQ ID NO: 168803 - protein, 204 aa, Heterodera glycines
  Homolog annotation: Hit_ID=CAE72242.1; Match level="QueryCoverage =44%, HitCoverage=29%, E-value=6e-28, Identity=68%"; Hit description =Hypothetical protein CBG19360 [Caenorhabditis briggsae]
  Gene Ontology: Mol. function=transcription co-repressor activity; Cellular component=nucleus; Biological process=negative regulation of transcription from Pol II promoter
  Coding regions on vcDNA: vcDNA=SeqID_95226; Strand=+; Position=25-639
MMKSSADAEQFGRLSFSINSLFSTQEVASSSSASDPTTQLIISSLNSVRKTNEGTVENATKKTDNKELSTDEDEQQNVASTSTPEDGEFSKISRIRKRRYSQARIQPTRVKKVMQSDEDIGRMVASVPVAIGSAMEVFAEKLLLAAAESVQHSSTKTLSPMHIKMAVSRVPQFSFLEPMLRDVPMNPKMAPSFGQQSSSTSNGE

SEQ ID NO: 168804 - protein, 384 aa, Heterodera glycines; identical to SEQ ID NO: 162746
  Homolog annotation: Hit_ID=NP_082253.1; Match level="QueryCoverage =97%, HitCoverage=88%, E-value=4e-56, Identity=37%"; Hit description =RIKEN cDNA 2310001A20 [Mus musculus] gb|AAH55706.1| RIKEN cDNA 2310001A20 [Mus musculus] sp|Q9D7N9|APMA_M
  Coding regions on vcDNA: vcDNA=SeqID_95227; Strand=+; Position=6-1160

SEQ ID NO: 168805 - protein, 148 aa, Heterodera glycines; identical to SEQ ID NO: 162278
  Homolog annotation: Hit_ID=NP_741446.1; Match level="QueryCoverage =93%, HitCoverage=78%, E-value=2e-41, Identity=62%"; Hit description =serine/aRginine rich pre-mRNA SPlicing factor, Serpin (20.5 kD) (rsp- 6) [Caenorhabditis elegans] gb|AAA82
  Gene Ontology: Mol. function=RNA binding; Cellular component=nuclear speck; Biological process=response to cold
  Coding regions on vcDNA: vcDNA=SeqID_95228; Strand=+; Position=31-477

SEQ ID NO: 168806 - protein, 155 aa, Heterodera glycines
  Coding regions on vcDNA: vcDNA=SeqID_95229; Strand=+; Position=33-497
FPTHSLRSEMPTTVVRTTTTRTTGGGVHHHSIRMVPIWSIKLITAVLALLMLILIFFLHTAIWQYYVVTFIVLVLTCGFLLGWALPPVLNRFLTFYRSDQISYSIIAGLTILSLILCAAYLIHNDYYKHGDNYKIMVGVTICMTVETLMCCVLLS

SEQ ID NO: 168807 - protein, 114 aa, Heterodera glycines; identical to SEQ ID NO: 164063
  Homolog annotation: Hit_ID=NP_498300.2; Match level="QueryCoverage =94%, HitCoverage=95%, E-value=4e-49, Identity=78%"; Hit description =LIM protein (12.2 kD) (3H62) [Caenorhabditis elegans] gb|AAM97945.1| Mlp/crp family (muscle lim protein/c
  Gene Ontology: Cellular component=nucleus; Biological process =myogenesis
  Coding regions on vcDNA: vcDNA=SeqID_95230; Strand=+; Position=42-386

SEQ ID NO: 168808 - protein, 160 aa, Heterodera glycines
  Homolog annotation: Hit_ID=NP_496366.1; Match level="QueryCoverage =91%, HitCoverage=71%, E-value=2e-14, Identity=35%"; Hit description =C.Elegans Y-box (21.3 kD) (cey-1) [Caenorhabditis elegans] emb|CAB04257.1| Hypothetical protein F33A8.3 [
  Gene Ontology: Mol. function=transcription co-repressor activity; Cellular component=perinuclear space; Biological process=negative regulation of transcription from Pol II promoter
  Coding regions on vcDNA: vcDNA=SeqID_95231; Strand=+; Position=1-483
KQNKKSEVVAANEKKQIKKSEVDFPVVLKRGVQGRVKWYSPEDAYGFIHRYDVDEDIFVHGSSIVRFNIRNKNQHPVLSIQQEVEFDVIKVRKGLEARCVSGPGGRLVGRFFNIPRRSVSGAKNQKHAVNGGLRSIRRRSDGEAIREGEGTRGLQQKGSG

SEQ ID NO: 168809 - protein, 136 aa, Heterodera glycines; identical to SEQ ID NO: 143562
  Homolog annotation: Hit_ID=NP_490905.1; Match level="QueryCoverage =100%, HitCoverage=100%, E-value=1e-45, Identity=64%"; Hit description=ribosomal Protein, Large subunit (15.7 kD) (rpl-27) [Caenorhabditis elegans] gb|AAK68266.1| Ribosomal p
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_95232; Strand=+; Position=22-432

SEQ ID NO: 168810 - protein, 195 aa, Heterodera glycines
  Homolog annotation: Hit_ID=CAE57511.1; Match level="QueryCoverage =83%, HitCoverage=91%, E-value=1e-38, Identity=49%"; Hit description =Hypothetical protein CBG00486 [Caenorhabditis briggsae]
  Gene Ontology: Cellular component=cytoplasm; Biological process =synaptic transmission
  Coding regions on vcDNA: vcDNA=SeqID_95233; Strand=+; Position=21-608
MSQSPQMATFSGLTANIYHEKQKRQLCLLHTLNNLFQREEFVRDELDEICERLDDSKWFNTHRSWLGLGNYDANILLCALKTRGLVGRWFDKRMPASWIRKEVIVAYIFNIPSTGFMPLPFLNGRHWFTIKQFGPTYYNLDSKLAAPTLISTANGIVHYINSLLAQGNELLLVVRPENEANCLLANGEAEHGGGE

SEQ ID NO: 168811 - protein, 216 aa, Heterodera glycines
  Homolog annotation: Hit_ID=NP_490770.1; Match level="QueryCoverage =99%, HitCoverage=95%, E-value=3e-60, Identity=53%"; Hit description =phosphoglycerate/bisphosphoglycerate mutase (24.9 kD) (1B166) [Caenorhabditis elegans] gb|AAK21514.2| Hyp
  Coding regions on vcDNA: vcDNA=SeqID_95234; Strand=+; Position=29-676
MVKTLWIVRHAEREDNINSNWQKNANPQKLKSDNSPLSSRGIKQATELAERFSNVQIDHIFASPFERTVQTATFLISQRKIPIKVEPGLAEALYLCESPPGFEESAELRRRFPLVDSEYRSIYEKPMPREGFGDESCIQRIRQTLEEILRRYNEATSIVFVSHGSPIGALHEVLVGDWNYVGQATVSKFVETGDGTGKFRQEFTSDSSHLSDKENL

SEQ ID NO: 168812 - protein, 197 aa, Heterodera glycines
  misc_feature (163)..(163): Xaa can be any naturally occurring amino acid
  misc_feature (177)..(177): Xaa can be any naturally occurring amino acid
  Homolog annotation: Hit_ID=AAP06491.1; Match level="QueryCoverage =100%, HitCoverage=70%, E-value=4e-43, Identity=47%"; Hit description= similar to probable hydroxyacylglutathione hydrolase (Glyoxalase II GLO2_SCHMA [Schistosoma japonicum]
  Gene Ontology: Mol. function=hydroxyacylglutathione hydrolase activity; Cellular component=mitochondrial matrix; Biological process=sulfur metabolism
  Coding regions on vcDNA: vcDNA=SeqID_95235; Strand=+; Position=70-659
MRVVPIPANTDNYMYLIIDDDDKYQKGHRPAALVDPVNVEKCFEVVKTEGTLLEAALVTHHHWDHAGGTYQLAIKSRSGFSDLLMKQPLCIISGDAERVERTEKVIADGESVQLGTNLSVTAMYTPCHTSTHVCYYVVDQRTNERAVFTGDTLFIGGCGRFFXEGTAEQMHHALNEXLAALPDETLVYCGHEYTVAN

SEQ ID NO: 168813 - protein, 106 aa, Heterodera glycines; identical to SEQ ID NO: 162945
  Homolog annotation: Hit_ID=NP_496375.1; Match level="QueryCoverage =100%, HitCoverage=100%, E-value=1e-50, Identity=90%"; Hit description=60S ribosomal protein L44 (12.4 kD) (2L388) [Caenorhabditis elegans] emb|CAA90434.1| Hypothetical prote
  Gene Ontology: Cellular component=cytosolic ribosome (sensu Eukarya); Biological process=protein biosynthesis
  Coding regions on vcDNA: vcDNA=SeqID_95236; Strand=+; Position=39-359

SEQ ID NO: 168814 - protein, 244 aa, Heterodera glycines; identical to SEQ ID NO: 163546
  Homolog annotation: Hit_ID=NP_502575.1; Match level="QueryCoverage =95%, HitCoverage=99%, E-value=1e-85, Identity=67%"; Hit description =putative protein of eukaryotic origin (26.5 kD) (4O146) [Caenorhabditis elegans] emb|CAB60598.1| Hypothet
  Gene Ontology: Cellular component=membrane
  Coding regions on vcDNA: vcDNA=SeqID_95237; Strand=+; Position=25-759

SEQ ID NO: 168815 - protein, 170 aa, Heterodera glycines
  Homolog annotation: Hit_ID=NP_493387.1; Match level="QueryCoverage =100%, HitCoverage=65%, E-value=4e-74, Identity=79%"; Hit description= protein YR-29 (29.7 kD) (1O220) [Caenorhabditis elegans] emb|CAB04941.1| Hypothetical protein W09C5.1 [C
  Gene Ontology: Cellular component=nucleus; Biological process=protein biosynthesis
  Coding regions on vcDNA: vcDNA=SeqID_95238; Strand=+; Position=32-541
MPQNEHIELHRKRHGRKLDHEERTRKKLARAVHDRSKVAKKLRKGKAKLYHKKRYAEKVQMRKLIKQHEEKKQKGTTDTQTEGAVPAYLLDRQKETAGKALSTAIKQKRKEKAAKYQVPLPKVRAVSDAEAFKVVNTGKTRRKGWKRMVTKVTFVGETFTRKPAKFERFI

SEQ ID NO: 168816 - protein, 167 aa, Heterodera glycines
  Homolog annotation: Hit_ID=CAE66170.1; Match level="QueryCoverage =97%, HitCoverage=28%, E-value=1e-59, Identity=68%"; Hit description =Hypothetical protein CBG11408 [Caenorhabditis briggsae]
  Gene Ontology: Mol. function=RNA helicase activity; Cellular component=nucleus; Biological process=cell growth
  Coding regions on vcDNA: vcDNA=SeqID_95239; Strand=+; Position=2-502
PIVHLLSVHYHIPTTIQSISWPVALSGRDLISIAKTGSGKTLGFILPAIVHTMAQPPRRPNDGPGVLVLLPTRELAVQVEQVAREYCKLMKLDVTCCYGGAPKAGQANDLRRGVDICVATPGRILDFMEANTTNMRRCTFLVLDEADRMLDMGFEPQIRKIVGQIRP

SEQ ID NO: 168817 - protein, 139 aa, Heterodera glycines; identical to SEQ ID NO: 163146
  Homolog annotation: Hit_ID=NP_508777.1; Match level="QueryCoverage =83%, HitCoverage=26%, E-value=1e-41, Identity=69%"; Hit description =target of (48.5 kD) (XF138) [Caenorhabditis elegans] gb|AAK39154.1| Hypothetical protein C07A12.7a [Caeno
  Gene Ontology: Cellular component=endosome; Biological process =endosome transport
  Coding regions on vcDNA: vcDNA=SeqID_95240; Strand=+; Position=65-481

SEQ ID NO: 168818 - protein, 158 aa, Heterodera glycines
  misc_feature (107)..(107): Xaa can be any naturally occurring amino acid
  Homolog annotation: Hit_ID=NP_501491.2; Match level="QueryCoverage =93%, HitCoverage=17%, E-value=8e-33, Identity=45%"; Hit description =heparan SulphoTransferase, N-deacetylase N-sulfotransferase (99.1 kD) (hst-1) [Caenorhabditis elegans] db
  Gene Ontology: Mol. function=heparin N-deacetylase/N-sulfotransferase activity; Cellular component=integral to membrane; Biological process= protein amino acid sulfation
  Coding regions on vcDNA: vcDNA=SeqID_95241; Strand=+; Position=16-488
MFGAKPNQHWLVRVALLDAVTFLAPAIHDDDLERFVQIDIDDVFIGAIGSRMVADDVDYLSILQGKLREHIADFHFTLGFSGNFFRHGDPAEIQGDEILAMRTNSTXFPHMWRHNHPPEFSADYLLALMTQNRVFAENVGISANLSYAVSPQHSGVYP

SEQ ID NO: 168819 - protein, 140 aa, Heterodera glycines
  Homolog annotation: Hit_ID=XP_314784.1; Match level="QueryCoverage =97%, HitCoverage=29%, E-value=7e-30, Identity=46%"; Hit description =ENSANGP00000014187 [Anopheles gambiae]
  Gene Ontology: Mol. function=protein binding; Cellular component =SWI/SNF complex; Biological process=signal transduction
  Coding regions on vcDNA: vcDNA=SeqID_95242; Strand=+; Position=74-493
MSGGIYGGDDVGALVFDPGSHSFRVGYGGEEFPRFDIPARVGVCPRPSAGTDASQTADATIEEVASGRGANASNKFDHYIGTTKLNVPRAGMEVKPYMREGMVEDWELFEKMLDYIYGPCLGAESREHGVLFTEPPWNPK

SEQ ID NO: 168820 - protein, 197 aa, Heterodera glycines
  Homolog annotation: Hit_ID=CAE72119.1; Match level="QueryCoverage =98%, HitCoverage=54%, E-value=2e-28, Identity=34%"; Hit description =Hypothetical protein CBG19214 [Caenorhabditis briggsae]
  Coding regions on vcDNA: vcDNA=SeqID_95243; Strand=+; Position=3-593
RPICDAKTGNYQPQQCRDEKHCFCVNYLTGVRQNKKEVPTNEILHCEGGQVDFSIDDSHIIKSEKGEGEKGDEELIPIGSPVCKKPRDAGHRCHGRAGGPIAAKNLKWYFDTETFECLAFSYNGCGGNGNHFDSPADCWDKCKLVDLAGCAGMRLPATDKQGHTIICAGAGYPSPTAACPSGYRCTMLAHMGVCCHS

SEQ ID NO: 168821 - protein, 71 aa, Heterodera glycines; identical to SEQ ID NO: 166678
  Coding regions on vcDNA: vcDNA=SeqID_95244; Strand=-; Position=1-213

SEQ ID NO: 168822 - protein, 172 aa, Heterodera glycines
  Homolog annotation: Hit_ID=NP_492323.1; Match level="QueryCoverage =90%, HitCoverage=91%, E-value=6e-27, Identity=40%"; Hit description =putative protein, with at least 2 transmembrane domains, of bilaterial origin (19.0 kD) (1J169) [Caenorha
  Coding regions on vcDNA: vcDNA=SeqID_95245; Strand=+; Position=3-521
MNQQKSAKRATRGQRQIYEENKQTLLCYVLASICSSVLVFSLNYFLFLPQKGAWIGLALSSASQAFSVILMSMMMKTVRNERNQLVDAGLDLNDPNAFGEYCKDIVILSVSAQLLSLIWTGFFFVLLSIPFFTLYKLWTNILGPWFFRPTLDDDEKEDKKKQKKPKFVHVRR

SEQ ID NO: 168823 - protein, 146 aa, Heterodera glycines
  Homolog annotation: Hit_ID=NP_496483.1; Match level="QueryCoverage =85%, HitCoverage=36%, E-value=2e-35, Identity=58%"; Hit description =ribokinase (2L903) [Caenorhabditis elegans] emb|CAA91318.1| Hypothetical protein F07A11.5 [Caenorhabditis
  Gene Ontology: Biological process=carbohydrate metabolism
  Coding regions on vcDNA: vcDNA=SeqID_95246; Strand=+; Position=39-476
MTSTSPPLTNGVANHLSENGSATSPELIVFGSIVQDLVSYVDRFPKPGESVRGHTFKTFCGGKGANQAVMASRMGTRVTMVGMVGDDLFAAENVRSIAQNGVDVSLVKQLSGQTTGTATITVSGDGENCIVVTLGANTSLGAECAL

SEQ ID NO: 168824 - protein, 201 aa, Heterodera glycines
  Homolog annotation: Hit_ID=NP_001002546.1; Match level="QueryCoverage= 99%, HitCoverage=78%, E-value=5e-33, Identity=42%"; Hit description =VAMP (vesicle-associated membrane protein)-associated protein A, like [Danio rerio] gb|AAH76262.1| VAM
  Gene Ontology: Cellular component=integral to membrane; Biological process=nonselective vesicle transport
  Coding regions on vcDNA: vcDNA=SeqID_95247; Strand=+; Position=25-627
MTKPQQVLVLDPNNELSFKGPFTEYVNANLTLSNPSRKDVYFKVKTTAPKFYCVRPNSGVIKANDKTQINVMLQPVESPETLESERSRHKFMIQTAFAPDDEQLPVDQFWKTVDPTLVMDSKLRVVFQRPFGFGDENNRDETNATGPFFNFNKTGEPKNEQPTQTPKSTEANSGDIQLALQREVELRMMYQDENKNLEKEN

SEQ ID NO: 168825 - protein, 195 aa, Heterodera glycines; identical to SEQ ID NO: 162806
  Homolog annotation: Hit_ID=NP_510363.1; Match level="QueryCoverage =96%, HitCoverage=72%, E-value=2e-29, Identity=35%"; Hit description =androgen induced protein like (XO797) [Caenorhabditis elegans] emb|CAB02823.1| Hypothetical protein C37E2
  Coding regions on vcDNA: vcDNA=SeqID_95248; Strand=+; Position=12-596

SEQ ID NO: 168826 - protein, 163 aa, Heterodera glycines
  Homolog annotation: Hit_ID=EAL31954.1; Match level="QueryCoverage =66%, HitCoverage=37%, E-value=1e-11, Identity=33%"; Hit description =GA10756-PA [Drosophila pseudoobscura]
  Coding regions on vcDNA: vcDNA=SeqID_95249; Strand=+; Position=1-489
PFRFVLSIRIGAALPHSFCSFSDAFPSSGDRILIRRENFNRNRPRLLKRNEKSLLAENRQGIPTATDCATLVLFCQLGSPSAEESWVLFTQRAKRMKHHANEISFPGGRIEQGESVETAAIREAEEEIGLDRNDVELWGTLRPLFFGEAGVVTPVVATIGQNV

SEQ ID NO: 168827 - protein, 154 aa, Heterodera glycines
  Homolog annotation: Hit_ID=XP_319632.1; Match level="QueryCoverage =99%, HitCoverage=28%, E-value=2e-48, Identity=59%"; Hit description =ENSANGP00000013881 [Anopheles gambiae] gb|EAL38961.1| ENSANGP00000028136 [Anopheles gambiae str. PEST]
  Gene Ontology: Mol. function=Pol II transcription elongation factor activity; Cellular component=transcription elongation factor complex; Biological process=RNA elongation from Pol II promoter
  Coding regions on vcDNA: vcDNA=SeqID_95250; Strand=+; Position=2-463
VAPSAMRQQHGPGQKRVSRVPIIIIPAGASSLITIYNAQEILQDLRYVSTEEKKQFSSKRENELLLQIPKNGVTVPYRVVDNPTRLKDEEWDRVVAVFVQGPAWQFKNWKWNGNPVEIFANIAAFHLQFDELPTDPNVKKWSVHVLKLSCTKRH

SEQ ID NO: 168828 - protein, 177 aa, Heterodera glycines
  Coding regions on vcDNA: vcDNA=SeqID_95251; Strand=+; Position=23-553
MRLNVLLAILAPLLLLIATATLCGATGKEAAANKIGVAAVALSEADNSTTPAPPPPPSPGGSDDKKKDDDDIKPDEDPAKKGQRNGHGRRRQKNGRSGRSIWRGVHFCCHSFRHGFDVRTDQNVCPLGEAARVGTHRTIRCIEKTWKALGQNKQRFPYFICCCFLHHFYHFSLKFLL

SEQ ID NO: 168829 - protein, 222 aa, Heterodera glycines
  Homolog annotation: Hit_ID=NP_498620.1; Match level="QueryCoverage =98%, HitCoverage=96%, E-value=2e-74, Identity=59%"; Hit description=- related (24.4 kD) (3I436) [Caenorhabditis elegans] gb|AAK68310.1| Hypothetical protein F08F8.7 [Caenorha
  Gene Ontology: Mol. function=ribulose-phosphate 3-epimerase activity; Cellular component=cytosol; Biological process=pentose-phosphate shunt
  Coding regions on vcDNA: vcDNA=SeqID_95252; Strand=+; Position=7-672
MASKIKPLICPSILNTDLSDLANECRKLMAAGADYLHLDIMDGHFVPNLTFGHPLIECLRNKLGNDAKLDVHMMVSNPSKWLDPLHKAGIDQFTFHWEALGEDEAVDTLIDRVKSKGIRCGLSIKPMTPLDKLMKFCEKIDTALIMTVEPGFGGQKFMQDQMEKVRQLRKAYPNLDIQVDGGVGLDNIEHCANAGANMIVSGTGIVRSADPRQTMPKMKETV

SEQ ID NO: 168830 - protein, 183 aa, Heterodera glycines
  Homolog annotation: Hit_ID=AAH74544.1; Match level="QueryCoverage =80%, HitCoverage=32%, E-value=5e-10, Identity=28%"; Hit description =LOC447984 protein [Xenopus tropicalis]
  Coding regions on vcDNA: vcDNA=SeqID_95253; Strand=+; Position=28-576
MKLPISSNKFNKYELYKFRHATMAIVENIGFSTSNSSAVSSLSFLLRTYFEQLCRDSLNSAINSGRAEVGLEDVSYVFGANGINITELHDYIQQVQPYAADEHPLFPVTEPLNVPPPSSEIADTSEQKNGERESAGNDGAEVDEEGNREQNNKHSLNSFNSRSVISMIFKMINIFQKVQCSKC

SEQ ID NO: 168831 - protein, 76 aa, Heterodera glycines
  Homolog annotation: Hit_ID=NP_498689.1; Match level="QueryCoverage =73%, HitCoverage=21%, E-value=8e-10, Identity=55%"; Hit description =metaxin 2 (3I852) [Caenorhabditis elegans] gb|AAA28180.2| Hypothetical protein ZC97.1a [Caenorhabditis el
  Coding regions on vcDNA: vcDNA=SeqID_95254; Strand=+; Position=11-238
GIRNLQFRIFNRFFHLNAQFTPFLNPLEEQALMYQYADTLAVRAFLMMADLSFVLEQRPNAEFMSPTGEVPFLRLQ

SEQ ID NO: 168832 - protein, 184 aa, Heterodera glycines
  Homolog annotation: Hit_ID=NP_741412.1; Match level="QueryCoverage =97%, HitCoverage=96%, E-value=4e-63, Identity=63%"; Hit description =MCT-1 protein-like (20.8 kD) (4G918) [Caenorhabditis elegans] gb|AAM81123.1| Hypothetical protein C11D2.7
  Gene Ontology: Mol. function=RNA binding; Biological process =regulation of cell cycle
  Coding regions on vcDNA: vcDNA=SeqID_95255; Strand=+; Position=18-572
MFKKFDSAEDVVGSQQLKGSVQKSIRAKLVEQYPSIEPYMDAILPKKENFKLVKCKDHLELIADANGTVHFVKSRDLANYFPTLRLLHKYPFMLPHQQVDKGAIKFVLNGSHIMCPGLTSAGGRLLDDCNEGALVAIMAEGKQHAMGIGQMKLSSANVRSQNVGIAIDNVHFMNDGLWRLTTVQ

SEQ ID NO: 168833 - protein, 165 aa, Heterodera glycines; identical to SEQ ID NO: 163782
  Homolog annotation: Hit_ID=NP_741446.1; Match level="QueryCoverage =84%, HitCoverage=93%, E-value=4e-44, Identity=62%"; Hit description =serine/aRginine rich pre-mRNA SPlicing factor, Serpin (20.5 kD) (rsp- 6) [Caenorhabditis elegans] gb|AAA82
  Gene Ontology: Mol. function=pre-mRNA splicing factor activity; Cellular component=nucleus; Biological process=spliceosome assembly
  Coding regions on vcDNA: vcDNA=SeqID_95256; Strand=+; Position=6-500

SEQ ID NO: 168834 - protein, 247 aa, Heterodera glycines; identical to SEQ ID NO: 163963
  Homolog annotation: Hit_ID=CAE63635.1; Match level="QueryCoverage =33%, HitCoverage=44%, E-value=7e-10, Identity=40%"; Hit description =Hypothetical protein CBG08131 [Caenorhabditis briggsae]
  Coding regions on vcDNA: vcDNA=SeqID_95257; Strand=+; Position=55-795

SEQ ID NO: 168835 - protein, 252 aa, Heterodera glycines
  Homolog annotation: Hit_ID=NP_499991.1; Match level="QueryCoverage =64%, HitCoverage=76%, E-value=1e-32, Identity=43%"; Hit description =putative membrane protein of fungal and metazoan origin (4B548) [Caenorhabditis elegans] gb|AAK29831.1| H
  Coding regions on vcDNA: vcDNA=SeqID_95258; Strand=+; Position=6-761
MSVGVLFRLTIRPSPAGLRLTCFLATNYHHNLHQFNNNCLVRRHFSCTSRLLLATTTDNKGDAASAKQQQFAKIELKPKTGSDGAVAEPERTYLEEMLIERDAEPKTAGQKVKRAVETTFYISFGLISCAVLGVMTYLVFKEFFAFNTPQGVYRDAVKRVKADERCREMFGKRIMTFGEESGRGRRRHILHNKYVKDGQERLSVMFHVKGDAGIGKTYAEIYKGEDGKWDYRFVLVESDGFPKKAIFLIDNR

SEQ ID NO: 168836 - protein, 158 aa, Heterodera glycines
  Homolog annotation: Hit_ID=CAE64122.1; Match level="QueryCoverage =93%, HitCoverage=26%, E-value=8e-41, Identity=56%"; Hit description =Hypothetical protein CBG08738 [Caenorhabditis briggsae]
  Gene Ontology: Mol. function=ATP binding; Biological process=protein amino acid phosphorylation
  Coding regions on vcDNA: vcDNA=SeqID_95259; Strand=+; Position=2-475
STPILKSVRSSGGGSPCSTNLSVAEGSKNGGGSSGSANAQQGTNGSGNNLFIALFDYNARTDDDLNFKKGEALEILNDFQGDWWYAKSLISGKCGFIPSNYVARESSIDAQPWYFGKLRRIDAEKLLMLGVNEHGAFLVRDSESRHNEFSLSVRDGEV

SEQ ID NO: 168837 - protein, 220 aa, Heterodera glycines; identical to SEQ ID NO: 163535
  Homolog annotation: Hit_ID=ZP_00195689.2; Match level="QueryCoverage =97%, HitCoverage=95%, E-value=1e-66, Identity=58%"; Hit description =COG1926: Predicted phosphoribosyltransferases [Mesorhizobium sp. BNC1]
  Coding regions on vcDNA: vcDNA=SeqID_95260; Strand=+; Position=14-673

SEQ ID NO: 168838 - protein, 144 aa, Heterodera glycines
  Coding regions on vcDNA: vcDNA=SeqID_95261; Strand=+; Position=35-469
MGKVSKTKSAKKSAGGSGNKTVIWAVEDIVDGPKYETIGTKRQKLYKVRWGETYELASNIPPGLIDLYEKREKKQIKILGPLVTSESSTSEGSLSPKERIPLHQTKFAIEIGGKVKCLSYSEVRNTYKEELLQYFEERAKIDEE

SEQ ID NO: 168839 - protein, 185 aa, Heterodera glycines
  Homolog annotation: Hit_ID=NP_494439.1; Match level="QueryCoverage =73%, HitCoverage=45%, E-value=5e-29, Identity=48%"; Hit description =putative protein, with at least 4 transmembrane domains, of eukaryotic origin (2D354) [Caenorhabditis ele
  Coding regions on vcDNA: vcDNA=SeqID_95262; Strand=+; Position=38-592
MDRLEFRDFPSSGGGASSEFFNSDSVNNKPPPDPAFPSGNLLDVSSSSESQRDDSSKVHFLSLSFYRRFFDIDEEQVFARLLNSAMPRRTGNFISDFVQPNPDLRGPFWVSVSLVFSIAIVGNLSRFLHTFGSDELFISDFSFVTGATSLVFGYVLTMPSLVYAFLWYHRPLNLQYSFLQFAVCL

SEQ ID NO: 168840 - protein, 127 aa, Heterodera glycines; identical to SEQ ID NO: 162396
  Homolog annotation: Hit_ID=CAE67247.1; Match level="QueryCoverage =71%, HitCoverage=21%, E-value=1e-14, Identity=43%"; Hit description =Hypothetical protein CBG12687 [Caenorhabditis briggsae]
  Gene Ontology: Cellular component=centrosome; Biological process =protein modification
  Coding regions on vcDNA: vcDNA=SeqID_95263; Strand=+; Position=195-575

SEQ ID NO: 168841 - protein, 115 aa, Heterodera glycines; identical to SEQ ID NO: 164043
  Homolog annotation: Hit_ID=NP_013086.1; Match level="QueryCoverage =81%, HitCoverage=6%, E-value=1e-29, Identity=65%"; Hit description =ABC type transmembrane transporter of MRP/CFTR family, found in vacuolar membrane, involved in the transpo
  Gene Ontology: Mol. function=bilirubin transporter activity; Cellular component=mitochondrion; Biological process=bilirubin transport
  Coding regions on vcDNA: vcDNA=SeqID_95264; Strand=+; Position=26-373

SEQ ID NO: 168842 - protein, 184 aa, Heterodera glycines; identical to SEQ ID NO: 161532
  Coding regions on vcDNA: vcDNA=SeqID_95265; Strand=+; Position=96-650

SEQ ID NO: 168843 - protein, 118 aa, Heterodera glycines; identical to SEQ ID NO: 163719
  Coding regions on vcDNA: vcDNA=SeqID_95266; Strand=+; Position=104-460

SEQ ID NO: 168844 - protein, 50 aa, Heterodera glycines; identical to SEQ ID NO: 154146
  Coding regions on vcDNA: vcDNA=SeqID_95267; Strand=+; Position=25-177

SEQ ID NO: 168845 - protein, 276 aa, Heterodera glycines
  Homolog annotation: Hit_ID=NP_510032.1; Match level="QueryCoverage =98%, HitCoverage=97%, E-value=1e-102, Identity=67%"; Hit description= reductase (29.2 kD) (XM767) [Caenorhabditis elegans] emb|CAA91943.1| Hypothetical protein M153.1 [Caenor
  Gene Ontology: Mol. function=pyrroline 5-carboxylate reductase activity; Cellular component=cytoplasm; Biological process=proline biosynthesis
  Coding regions on vcDNA: vcDNA=SeqID_95268; Strand=+; Position=35-862
MLSETVKIGFIGAGKMAQALARGLINSGRYPAENLMASCPKTDESLLEQCKKLGIGTTSDNTRIARENDVIILAVKPMNISKVTSEIAPNFRREHLLISIALGITLRYIEQLLPSKSRVVRVMPNTPAVVGAGASAYSMGSACQDGDSKVVQDLFSTVGYSVEVPEIHLDPITGLSGSGPSYGFSMIEGLADGGVKMGLPRELSLKLAAMSLYGAAKMFLETGEHPGVLKEAVQSPGGSTSVEIPELEKGGMRGLLINAVEAASERSRRTGEAALP

SEQ ID NO: 168846 - protein, 171 aa, Heterodera glycines
  Homolog annotation: Hit_ID=CAE71585.1; Match level="QueryCoverage =91%, HitCoverage=29%, E-value=2e-14, Identity=36%"; Hit description =Hypothetical protein CBG18542 [Caenorhabditis briggsae]
  Coding regions on vcDNA: vcDNA=SeqID_95269; Strand=+; Position=144-656
MNSAEMASPSIDIGLLVLRGNEELIRQKLKRLLAITMPKVRQKLYVHLEQMDVIRALLPAIYINAASIAPKIDLRVLLNRTTSVPVDRVFYDEVKDPSHPIFPMLREENGPTFKMDSFATSHHKLPEKPYDHVVLGGTFDRLHNGHKLLLSEAAMMARTRITCGVTDGKMN

SEQ ID NO: 168847 - protein, 151 aa, Heterodera glycines
  Homolog annotation: Hit_ID=EAL04505.1; Match level="QueryCoverage =100%, HitCoverage=58%, E-value=3e-47, Identity=63%"; Hit description= likely cytosolic ribosomal protein L8 [Candida albicans SC5314] gb|EAL04350.1| likely cytosolic ribosomal
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_95270; Strand=+; Position=36-488
MAPKGKKIAAAPFKTAAKAGAVKDPRFEKATRNFGIGNAVQPKRDLTRYTKWPEYVRLQRQRAILKRRLKVPPAINQFSRVVDKNVASQLFKLLNKIRPETKQEKKQRLKAIAEAKAAGKTVEAGKKPVVVKYGINHVTALIEAKKAKLVV

SEQ ID NO: 168848 - protein, 288 aa, Heterodera glycines
  Homolog annotation: Hit_ID=AAA80437.6; Match level="QueryCoverage =85%, HitCoverage=81%, E-value=4e-51, Identity=41%"; Hit description =Carbonic anhydrase protein 5 [Caenorhabditis elegans] sp|Q10462|CAH5_ CAEEL Putative carbonic anhydrase 5 p
  Gene Ontology: Mol. function=carbonate dehydratase activity; Cellular component=membrane; Biological process=one-carbon compound metabolism
  Coding regions on vcDNA: vcDNA=SeqID_95271; Strand=+; Position=22-888
MVNFFVIFVPFLLLIVSNQLKAEETEENRHKTEETWNYEEPEEWGGKCQKGDRQSPIDIHKQWFIDYKIPAISFANYEKNGTVTMKNNGHTVVVSGFDTWEKQPNIADGGFGSKYMLSQFHFHWSQNENGSEHTVDGEHYDAELHLVHVKEGLSLSEALALSDGVAVLGIFFKRAYVGSALLALQNGLSQVTNKDDSVTIEHYEPNDLLPTASEVFFRYNGSLTTPDCNEAVIWTVFAVPKSISREQIQLLRAINGHDGKPISSNIRPVQKFSRKVQKFGYNKVSILP

SEQ ID NO: 168849 - protein, 155 aa, Heterodera glycines
  Homolog annotation: Hit_ID=NP_490690.1; Match level="QueryCoverage =100%, HitCoverage=88%, E-value=6e-37, Identity=47%"; Hit description= growth factor (1A656) [Caenorhabditis elegans] gb|AAB97554.1| Hypothetical protein F56C11.3 [Caenorhabdi
  Gene Ontology: Mol. function=thiol oxidase activity; Cellular component=mitochondrial intermembrane space; Biological process=iron ion homeostasis
  Coding regions on vcDNA: vcDNA=SeqID_95272; Strand=+; Position=9-473
MDFGPRDDEGKPCKACFSFEDMLRMMGKKKTADRRNGEAQNKTAGDEPSTSSSPSADRRRTDCPLDKDELGRSTWNLMHSMSVYYPKEPTEQQKTAMGQTIDGISKTYPCDHCAADFRADLRAHPPLLNSRDAFARWMCEAHNRVNVKLGKERFD

SEQ ID NO: 168850 - protein, 55 aa, Heterodera glycines
  Coding regions on vcDNA: vcDNA=SeqID_95273; Strand=+; Position=48-215
IADFRLCFDRTIILTGLTWPRKIAQKWWTSWLQLLFATICQRMPFYWLLGCAMCL

SEQ ID NO: 168851 - protein, 210 aa, Heterodera glycines
  Coding regions on vcDNA: vcDNA=SeqID_95274; Strand=+; Position=1-630
SSCPSGHQQQMNACQKLKRPTPPITTYSSVGPERDCPLRKDRAEPNWTETDEAICDDSDLIGIMQRQYVNLPHSTQKAARRTNAVRQRMVADATESSDCSSDVTTPNGAIMEELASLATEGDGAAMARENGSEKSTSSSRTGVDSLSALLNRRVSPPHHHSLSPSAALSGGAASIQLRRATCGELDKSKRGELGHSIFYVDEPDSPSADG

SEQ ID NO: 168852 - protein, 245 aa, Heterodera glycines
  Homolog annotation: Hit_ID=NP_491131.1; Match level="QueryCoverage =98%, HitCoverage=60%, E-value=5e-77, Identity=54%"; Hit description =predicted CDS, tyrosinase family member (1D831) [Caenorhabditis elegans] gb|AAK21515.1| Hypothetical prot
  Gene Ontology: Mol. function=structural molecule activity; Cellular component=integral to membrane
  Coding regions on vcDNA: vcDNA=SeqID_95275; Strand=+; Position=41-775
MRRFKSSGLYRRFGMIHRRSGVHSGPAFLVWHREFLKRLELVFRALHPENSEPILGLPYWDSTLDHDLPSPEDSVMFSEYLLGEPDEAGFVTNGLFANWTTMDGRHSFQRMFGDQDDGEFINDARIDWVMTQDIVESVMAFTLPTQNCINYEVDDRFLEYSHDYVHYFISGDMQERFSSSNDPIFFMHHGFIDSIWEHWRQNKQSRLQRETDFPRNDAACAPRWHFSEEFMPMLQPLWNIDVLSN

SEQ ID NO: 168853 - protein, 245 aa, Heterodera glycines
  Homolog annotation: Hit_ID=NP_490882.2; Match level="QueryCoverage =95%, HitCoverage=72%, E-value=1e-88, Identity=64%"; Hit description =ubiquitin conjugating enzyme (ubc-3) [Caenorhabditis elegans] gb|AAK73914.2| Ubiquitin conjugating enzyme
  Gene Ontology: Mol. function=ubiquitin-protein ligase activity; Cellular component=nucleus; Biological process=DNA replication initiation
  Coding regions on vcDNA: vcDNA=SeqID_95276; Strand=+; Position=110-847
MSSSSGHPQTSSASAIRALQMELRSLQSQPLEGFTVTCDDDNMFKWTVGIFGPPGTLYQGGYFKAHLKFPTNYPYSPPTMRFIHPVWHPNVYENGDICISILHPPVDDPHSGEMPSERWNPTQSVRTVLLSVISLLNEPNTSSPANVDASVMYRKYKDHGEPEYATIIRKQVEKSKEEAKKDGIKVPETIDEYVVKAKPRVQGNESNDVIELDEDYYDYEDDDTDEDAEYGGEEEQDSGQGDDES

SEQ ID NO: 168854 - protein, 152 aa, Heterodera glycines
  Coding regions on vcDNA: vcDNA=SeqID_95277; Strand=+; Position=1-456
VQLRFILLFCFFLHIFHVMCFSTKKKMTSFLAKTKTMFANSFDCFSASEIGAFEAEHCCACGTTHLWADKFWKVACSVDSEKLAFRGQATTAIGAAYWHPMFFTETRRSRSAVQAHLKCASCGKEVNKVYEGTDDAGGGSRSAFGHYTDTEK

SEQ ID NO: 168855 - protein, 237 aa, Heterodera glycines; identical to SEQ ID NO: 162433
  Homolog annotation: Hit_ID=NP_506715.1; Match level="QueryCoverage =100%, HitCoverage=68%, E-value=9e-70, Identity=54%"; Hit description= AHA1 activator of heat shock 90kDa protein ATPase homolog 1 (38.6 kD) (5P564) [Caenorhabditis elegans] e
  Gene Ontology: Mol. function=chaperone activator activity; Cellular component=cytoplasm; Biological process=protein folding
  Coding regions on vcDNA: vcDNA=SeqID_95278; Strand=+; Position=95-805

SEQ ID NO: 168856 - protein, 175 aa, Heterodera glycines
  Homolog annotation: Hit_ID=CAE75135.1; Match level="QueryCoverage =85%, HitCoverage=38%, E-value=3e-47, Identity=58%"; Hit description =Hypothetical protein CBG23064 [Caenorhabditis briggsae]
  Coding regions on vcDNA: vcDNA=SeqID_95279; Strand=+; Position=1-525
TSGSPGCRNSARGTLHPSKLNQKKSEKVLVSSVRMDRLSWYQTGESMEEILCQAGSVGIYDGDLKQTSFEQGTASLTYQRIIWADSTDPDCRLVLHHSMVHKIEKQHKTMFGRGGKIIVTVKPVTPGHAQGPIAASGTNSLRFVFRNGGEEEFYKRFLDALNKQMWQRTSSTSSS

SEQ ID NO: 168857 - protein, 134 aa, Heterodera glycines
  Homolog annotation: Hit_ID=CAE75135.1; Match level="QueryCoverage =91%, HitCoverage=30%, E-value=3e-36, Identity=58%"; Hit description =Hypothetical protein CBG23064 [Caenorhabditis briggsae]
  Coding regions on vcDNA: vcDNA=SeqID_95280; Strand=+; Position=139-540
ISLPSKLNQKKSEKVVVSSVRMDRLSWYQTGESMEEILCQAGSVGIYDGDLKQSSFEQGTASLTYQRIIWADSTDPDCRLVLHHSMVHKIEKQHKTMFGRGGKIIVTVKPVTPGHAQGPIAASGTNSLRFVFRN

SEQ ID NO: 168858 - protein, 128 aa, Heterodera glycines
  Coding regions on vcDNA: vcDNA=SeqID_95281; Strand=+; Position=16-399
IRRYSMCHRSQAATDYGISSCCCSYCSTCNCCSITAVPLPTTAQPVVAAVTVTVSSHHRVLPYHRPSMIRMLLLALLMVYCCYCHTVQCSPSTVWNTVSGAEDNIDTVVAAANNGGGATFLVPQQQLL

SEQ ID NO: 168859 - protein, 231 aa, Heterodera glycines
  Homolog annotation: Hit_ID=XP_311206.1; Match level="QueryCoverage =95%, HitCoverage=61%, E-value=2e-53, Identity=49%"; Hit description =ENSANGP00000019078 [Anopheles gambiae] gb|EAA06830.2| ENSANGP00000019078 [Anopheles gambiae str. PEST]
  Coding regions on vcDNA: vcDNA=SeqID_95282; Strand=+; Position=126-818
MHGRQQQLRMRKEIYRYTCEEPLYAAAWSNKLYPDKRFRLVVGTLLLDEEGISSNKMYIIELDENVGELVKRFGILHGYPCTATQFIPNTDVSQPELFATTSNCLRIFRYHPSSASISQECELSATKSSAYSSPLTNLDWNEVDPSLVATCSIDTTCTVWNIETNQPIGQAPSIKGLQKTQLIAHEKPVHDIAFTRLDNGRDQFATAGADGSIRLFDLRALQHSTILYEDA

SEQ ID NO: 168860 - protein, 357 aa, Heterodera glycines
  Homolog annotation: Hit_ID=NP_508475.1; Match level="QueryCoverage =96%, HitCoverage=46%, E-value=2e-60, Identity=39%"; Hit description =putative protein, with 2 coiled coil-4 domains, of fungal and metazoan origin (XD302) [Caenorhabditis ele
  Gene Ontology: Cellular component=mitochondrial inner membrane
  Coding regions on vcDNA: vcDNA=SeqID_95283; Strand=+; Position=3-1076
DKGHRKAELANAQRIAELEQQLVTQKGMEKQKIAQAVEEQRKLDESLSKMALEIERRRNREMTTGATQTDHLVGSTRNESDEAELDAQLKRAALAHAEHLERVIRTQKQIHDMETQQIVQETIAIERDKFGKQIENGLVKLAAIEEMLKSRATKDLENRRAKIYWTICHSLTDALANGGTAQSQKTTYYKTQLLEQIAVLKKLVQNDAFAQSVCAHFPSDDAIGRGVPTEQGLVKRFDGVYKLARCTAQIGDEGGTLWRYITSWLQSLFTFELPYAYSADDRLDLNRYDPYELLARCRHFVQQRDLLNAVRVDNLIRGKSARIFSDWLKDAKFHLEVRLLVELLLAHSQASGIRTTY

SEQ ID NO: 168861 - protein, 149 aa, Heterodera glycines
  Coding regions on vcDNA: vcDNA=SeqID_95284; Strand=+; Position=15-461
MAFQQHLVNKFSPLLISVFSPLRNCANFAATTQKAAHSPLPFSLKTMDEFDEDAAMAQRPMPKWKKAGLRIERNCAENQIFLSIVQEIVDKFGWDNSAHDYDMWKKAFGPNFSMFFVLDQNRVPMGCISMSLYPQVAHWSMFYVKDPYH

SEQ ID NO: 168862 - protein, 203 aa, Heterodera glycines
  misc_feature (112)..(112): Xaa can be any naturally occurring amino acid
  Homolog annotation: Hit_ID=CAE64949.1; Match level="QueryCoverage =99%, HitCoverage=99%, E-value=2e-69, Identity=62%"; Hit description =Hypothetical protein CBG09780 [Caenorhabditis briggsae]
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_95285; Strand=+; Position=33-645
MGFSTKPIIIDGKDHLLGRLAAVTSKQLLLGQKIVIVRCESINISGNFHRSKLKFLAFLRKRCNVKPSRGPFHYRAPSRIFWRTVRGMLPHKTARGMEALKKLKCFDGCPAXYDTKKKFVLPNSLRHIALKPRRKYCTVGRLAHEVGWQYQGVVEKLETKRKVRGAAFHEKKKAVLKLKRKAVENAKPKTALFDKILEQYGHA

SEQ ID NO: 168863 - protein, 192 aa, Heterodera glycines
  Homolog annotation: Hit_ID=NP_611208.1; Match level="QueryCoverage =90%, HitCoverage=59%, E-value=2e-55, Identity=59%"; Hit description =CG4802-PA [Drosophila melanogaster] gb|AAF57869.1| CG4802-PA [Drosophila melanogaster] gb|AAO49165.1| GM0
  Gene Ontology: Mol. function=5'-methylthioadenosine phosphorylase activity; Cellular component=cytoplasm; Biological process =phosphorylation
  Coding regions on vcDNA: vcDNA=SeqID_95286; Strand=+; Position=71-646
MATQNGAAMATDLLQRKAFKIGIIGGTGLEDPHIMERSGEVRVETPYGRPSDALIEGNVAGVPCVLLSRHGRRHQQSPTNINYRANIWALKKAGVNVIVAACACGSLREELEPGKLVLIDSFIDRTTKREQTFYDGLPGHPPGICHMPMHPALNERLRRALLATATRLGAAHSDRGVLVCVEGPRFSTRAES

SEQ ID NO: 168864 - protein, 158 aa, Heterodera glycines
  Coding regions on vcDNA: vcDNA=SeqID_95287; Strand=+; Position=3-476
NPSVNKIHFSKDELDKILRDADEQRDFPALLRSLGQLAFRPTDGFSLPSSALSQMASHFASLSPFSAFHWANGLFALLPSAENHANSEVLIVSLLRSLVDNVPLLNANKLRAFVKTEISRQCVSFWQIGKAHLASALTLCVLRILLMELSYLEAIQNG

SEQ ID NO: 168865 - protein, 270 aa, Heterodera glycines
  misc_feature (178)..(178): Xaa can be any naturally occurring amino acid
  misc_feature (193)..(193): Xaa can be any naturally occurring amino acid
  Homolog annotation: Hit_ID=NP_497276.2; Match level="QueryCoverage =98%, HitCoverage=85%, E-value=6e-51, Identity=47%"; Hit description =RNA-binding protein S1 serine-rich domain like (rnp-4) [Caenorhabditis elegans] gb|AAK21429.2| Rnp (rrm r
  Gene Ontology: Mol. function=RNA binding; Cellular component=nucleus; Biological process=RNA splicing
  Coding regions on vcDNA: vcDNA=SeqID_95288; Strand=+; Position=30-838
MVERRKESPKRRRRSSSSSSSGSSSSTGSSSSGSSSSSSTTASRSPSPKKQRAAARPSARDDRTTRRSPRRSRSPHRVQPKTEKSTVSSRRSPSPRRRRPSPPSRGPRRRSRSPRHERAAPSPPPVKRERTPEPPPRRLCVRNLSRNITKAHMEEIFALFGALKSCELPMDRVHVHLXRGYGYVEYEKAEDAXEKALKHMDGGQIDGLEIQCEMTFPFKGTGGGRGHSPVGINSMGIGIKRERSRSPARRFAARLSPPRRGRRSRSPTPM

SEQ ID NO: 168866 - protein, 120 aa, Heterodera glycines; identical to SEQ ID NO: 163519
  Coding regions on vcDNA: vcDNA=SeqID_95289; Strand=-; Position=127-489

SEQ ID NO: 168867 - protein, 119 aa, Heterodera glycines
  Homolog annotation: Hit_ID=CAE62352.1; Match level="QueryCoverage =78%, HitCoverage=38%, E-value=2e-12, Identity=39%"; Hit description =Hypothetical protein CBG06429 [Caenorhabditis briggsae]
  Coding regions on vcDNA: vcDNA=SeqID_95290; Strand=+; Position=38-397
MQHARCPYVKENAPLPTNIKEALPKDVSVKIQQIHDDGSLSAEQKMERIDSIICTLPENVIDQIPDPPEVAQLPADVRQRVKQIERQQGKSFSTKFEEIMKYVDTLPEGTKSAAKNIFH

SEQ ID NO: 168868 - protein, 160 aa, Heterodera glycines; identical to SEQ ID NO: 163285
  Coding regions on vcDNA: vcDNA=SeqID_95291; Strand=+; Position=56-538

SEQ ID NO: 168869 - protein, 208 aa, Heterodera glycines
  Coding regions on vcDNA: vcDNA=SeqID_95292; Strand=+; Position=13-636
MPNIRQQKKHEMVDSDDERNEYGSTKAEPSPLTDQSATSMMTHNSSNAAEGGHIISSNGGAQICGGNGTVPMPLISCWSPCSASSAGDPLLWYETDKCQYCNQKCRKPRRLLDCLHYVCEECVPEQCLLLDNLEPDEIRCPNCSQVEMSSISGQSTESSRVEICIKHKENFTRVCLSCARLLCVNCEQQLSLPTAQVNNITNVVAVPQ

SEQ ID NO: 168870 - protein, 48 aa, Heterodera glycines
  Homolog annotation: Hit_ID=AAN62918.1; Match level="QueryCoverage =95%, HitCoverage=24%, E-value=1e-09, Identity=65%"; Hit description =transaldolase [Ctenopharyngodon idella]
  Coding regions on vcDNA: vcDNA=SeqID_95293; Strand=+; Position=1-147
HEEQIEVDEKIFRWQMNEDAMADEKLADGIRRFAVDAIKLEELIRSNL

SEQ ID NO: 168871 - protein, 162 aa, Heterodera glycines
  misc_feature (62)..(62): Xaa can be any naturally occurring amino acid
  Homolog annotation: Hit_ID=NP_625403.1; Match level="QueryCoverage =97%, HitCoverage=58%, E-value=9e-35, Identity=48%"; Hit description =putative secreted lyase [Streptomyces coelicolor A3(2)] emb|CAC13062.1| putative secreted lyase [Streptom
  Coding regions on vcDNA: vcDNA=SeqID_95294; Strand=+; Position=27-513
MSFLLFVTIAFANLAPNAFGQQWPKATSDETVPATIVVTGGSRDFGYKRLTASSALGTGDQXEGQKALIRAEKGAVIKNLIIGQNGADGIHCYDGCTLQNVWWEKVGEDAATFRSSSGCKEYNFLVTGGGVKNAKDKVFQMNGGGTLTIKDFVAENIGKLAR

SEQ ID NO: 168872 - protein, 173 aa, Heterodera glycines
  Homolog annotation: Hit_ID=NP_625403.1; Match level="QueryCoverage =97%, HitCoverage=62%, E-value=3e-42, Identity=52%"; Hit description =putative secreted lyase [Streptomyces coelicolor A3(2)] emb|CAC13062.1| putative secreted lyase [Streptom
  Coding regions on vcDNA: vcDNA=SeqID_95295; Strand=+; Position=33-551
MHSFLVLTILFANLASNAFGQQWPKATSEETVKATIKVSGGVKDFGFKRLTASSALGSGDQSEGQKALIRAEKGAVIKNLIIGQNGADGIHCYDGCTLQNVWWEKVGEDAATFRSSSGCKEYSFTVTGGGVKNAKDKVFQMNGGGTLTIKDFVAESIGKLARSCGNCKTQCQK

SEQ ID NO: 168873 - protein, 253 aa, Heterodera glycines
  Homolog annotation: Hit_ID=NP_827559.1; Match level="QueryCoverage =88%, HitCoverage=78%, E-value=1e-54, Identity=50%"; Hit description =putative secreted lyase [Streptomyces avermitilis MA-4680] dbj|BAC74094.1| putative secreted lyase [Strep
  Coding regions on vcDNA: vcDNA=SeqID_95296; Strand=+; Position=31-792
MSFLLFVTIAFANLAPNAFGQQWPKATSDETVSATIKVSGGTKDFGYKRLTASSALGTGDQSEGQKALIRAEKGAVIKNLIIGQNGADGIHCYDGCTLQNVWWEKVGEDAATFRSSSGCKEYNFLVTGGGVKNAADKVFQMNGGGTLTVKDFVAENIGKLVRSCGNCKSQCQKRKFVVENVKVTGLKTLLCGLNEIYGDVATIKNVQVSGPSKKVCAEFEGNDKQKEPPMLRSFDVGSSGDGKNCIISSTTSG

SEQ ID NO: 168874 - protein, 74 aa, Heterodera glycines; identical to SEQ ID NO: 162378
  Coding regions on vcDNA: vcDNA=SeqID_95297; Strand=-; Position=1-222

SEQ ID NO: 168875 - protein, 159 aa, Heterodera glycines
  Homolog annotation: Hit_ID=CAE72193.1; Match level="QueryCoverage =97%, HitCoverage=86%, E-value=3e-25, Identity=33%"; Hit description =Hypothetical protein CBG19301 [Caenorhabditis briggsae]
  Coding regions on vcDNA: vcDNA=SeqID_95298; Strand=+; Position=10-486
MAKSTEEERIANVHFDLEVVNSDFIRPMRMNFRRRGRDLYWDMALGHDSVAALIFHTERKQLLFVKQFRPPVFVNVVRSLPENKNKSLAEVRWENYPIENGCTVELCAGLMDEPGKTPLEHMKKEILEECGYRVDESNIRPIRRYVTGISLSGAIQHLF

SEQ ID NO: 168876 - protein, 144 aa, Heterodera glycines
  Homolog annotation: Hit_ID=NP_510091.1; Match level="QueryCoverage =64%, HitCoverage=23%, E-value=1e-26, Identity=63%"; Hit description =zinc transporter ZnT-8 family member (XN84) [Caenorhabditis elegans] emb|CAA92193.1| Hypothetical protein
  Gene Ontology: Mol. function=zinc porter activity; Cellular component= synaptic vesicle; Biological process=transport
  Coding regions on vcDNA: vcDNA=SeqID_95299; Strand=+; Position=45-476
MASGERQKLVNNSTAERPIPSQHFSVHSNGYGAIAADATRPSVSGSSNSSSDGFHCHADGDRRPTDAQNGASDQRRARTVLWMSVGVCFVFMICEVIGGVLANSLAIITDAAHLLTDLASMLISLFSLYIASRPASQRMSFGWH

SEQ ID NO: 168877 - protein, 154 aa, Heterodera glycines
  misc_feature (122)..(122): Xaa can be any naturally occurring amino acid
  Coding regions on vcDNA: vcDNA=SeqID_95300; Strand=+; Position=2-463
KTKISFAIMANPSKNIAMLREARSSPYIGGGGSVGTLPPDALPASGPMHTRLQRNRRPDSATAPNTARLQNAASAEHFEQLKELIQFSAGSSSSTSLIAAGRHFGTEQSIENYGRLKAESVXQFVGGQRHLSDQQHRSVHFGKSRINHFNDSHR

SEQ ID NO: 168878 - protein, 132 aa, Heterodera glycines
  Homolog annotation: Hit_ID=NP_492143.1; Match level="QueryCoverage =88%, HitCoverage=24%, E-value=5e-33, Identity=60%"; Hit description =quaking, defective in Germ Line Development GLD-1 (50.6 kD) (gld-1) [Caenorhabditis elegans] emb|CAB03417
  Gene Ontology: Mol. function=RNA binding; Cellular component=nucleus; Biological process=embryogenesis and morphogenesis
  Coding regions on vcDNA: vcDNA=SeqID_95301; Strand=+; Position=24-419
AVGTPRLPCKIMVRGRGSLRDAAKEEMNRGKPNWEHLEDDLHILIQCEDNEKRARSKLDKAVDKVKKLLVPSRDGIDELKRKQLMELSIINGTYRANIGPKNSPTVPRLTPLSMLSPVHSPLSPPHRVHSTV

SEQ ID NO: 168879 - protein, 156 aa, Heterodera glycines
  misc_feature (154)..(154): Xaa can be any naturally occurring amino acid
  Homolog annotation: Hit_ID=CAE66106.1; Match level="QueryCoverage =89%, HitCoverage=89%, E-value=3e-10, Identity=30%"; Hit description =Hypothetical protein CBG11326 [Caenorhabditis briggsae]
  Coding regions on vcDNA: vcDNA=SeqID_95302; Strand=+; Position=12-479
MQQIPILSLSNFLPIFSLISVPFLLSFPSTAFGCSCAPTKFNESMCVAKWVSHVKVLQNTTTTNSHRIFTVRHLEVFKSPNGTAHNDQLIGKESAVWTPIFTAACGVRELDTEKEYLLAGTVDNLGTMQINLCLFIPIEDGQPNAENGIVEWAXVP

SEQ ID NO: 168880 - protein, 275 aa, Heterodera glycines
  Homolog annotation: Hit_ID=NP_502314.1; Match level="QueryCoverage =99%, HitCoverage=43%, E-value=5e-61, Identity=44%"; Hit description =quiescin Q6 precursor family member (69.5 kD) (4M971) [Caenorhabditis elegans] emb|CAA93467.1| Hypothetic
  Coding regions on vcDNA: vcDNA=SeqID_95303; Strand=+; Position=1-828
LKAIHTALLDEVISSGGDEINGDRFAALRKFVELLIQRFPKKTFERNPQLSAHPKGTALSSIGKPLLRSQRAFKVFEQMKRFLDAKAGDGKVSMDEWRAEFDQAKKQNGDPFPVTAEWEHCKGTRTIFRGFTCGLWTAFHAMTVQAYLGQEQQPLKPLKAIQGWVANFFSCSGCRRHFMAMTTEKFPMEAKNVNKPEDVVLYLWKAHNIVNKRLHGDEATEDPQFIKEQFPPQYLCPGCHKTPSSASDGNDPTELDPEKTLRFLLQYSTNIKPRP

SEQ ID NO: 168881 - protein, 133 aa, Heterodera glycines
  Coding regions on vcDNA: vcDNA=SeqID_95304; Strand=+; Position=37-435
RIMHERVQQDFRSSKFSTRANQNGQHGNRSREVRFDNTNGRAYTRRNGSYSSEPSSGRRSSFSRHQDGARTYVPSTAVQRPISPNGCDSGGMFLMVDPFNIPNTLGAQIQVFDLQENIRHIIGYCIPLRCCVG

SEQ ID NO: 168882 - protein, 155 aa, Heterodera glycines
  Homolog annotation: Hit_ID=CAE73726.1; Match level="QueryCoverage =96%, HitCoverage=80%, E-value=2e-22, Identity=43%"; Hit description =Hypothetical protein CBG21248 [Caenorhabditis briggsae]
  Coding regions on vcDNA: vcDNA=SeqID_95305; Strand=+; Position=4-468
MNSFIFRRLPSLRFPTASMNFRKMFSTAASSSQQFNVEKPVINKSDIMEPEDYDLTDRRKWVIENISNSIGDLTKMIFAVIYIQGKQHKVTQDDIIHVEHNIPLDVGEEIALEKVLMIGNDEFTLIGRPLLDPKFVHVRATVIEKTTTSPEVQYD

SEQ ID NO: 168883 - protein, 135 aa, Heterodera glycines; identical to SEQ ID NO: 163767
  Homolog annotation: Hit_ID=AAF68270.1; Match level="QueryCoverage =85%, HitCoverage=80%, E-value=5e-18, Identity=38%"; Hit description =ornithine decarboxylase antizyme [Onchocerca volvulus] sp|Q9NHZ5|OAZ_ ONCVO Ornithine decarboxylase antizym
  Coding regions on vcDNA: vcDNA=SeqID_95306; Strand=+; Position=82-489

SEQ ID NO: 168884 - protein, 73 aa, Heterodera glycines; identical to SEQ ID NO: 162438
  Coding regions on vcDNA: vcDNA=SeqID_95307; Strand=+; Position=16-237

SEQ ID NO: 168885 - protein, 102 aa, Heterodera glycines; identical to SEQ ID NO: 162191
  Homolog annotation: Hit_ID=NP_492370.1; Match level="QueryCoverage =100%, HitCoverage=96%, E-value=6e-21, Identity=45%"; Hit description= transport to INner mitochondrial membrane (yeast TIM) TIN-13, TIMeless related (11.7 kD) (tin-13) [Caeno
  Coding regions on vcDNA: vcDNA=SeqID_95308; Strand=+; Position=39-347

SEQ ID NO: 168886 - protein, 385 aa, Heterodera glycines
  Homolog annotation: Hit_ID=NP_502680.1; Match level="QueryCoverage =87%, HitCoverage=36%, E-value=2e-36, Identity=30%"; Hit description =putative protein, with a coiled coil-4 domain, of bilaterial origin (86.8 kD) (4O727) [Caenorhabditis ele
  Coding regions on vcDNA: vcDNA=SeqID_95309; Strand=+; Position=638 -1792
LSRVSLVAIRAAMSAIEGETCGVLGRLQFEVHAIVGFARLCAGDVFEVSVRHGHQRWRSRGKTLADKSQRWEQRMSTMDVLWNEPVVVKVLEVKFLKSRCLNERQFDPAKFALAQPQLVTMNLNSAGSIKLRLVVTWLPLLATKTIGENSLNNCQKGNLTEREKQRTDHRTNGSKQNARLTQNEQKKRDEEERGREMQQQNTETKEEDQCQNESADGAAVKVCLRDKKRQREQRIQLGNSVSTGSNFGIGKEKWRCSSTTLLDDVYKDLAKSIPTIDDLTVLHPSHFASLPSSSPRHRSFDSESDRAKTEAKNPRRIFSFIKRGQSEASADQQKKDWRKSASLGEIALAKDECFTTTNAEKASPVSTEKNGNGAKRGKPSSVKKG

SEQ ID NO: 168887 - protein, 187 aa, Heterodera glycines; identical to SEQ ID NO: 163511
  Coding regions on vcDNA: vcDNA=SeqID_95310; Strand=+; Position=3-566

SEQ ID NO: 168888 - protein, 160 aa, Heterodera glycines
  Homolog annotation: Hit_ID=CAE58324.1; Match level="QueryCoverage =98%, HitCoverage=43%, E-value=8e-22, Identity=38%"; Hit description =Hypothetical protein CBG01437 [Caenorhabditis briggsae]
  Gene Ontology: Mol. function=oligosaccharyl transferase activity; Biological process=protein amino acid glycosylation
  Coding regions on vcDNA: vcDNA=SeqID_95311; Strand=+; Position=5-484
GLAKMVSAIAQYFLAFLLSASVIAFFSFLLLTALSIFKPWTKRNKSHFVAPRFHFRPEEEEEANAQFPCLLTREETSWKGLQHSEPELYLSVIVPAKNEEKRLPRMLDECLKYLEKRAAKDSEFTYEVIVVDDGSTDGTADVAFSYARSHPLFILRLPKN

SEQ ID NO: 168889 - protein, 187 aa, Heterodera glycines
  Homolog annotation: Hit_ID=CAG10886.1; Match level="QueryCoverage =93%, HitCoverage=45%, E-value=8e-21, Identity=30%"; Hit description =unnamed protein product [Tetraodon nigroviridis]
  Gene Ontology: Mol. function=protein binding; Biological process=DNA repair
  Coding regions on vcDNA: vcDNA=SeqID_95312; Strand=+; Position=91-651
MPISSNSATAGTSAMSFDYAENRFLLCGNARGNVSVVDFESFSNSLSNAEVYPRHYVVINTNRKSHHEFMVNGCQWYPVDSSIFATSGRDKLLKIWDADQLKSVEKFAFEQPISSFHWFVPCDCNSSLIPIATSSSNVVLLDPRLGNTAQQIRCLQQRIWSVRWDRFRDYVLVTGSDSGEIALWDIR

SEQ ID NO: 168890 - protein, 104 aa, Heterodera glycines; identical to SEQ ID NO: 163361
  Coding regions on vcDNA: vcDNA=SeqID_95313; Strand=+; Position=1-315

SEQ ID NO: 168891 - protein, 60 aa, Heterodera glycines; identical to SEQ ID NO: 153246
  Homolog annotation: Hit_ID=NP_508656.1; Match level="QueryCoverage =85%, HitCoverage=86%, E-value=3e-11, Identity=49%"; Hit description =putative endoplasmic reticulum protein, with a transmembrane domain (XE407) [Caenorhabditis elegans] gb|A
  Coding regions on vcDNA: vcDNA=SeqID_95314; Strand=+; Position=37-219

SEQ ID NO: 168892 - protein, 80 aa, Heterodera glycines
  Coding regions on vcDNA: vcDNA=SeqID_95315; Strand=+; Position=2-241
PAPPSDSIVNANGPQLNNQQTDTGLVNIVPLAWQPPKFTNGGIQGQSESNPMLFGGGFSFTTTVPPAANGPFQFGAAPPV

SEQ ID NO: 168893 - protein, 209 aa, Heterodera glycines
  misc_feature (50)..(50): Xaa can be any naturally occurring amino acid
  Homolog annotation: Hit_ID=NP_504167.1; Match level="QueryCoverage =88%, HitCoverage=67%, E-value=4e-25, Identity=36%"; Hit description =putative nuclear protein, with a coiled coil-4 domain, of eukaryotic origin (5E683) [Caenorhabditis elega
  Coding regions on vcDNA: vcDNA=SeqID_95316; Strand=+; Position=28-658
MGLPIIQIYMIVARQLSKPITGYFMGLGKEHPAFRNRVLIPIGKTITNWXTKLRMKNLDLGSPTSVVNVSEETALEQASEVIHQVAIFGYTVVVFYAYSYFTHKEEKELASAEELRELSKKTSQEIMRLNVLVTELQDEMRMPRRDRNWTFPWSGESKSALRESAVVNPMLPSVVMTDSQPKEQKKDMTKSISRTEALNRLTNATETSS

SEQ ID NO: 168894 - protein, 232 aa, Heterodera glycines; identical to SEQ ID NO: 163507
  Homolog annotation: Hit_ID=NP_505777.1; Match level="QueryCoverage =82%, HitCoverage=89%, E-value=6e-42, Identity=45%"; Hit description =putative protein, with a transmembrane domain (24.9 kD) (5L375) [Caenorhabditis elegans] emb|CAA98457.1|
  Coding regions on vcDNA: vcDNA=SeqID_95317; Strand=+; Position=49-744
